United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 8

SEQ ID NO: 23056 - DNA, 899 bp, Artificial Sequence
  chemically treated genomic DNA (Homo sapiens) CpG-island No: 23056
aaacgccacgccgaaacctatcgcaaacccgaaaaaaaaaaccccgaaaactaaacgcgcgaaatacaaaaaaccgtaaacgcgaccttccataaaacgacaatacgcgaacaaaaaaacaaaataaaacgataaaaaaaatcgaaacccgaacgacaacgacgaaaaaaaaacgacgacgacgaacacgcgccccgccaaaacttcctcctccgaccaacgacgaaaaaaaaaacgcgacgacgaccaattctctccgccgcttacacgcgaccccaccgcccgaacctaacgcgacgaaaaacgccaaccgaataccgccaacaataaaaaacgaaacaacgccgacgaaaaaaaaaccgacgacaactacacaacgacccgcgtccgcgctccgaaccccgcgacgactcgccgcgcccgcgacccgtaaaacgacgcgataaaacgaaaaacgaaaaaacgccacgccaaaaatcgacgacgcgacccaaaaacgacaaaaacgcacactctacaatcgcttcgactcgcgaccgcaacgaaccccgaatcaacttcccgaccgcaacgccgcccgcgtcgacgacgaaaacctaaactctcacgtacctaattaaactcttcgccgacatccgcgtaaatatctatataatccacgccgtccgccatcttccttcaacctcgaccgccgccgccgccgccgcctcctacaaatctacccgccgcgacaacaacaacgaatctaacgacgataaaaaaacgcttacgtcacttccgaaacccgaaaaaaaaaaacgcgaacgacaaaaaccgaccgaaaacgaaaactctacaacccaaccgctctactaactaaaaaaaaactacgcctctaaaaacaaaaaacgtttctttta

SEQ ID NO: 23057 - DNA, 578 bp, Artificial Sequence
  chemically treated genomic DNA (Homo sapiens) CpG-island No: 23057
  misc_feature (570)..(570): n is either a, c, g or t
ttttcgatttatttcgtttatcgtttattttttttttcgttttgttcgtcgagtttcggttcggcgggcgttttcgttcgcgtttcggtcgcgtttttttttttttcgcgtcggtttttcgcgtattatcgttttcggtcggttcgacgcgtttttttagacgttcgatcggcgtcgtgtcggtcgtttttcgacgtttattttttttgcgtttatttttatttttttttttttattttttttcggtttttttttttcgttcgggtcgtcgttcgtttttttttttcgtttttattgtttgtcggatcgttttttcgcgttacgttattatatttttttgtcggtcgttcgggtcgagcggcgcgtaatgacgtcgtcgtttttcgtttgatgcgttttagttttatcgtatatttttagtggaattcggatttttcgtgtttcggcgatcggtttgcgcgttttggttatcgtatgtttagtgacgcgcgaggttatatagatagtatttcggtaatatcgtaaaattttaaaatatttaaaattttatttattttttttcgataatanaattttaa

SEQ ID NO: 23058 - DNA, 578 bp, Artificial Sequence
  chemically treated genomic DNA (Homo sapiens) CpG-island No: 23058
  misc_feature (9)..(9): n is either a, c, g or t
ttaaaattntattatcgaaaaaaaataaataaaattttaaatattttaaaattttacgatattaccgaaatactatctatataacctcgcgcgtcactaaacatacgataaccaaaacgcgcaaaccgatcgccgaaacacgaaaaatccgaattccactaaaaatatacgataaaactaaaacgcatcaaacgaaaaacgacgacgtcattacgcgccgctcgacccgaacgaccgacaaaaaaatataataacgtaacgcgaaaaaacgatccgacaaacaataaaaacgaaaaaaaaaaacgaacgacgacccgaacgaaaaaaaaaaaccgaaaaaaaataaaaaaaaaaaaataaaaataaacgcaaaaaaaataaacgtcgaaaaacgaccgacacgacgccgatcgaacgtctaaaaaaacgcgtcgaaccgaccgaaaacgataatacgcgaaaaaccgacgcgaaaaaaaaaaaaacgcgaccgaaacgcgaacgaaaacgcccgccgaaccgaaactcgacgaacaaaacgaaaaaaaaaataaacgataaacgaaataaatcgaaaa

SEQ ID NO: 23059 - DNA, 578 bp, Artificial Sequence
  chemically treated genomic DNA (Homo sapiens) CpG-island No: 23059
  misc_feature (9)..(9): n is either a, c, g or t
ttggggttntgttgtcggggaggggtgaatggggttttgagtattttggagttttacgatgttgtcgaagtgttatttatgtggtttcgcgcgttattgagtatgcggtgattaaaacgcgtaggtcggtcgtcggggtacgagaggttcgaattttattagagatgtgcgatgggattggggcgtattaggcggggggcggcgacgttattgcgcgtcgttcggttcgggcggtcgatagaaaggtgtggtggcgtggcgcgggggaacgattcgataagtagtgggggcgaggggggggggcgggcggcgattcgggcggggggggggggtcggggaggggtggggggagggaggtagagatgggcgtagggggggtaggcgtcggggggcggtcggtacggcgtcggtcgggcgtttaagagagcgcgtcgggtcgatcgggggcggtggtgcgcggggggtcggcgcggggggggggagaacgcgatcggggcgcgggcgggagcgttcgtcgggtcggggttcggcgggtagggcgagaagaaaggtgggcggtgggcggggtgggtcgggaa

SEQ ID NO: 23060 - DNA, 578 bp, Artificial Sequence
  chemically treated genomic DNA (Homo sapiens) CpG-island No: 23060
  misc_feature (570)..(570): n is either a, c, g or t
ttcccgacccaccccgcccaccgcccacctttcttctcgccctacccgccgaaccccgacccgacgaacgctcccgcccgcgccccgatcgcgttctccccccccccgcgccgaccccccgcgcaccaccgcccccgatcgacccgacgcgctctcttaaacgcccgaccgacgccgtaccgaccgccccccgacgcctaccccccctacgcccatctctacctccctccccccacccctccccgaccccccccccccgcccgaatcgccgcccgcccccccccctcgcccccactacttatcgaatcgttcccccgcgccacgccaccacacctttctatcgaccgcccgaaccgaacgacgcgcaataacgtcgccgccccccgcctaatacgccccaatcccatcgcacatctctaataaaattcgaacctctcgtaccccgacgaccgacctacgcgttttaatcaccgcatactcaataacgcgcgaaaccacataaataacacttcgacaacatcgtaaaactccaaaatactcaaaaccccattcacccctccccgacaacanaaccccaa

SEQ ID NO: 23061 - DNA, 515 bp, Artificial Sequence
  chemically treated genomic DNA (Homo sapiens) CpG-island No: 23061
taggtcgtgggttttcgtcgcgttggttttaaggagcggtttttgagtgtagcgcgagttttgggttttttgcgttggttgcggcggcggttgcggttgcggcggcggtcgttagagggcgaggggtagggtatcgggttacgggcgagcgaggggtggggtcgtcggaaatcggacgaggggcggggttatgggagaggaagtaaggggcggggtcgcgggaaagcggatgaagggcggggttacgagcgaggggacgagggtcggggtcgcgggaaagcggacgaagggcggggttacgagcgagggtacgaggggcggggttgcgggaaagcggacgaggggcggggttacgagagaggtgacgagggtcgggattattagagagggtacgaggggtggggtcgtgagttcgggttgcggtatcgtttagcgttgcgtttggttggtttagtagggttggggggtatgtcgagggttttttttggtggtcgtttttcgtaggtttcgataag

SEQ ID NO: 23062 - DNA, 515 bp, Artificial Sequence
  chemically treated genomic DNA (Homo sapiens) CpG-island No: 23062
cttatcgaaacctacgaaaaacgaccaccaaaaaaaaccctcgacataccccccaaccctactaaaccaaccaaacgcaacgctaaacgataccgcaacccgaactcacgaccccacccctcgtaccctctctaataatcccgaccctcgtcacctctctcgtaaccccgcccctcgtccgctttcccgcaaccccgcccctcgtaccctcgctcgtaaccccgcccttcgtccgctttcccgcgaccccgaccctcgtcccctcgctcgtaaccccgcccttcatccgctttcccgcgaccccgccccttacttcctctcccataaccccgcccctcgtccgatttccgacgaccccacccctcgctcgcccgtaacccgataccctacccctcgccctctaacgaccgccgccgcaaccgcaaccgccgccgcaaccaacgcaaaaaacccaaaactcgcgctacactcaaaaaccgctccttaaaaccaacgcgacgaaaacccacgaccta

SEQ ID NO: 23063 - DNA, 515 bp, Artificial Sequence
  chemically treated genomic DNA (Homo sapiens) CpG-island No: 23063
tttgtcgggatttgcggggagcggttattaggggaagttttcggtatattttttagttttgttaagttagttaggcgtaacgttagacggtgtcgtagttcgggtttacggttttatttttcgtattttttttggtggtttcggttttcgttatttttttcgtgatttcgtttttcgttcgttttttcgtagtttcgtttttcgtattttcgttcgtggtttcgtttttcgttcgttttttcgcggtttcgattttcgttttttcgttcgtggtttcgttttttattcgttttttcgcggtttcgttttttgtttttttttttatgatttcgtttttcgttcggttttcggcggttttatttttcgttcgttcgtggttcggtattttgtttttcgttttttggcggtcgtcgtcgtagtcgtagtcgtcgtcgtagttagcgtaggaggtttagggttcgcgttatatttaggagtcgttttttgaggttagcgcggcgggggtttacggtttg

SEQ ID NO: 23064 - DNA, 515 bp, Artificial Sequence
  chemically treated genomic DNA (Homo sapiens) CpG-island No: 23064
caaaccgtaaacccccgccgcgctaacctcaaaaaacgactcctaaatataacgcgaaccctaaacctcctacgctaactacgacgacgactacgactacgacgacgaccgccaaaaaacgaaaaacaaaataccgaaccacgaacgaacgaaaaataaaaccgccgaaaaccgaacgaaaaacgaaatcataaaaaaaaaaacaaaaaacgaaaccgcgaaaaaacgaataaaaaacgaaaccacgaacgaaaaaacgaaaatcgaaaccgcgaaaaaacgaacgaaaaacgaaaccacgaacgaaaatacgaaaaacgaaactacgaaaaaacgaacgaaaaacgaaatcacgaaaaaaataacgaaaaccgaaaccaccaaaaaaaatacgaaaaataaaaccgtaaacccgaactacgacaccgtctaacgttacgcctaactaacttaacaaaactaaaaaatataccgaaaacttcccctaataaccgctccccgcaaatcccgacaaa

SEQ ID NO: 23065 - DNA, 582 bp, Artificial Sequence
  chemically treated genomic DNA (Homo sapiens) CpG-island No: 23065
tcgtcgttattgtcgtttcggatagcgaaggagttggtgtttaatatcggcgtggagacggtttcgaaggtgtagggttcgggcgagacgatcgtttggaagtgtttaaggtagacgcggaagaaagttcggtagtcgggttcgtaaggtcgtttattggttagtacgtcgcgttcgttgatgaatttttgtagttgtagttggaagacgtcggagtcggtcgcgcgttattgtatagggatcgagggaaggagggaggggatcggttagtttagttggtgttcggggttgaggtttagagcgcggtagaggggacggagagggcgcgggacgtgttatttgttgttaaagtgttattagtagtagtagcgtttagttagaggcgtttcgggacgttgtcgttattttttcgggcgtcgttttttttattcgcgggtttttaatttggttttgttcgcgacgtcgttttttcgcgcgttcggtagtcgggggggttttttaaaaagaggcgttttttttggggacgttgtttttttttggttttttcgttggtttcgttgtagttgtcgttgtaggtaattt

SEQ ID NO: 23066 - DNA, 582 bp, Artificial Sequence
  chemically treated genomic DNA (Homo sapiens) CpG-island No: 23066
aaattacctacaacgacaactacaacgaaaccaacgaaaaaaccaaaaaaaaacaacgtccccaaaaaaaacgcctctttttaaaaaacccccccgactaccgaacgcgcgaaaaaacgacgtcgcgaacaaaaccaaattaaaaacccgcgaataaaaaaaacgacgcccgaaaaaataacgacaacgtcccgaaacgcctctaactaaacgctactactactaataacactttaacaacaaataacacgtcccgcgccctctccgtcccctctaccgcgctctaaacctcaaccccgaacaccaactaaactaaccgatcccctccctccttccctcgatccctatacaataacgcgcgaccgactccgacgtcttccaactacaactacaaaaattcatcaacgaacgcgacgtactaaccaataaacgaccttacgaacccgactaccgaactttcttccgcgtctaccttaaacacttccaaacgatcgtctcgcccgaaccctacaccttcgaaaccgtctccacgccgatattaaacaccaactccttcgctatccgaaacgacaataacgacga

SEQ ID NO: 23067 - DNA, 582 bp, Artificial Sequence
  chemically treated genomic DNA (Homo sapiens) CpG-island No: 23067
gaattatttatagcggtagttgtagcgaagttagcgagaaggttaaaggggagtagcgtttttaagagaagcgtttttttttaagggattttttcggttgtcgaacgcgcgggaaagcggcgtcgcgaatagagttagattgagggttcgcgggtggagagagcgacgttcgaggggatggcggtagcgtttcggagcgtttttggttgggcgttattgttgttggtggtattttggtagtaggtaatacgtttcgcgtttttttcgttttttttgtcgcgttttgggttttagtttcgggtattagttgagttgatcggttttttttttttttttttcggtttttgtgtaatagcgcgcggtcggtttcggcgttttttagttgtagttgtaggagtttattaacgagcgcggcgtattggttagtgggcggttttgcgagttcggttgtcggattttttttcgcgtttgttttaagtatttttaggcggtcgtttcgttcggattttgtattttcgggatcgtttttacgtcggtattgggtattaattttttcgttgttcgggacgatagtagcggcgg

SEQ ID NO: 23068 - DNA, 582 bp, Artificial Sequence
  chemically treated genomic DNA (Homo sapiens) CpG-island No: 23068
ccgccgctactatcgtcccgaacaacgaaaaaattaatacccaataccgacgtaaaaacgatcccgaaaatacaaaatccgaacgaaacgaccgcctaaaaatacttaaaacaaacgcgaaaaaaaatccgacaaccgaactcgcaaaaccgcccactaaccaatacgccgcgctcgttaataaactcctacaactacaactaaaaaacgccgaaaccgaccgcgcgctattacacaaaaaccgaaaaaaaaaaaaaaaaaaccgatcaactcaactaatacccgaaactaaaacccaaaacgcgacaaaaaaaacgaaaaaaacgcgaaacgtattacctactaccaaaataccaccaacaacaataacgcccaaccaaaaacgctccgaaacgctaccgccatcccctcgaacgtcgctctctccacccgcgaaccctcaatctaactctattcgcgacgccgctttcccgcgcgttcgacaaccgaaaaaatcccttaaaaaaaaacgcttctcttaaaaacgctactcccctttaaccttctcgctaacttcgctacaactaccgctataaataattc

SEQ ID NO: 23069 - DNA, 578 bp, Artificial Sequence
  chemically treated genomic DNA (Homo sapiens) CpG-island No: 23069
gtttgttcggtgttttcgtagttttattcgtgttggtttagttttcgcgagttcgggattcggggttttcggggtggtagggggtttttatgtcgtttgcgaggtttcggttcgggtcgttttcggaatttgtattttaggggttttggttcgtcgtttttagtaggagtaaaataagagtacgcgtatttgtcggttcgttcgtttttttggtgtcggttaatcgcgcgttcggggcggggtcgggcgcgttggaattagagtcggagtcggattttagtcggagtttaagcgtagttcgtatttcgcgtagcggttgagtcgggagttagcgtagtttcggtttcgtagtttaagtttcgttttcgtcgtcgtcgtcgtcgtcgtcgtcgtcgttttcggggtatggtttgtttgatggtcgttttttcggtcggtatcgttatggtgagtgagcgtatttttcgttcgtcgggaacggttttatttttaaggagagtaggaaatatataaagattcgtaagttcgatttgatattttttttaggagcgcgttttttgggcgttgatttagggtat

SEQ ID NO: 23070 - DNA, 578 bp, Artificial Sequence
  chemically treated genomic DNA (Homo sapiens) CpG-island No: 23070
ataccctaaatcaacgcccaaaaaacgcgctcctaaaaaaaatatcaaatcgaacttacgaatctttatatatttcctactctccttaaaaataaaaccgttcccgacgaacgaaaaatacgctcactcaccataacgataccgaccgaaaaaacgaccatcaaacaaaccataccccgaaaacgacgacgacgacgacgacgacgacgacgaaaacgaaacttaaactacgaaaccgaaactacgctaactcccgactcaaccgctacgcgaaatacgaactacgcttaaactccgactaaaatccgactccgactctaattccaacgcgcccgaccccgccccgaacgcgcgattaaccgacaccaaaaaaacgaacgaaccgacaaatacgcgtactcttattttactcctactaaaaacgacgaaccaaaacccctaaaatacaaattccgaaaacgacccgaaccgaaacctcgcaaacgacataaaaaccccctaccaccccgaaaaccccgaatcccgaactcgcgaaaactaaaccaacacgaataaaactacgaaaacaccgaacaaac

SEQ ID NO: 23071 - DNA, 578 bp, Artificial Sequence
  chemically treated genomic DNA (Homo sapiens) CpG-island No: 23071
gtgttttgggttagcgtttagaggacgcgtttttgggaggggtgttaggtcgagtttgcgagtttttgtgtgttttttgttttttttgaaaataaaatcgttttcggcggacgaaggatgcgtttatttattatggcggtgtcgatcgagaaagcggttattagataggttatgtttcgggggcggcggcggcggcggcggcggcggcggcggggacgaggtttgagttgcggggtcgaggttgcgttggttttcggtttagtcgttgcgcggggtgcgggttgcgtttgggtttcggttgggattcggtttcggttttggttttagcgcgttcgatttcgtttcgagcgcgcgattggtcggtattaagggggcgggcgggtcggtaggtgcgcgtgtttttgttttgtttttgttgggggcggcggattaggatttttgaagtgtaggtttcgggagcggttcgagtcgaggtttcgtaggcggtatgggaattttttgttatttcggaaatttcgggtttcgaattcgcgggggttgggttagtacgggtgaggttgcggggatatcggatagat

SEQ ID NO: 23072 - DNA, 578 bp, Artificial Sequence
  chemically treated genomic DNA (Homo sapiens) CpG-island No: 23072
atctatccgatatccccgcaacctcacccgtactaacccaacccccgcgaattcgaaacccgaaatttccgaaataacaaaaaattcccataccgcctacgaaacctcgactcgaaccgctcccgaaacctacacttcaaaaatcctaatccgccgcccccaacaaaaacaaaacaaaaacacgcgcacctaccgacccgcccgcccccttaataccgaccaatcgcgcgctcgaaacgaaatcgaacgcgctaaaaccaaaaccgaaaccgaatcccaaccgaaacccaaacgcaacccgcaccccgcgcaacgactaaaccgaaaaccaacgcaacctcgaccccgcaactcaaacctcgtccccgccgccgccgccgccgccgccgccgccgcccccgaaacataacctatctaataaccgctttctcgatcgacaccgccataataaataaacgcatccttcgtccgccgaaaacgattttattttcaaaaaaaacaaaaaacacacaaaaactcgcaaactcgacctaacacccctcccaaaaacgcgtcctctaaacgctaacccaaaacac

SEQ ID NO: 23073 - DNA, 1022 bp, Artificial Sequence
  chemically treated genomic DNA (Homo sapiens) CpG-island No: 23073
  misc_feature (206)..(206): n is either a, c, g or t
  misc_feature (208)..(208): n is either a, c, g or t
  misc_feature (569)..(569): n is either a, c, g or t
tcgcgtcgggatattttatattttcgtcgtaatttcgtttaagtttcgcgggaaaatatttttcgtcgcggtacggcgtcgttcgaggtcgtaacgtttatttagcgtcgatcgaggtttcgcgtcgaatcgatacgtcgcgggcgcgattcgacgacgaattttaattttatacgtttcgtttttcgcgggcgggaggggcgaantnatattaatcgaaggcgttcgatcgcgggcggtttcgttttttttatatatgtcgtttatcgcgattatgttttttttcgttttatttcggggcgtttattttacgcggttagcgtcgatcgtattcgatattatatcgtttttaatttatagtttttattcgtatacgatatatatttttatattatcgtagttcgtttttatattatatatcggttttttatattttattattattttaacgtttacgtttacgatatttagttttttttatatttttttatagtgtttttttttgcggtatattttcgtacggtttatatagttttttcgttattattcgtttgtcgttttttcgtttntatcgcgtcgataattatattcgttaaatgtcggtatcgtcgattttttcgatttataatatcgacgttcgaacgaggattatatatagtataatacgacgaattcggtttggtcgtcgattcgtttttcgtcgcgtttaaatatgattaagagatcgttcgacgttttattttcgtacgattattatgtcgtcgtttacgagagtattgtgtttttatcgatttagtcgtgttcggggagcgtttcgcgtcgttttcgttattatcgttcgttgtttaagtatataaaatttaattttcgtattttttttaattttttagaattagtgtttcgggtattcgtatttttattcgattacgtaataatattatttatttatttttattatttatttttatttattcgtattttatatattttaattacgtttttatttttagaatcgatagtag

SEQ ID NO: 23074 - DNA, 1022 bp, Artificial Sequence
  chemically treated genomic DNA (Homo sapiens) CpG-island No: 23074
  misc_feature (454)..(454): n is either a, c, g or t
  misc_feature (815)..(815): n is either a, c, g or t
  misc_feature (817)..(817): n is either a, c, g or t
ctactatcgattctaaaaataaaaacgtaattaaaatatataaaatacgaataaataaaaataaataataaaaataaataaataatattattacgtaatcgaataaaaatacgaatacccgaaacactaattctaaaaaattaaaaaaaatacgaaaattaaattttatatacttaaacaacgaacgataataacgaaaacgacgcgaaacgctccccgaacacgactaaatcgataaaaacacaatactctcgtaaacgacgacataataatcgtacgaaaataaaacgtcgaacgatctcttaatcatatttaaacgcgacgaaaaacgaatcgacgaccaaaccgaattcgtcgtattatactatatataatcctcgttcgaacgtcgatattataaatcgaaaaaatcgacgataccgacatttaacgaatataattatcgacgcgatanaaacgaaaaaacgacaaacgaataataacgaaaaaactatataaaccgtacgaaaatataccgcaaaaaaaaacactataaaaaaatataaaaaaaactaaatatcgtaaacgtaaacgttaaaataataataaaatataaaaaaccgatatataatataaaaacgaactacgataatataaaaatatatatcgtatacgaataaaaactataaattaaaaacgatataatatcgaatacgatcgacgctaaccgcgtaaaataaacgccccgaaataaaacgaaaaaaaacataatcgcgataaacgacatatataaaaaaaacgaaaccgcccgcgatcgaacgccttcgattaatatnanttcgcccctcccgcccgcgaaaaacgaaacgtataaaattaaaattcgtcgtcgaatcgcgcccgcgacgtatcgattcgacgcgaaacctcgatcgacgctaaataaacgttacgacctcgaacgacgccgtaccgcgacgaaaaatattttcccgcgaaacttaaacgaaattacgacgaaaatataaaatatcccgacgcga

SEQ ID NO: 23075 - DNA, 1022 bp, Artificial Sequence
  chemically treated genomic DNA (Homo sapiens) CpG-island No: 23075
  misc_feature (454)..(454): n is either a, c, g or t
  misc_feature (815)..(815): n is either a, c, g or t
  misc_feature (817)..(817): n is either a, c, g or t
ttattgtcggttttgggggtgggaacgtagttgaagtgtatgaggtgcgaatgggtgagagtgagtaataggggtgagtgggtagtattattgcgtggtcgggtggggatgcgagtgttcggggtattaattttggggggttggggggggtgcgggagttgggttttgtgtatttaaatagcgagcggtggtggcggaggcggcgcggggcgtttttcgggtacgattgaatcggtgaaaatataatattttcgtggacggcggtataatgatcgtgcggaggtggggcgtcgggcggttttttaattatatttaagcgcggcgggagacgggtcgacgattagatcgagttcgtcgtgttgtgttgtgtgtggttttcgttcgggcgtcgatattatgggtcgagagggtcggcggtgtcgatatttggcgggtgtggttgtcggcgcggtanaaacgagaaaacggtagacgggtaatagcgggggaattgtgtggatcgtgcggagatatgtcgtaagggggggtattgtaggggggtgtgggaggggttggatgtcgtgagcgtggacgttggggtggtggtgggatatgaagggtcggtgtatgatgtgggggcggattgcggtaatatggggatatatatcgtgtgcgggtaagggttataagttgggggcggtgtggtgtcgggtgcggtcggcgttaatcgcgtgaggtaagcgtttcggggtgaggcggagggggatatagtcgcggtggacggtatgtgtagggggagcggggtcgttcgcggtcgggcgttttcggttggtgtngnttcgtttttttcgttcgcggggggcggggcgtgtggggttagggttcgtcgtcgggtcgcgttcgcggcgtgtcggttcggcgcggggtttcggtcggcgttgggtgggcgttgcggtttcgggcggcgtcgtgtcgcggcggggggtgttttttcgcggggtttgggcggggttgcggcgggggtgtggggtgtttcggcgcgg

SEQ ID NO: 23076 - DNA, 1022 bp, Artificial Sequence
  chemically treated genomic DNA (Homo sapiens) CpG-island No: 23076
  misc_feature (206)..(206): n is either a, c, g or t
  misc_feature (208)..(208): n is either a, c, g or t
  misc_feature (569)..(569): n is either a, c, g or t
ccgcgccgaaacaccccacacccccgccgcaaccccgcccaaaccccgcgaaaaaacaccccccgccgcgacacgacgccgcccgaaaccgcaacgcccacccaacgccgaccgaaaccccgcgccgaaccgacacgccgcgaacgcgacccgacgacgaaccctaaccccacacgccccgccccccgcgaacgaaaaaaacgaancnacaccaaccgaaaacgcccgaccgcgaacgaccccgctccccctacacataccgtccaccgcgactatatccccctccgcctcaccccgaaacgcttacctcacgcgattaacgccgaccgcacccgacaccacaccgcccccaacttataacccttacccgcacacgatatatatccccatattaccgcaatccgcccccacatcatacaccgacccttcatatcccaccaccaccccaacgtccacgctcacgacatccaacccctcccacacccccctacaatacccccccttacgacatatctccgcacgatccacacaattcccccgctattacccgtctaccgttttctcgtttntaccgcgccgacaaccacacccgccaaatatcgacaccgccgaccctctcgacccataatatcgacgcccgaacgaaaaccacacacaacacaacacgacgaactcgatctaatcgtcgacccgtctcccgccgcgcttaaatataattaaaaaaccgcccgacgccccacctccgcacgatcattataccgccgtccacgaaaatattatattttcaccgattcaatcgtacccgaaaaacgccccgcgccgcctccgccaccaccgctcgctatttaaatacacaaaacccaactcccgcaccccccccaaccccccaaaattaataccccgaacactcgcatccccacccgaccacgcaataatactacccactcacccctattactcactctcacccattcgcacctcatacacttcaactacgttcccacccccaaaaccgacaataa

SEQ ID NO: 23077 - DNA, 597 bp, Artificial Sequence
  chemically treated genomic DNA (Homo sapiens) CpG-island No: 23077
  misc_feature (258)..(258): n is either a, c, g or t
ttttgtttcgttgttttcgttttgttgttttgttttttgttttttttttcgtttgttttttttttgttcgcgtgttcgttgtttttttttttttcgtcgtttttttttttttcgtttgtgtgtgcgtttcgtgtgtcgttttttttttttttttttcgttttttttttttttttttttttttttttcgttttttttttttttttttttgtgcgtttttttcgtttttttttttttttttcgttttttttttgtttttntgtttttttttttttttttttgttttttcgttttttcgttttttttttttttttttttttttgttgtgttttttcgtttttttttttttttgcgtgggtcgggttcgttttttttttcgtttcgtttttttttttttttttttttttttttttttttttttttcgtcgtttttttttttttttttttttttttttttgtggttcgagcgtttttttttgttttttttttttttttttttttttattttttttttttttttttttttcgtcgtttttttttttcggttttttttcgtttttttttttttcgtcggttttttttttttttcgttttttttt

SEQ ID NO: 23078 - DNA, 597 bp, Artificial Sequence
  chemically treated genomic DNA (Homo sapiens) CpG-island No: 23078
  misc_feature (340)..(340): n is either a, c, g or t
aaaaaaaaacgaaaaaaaaaaaaaaccgacgaaaaaaaaaaaaacgaaaaaaaaccgaaaaaaaaaaacgacgaaaaaaaaaaaaaaaaaaaaaataaaaaaaaaaaaaaaaaaaaaaaacaaaaaaaaacgctcgaaccacaaaaaaaaaaaaaaaaaaaaaaaaaaaaacgacgaaaaaaaaaaaaaaaaaaaaaaaaaaaaaaaaaaaaaaacgaaacgaaaaaaaaaacgaacccgacccacgcaaaaaaaaaaaaaaacgaaaaaacacaacaaaaaaaaaaaaaaaaaaaaaaaacgaaaaaacgaaaaaacaaaaaaaaaaaaaaaaaaacanaaaaacaaaaaaaaaacgaaaaaaaaaaaaaaaaacgaaaaaaacgcacaaaaaaaaaaaaaaaaaaaacgaaaaaaaaaaaaaaaaaaaaaaaaaaaacgaaaaaaaaaaaaaaaaaacgacacacgaaacgcacacacaaacgaaaaaaaaaaaaacgacgaaaaaaaaaaaaacaacgaacacgcgaacaaaaaaaaaacaaacgaaaaaaaaaacaaaaaacaaaacaacaaaacgaaaacaacgaaacaaaa

SEQ ID NO: 23079 - DNA, 597 bp, Artificial Sequence
  chemically treated genomic DNA (Homo sapiens) CpG-island No: 23079
  misc_feature (340)..(340): n is either a, c, g or t
agggggaggcgagggaaagaagaaatcggcgaggagaagaggaacgggggggaatcgggaggaaagaacggcgagggaaggggaggggggaaaaataggaagaggaagaggggagagggataggggggggcgttcggattatagaaggaaggggagaggaaagggaaaaaacgacgagggaaagagggagggggggaaggaaagaaaaaaaagggcgagacgggagaaggagcgaattcggtttacgtagagaaggggaaaaacgggggagtatagtaaaaggaaaggggaggagggagaacgaaggagcggggggatagaaaaggaagggaaaagatangaaaataaggagagagcggggggagagaaagagggcgagagggacgtataaagggagagggaaagaaagcggaaaaggaagagagagaggagaaagggacggaggaagaagagagagggcgatatacggggcgtatatataaacgagaaggagaagggcgacgggggagggaaagataacgagtacgcgaataagagaaaggtaaacgagagggggaataagaaataaggtaataagacgggagtagcggggtagag

SEQ ID NO: 23080 - DNA, 597 bp, Artificial Sequence
  chemically treated genomic DNA (Homo sapiens) CpG-island No: 23080
  misc_feature (258)..(258): n is either a, c, g or t
ctctaccccgctactcccgtcttattaccttatttcttattccccctctcgtttacctttctcttattcgcgtactcgttatctttccctcccccgtcgcccttctccttctcgtttatatatacgccccgtatatcgccctctctcttcttcctccgtccctttctcctctctctcttccttttccgctttctttccctctccctttatacgtccctctcgccctctttctctccccccgctctctccttattttcntatcttttcccttccttttctatccccccgctccttcgttctccctcctcccctttccttttactatactcccccgtttttccccttctctacgtaaaccgaattcgctccttctcccgtctcgcccttttttttctttccttccccccctccctctttccctcgtcgttttttccctttcctctccccttccttctataatccgaacgcccccccctatccctctcccctcttcctcttcctatttttcccccctccccttccctcgccgttctttcctcccgattcccccccgttcctcttctcctcgccgatttcttctttccctcgcctccccct

SEQ ID NO: 23081 - DNA, 761 bp, Artificial Sequence
  chemically treated genomic DNA (Homo sapiens) CpG-island No: 23081
acggtggcggagttcggttttagttagatttacgtatttatagttttcgttgtcgttttcgttttaggttaaggggcgttattcgttttattgttcgtttcgagagggtttttttttaggtttcgtatttttacgtcgtgcgatttggatttttacggcgggattcgggtttatatttttttttgttgcggggcggagtcgtcgtcgtttcgggtttttgttttcgttttcgagattttcgcgcgtttttagtattttcggtcgcgggagttaagggttcgtgtcgggtagcgtttttcggggttaggtcgttttttgtcgggattcgggcgcgttgtagtcgcggagtcgggtgtttcgtttttttttcgtcggcggcggagtcgttgtcgtttcgggttttcgttttcgttttcgagattttcgcgcgttttttttaggcgagttgcggggcgggaagggttcggttatcgtgggtcgttgttagtcgcggggttgtcgagggtcgcgggtacggggcgttggtttcgggtttggcgaatcgttgatgggagtcggagttcgggcgggcgagcggcggcgcggcggttattatggggaataagtagattatttttatcgaagagtagttagataattattaggtgagttcggcgcgttcggtttttaatataggtttcgtcgtttcgtcgttttttttttttttcggtcgttggtcgaggtttttcgagagttagtttttttaggtttaaattttgttt

SEQ ID NO: 23082 - DNA, 761 bp, Artificial Sequence
  chemically treated genomic DNA (Homo sapiens) CpG-island No: 23082
aaacaaaatttaaacctaaaaaaactaactctcgaaaaacctcgaccaacgaccgaaaaaaaaaaaaaacgacgaaacgacgaaacctatattaaaaaccgaacgcgccgaactcacctaataattatctaactactcttcgataaaaataatctacttattccccataataaccgccgcgccgccgctcgcccgcccgaactccgactcccatcaacgattcgccaaacccgaaaccaacgccccgtacccgcgaccctcgacaaccccgcgactaacaacgacccacgataaccgaacccttcccgccccgcaactcgcctaaaaaaaacgcgcgaaaatctcgaaaacgaaaacgaaaacccgaaacgacaacgactccgccgccgacgaaaaaaaaacgaaacacccgactccgcgactacaacgcgcccgaatcccgacaaaaaacgacctaaccccgaaaaacgctacccgacacgaacccttaactcccgcgaccgaaaatactaaaaacgcgcgaaaatctcgaaaacgaaaacaaaaacccgaaacgacgacgactccgccccgcaacaaaaaaaaatataaacccgaatcccgccgtaaaaatccaaatcgcacgacgtaaaaatacgaaacctaaaaaaaaaccctctcgaaacgaacaataaaacgaataacgccccttaacctaaaacgaaaacgacaacgaaaactataaatacgtaaatctaactaaaaccgaactccgccaccgt

SEQ ID NO: 23083 - DNA, 761 bp, Artificial Sequence
  chemically treated genomic DNA (Homo sapiens) CpG-island No: 23083
aggtagggtttgaatttgggagagttggttttcgggaggtttcggttagcgatcgagaaaagggaggggcggcggggcggcggggtttgtgttgggggtcgggcgcgtcgagtttatttggtagttgtttagttgtttttcggtgaagatggtttgtttgttttttatggtggtcgtcgcgtcgtcgttcgttcgttcgggtttcgatttttattagcggttcgttagattcggagttagcgtttcgtgttcgcggttttcggtagtttcgcggttggtagcggtttacggtggtcggatttttttcgtttcgtagttcgtttggaggaggcgcgcgggggtttcggaggcggggacgggaattcggagcggtagcgatttcgtcgtcggcgggaagagggcggggtattcggtttcgcggttgtagcgcgttcgggtttcggtaggaggcgatttggtttcgggagacgttgttcggtacgaatttttggttttcgcggtcggaagtgttgggggcgcgcgggggtttcggaggcggggataaagattcggagcggcggcgatttcgtttcgtagtaggaagaggtgtgagttcgggtttcgtcgtgggagtttaggtcgtacggcgtgagggtgcggggtttgggaaaaaattttttcgaggcgggtagtggggcgagtggcgttttttgatttggggcgggggcggtagcgaggattgtgagtgcgtggatttagttggggtcgggtttcgttatcgt

SEQ ID NO: 23084 - DNA, 761 bp, Artificial Sequence
  chemically treated genomic DNA (Homo sapiens) CpG-island No: 23084
acgataacgaaacccgaccccaactaaatccacgcactcacaatcctcgctaccgcccccgccccaaatcaaaaaacgccactcgccccactacccgcctcgaaaaaattttttcccaaaccccgcaccctcacgccgtacgacctaaactcccacgacgaaacccgaactcacacctcttcctactacgaaacgaaatcgccgccgctccgaatctttatccccgcctccgaaacccccgcgcgcccccaacacttccgaccgcgaaaaccaaaaattcgtaccgaacaacgtctcccgaaaccaaatcgcctcctaccgaaacccgaacgcgctacaaccgcgaaaccgaataccccgccctcttcccgccgacgacgaaatcgctaccgctccgaattcccgtccccgcctccgaaacccccgcgcgcctcctccaaacgaactacgaaacgaaaaaaatccgaccaccgtaaaccgctaccaaccgcgaaactaccgaaaaccgcgaacacgaaacgctaactccgaatctaacgaaccgctaataaaaatcgaaacccgaacgaacgaacgacgacgcgacgaccaccataaaaaacaaacaaaccatcttcaccgaaaaacaactaaacaactaccaaataaactcgacgcgcccgacccccaacacaaaccccgccgccccgccgcccctcccttttctcgatcgctaaccgaaacctcccgaaaaccaactctcccaaattcaaaccctacct

SEQ ID NO: 23085 - DNA, 723 bp, Artificial Sequence
  chemically treated genomic DNA (Homo sapiens) CpG-island No: 23085
gtaacggtcggcgggcgggcgggggcgagattataagttttagggtgttttgcgcgttcgcgggtcgtgcggagcgaaggggcggtgcggagggggtagggggcgtagcggtcgcggcgcggaggcgtagggcgcgggcgtttacggttggcgcgcggtagcgatgtcgggggtcggagttcgggcggaggagggcggcggcggcggcgagggcgcggcgtagggggcggtcgcggagttcggggcgggttcggcgcgggagttagcgcggttgtgtggttatttgtagaagttgtcgggtaagggttttttgcgtggttatcgtagtcgttggttcgtgttcgacgcgcgtcgttgttatttttattattttaagagttcgtaggacgcgttgtttttcggttatttggatatcgcggacgtttgttttagttattagggtttcgacgaggcggcggagtcgggtacggagtcgttcgcgtatttttaggtgtatagcgcgggagtcgttacggtgtttaaggtgggatcgttcgttttaaagtcgttcgcgcgttttcgtcggcgttttttgttttcgttattggtttgcgttatttatttttttttttttaaggttttttcgtttttgtttacgtcggtttgtttttttttgtttttttatatttcgttttcgtttttattttttttttattatttgggtttaggttagtttcgttgggg

SEQ ID NO: 23086 - DNA, 723 bp, Artificial Sequence
  chemically treated genomic DNA (Homo sapiens) CpG-island No: 23086
ccccaacgaaactaacctaaacccaaataataaaaaaaaaataaaaacgaaaacgaaatataaaaaaacaaaaaaaaacaaaccgacgtaaacaaaaacgaaaaaaccttaaaaaaaaaaaaataaataacgcaaaccaataacgaaaacaaaaaacgccgacgaaaacgcgcgaacgactttaaaacgaacgatcccaccttaaacaccgtaacgactcccgcgctatacacctaaaaatacgcgaacgactccgtacccgactccgccgcctcgtcgaaaccctaataactaaaacaaacgtccgcgatatccaaataaccgaaaaacaacgcgtcctacgaactcttaaaataataaaaataacaacgacgcgcgtcgaacacgaaccaacgactacgataaccacgcaaaaaacccttacccgacaacttctacaaataaccacacaaccgcgctaactcccgcgccgaacccgccccgaactccgcgaccgccccctacgccgcgccctcgccgccgccgccgccctcctccgcccgaactccgacccccgacatcgctaccgcgcgccaaccgtaaacgcccgcgccctacgcctccgcgccgcgaccgctacgccccctaccccctccgcaccgccccttcgctccgcacgacccgcgaacgcgcaaaacaccctaaaacttataatctcgcccccgcccgcccgccgaccgttac

SEQ ID NO: 23087 - DNA, 723 bp, Artificial Sequence
  chemically treated genomic DNA (Homo sapiens) CpG-island No: 23087
ttttagcgagattggtttaagtttagatagtggggaggagataggaacgagggcgggatgtggagaagtagggaaaggtaggtcgacgtgggtaggggcgaggaggttttggaggaaggagggtggatggcgtaagttagtggcggaggtaggggacgtcggcggaagcgcgcgggcggttttggggcgagcggttttattttgagtatcgtgacggttttcgcgttgtgtatttggaagtgcgcgggcggtttcgtgttcggtttcgtcgtttcgtcggggttttggtagttgaagtaggcgttcgcgatgtttaagtggtcgaggggtagcgcgttttgcggatttttgaaatagtaaaggtagtagcggcgcgcgtcgaatacgaattagcggttgcggtagttacgtagggggtttttgttcgatagtttttgtagatagttatatagtcgcgttggttttcgcgtcggattcgtttcgggtttcgcggtcgttttttgcgtcgcgttttcgtcgtcgtcgtcgttttttttcgttcgggtttcggttttcggtatcgttatcgcgcgttaatcgtaggcgttcgcgttttgcgttttcgcgtcgcggtcgttgcgttttttatttttttcgtatcgttttttcgtttcgtacggttcgcgggcgcgtaaagtattttgggatttgtagtttcgttttcgttcgttcgtcggtcgttgt

SEQ ID NO: 23088 - DNA, 723 bp, Artificial Sequence
  chemically treated genomic DNA (Homo sapiens) CpG-island No: 23088
acaacgaccgacgaacgaacgaaaacgaaactacaaatcccaaaatactttacgcgcccgcgaaccgtacgaaacgaaaaaacgatacgaaaaaaataaaaaacgcaacgaccgcgacgcgaaaacgcaaaacgcgaacgcctacgattaacgcgcgataacgataccgaaaaccgaaacccgaacgaaaaaaaacgacgacgacgacgaaaacgcgacgcaaaaaacgaccgcgaaacccgaaacgaatccgacgcgaaaaccaacgcgactatataactatctacaaaaactatcgaacaaaaaccccctacgtaactaccgcaaccgctaattcgtattcgacgcgcgccgctactacctttactatttcaaaaatccgcaaaacgcgctacccctcgaccacttaaacatcgcgaacgcctacttcaactaccaaaaccccgacgaaacgacgaaaccgaacacgaaaccgcccgcgcacttccaaatacacaacgcgaaaaccgtcacgatactcaaaataaaaccgctcgccccaaaaccgcccgcgcgcttccgccgacgtcccctacctccgccactaacttacgccatccaccctccttcctccaaaacctcctcgcccctacccacgtcgacctacctttccctacttctccacatcccgccctcgttcctatctcctccccactatctaaacttaaaccaatctcgctaaaa

SEQ ID NO: 23089 - DNA, 754 bp, Artificial Sequence
  chemically treated genomic DNA (Homo sapiens) CpG-island No: 23089
cgagttcggcgattcgttagcggaatgtttaggggcggggtagcgagcgagcgcgaagtaattttgaggcggtttagggggcggggcgtttagggggcgtggtcgtgtaggggcgggtttcgagcgtggggtgggcgtttgcgtattgtcgttgcggttgttgttgcggagttaggaggggaagcgatggttgggttcgcgtggatttttaaggtgagcgttggtaggtcggcgtgtggtaggtaggtaggtcgcgagggttggtaggagagtcggtcgcgtgtcgggtgtgggcgggcgcgtgggttagatagggaggcggtggttgttcgcggggatagtttgggagtcggttttggtcgttcgtgtttcgcgtttcgtggtcggttcgtagtgtatgggtcgtttcgggtcgggttagtagcgtagaggcggggacggcgttaaggttaaggcgggggggcgtcggttttgtttttgtcgagattcggttgtcgttattcgtattcgtttaggttagagtttaggtttcgcgtcgagttcgggaaggttacgggagtttttgtttcggtttcgttattcgggtcgttttttcggttgcggttttgttgcgggattgatttttttagtattgtttatattttttattcgttgtttgcgcggtttttggtcggggaatcgtaggtgttacgggtattggcgttgagtttgggaggtttttttaggtgagagaattcgggggttttttttttta

SEQ ID NO: 23090 - DNA, 754 bp, Artificial Sequence
  chemically treated genomic DNA (Homo sapiens) CpG-island No: 23090
taaaaaaaaaaacccccgaattctctcacctaaaaaaacctcccaaactcaacgccaatacccgtaacacctacgattccccgaccaaaaaccgcgcaaacaacgaataaaaaatataaacaatactaaaaaaatcaatcccgcaacaaaaccgcaaccgaaaaaacgacccgaataacgaaaccgaaacaaaaactcccgtaaccttcccgaactcgacgcgaaacctaaactctaacctaaacgaatacgaataacgacaaccgaatctcgacaaaaacaaaaccgacgcccccccgccttaaccttaacgccgtccccgcctctacgctactaacccgacccgaaacgacccatacactacgaaccgaccacgaaacgcgaaacacgaacgaccaaaaccgactcccaaactatccccgcgaacaaccaccgcctccctatctaacccacgcgcccgcccacacccgacacgcgaccgactctcctaccaaccctcgcgacctacctacctaccacacgccgacctaccaacgctcaccttaaaaatccacgcgaacccaaccatcgcttcccctcctaactccgcaacaacaaccgcaacgacaatacgcaaacgcccaccccacgctcgaaacccgcccctacacgaccacgccccctaaacgccccgccccctaaaccgcctcaaaattacttcgcgctcgctcgctaccccgcccctaaacattccgctaacgaatcgccgaactcg

SEQ ID NO: 23091 - DNA, 754 bp, Artificial Sequence
  chemically treated genomic DNA (Homo sapiens) CpG-island No: 23091
tagggaaaagggttttcggatttttttatttgggaaaattttttaagtttaacgttagtgttcgtggtatttgcggtttttcggttaagggtcgcgtagatagcggatgagaggtgtgggtagtgttgaggggattagtttcgtagtagggtcgtagtcggggaagcggttcggatggcggagtcgggatagaggttttcgtgattttttcgggttcggcgcgaagtttgggttttggtttgggcggatgcgggtgacggtagtcgggtttcggtaggagtagggtcggcgttttttcgttttgattttgacgtcgttttcgtttttgcgttgttgattcggttcggggcggtttatatattgcgagtcggttacggagcgcggggtacgggcgattaggatcggtttttaagttgttttcgcgggtagttatcgtttttttgtttggtttacgcgttcgtttatattcggtacgcgatcggtttttttgttagttttcgcggtttgtttgtttgttatacgtcggtttgttagcgtttattttagagatttacgcgggtttagttatcgtttttttttttggtttcgtagtaatagtcgtagcggtagtgcgtaagcgtttattttacgttcggagttcgtttttgtacggttacgttttttgaacgtttcgttttttagatcgttttaggattgtttcgcgttcgttcgttgtttcgtttttggatatttcgttggcgaatcgtcgggttcg

SEQ ID NO: 23092 - DNA, 754 bp, Artificial Sequence
  chemically treated genomic DNA (Homo sapiens) CpG-island No: 23092
cgaacccgacgattcgccaacgaaatatccaaaaacgaaacaacgaacgaacgcgaaacaatcctaaaacgatctaaaaaacgaaacgttcaaaaaacgtaaccgtacaaaaacgaactccgaacgtaaaataaacgcttacgcactaccgctacgactattactacgaaaccaaaaaaaaaaacgataactaaacccgcgtaaatctctaaaataaacgctaacaaaccgacgtataacaaacaaacaaaccgcgaaaactaacaaaaaaaccgatcgcgtaccgaatataaacgaacgcgtaaaccaaacaaaaaaacgataactacccgcgaaaacaacttaaaaaccgatcctaatcgcccgtaccccgcgctccgtaaccgactcgcaatatataaaccgccccgaaccgaatcaacaacgcaaaaacgaaaacgacgtcaaaatcaaaacgaaaaaacgccgaccctactcctaccgaaacccgactaccgtcacccgcatccgcccaaaccaaaacccaaacttcgcgccgaacccgaaaaaatcacgaaaacctctatcccgactccgccatccgaaccgcttccccgactacgaccctactacgaaactaatcccctcaacactacccacacctctcatccgctatctacgcgacccttaaccgaaaaaccgcaaataccacgaacactaacgttaaacttaaaaaattttcccaaataaaaaaatccgaaaacccttttcccta

SEQ ID NO: 23093 - DNA, 652 bp, Artificial Sequence
  chemically treated genomic DNA (Homo sapiens) CpG-island No: 23093
ttattcgtcgttattgttttattttatagttacgttttcgtttttttatttttttcgttttattcgtttcgtttttttgaacgaaaaagtttcgttcgtttcgaaatttcgtcgtaattcgtttaagtattttttaggattcgatcgcgcgtaggcgcgtcgggcgtaatcgcggattacgtaacgttttattagtttttcgattattttaaattttcgttttcgtaacgttcgatatttttcgtaattattcgttcgtcgtatcgttttttaaaaattagcggtcgcgagttagtcgagaggttaacgtcgtcgagcgtagtttatattatgattattaatcgcgcgtcgtttattttttttcgtttcggtagcggttttttattaggtcgattcgtttttacgacggatcgttgtcgtcgacgcgttatcgcgaattttttttatcgttttcgatttatttttatcgtaatcgaaggtttcgcgttatttatatcgaaattagaaatcgttttttatttcgttaatatcgaagcgttttttatcggggcgaagattcggtcgtcgtattttatcggtaatttatttatatattcgatttatttattttcgttattattacgtaagttatttcgatatacgagtacgtttt

SEQ ID NO: 23094 - DNA, 652 bp, Artificial Sequence
  chemically treated genomic DNA (Homo sapiens) CpG-island No: 23094
aaaacgtactcgtatatcgaaataacttacgtaataataacgaaaataaataaatcgaatatataaataaattaccgataaaatacgacgaccgaatcttcgccccgataaaaaacgcttcgatattaacgaaataaaaaacgatttctaatttcgatataaataacgcgaaaccttcgattacgataaaaataaatcgaaaacgataaaaaaaattcgcgataacgcgtcgacgacaacgatccgtcgtaaaaacgaatcgacctaataaaaaaccgctaccgaaacgaaaaaaaataaacgacgcgcgattaataatcataatataaactacgctcgacgacgttaacctctcgactaactcgcgaccgctaatttttaaaaaacgatacgacgaacgaataattacgaaaaatatcgaacgttacgaaaacgaaaatttaaaataatcgaaaaactaataaaacgttacgtaatccgcgattacgcccgacgcgcctacgcgcgatcgaatcctaaaaaatacttaaacgaattacgacgaaatttcgaaacgaacgaaactttttcgttcaaaaaaacgaaacgaataaaacgaaaaaaataaaaaaacgaaaacgtaactataaaataaaacaataacgacgaataa

SEQ ID NO: 23095 - DNA, 652 bp, Artificial Sequence
  chemically treated genomic DNA (Homo sapiens) CpG-island No: 23095
agggcgtgttcgtgtgtcggggtggtttgcgtggtggtgacgggggtgggtgggtcgggtatatggatagattgtcggtggggtgcggcgatcgggttttcgtttcggtggggggcgtttcggtgttggcggggtggggggcggtttttggtttcggtgtgggtggcgcggggttttcggttgcggtgggagtgggtcgggggcggtggggggggttcgcggtggcgcgtcggcggtagcgattcgtcgtgggggcgggtcggtttagtggggggtcgttatcggggcgaaggggggtgggcggcgcgcggttggtgattatagtatgggttacgttcggcggcgttggtttttcgattggttcgcggtcgttggtttttggggggcggtgcggcgaacgggtagttgcggggggtatcgggcgttgcgggggcgggggtttggggtggtcgggaggttggtgggacgttgcgtggttcgcggttgcgttcggcgcgtttgcgcgcggtcgggttttggggggtgtttaggcgggttgcggcggggtttcggggcgggcggggttttttcgtttaggggggcgggacgggtgggacggggggggtggggaagcgggggcgtggttgtggggtgaggtagtgacggcggataa

SEQ ID NO: 23096 - DNA, 652 bp, Artificial Sequence
  chemically treated genomic DNA (Homo sapiens) CpG-island No: 23096
ttatccgccgtcactacctcaccccacaaccacgcccccgcttccccaccccccccgtcccacccgtcccgcccccctaaacgaaaaaaccccgcccgccccgaaaccccgccgcaacccgcctaaacaccccccaaaacccgaccgcgcgcaaacgcgccgaacgcaaccgcgaaccacgcaacgtcccaccaacctcccgaccaccccaaacccccgcccccgcaacgcccgataccccccgcaactacccgttcgccgcaccgccccccaaaaaccaacgaccgcgaaccaatcgaaaaaccaacgccgccgaacgtaacccatactataatcaccaaccgcgcgccgcccaccccccttcgccccgataacgaccccccactaaaccgacccgcccccacgacgaatcgctaccgccgacgcgccaccgcgaaccccccccaccgcccccgacccactcccaccgcaaccgaaaaccccgcgccacccacaccgaaaccaaaaaccgccccccaccccgccaacaccgaaacgccccccaccgaaacgaaaacccgatcgccgcaccccaccgacaatctatccatatacccgacccacccacccccgtcaccaccacgcaaaccaccccgacacacgaacacgccct

SEQ ID NO: 23097 - DNA, 1211 bp, Artificial Sequence
  chemically treated genomic DNA (Homo sapiens) CpG-island No: 23097
atatatcgaaagcgtcgatatagttaggcgtgagggcgaggacgggggtgggggtgggggtcggacgttattggttttcgagtttcgattttgattacgattttcggagcgtagggtcggttcgggagttattagtttggtttttagttttcggttcgttttcgattcgttttcggttggttttcgcggttcgcgttcgtttatcgtaagcgtagatgtttcgtagtaggttttttcgtaggtttatggtgtcgaacgtgggggttatatttattttttcgttggtttcgaattttattttagttatgtttttttttttgagtagtcgttttcgcgtcgagttcgaggtcgttatcgtggtcgtggtcgttatgatttagagttcgcggaagagtatagcgcgcgtcgttgtcgatttcgttgtcgttgtcgatttcgttgtgtcgttgtcgatttcgttgtcgttgtcgatttcgttgtgtcgttgtcgatttcgttgtgtcgttgtcgatttcgttgtgtcgttgtcgatttcgttgtgtcgttgtcgagaatagacgttttaagtatgcgaaagcgagagacgtgcgtgcgtacgtgcgtacgtgcgtacgcgcgacgcggttacgtttttgggggacggggtatttttcgttacgtgaaagggaattgggcgtttgtcgtagggaaaagtaaggtgtttttgttttcgcgttatatgtagttttcgcgggatttcgttgagggcggggtatttagttttttacgaaagggatggagggggtggtatttttaaagttggcggtgtttcgtatcggtcgcgggatttcgcggattggggcgttgaggttttttgagcggcgtgtggatttgaattttttggaaataggttggggtcgcgaggggttttcgtttcgggcggggtttttagatagtttcgtttcgaataaaaatgacgagtacgggttttttttcgggttcgtagtgggtggattgcgtcgtagattcgtagtggaggcgtttagttcgtcggggagattcgagtggaaatttttacggtcgtcggtggtgggtttcggcgcggcgttgggtttcggcgggtttgcgttggggagggttagggtttttgaagtcggcgttttttttaggggacgcgtttgggtgtgtttttatcgtttgtttggtgagttggagatagggtttcgtttcgt

SEQ ID NO: 23098 - DNA, 1211 bp, Artificial Sequence
  chemically treated genomic DNA (Homo sapiens) CpG-island No: 23098
acgaaacgaaaccctatctccaactcaccaaacaaacgataaaaacacacccaaacgcgtcccctaaaaaaaacgccgacttcaaaaaccctaaccctccccaacgcaaacccgccgaaacccaacgccgcgccgaaacccaccaccgacgaccgtaaaaatttccactcgaatctccccgacgaactaaacgcctccactacgaatctacgacgcaatccacccactacgaacccgaaaaaaaacccgtactcgtcatttttattcgaaacgaaactatctaaaaaccccgcccgaaacgaaaacccctcgcgaccccaacctatttccaaaaaattcaaatccacacgccgctcaaaaaacctcaacgccccaatccgcgaaatcccgcgaccgatacgaaacaccgccaactttaaaaataccaccccctccatccctttcgtaaaaaactaaataccccgccctcaacgaaatcccgcgaaaactacatataacgcgaaaacaaaaacaccttacttttccctacgacaaacgcccaattccctttcacgtaacgaaaaataccccgtcccccaaaaacgtaaccgcgtcgcgcgtacgcacgtacgcacgtacgcacgcacgtctctcgctttcgcatacttaaaacgtctattctcgacaacgacacaacgaaatcgacaacgacacaacgaaatcgacaacgacacaacgaaatcgacaacgacacaacgaaatcgacaacgacaacgaaatcgacaacgacacaacgaaatcgacaacgacaacgaaatcgacaacgacgcgcgctatactcttccgcgaactctaaatcataacgaccacgaccacgataacgacctcgaactcgacgcgaaaacgactactcaaaaaaaaaaacataactaaaataaaattcgaaaccaacgaaaaaataaatataacccccacgttcgacaccataaacctacgaaaaaacctactacgaaacatctacgcttacgataaacgaacgcgaaccgcgaaaaccaaccgaaaacgaatcgaaaacgaaccgaaaactaaaaaccaaactaataactcccgaaccgaccctacgctccgaaaatcgtaatcaaaatcgaaactcgaaaaccaataacgtccgacccccacccccacccccgtcctcgccctcacgcctaactatatcgacgctttcgatatat

SEQ ID NO: 23099 - DNA, 1211 bp, Artificial Sequence
  chemically treated genomic DNA (Homo sapiens) CpG-island No: 23099
acggagcgagattttgtttttaatttattaggtaaacggtgaagatatatttaggcgcgttttttaagagggacgtcggttttaggggttttggttttttttagcgtagattcgtcggagtttagcgtcgcgtcggggtttattatcggcggtcgtgagggtttttattcgaattttttcggcgagttgggcgtttttattacgggtttgcgacgtagtttatttattgcgggttcgagagaggattcgtgttcgttatttttattcgaggcggggttatttggggatttcgttcggagcggaggtttttcgcggttttagtttgtttttagggaatttaggtttatacgtcgtttaaagaattttagcgttttagttcgcgaaatttcgcggtcggtacgaaatatcgttaattttagaagtattattttttttatttttttcgtaaggaattgggtgtttcgtttttaacgagatttcgcgggaattgtatatggcgcgagagtagaaatattttatttttttttgcggtaaacgtttagtttttttttacgtgacgaagagtgtttcgttttttagaggcgtggtcgcgtcgcgcgtacgtacgtacgtacgtacgtacgtacgtttttcgttttcgtatatttaaggcgtttgttttcggtagcggtatagcgaggtcggtagcggtatagcgaggtcggtagcggtatagcgaggtcggtagcggtatagcgaggtcggtagcggtagcgaggtcggtagcggtatagcgaggtcggtagcggtagcgaggtcggtagcggcgcgcgttgtgttttttcgcggattttgaattatggcgattacggttacgatggcgatttcgggttcggcgcgaaagcggttgtttaaagaggaagatatgattaaagtggaattcgagattagcgaggaggtggatgtgatttttacgttcgatattatgggtttgcgggaggatttgttgcggggtatttacgtttacggtgagcgggcgcgggtcgcgggggttagtcgggggcgagtcgggggcgagtcgggggttgagggttagattggtgattttcgggtcggttttgcgtttcggaggtcgtggttagggtcgaggttcgggggttagtgacgttcgatttttatttttattttcgttttcgtttttacgtttggttgtgtcggcgttttcggtgtgt

SEQ ID NO: 23100 - DNA, 1211 bp, Artificial Sequence
  chemically treated genomic DNA (Homo sapiens) CpG-island No: 23100
acacaccgaaaacgccgacacaaccaaacgtaaaaacgaaaacgaaaataaaaataaaaatcgaacgtcactaacccccgaacctcgaccctaaccacgacctccgaaacgcaaaaccgacccgaaaatcaccaatctaaccctcaacccccgactcgcccccgactcgcccccgactaacccccgcgacccgcgcccgctcaccgtaaacgtaaataccccgcaacaaatcctcccgcaaacccataatatcgaacgtaaaaatcacatccacctcctcgctaatctcgaattccactttaatcatatcttcctctttaaacaaccgctttcgcgccgaacccgaaatcgccatcgtaaccgtaatcgccataattcaaaatccgcgaaaaaacacaacgcgcgccgctaccgacctcgctaccgctaccgacctcgctataccgctaccgacctcgctaccgctaccgacctcgctataccgctaccgacctcgctataccgctaccgacctcgctataccgctaccgacctcgctataccgctaccgaaaacaaacgccttaaatatacgaaaacgaaaaacgtacgtacgtacgtacgtacgtacgtacgcgcgacgcgaccacgcctctaaaaaacgaaacactcttcgtcacgtaaaaaaaaactaaacgtttaccgcaaaaaaaaataaaatatttctactctcgcgccatatacaattcccgcgaaatctcgttaaaaacgaaacacccaattccttacgaaaaaaataaaaaaaataatacttctaaaattaacgatatttcgtaccgaccgcgaaatttcgcgaactaaaacgctaaaattctttaaacgacgtataaacctaaattccctaaaaacaaactaaaaccgcgaaaaacctccgctccgaacgaaatccccaaataaccccgcctcgaataaaaataacgaacacgaatcctctctcgaacccgcaataaataaactacgtcgcaaacccgtaataaaaacgcccaactcgccgaaaaaattcgaataaaaaccctcacgaccgccgataataaaccccgacgcgacgctaaactccgacgaatctacgctaaaaaaaaccaaaacccctaaaaccgacgtccctcttaaaaaacgcgcctaaatatatcttcaccgtttacctaataaattaaaaacaaaatctcgctccgt

SEQ ID NO: 23101 - DNA, 770 bp, Artificial Sequence
  chemically treated genomic DNA (Homo sapiens) CpG-island No: 23101
ttatcgtcggtagcgcggggtagacgttaggtgttttattcgtttcgtgttttagttttttcgttagttgcggtacgcgtagagtttttttcgttgaataacgggcggacgaggagaatttagaggtggtcggggtttttcgcgttatcgaggttattgttttatttgttgttttattttcgatttttattcgcggtttcggcgataattttagtttttttaattgagaggtcgcgcgggtagtcgatcgttttatcgattcggttcgcgtttagggaagtttcgtagtttcggttcggtttattttcgcgtacgcgcgttttggtcgttcgcggagatttcggggtcgtgttcgggggcgcgtagaggcgggttacgtgatcggcgggagttcgtcgcggggcggggtcgcggtgggttacgtgacgcggtttttcgcgtaggcgttcgaggtaagggtgcgcgttcgcgttacgttttttagtggcggtttcggtagagcgggtttgggcgcgttttcgttttcggagggggtttggggagcgcgtttggttgcgcgttcggcgtttcgcggggagaggtttacgcgtgttgttcgttgtcggtttttttggggttagagacggggcgaggttttcgttggcgtagtttcggttcggttttcgtggggtcggagatggggcgtggttttcgttgtttcggtttgggttttcgtagttcgtagggttttgtaaggggttggtttagtcgcgttttgcgtttagggattt

SEQ ID NO: 23102 - DNA, 770 bp, Artificial Sequence
  chemically treated genomic DNA (Homo sapiens) CpG-island No: 23102
aaatccctaaacgcaaaacgcgactaaaccaaccccttacaaaaccctacgaactacgaaaacccaaaccgaaacaacgaaaaccacgccccatctccgaccccacgaaaaccgaaccgaaactacgccaacgaaaacctcgccccgtctctaaccccaaaaaaaccgacaacgaacaacacgcgtaaacctctccccgcgaaacgccgaacgcgcaaccaaacgcgctccccaaaccccctccgaaaacgaaaacgcgcccaaacccgctctaccgaaaccgccactaaaaaacgtaacgcgaacgcgcacccttacctcgaacgcctacgcgaaaaaccgcgtcacgtaacccaccgcgaccccgccccgcgacgaactcccgccgatcacgtaacccgcctctacgcgcccccgaacacgaccccgaaatctccgcgaacgaccaaaacgcgcgtacgcgaaaataaaccgaaccgaaactacgaaacttccctaaacgcgaaccgaatcgataaaacgatcgactacccgcgcgacctctcaattaaaaaaactaaaattatcgccgaaaccgcgaataaaaatcgaaaataaaacaacaaataaaacaataacctcgataacgcgaaaaaccccgaccacctctaaattctcctcgtccgcccgttattcaacgaaaaaaactctacgcgtaccgcaactaacgaaaaaactaaaacacgaaacgaataaaacacctaacgtctaccccgcgctaccgacgataa

SEQ ID NO: 23103 - DNA, 770 bp, Artificial Sequence
  chemically treated genomic DNA (Homo sapiens) CpG-island No: 23103
gaatttttgggcgtaaggcgcggttgggttagttttttataaagttttacgagttgcggggatttaggtcggggtagcgggggttacgttttattttcgattttacggggatcgggtcgggattgcgttagcgggggtttcgtttcgtttttgattttagaggaatcggtagcgggtagtacgcgtgggttttttttcgcgggacgtcggacgcgtagttagacgcgttttttaggtttttttcgagagcgaggacgcgtttaggttcgttttgtcggagtcgttattggggggcgtagcgcggacgcgtatttttgtttcgggcgtttgcgcgggaggtcgcgttacgtgatttatcgcggtttcgtttcgcgacgagttttcgtcggttacgtgattcgtttttgcgcgttttcgggtacgatttcggagttttcgcgggcggttagggcgcgcgtgcgcggaggtgagtcgggtcggggttgcggggtttttttgagcgcgggtcgggtcggtggggcggtcggttgttcgcgcggttttttagttgggaaagttgaggttgtcgtcggggtcgcgggtggaggtcggggatgaggtagtaggtaggatagtgatttcggtgacgcgaaggatttcggttatttttaggtttttttcgttcgttcgttgtttagcgagggaggttttgcgcgtgtcgtagttgacggggaaattgaggtacggagcgggtgagatatttgacgtttgtttcgcgttgtcggcggtaa

SEQ ID NO: 23104 - DNA, 770 bp, Artificial Sequence
  chemically treated genomic DNA (Homo sapiens) CpG-island No: 23104
ttaccgccgacaacgcgaaacaaacgtcaaatatctcacccgctccgtacctcaatttccccgtcaactacgacacgcgcaaaacctccctcgctaaacaacgaacgaacgaaaaaaacctaaaaataaccgaaatccttcgcgtcaccgaaatcactatcctacctactacctcatccccgacctccacccgcgaccccgacgacaacctcaactttcccaactaaaaaaccgcgcgaacaaccgaccgccccaccgacccgacccgcgctcaaaaaaaccccgcaaccccgacccgactcacctccgcgcacgcgcgccctaaccgcccgcgaaaactccgaaatcgtacccgaaaacgcgcaaaaacgaatcacgtaaccgacgaaaactcgtcgcgaaacgaaaccgcgataaatcacgtaacgcgacctcccgcgcaaacgcccgaaacaaaaatacgcgtccgcgctacgccccccaataacgactccgacaaaacgaacctaaacgcgtcctcgctctcgaaaaaaacctaaaaaacgcgtctaactacgcgtccgacgtcccgcgaaaaaaaacccacgcgtactacccgctaccgattcctctaaaatcaaaaacgaaacgaaacccccgctaacgcaatcccgacccgatccccgtaaaatcgaaaataaaacgtaacccccgctaccccgacctaaatccccgcaactcgtaaaactttataaaaaactaacccaaccgcgccttacgcccaaaaattc

SEQ ID NO: 23105 - DNA, 664 bp, Artificial Sequence
  chemically treated genomic DNA (Homo sapiens) CpG-island No: 23105
gttcgataggtcgggaaagttgagcgcgcgttgttggggggacgtatattttggaggttgtgtgggcgcgcgtcggtattttataagtttttattcgtttgtttcgtcgatttagttagataaagatcgtaagtttttcggtttatcgttttagataggcggggattagttttttcgaattaggtttatttcgggttcgggcgtttttattcgtcgcggggaaaagtttttaggtgttttttcgtgatttaggtttttttataacgttttcgtttttgttggcgtttcgtatttcgaggacggcggtcggatttcggttttttttcggtttcgcggttgtaggtttacgcgtttcgcgcgtttcgcgcgttttcgttttagtttcgtcgagggggcgttgttcgttgcgcggtggatttttcggatttcgttttcgcggtttcgttcgggtttcgatatttattcgggtttcgttgcgggggtcggattcgcgtcggtttcgagagtcgttatcgtcgttttcgtcgttgtcgtcgttagtgaggcgcggcggggcggggacgcgcggggaggttcggttttcggttcgttttcgggttcgttttcggttcggtttttgtttgttttcgtcggttttttcgtttattttttggtttagttttgg

SEQ ID NO: 23106 - DNA, 664 bp, Artificial Sequence
  chemically treated genomic DNA (Homo sapiens) CpG-island No: 23106
ccaaaactaaaccaaaaaataaacgaaaaaaccgacgaaaacaaacaaaaaccgaaccgaaaacgaacccgaaaacgaaccgaaaaccgaacctccccgcgcgtccccgccccgccgcgcctcactaacgacgacaacgacgaaaacgacgataacgactctcgaaaccgacgcgaatccgacccccgcaacgaaacccgaataaatatcgaaacccgaacgaaaccgcgaaaacgaaatccgaaaaatccaccgcgcaacgaacaacgccccctcgacgaaactaaaacgaaaacgcgcgaaacgcgcgaaacgcgtaaacctacaaccgcgaaaccgaaaaaaaaccgaaatccgaccgccgtcctcgaaatacgaaacgccaacaaaaacgaaaacgttataaaaaaacctaaatcacgaaaaaacacctaaaaacttttccccgcgacgaataaaaacgcccgaacccgaaataaacctaattcgaaaaaactaatccccgcctatctaaaacgataaaccgaaaaacttacgatctttatctaactaaatcgacgaaacaaacgaataaaaacttataaaataccgacgcgcgcccacacaacctccaaaatatacgtccccccaacaacgcgcgctcaactttcccgacctatcgaac

SEQ ID NO: 23107 - DNA, 664 bp, Artificial Sequence
  chemically treated genomic DNA (Homo sapiens) CpG-island No: 23107
ttagggttgggttagaaggtgggcggggagatcggcgggggtaggtaggggtcgggtcgggggcgggttcgggggcgggtcgggggtcgggttttttcgcgcgttttcgtttcgtcgcgttttattggcggcggtagcggcggaggcgacggtggcggttttcggagtcggcgcgaattcggttttcgtagcgggattcgggtgggtatcggggttcggacggggtcgcgggggcggggttcgaggggtttatcgcgtagcgagtagcgttttttcggcggagttggggcgggggcgcgcggggcgcgcggggcgcgtgggtttgtagtcgcgggatcggggaggggtcggggttcggtcgtcgttttcggggtgcggggcgttagtaggagcgggagcgttgtgggaggatttggattacggaggggtatttggggattttttttcgcggcgagtgagggcgttcgggttcggaatgggtttaattcggggagattggttttcgtttgtttggagcggtggatcggggaatttgcggtttttgtttggttgaatcggcggagtagacggatgagaatttgtggggtgtcggcgcgcgtttatatagtttttaaagtgtgcgtttttttagtagcgcgcgtttagttttttcggtttgtcgggt

SEQ ID NO: 23108 - DNA, 664 bp, Artificial Sequence
  chemically treated genomic DNA (Homo sapiens) CpG-island No: 23108
acccgacaaaccgaaaaaactaaacgcgcgctactaaaaaaacgcacactttaaaaactatataaacgcgcgccgacaccccacaaattctcatccgtctactccgccgattcaaccaaacaaaaaccgcaaattccccgatccaccgctccaaacaaacgaaaaccaatctccccgaattaaacccattccgaacccgaacgccctcactcgccgcgaaaaaaaatccccaaatacccctccgtaatccaaatcctcccacaacgctcccgctcctactaacgccccgcaccccgaaaacgacgaccgaaccccgacccctccccgatcccgcgactacaaacccacgcgccccgcgcgccccgcgcgcccccgccccaactccgccgaaaaaacgctactcgctacgcgataaacccctcgaaccccgcccccgcgaccccgtccgaaccccgatacccacccgaatcccgctacgaaaaccgaattcgcgccgactccgaaaaccgccaccgtcgcctccgccgctaccgccgccaataaaacgcgacgaaacgaaaacgcgcgaaaaaacccgacccccgacccgcccccgaacccgcccccgacccgacccctacctacccccgccgatctccccgcccaccttctaacccaaccctaa

SEQ ID NO: 23109 - DNA, 792 bp, Artificial Sequence
  chemically treated genomic DNA (Homo sapiens) CpG-island No: 23109
attttcgggcgtttagtagttcggggtttttaggtgttcggtaggttttttcgggatttcgagtcgttcgttgggtatacgttgacgtcgttgtcgttttatagaaattgagcgtagtcgaggcgggattcgggcgtagagagcgataaaggaaaagtatggtcgtgttttaattattatagtttaagggacgatacgtcgagacggcgcgcgtttttgcgtgcgtggagatggtataaagatcgcgtcgttttcggcggttttcgttttcgtagcgcgcgtggtttcggttcggtcggatgttgatagcgtcgtttagtaacgggaaatggcggaatcggtcggcgcggcgggtcggtaagtcgggtcgaggggtagcgggttttggagtcgttaggtcgcgtttttcgtttaacgttttaggtggttttcgcgtcggtttttgtttcgttttttcgtttttattttttttttttttcgtttgtgttttttttttcgttattttgttggtttttttcgtttattgcgtttagttttttattttttcgttaattttttttatttttttttttttgtttttttgttttttttcggttttttttttttttttattttaagcgcgcgattttttttaaaattcgggatcgtttattttgtagttattatggtaattattttgcgtggcggtttttgcgcgtagtttttttaagagtagagggttttgtagggcgcggggttgttggatatcgtttttgattttgtttcggggttattcgttgtggtcggagatta

SEQ ID NO: 23110 - DNA, 792 bp, Artificial Sequence
  chemically treated genomic DNA (Homo sapiens) CpG-island No: 23110
taatctccgaccacaacgaataaccccgaaacaaaatcaaaaacgatatccaacaaccccgcgccctacaaaaccctctactcttaaaaaaactacgcgcaaaaaccgccacgcaaaataattaccataataactacaaaataaacgatcccgaattttaaaaaaaatcgcgcgcttaaaataaaaaaaaaaaaaaaaccgaaaaaaaacaaaaaaacaaaaaaaaaaaaataaaaaaaattaacgaaaaaataaaaaactaaacgcaataaacgaaaaaaaccaacaaaataacgaaaaaaaaaacacaaacgaaaaaaaaaaaaaataaaaacgaaaaaacgaaacaaaaaccgacgcgaaaaccacctaaaacgttaaacgaaaaacgcgacctaacgactccaaaacccgctacccctcgacccgacttaccgacccgccgcgccgaccgattccgccatttcccgttactaaacgacgctatcaacatccgaccgaaccgaaaccacgcgcgctacgaaaacgaaaaccgccgaaaacgacgcgatctttataccatctccacgcacgcaaaaacgcgcgccgtctcgacgtatcgtcccttaaactataataattaaaacacgaccatacttttcctttatcgctctctacgcccgaatcccgcctcgactacgctcaatttctataaaacgacaacgacgtcaacgtatacccaacgaacgactcgaaatcccgaaaaaacctaccgaacacctaaaaaccccgaactactaaacgcccgaaaat

SEQ ID NO: 23111 - DNA, 792 bp, Artificial Sequence
  chemically treated genomic DNA (Homo sapiens) CpG-island No: 23111
tggttttcggttatagcgagtggtttcggagtaaggttaggggcggtatttaatagtttcgcgttttgtagagttttttatttttaggaggattgcgcgtagggatcgttacgtagagtggttgttatggtgattgtagagtgagcggtttcgggttttagagggagtcgcgcgtttggagtaggggaaagagggaggtcgagagaggataaagggataggaggggagaagtgagaagggttggcgggggggtgaggggttgaacgtagtggacgggaaaggttagtaaaatggcgagagaagggatataggcgagaggaagggggagtggaggcgaaggggcgaggtaggagtcgacgcgggggttatttggagcgttgaacggagagcgcggtttggcgattttaagattcgttgtttttcggttcggtttatcggttcgtcgcgtcggtcggtttcgttatttttcgttgttaggcgacgttgttaatattcggtcgggtcgggattacgcgcgttgcgagggcgggggtcgtcgggggcggcgcggtttttgtgttatttttacgtacgtagaggcgcgcgtcgtttcgacgtgtcgttttttagattgtaatgattagagtacgattatgttttttttttatcgttttttgcgttcgggtttcgtttcggttgcgtttaatttttgtaaagcgatagcggcgttagcgtgtgtttagcgggcggttcgaggtttcgaagggatttgtcgggtatttggggatttcggattgttaagcgttcgggaat

SEQ ID NO: 23112 - DNA, 792 bp, Artificial Sequence
  chemically treated genomic DNA (Homo sapiens) CpG-island No: 23112
attcccgaacgcttaacaatccgaaatccccaaatacccgacaaatcccttcgaaacctcgaaccgcccgctaaacacacgctaacgccgctatcgctttacaaaaattaaacgcaaccgaaacgaaacccgaacgcaaaaaacgataaaaaaaaaacataatcgtactctaatcattacaatctaaaaaacgacacgtcgaaacgacgcgcgcctctacgtacgtaaaaataacacaaaaaccgcgccgcccccgacgacccccgccctcgcaacgcgcgtaatcccgacccgaccgaatattaacaacgtcgcctaacaacgaaaaataacgaaaccgaccgacgcgacgaaccgataaaccgaaccgaaaaacaacgaatcttaaaatcgccaaaccgcgctctccgttcaacgctccaaataacccccgcgtcgactcctacctcgccccttcgcctccactcccccttcctctcgcctatatcccttctctcgccattttactaacctttcccgtccactacgttcaacccctcacccccccgccaacccttctcacttctcccctcctatccctttatcctctctcgacctccctctttcccctactccaaacgcgcgactccctctaaaacccgaaaccgctcactctacaatcaccataacaaccactctacgtaacgatccctacgcgcaatcctcctaaaaataaaaaactctacaaaacgcgaaactattaaataccgcccctaaccttactccgaaaccactcgctataaccgaaaacca

SEQ ID NO: 23113 - DNA, 643 bp, Artificial Sequence
  chemically treated genomic DNA (Homo sapiens) CpG-island No: 23113
tcgttagatagagtcgtttattattataatcgtttgtagcgacggcgtttagcgtttatgtcgcggcggcgtgatttgtcgggatttttgttcgtcgcgtattcgtagttatcgtcgagcgggcgtcgggtcgggattcgtgagtgtgtatcggcggtcgggttggcgtcgagtttagagcggattagtagtagtttaagcgttgcggtcgtcgttttttcgttgatttcgcggtaagagtcgggttgggcgcgggtcgcgggggcgggagggtcgggtagggtggagggcgagggtttttcggggtttttgttttcgtagacgggtatttacgcggtttttcgcgcgtttttttggtattagggttgtgtcgaggttatcgagtggattcgtagcggtcggagcggagtcggggcggcgtgggggttaaggtatagttgggcgcggaggcggcgcgggtttttttttgggttagcgtgcgtcgcggcgtttttattagggcgggaatcgtcgttttttttagggttgttcgggttgttattcgcgcgtatcgagataattttaggggcgggtggggttagaagttttggtgagattttatggtttttcgtggtcgtttagttttttatcgtaggggaagggg

SEQ ID NO: 23114 - DNA, 643 bp, Artificial Sequence
  chemically treated genomic DNA (Homo sapiens) CpG-island No: 23114
ccccttcccctacgataaaaaactaaacgaccacgaaaaaccataaaatctcaccaaaacttctaaccccacccgcccctaaaattatctcgatacgcgcgaataacaacccgaacaaccctaaaaaaaacgacgattcccgccctaataaaaacgccgcgacgcacgctaacccaaaaaaaaacccgcgccgcctccgcgcccaactataccttaacccccacgccgccccgactccgctccgaccgctacgaatccactcgataacctcgacacaaccctaataccaaaaaaacgcgcgaaaaaccgcgtaaatacccgtctacgaaaacaaaaaccccgaaaaaccctcgccctccaccctacccgaccctcccgcccccgcgacccgcgcccaacccgactcttaccgcgaaatcaacgaaaaaacgacgaccgcaacgcttaaactactactaatccgctctaaactcgacgccaacccgaccgccgatacacactcacgaatcccgacccgacgcccgctcgacgataactacgaatacgcgacgaacaaaaatcccgacaaatcacgccgccgcgacataaacgctaaacgccgtcgctacaaacgattataataataaacgactctatctaacga

SEQ ID NO: 23115 - DNA, 643 bp, Artificial Sequence
  chemically treated genomic DNA (Homo sapiens) CpG-island No: 23115
tttttttttttacgatgagggattaagcggttacggaggattatgaggttttattagagtttttgattttattcgtttttggagttgtttcggtgcgcgcgggtggtagttcgagtagttttagaggaggcggcggttttcgttttggtgaaggcgtcgcggcgtacgttagtttagggaaaagttcgcgtcgttttcgcgtttagttgtgttttggtttttacgtcgtttcgatttcgtttcggtcgttgcgagtttattcggtgatttcggtatagttttggtgttaagagggcgcgcgggaggtcgcgtgggtgttcgtttgcgagggtaggagtttcggggggttttcgttttttattttgttcggttttttcgttttcgcggttcgcgtttagttcggtttttatcgcggggttagcggggaggcggcggtcgtagcgtttgagttgttgttggttcgttttgggttcggcgttagttcggtcgtcggtgtatatttacgggtttcggttcggcgttcgttcggcggtgattgcgggtgcgcggcgggtaagggtttcggtaggttacgtcgtcgcgatatgggcgttggacgtcgtcgttgtagacggttatggtaatgagcggttttgtttagcga

SEQ ID NO: 23116 - DNA, 643 bp, Artificial Sequence
  chemically treated genomic DNA (Homo sapiens) CpG-island No: 23116
tcgctaaacaaaaccgctcattaccataaccgtctacaacgacgacgtccaacgcccatatcgcgacgacgtaacctaccgaaacccttacccgccgcgcacccgcaatcaccgccgaacgaacgccgaaccgaaacccgtaaatatacaccgacgaccgaactaacgccgaacccaaaacgaaccaacaacaactcaaacgctacgaccgccgcctccccgctaaccccgcgataaaaaccgaactaaacgcgaaccgcgaaaacgaaaaaaccgaacaaaataaaaaacgaaaaccccccgaaactcctaccctcgcaaacgaacacccacgcgacctcccgcgcgccctcttaacaccaaaactataccgaaatcaccgaataaactcgcaacgaccgaaacgaaatcgaaacgacgtaaaaaccaaaacacaactaaacgcgaaaacgacgcgaacttttccctaaactaacgtacgccgcgacgccttcaccaaaacgaaaaccgccgcctcctctaaaactactcgaactaccacccgcgcgcaccgaaacaactccaaaaacgaataaaatcaaaaactctaataaaacctcataatcctccgtaaccgcttaatccctcatcgtaaaaaaaaaaa

SEQ ID NO: 23117 - DNA, 555 bp, Artificial Sequence
  chemically treated genomic DNA (Homo sapiens) CpG-island No: 23117
ttatgaggttgtcgtataggggtagtttaggttgcggcggcggttgcgttttttttatggtcggcgtcgtcgtcgacgacgtcgcggatatttttatatttttttttatcggtttttttttaggagtcggcgtttacgatttgttagtttttaggaaagttcggtattaggttcgattcgcgtagtttacgcgcgaattttcgcgttgtcgacgcgttcggcgttattttttttttattcgttttcgtttcgttttagcgttcgtttttttttttttttgggtttcggtcgcgttgttaggtatttgagtttcgtttttttttattttttttttttttttattcgttttgtttattttcgtatatttcgtttcgtcgttttgagtgatttggtcgcgtattagttatagagacggtaggtattcgggggggcgggcggggcggggcgggggcgggaagaatcgggataggttgcgtaggggggattgttgattggacgtgttttcgtgggttttggttaattaacgtgagataagtttgagttttgggtagagag

SEQ ID NO: 23118 - DNA, 555 bp, Artificial Sequence
  chemically treated genomic DNA (Homo sapiens) CpG-island No: 23118
ctctctacccaaaactcaaacttatctcacgttaattaaccaaaacccacgaaaacacgtccaatcaacaatcccccctacgcaacctatcccgattcttcccgcccccgccccgccccgcccgcccccccgaatacctaccgtctctataactaatacgcgaccaaatcactcaaaacgacgaaacgaaatatacgaaaataaacaaaacgaataaaaaaaaaaaaaaaataaaaaaaaacgaaactcaaatacctaacaacgcgaccgaaacccaaaaaaaaaaaaaaacgaacgctaaaacgaaacgaaaacgaataaaaaaaaaataacgccgaacgcgtcgacaacgcgaaaattcgcgcgtaaactacgcgaatcgaacctaataccgaactttcctaaaaactaacaaatcgtaaacgccgactcctaaaaaaaaaccgataaaaaaaaatataaaaatatccgcgacgtcgtcgacgacgacgccgaccataaaaaaaacgcaaccgccgccgcaacctaaactacccctatacgacaacctcataa

SEQ ID NO: 23119 - DNA, 555 bp, Artificial Sequence
  chemically treated genomic DNA (Homo sapiens) CpG-island No: 23119
ttttttatttaaggtttaggtttgttttacgttgattggttagagtttacgagggtacgtttaattagtaattttttttgcgtaatttatttcggtttttttcgttttcgtttcgtttcgttcgttttttcgggtatttatcgtttttgtgattggtgcgcggttaggttatttagggcggcggggcgaggtgtgcgggagtgggtaggacgggtgggaggaggggaggggtgggagaaggcggggtttaggtgtttggtagcgcggtcggggtttaggaaggggagggggcgaacgttggagcgaggcgggggcgggtgaggagggggtgacgtcggacgcgtcgatagcgcgagggttcgcgcgtgagttgcgcgggtcgggtttggtatcgagtttttttgggggttagtaggtcgtggacgtcggtttttggaggagagtcggtaggagggagtgtgaaggtgttcgcggcgtcgtcgacggcggcgtcggttatggaggagacgtagtcgtcgtcgtagtttaagttgtttttgtgcgatagttttatga

SEQ ID NO: 23120 - DNA, 555 bp, Artificial Sequence
  chemically treated genomic DNA (Homo sapiens) CpG-island No: 23120
tcataaaactatcgcacaaaaacaacttaaactacgacgacgactacgtctcctccataaccgacgccgccgtcgacgacgccgcgaacaccttcacactccctcctaccgactctcctccaaaaaccgacgtccacgacctactaacccccaaaaaaactcgataccaaacccgacccgcgcaactcacgcgcgaaccctcgcgctatcgacgcgtccgacgtcaccccctcctcacccgcccccgcctcgctccaacgttcgccccctccccttcctaaaccccgaccgcgctaccaaacacctaaaccccgccttctcccacccctcccctcctcccacccgtcctacccactcccgcacacctcgccccgccgccctaaataacctaaccgcgcaccaatcacaaaaacgataaatacccgaaaaaacgaacgaaacgaaacgaaaacgaaaaaaaccgaaataaattacgcaaaaaaaattactaattaaacgtaccctcgtaaactctaaccaatcaacgtaaaacaaacctaaaccttaaataaaaaa

SEQ ID NO: 23121 - DNA, 1163 bp, Artificial Sequence
  chemically treated genomic DNA (Homo sapiens) CpG-island No: 23121
ggagcgcggcgtggaaaagggtgggcgtgggttaggttttggttggaggtagacgaggtcggcgagttgggcgcggggtcgcggggttatttcggggtatcgggtatagagtcgagaagtttaagttagggaaaatcgaggtcggcgttggcgggaattcgggaggacgtgggggtttcgggtggggtttgtttttttttttcgttcggtttttgagttcgtcgtagtttaggttgacgtcgggtttacgtggggaagtcggcggcgggtttttagcgtcgggagggttcgcggggtttagtttttttttttgttttttttttcgggatcggcgcgcggttttagtttcggcggtttcggcggtttcggcgtttttttggtgttggttgttcgtcgtcgttgtttgttcgttcgttcgttcgttgttgtttggggggtcgggatcgtcgtcgtttttttcgggggagtcggtcggggcggggcggagcggcgagagggggtgtggggggcgggcgaggagggggttgagcgtcgtgggagggagagtaggagcgagcgcgcgagagagcggggtatttttgcgtagttttagcgcgtttcggagttcgtcggggtagtcgtcggatattaggatcgcgagttagatagttttcggaagtcgcgtcgtcgtcgttaggttagtcgtattcgtcgttttttttcgcgtttcggggatttcgtcgcgtcgggtttcgcgtgtgcgtgtggggtggtcgtcgagggcggcgggttcgattttcgatttttgggtattgataggtcggcgggtcggttttaggagtcgcgggtttcggttcgtgtgtgtggggattgtcgcgggtttgtgtgtcggggttttagtttttgggtgtgtgttaggtgtgagcgcgcgtgtgttcgtggattcgtgcgagcggttgttcggtgtgcgcgcgcgtgcgtgtgtgcgtcgggtgtgtatttgtgtgtgcgtgtgtgagggtgtgtgttttgcgtgttttcgcgagtggtgcgtgcgtatttgggtgagggtgcgtgtgtttgcgtgtgtttgtcggtgaatgtatttgtgagagggtgtgttcgaatgtgtagtagtgtgtatatttttgggtgagggcgtgtgttagtggtttcgtttgtgg

SEQ ID NO: 23122 - DNA, 1163 bp, Artificial Sequence
  chemically treated genomic DNA (Homo sapiens) CpG-island No: 23122
ccacaaacgaaaccactaacacacgccctcacccaaaaatatacacactactacacattcgaacacaccctctcacaaatacattcaccgacaaacacacgcaaacacacgcaccctcacccaaatacgcacgcaccactcgcgaaaacacgcaaaacacacaccctcacacacgcacacacaaatacacacccgacgcacacacgcacgcgcgcgcacaccgaacaaccgctcgcacgaatccacgaacacacgcgcgctcacacctaacacacacccaaaaactaaaaccccgacacacaaacccgcgacaatccccacacacacgaaccgaaacccgcgactcctaaaaccgacccgccgacctatcaatacccaaaaatcgaaaatcgaacccgccgccctcgacgaccaccccacacgcacacgcgaaacccgacgcgacgaaatccccgaaacgcgaaaaaaaacgacgaatacgactaacctaacgacgacgacgcgacttccgaaaactatctaactcgcgatcctaatatccgacgactaccccgacgaactccgaaacgcgctaaaactacgcaaaaataccccgctctctcgcgcgctcgctcctactctccctcccacgacgctcaaccccctcctcgcccgccccccacaccccctctcgccgctccgccccgccccgaccgactcccccgaaaaaaacgacgacgatcccgaccccccaaacaacaacgaacgaacgaacgaacaaacaacgacgacgaacaaccaacaccaaaaaaacgccgaaaccgccgaaaccgccgaaactaaaaccgcgcgccgatcccgaaaaaaaaaacaaaaaaaaaaactaaaccccgcgaaccctcccgacgctaaaaacccgccgccgacttccccacgtaaacccgacgtcaacctaaactacgacgaactcaaaaaccgaacgaaaaaaaaaaacaaaccccacccgaaacccccacgtcctcccgaattcccgccaacgccgacctcgattttccctaacttaaacttctcgactctatacccgataccccgaaataaccccgcgaccccgcgcccaactcgccgacctcgtctacctccaaccaaaacctaacccacgcccacccttttccacgccgcgctcc

SEQ ID NO: 23123 - DNA, 1163 bp, Artificial Sequence
  chemically treated genomic DNA (Homo sapiens) CpG-island No: 23123
ttataagcgaagttattggtatacgtttttatttagaggtgtatatattgttatatattcggatatatttttttatagatatatttatcgatagatatacgtagatatacgtatttttatttagatacgtacgtattattcgcgaagatacgtaaggtatatatttttatatacgtatatatagatgtatattcggcgtatatacgtacgcgcgcgtatatcgagtagtcgttcgtacggatttacgggtatacgcgcgtttatatttaatatatatttagagattggagtttcgatatataaattcgcgatagtttttatatatacgaatcgaagttcgcggtttttggagtcggttcgtcggtttgttagtgtttaaagatcgggaatcgagttcgtcgttttcggcggttattttatacgtatacgcgggattcgacgcggcggggttttcgggacgcggagggggacggcgggtgcggttaatttggcggcggcggcgcggttttcgggagttgtttggttcgcggttttggtgttcggcggttgtttcggcgggtttcgaggcgcgttagagttgcgtagaaatgtttcgttttttcgcgcgttcgtttttgtttttttttttacggcgtttagtttttttttcgttcgttttttatattttttttcgtcgtttcgtttcgtttcggtcggttttttcggaggaggcggcggcgatttcggttttttaagtagtagcgggcgggcgaacgagtaagtagcggcggcgagtagttaatattaggggagcgtcggagtcgtcggagtcgtcggagttggggtcgcgcgtcggtttcggggaggggagtagaggaaggggttgagtttcgcgaattttttcggcgttggggattcgtcgtcggtttttttacgtgggttcggcgttaatttgagttgcggcgggtttagaggtcgggcgaagaagaggagtagattttattcggggtttttacgttttttcgggttttcgttagcgtcgatttcgattttttttagtttagatttttcggttttgtgttcggtgtttcggggtaatttcgcggtttcgcgtttagttcgtcgatttcgtttatttttagttaggatttggtttacgtttatttttttttacgtcgcgtttt

SEQ ID NO: 23124 - DNA, 1163 bp, Artificial Sequence
  chemically treated genomic DNA (Homo sapiens) CpG-island No: 23124
aaaacgcgacgtaaaaaaaaataaacgtaaaccaaatcctaactaaaaataaacgaaatcgacgaactaaacgcgaaaccgcgaaattaccccgaaacaccgaacacaaaaccgaaaaatctaaactaaaaaaaatcgaaatcgacgctaacgaaaacccgaaaaaacgtaaaaaccccgaataaaatctactcctcttcttcgcccgacctctaaacccgccgcaactcaaattaacgccgaacccacgtaaaaaaaccgacgacgaatccccaacgccgaaaaaattcgcgaaactcaaccccttcctctactcccctccccgaaaccgacgcgcgaccccaactccgacgactccgacgactccgacgctcccctaatattaactactcgccgccgctacttactcgttcgcccgcccgctactacttaaaaaaccgaaatcgccgccgcctcctccgaaaaaaccgaccgaaacgaaacgaaacgacgaaaaaaaatataaaaaacgaacgaaaaaaaaactaaacgccgtaaaaaaaaaaacaaaaacgaacgcgcgaaaaaacgaaacatttctacgcaactctaacgcgcctcgaaacccgccgaaacaaccgccgaacaccaaaaccgcgaaccaaacaactcccgaaaaccgcgccgccgccgccaaattaaccgcacccgccgtccccctccgcgtcccgaaaaccccgccgcgtcgaatcccgcgtatacgtataaaataaccgccgaaaacgacgaactcgattcccgatctttaaacactaacaaaccgacgaaccgactccaaaaaccgcgaacttcgattcgtatatataaaaactatcgcgaatttatatatcgaaactccaatctctaaatatatattaaatataaacgcgcgtatacccgtaaatccgtacgaacgactactcgatatacgcgcgcgtacgtatatacgccgaatatacatctatatatacgtatataaaaatatataccttacgtatcttcgcgaataatacgtacgtatctaaataaaaatacgtatatctacgtatatctatcgataaatatatctataaaaaaatatatccgaatatataacaatatatacacctctaaataaaaacgtataccaataacttcgcttataa

SEQ ID NO: 23125 - DNA, 596 bp, Artificial Sequence
  chemically treated genomic DNA (Homo sapiens) CpG-island No: 23125
tcggttagcggtcgggtaggcgggtagcgggtagtaggtaggttcgttattcgtcgtttgtcgttcgtcgcgcgagttttagttttttcgtttttagagtaatgtttttggattgataaagttaattatttatttttcgtatataaatcgagcgggaggtcgcgaggcgcgcgttaatggggagttagttggttcgcggttatttgattttcggtcggattgtttattggtcgtcgcgaggttgattggtagcgcggagcggagaatatggtagtcgcggtcgagcgattttcgttgattgggtagtcgtcgggtgtttggtaggtgaggcggcggttgtcgggcggtcgcgagtgggttttatcgggtttgagtggttgcggggaattggggttaggttttagtcggtaaacggcgggacgtcgtcgggattttcgcgggtttttttttatttttcgcgggttttttgtttcgcgaggatcggttttattgttgcgtcgatggaggagacgcggcgtttaacgtttagttttgtttgggttttcgttgttttattattttgagaatatgttttttttgtagttgtagggcgtaga

SEQ ID NO: 23126 - DNA, 596 bp, Artificial Sequence
  chemically treated genomic DNA (Homo sapiens) CpG-island No: 23126
tctacgccctacaactacaaaaaaaacatattctcaaaataataaaacaacgaaaacccaaacaaaactaaacgttaaacgccgcgtctcctccatcgacgcaacaataaaaccgatcctcgcgaaacaaaaaacccgcgaaaaataaaaaaaaacccgcgaaaatcccgacgacgtcccgccgtttaccgactaaaacctaaccccaattccccgcaaccactcaaacccgataaaacccactcgcgaccgcccgacaaccgccgcctcacctaccaaacacccgacgactacccaatcaacgaaaatcgctcgaccgcgactaccatattctccgctccgcgctaccaatcaacctcgcgacgaccaataaacaatccgaccgaaaatcaaataaccgcgaaccaactaactccccattaacgcgcgcctcgcgacctcccgctcgatttatatacgaaaaataaataattaactttatcaatccaaaaacattactctaaaaacgaaaaaactaaaactcgcgcgacgaacgacaaacgacgaataacgaacctacctactacccgctacccgcctacccgaccgctaaccga

SEQ ID NO: 23127 - DNA, 596 bp, Artificial Sequence
  chemically treated genomic DNA (Homo sapiens) CpG-island No: 23127
tttgcgttttgtagttatagaggggatatgtttttaaggtggtgaggtagcgggggtttaagtaggattggacgttgagcgtcgcgttttttttatcggcgtagtagtgggatcgattttcgcggggtaaagagttcgcgaggggtgggggaaagttcgcgagagtttcggcggcgtttcgtcgtttgtcggttggagtttggttttagtttttcgtagttatttaagttcggtggagtttattcgcggtcgttcggtagtcgtcgttttatttgttaggtattcggcggttgtttaattagcgggggtcgttcggtcgcggttgttatgtttttcgtttcgcgttgttaattagtttcgcggcggttaatgggtagttcggtcggaggttaggtgatcgcgggttagttggttttttattggcgcgcgtttcgcggtttttcgttcggtttatgtgcgaggagtgagtgattgattttattagtttaaggatattattttggaggcgaagaggttgggattcgcgcggcgagcggtaagcggcgagtaacgagtttgtttattgttcgttgttcgtttgttcggtcgttagtcgg

SEQ ID NO: 23128 - DNA, 596 bp, Artificial Sequence
  chemically treated genomic DNA (Homo sapiens) CpG-island No: 23128
ccgactaacgaccgaacaaacgaacaacgaacaataaacaaactcgttactcgccgcttaccgctcgccgcgcgaatcccaacctcttcgcctccaaaataatatccttaaactaataaaatcaatcactcactcctcgcacataaaccgaacgaaaaaccgcgaaacgcgcgccaataaaaaaccaactaacccgcgatcacctaacctccgaccgaactacccattaaccgccgcgaaactaattaacaacgcgaaacgaaaaacataacaaccgcgaccgaacgacccccgctaattaaacaaccgccgaatacctaacaaataaaacgacgactaccgaacgaccgcgaataaactccaccgaacttaaataactacgaaaaactaaaaccaaactccaaccgacaaacgacgaaacgccgccgaaactctcgcgaactttcccccacccctcgcgaactctttaccccgcgaaaatcgatcccactactacgccgataaaaaaaacgcgacgctcaacgtccaatcctacttaaacccccgctacctcaccaccttaaaaacatatcccctctataactacaaaacgcaaa

SEQ ID NO: 23129 - DNA, 888 bp, Artificial Sequence
  chemically treated genomic DNA (Homo sapiens) CpG-island No: 23129
ggaagtcgttttcgttatcgttcgtcgttattcgttgggttttcgcggcgtttgaggtcgcgtaaattcggagcgtcggttttcggagttttcgtcggtagcgttttaggaaagttatttaggggaagtttgtttcgttttttatcgcgcgttttttcgggagaggggcgcggttttcgttatttgttaggcgtcgaggtttttcgatcgcgttttttgtttggattttcgttattttcggggtcgcgtatttcgcgggcgttcgtacggttaggcgggttcgtgcgttttttttcgcggtttttcggttgaggcggttttgttttttcgttttcggtattaggattttcgcgcgggttcgacgcgttttattgggattttttttttttcggaaagttagttcgcgcggttagcgtttttcgagttcgggggacggatatgggattttttggtttcgtgggttcgaggtcgatttgcggttattagttcggttttttttcgtttcgttcggttttttcggtcggtcgtagggcgcgcgtttttgttcgggcggtttcgcgttgcgtacgcgcggaggcgtcgattcgttcgttcgcggcgtttttatttatcgttagcgttttttttcgtttcgggcgacgtagtcgttcgtcgttttgttttgtgttcgttttttaggtttcggtcggggtattcggagatttagcgttcggcgggttcggcgggtattcgtacgtagggtacgttttgcgggagcgagcgcgcgtgttcggttatcgggagggagcggagcggtatgggaggtgttttcggaggcggttttggatacggggtatgcgtaatgtttgttttgtttttaagtaggagtgaggggtgggcgggaattcg

SEQ ID NO: 23130 - DNA, 888 bp, Artificial Sequence
  chemically treated genomic DNA (Homo sapiens) CpG-island No: 23130
cgaattcccgcccacccctcactcctacttaaaaacaaaacaaacattacgcataccccgtatccaaaaccgcctccgaaaacacctcccataccgctccgctccctcccgataaccgaacacgcgcgctcgctcccgcaaaacgtaccctacgtacgaatacccgccgaacccgccgaacgctaaatctccgaataccccgaccgaaacctaaaaaacgaacacaaaacaaaacgacgaacgactacgtcgcccgaaacgaaaaaaaacgctaacgataaataaaaacgccgcgaacgaacgaatcgacgcctccgcgcgtacgcaacgcgaaaccgcccgaacaaaaacgcgcgccctacgaccgaccgaaaaaaccgaacgaaacgaaaaaaaaccgaactaataaccgcaaatcgacctcgaacccacgaaaccaaaaaatcccatatccgtcccccgaactcgaaaaacgctaaccgcgcgaactaactttccgaaaaaaaaaaaatcccaataaaacgcgtcgaacccgcgcgaaaatcctaataccgaaaacgaaaaaacaaaaccgcctcaaccgaaaaaccgcgaaaaaaaacgcacgaacccgcctaaccgtacgaacgcccgcgaaatacgcgaccccgaaaataacgaaaatccaaacaaaaaacgcgatcgaaaaacctcgacgcctaacaaataacgaaaaccgcgcccctctcccgaaaaaacgcgcgataaaaaacgaaacaaacttcccctaaataactttcctaaaacgctaccgacgaaaactccgaaaaccgacgctccgaatttacgcgacctcaaacgccgcgaaaacccaacgaataacgacgaacgataacgaaaacgacttcc

SEQ ID NO: 23131 - DNA, 888 bp, Artificial Sequence
  chemically treated genomic DNA (Homo sapiens) CpG-island No: 23131
cgggttttcgtttattttttatttttgtttgaggatagggtagatattgcgtatgtttcgtatttaaggtcgttttcgggagtattttttatgtcgtttcgttttttttcggtgatcgggtacgcgcgttcgttttcgtagagcgtgttttgcgtgcgggtgttcgtcgagttcgtcgggcgttggattttcgagtgtttcggtcggggtttgaggagcgggtatagggtaaggcggcggacggttgcgtcgttcgaggcgaggaggagcgttggcggtgagtgagggcgtcgcgggcgagcgggtcggcgttttcgcgcgtgcgtagcgcgggatcgttcgggtaggggcgcgcgttttgcggtcggtcggaggggtcgagcgaagcgaggagaggtcgggttggtggtcgtaggtcggtttcggatttacgggattagaggattttatattcgtttttcgggttcgagaggcgttggtcgcgcgggttggtttttcgagggggggggggttttagtggggcgcgtcgggttcgcgcggaggttttggtgtcgggggcggaggggtagggtcgttttagtcgaaagatcgcggggaggggcgtacgagttcgtttggtcgtgcggacgttcgcggggtgcgcgatttcggaggtggcggaggtttaggtagggggcgcggtcgggaagtttcggcgtttagtaggtggcgggggtcgcgtttttttttcggggaggcgcgcggtgggaagcggagtaaattttttttaagtaatttttttgaggcgttgtcggcggggatttcggggatcgacgtttcgggtttgcgcggttttaggcgtcgcgggaatttagcgagtggcggcgggcgatggcgggggcggttttt

SEQ ID NO: 23132 - DNA, 888 bp, Artificial Sequence
  chemically treated genomic DNA (Homo sapiens) CpG-island No: 23132
aaaaaccgcccccgccatcgcccgccgccactcgctaaattcccgcgacgcctaaaaccgcgcaaacccgaaacgtcgatccccgaaatccccgccgacaacgcctcaaaaaaattacttaaaaaaaatttactccgcttcccaccgcgcgcctccccgaaaaaaaaacgcgacccccgccacctactaaacgccgaaacttcccgaccgcgccccctacctaaacctccgccacctccgaaatcgcgcaccccgcgaacgtccgcacgaccaaacgaactcgtacgcccctccccgcgatctttcgactaaaacgaccctacccctccgcccccgacaccaaaacctccgcgcgaacccgacgcgccccactaaaaccccccccccctcgaaaaaccaacccgcgcgaccaacgcctctcgaacccgaaaaacgaatataaaatcctctaatcccgtaaatccgaaaccgacctacgaccaccaacccgacctctcctcgcttcgctcgacccctccgaccgaccgcaaaacgcgcgcccctacccgaacgatcccgcgctacgcacgcgcgaaaacgccgacccgctcgcccgcgacgccctcactcaccgccaacgctcctcctcgcctcgaacgacgcaaccgtccgccgccttaccctatacccgctcctcaaaccccgaccgaaacactcgaaaatccaacgcccgacgaactcgacgaacacccgcacgcaaaacacgctctacgaaaacgaacgcgcgtacccgatcaccgaaaaaaaacgaaacgacataaaaaatactcccgaaaacgaccttaaatacgaaacatacgcaatatctaccctatcctcaaacaaaaataaaaaataaacgaaaacccg

SEQ ID NO: 23133 - DNA, 582 bp, Artificial Sequence
  chemically treated genomic DNA (Homo sapiens) CpG-island No: 23133
tcgttttttatttatagcgagcgggtcggttagttgtttggcgtcggggtggtcggggtggtcggggttgggttcggcgtagttcgggagagtttgggcgtcgtcgtcgtcgcgtgagaggtatagagggagggcgttcgagagtcgagagtcgcggcggtttagtcgcgggttggagacgcgttgtgcgcggtagcggagcgcgttgtcgttcgttttagggtttgtcgtcgtcgttgttgtttttttttaggatattttttacgttcgcgattttaggtttagggtgaattttattcgattgggagaaattcgtttgatcgggaggttgtagcgtgcgggaattaatttgacgtgttttttacgttaatttcggtagttacgtcggagacgcgcgagttggtagtttattggttttcgttattgcgttttagcgttttttttttcgttttgaaattttattttttttttttatttttttttttcggtttttttttattattttttcggaatttatttttttatatatatatatatatatatatatatatatatatatatatatacgttttaattttagtt

SEQ ID NO: 23134 - DNA, 582 bp, Artificial Sequence
  chemically treated genomic DNA (Homo sapiens) CpG-island No: 23134
aactaaaattaaaacgtatatatatatatatatatatatatatatatatatatatatataaaaaaataaattccgaaaaaataataaaaaaaaaccgaaaaaaaaaaataaaaaaaaaaaataaaatttcaaaacgaaaaaaaaaacgctaaaacgcaataacgaaaaccaataaactaccaactcgcgcgtctccgacgtaactaccgaaattaacgtaaaaaacacgtcaaattaattcccgcacgctacaacctcccgatcaaacgaatttctcccaatcgaataaaattcaccctaaacctaaaatcgcgaacgtaaaaaatatcctaaaaaaaaacaacaacgacgacgacaaaccctaaaacgaacgacaacgcgctccgctaccgcgcacaacgcgtctccaacccgcgactaaaccgccgcgactctcgactctcgaacgccctccctctatacctctcacgcgacgacgacgacgcccaaactctcccgaactacgccgaacccaaccccgaccaccccgaccaccccgacgccaaacaactaaccgacccgctcgctataaataaaaaacga

SEQ ID NO: 23135 - DNA, 582 bp, Artificial Sequence
  chemically treated genomic DNA (Homo sapiens) CpG-island No: 23135
agttggggttgggacgtgtgtgtgtgtgtgtgtgtgtgtgtgtgtgtgtgtgtgtgtgtagaggggtgggtttcgggggggtggtggaagagggtcgaggggggaggatagaaggagggggtagagttttagggcggggaggggggcgttggggcgtagtgacgggaattaatgagttgttaattcgcgcgttttcggcgtgattgtcgagattgacgtggaggatacgttaaattgattttcgtacgttgtagtttttcggttagacgaattttttttaatcggatgaagtttattttgggtttggggtcgcgggcgtggagagtgttttgggagggggtagtagcggcggcggtaggttttggagcgggcggtagcgcgtttcgttgtcgcgtatagcgcgtttttagttcgcggttgggtcgtcgcggttttcggttttcgggcgttttttttttatgttttttacgcggcggcggcggcgtttaagttttttcggattgcgtcgggtttagtttcggttatttcggttatttcggcgttaggtagttggtcggttcgttcgttatgggtaaggggcgg

SEQ ID NO: 23136 - DNA, 582 bp, Artificial Sequence
  chemically treated genomic DNA (Homo sapiens) CpG-island No: 23136
ccgccccttacccataacgaacgaaccgaccaactacctaacgccgaaataaccgaaataaccgaaactaaacccgacgcaatccgaaaaaacttaaacgccgccgccgccgcgtaaaaaacataaaaaaaaaacgcccgaaaaccgaaaaccgcgacgacccaaccgcgaactaaaaacgcgctatacgcgacaacgaaacgcgctaccgcccgctccaaaacctaccgccgccgctactaccccctcccaaaacactctccacgcccgcgaccccaaacccaaaataaacttcatccgattaaaaaaaattcgtctaaccgaaaaactacaacgtacgaaaatcaatttaacgtatcctccacgtcaatctcgacaatcacgccgaaaacgcgcgaattaacaactcattaattcccgtcactacgccccaacgcccccctccccgccctaaaactctaccccctccttctatcctcccccctcgaccctcttccaccacccccccgaaacccacccctctacacacacacacacacacacacacacacacacacacacacacacgtcccaaccccaact

SEQ ID NO: 23137 - DNA, 665 bp, Artificial Sequence
  chemically treated genomic DNA (Homo sapiens) CpG-island No: 23137
gggcgttcgtgcggagcgcgtttagcgttggagcgcgtttaagaggcgttttgtagtgtggtttcggggtgtgggcggggttcggagaaggttttcgttttgggaggggttgggtttcgcgtttaaatttcgtttcggggcggggcgagggcgacgtagttttttttgttttttgggtcgttgcggacggtggtgcgcgatttcgtttcgggcgcgcgcgttgtgggcggtgtacgtcgtcgtttttcggaagtgcgtgttgtgggcggtgtcgcgcggattttcgggaagtgtttttgtgggcggtcgtcgggttgagttgcggtatacgtgcgacggtcgtgatgaagttcgtttatcgggtgagcgcgggcggcgggcggtttgttggatcggcgcggttttttcggtggacggcgtttgagttggtttcgggcgggttgggggcgcgtggtttgtttttgcggcgtttggtcgcgtgggggtcgtcggttgtttgcgcgttcgtggtttcggggacgcggggttgtggtggggtttttgggagagttgggacggaggcgtcgacggtttttcggagggaatagggatatttgtcggggtttcgggatatttttaatttgagtatggtttaatttaaaggttggagttggtgtagtcgggga

SEQ ID NO: 23138 - DNA, 665 bp, Artificial Sequence
  chemically treated genomic DNA (Homo sapiens) CpG-island No: 23138
tccccgactacaccaactccaacctttaaattaaaccatactcaaattaaaaatatcccgaaaccccgacaaatatccctattccctccgaaaaaccgtcgacgcctccgtcccaactctcccaaaaaccccaccacaaccccgcgtccccgaaaccacgaacgcgcaaacaaccgacgacccccacgcgaccaaacgccgcaaaaacaaaccacgcgcccccaacccgcccgaaaccaactcaaacgccgtccaccgaaaaaaccgcgccgatccaacaaaccgcccgccgcccgcgctcacccgataaacgaacttcatcacgaccgtcgcacgtataccgcaactcaacccgacgaccgcccacaaaaacacttcccgaaaatccgcgcgacaccgcccacaacacgcacttccgaaaaacgacgacgtacaccgcccacaacgcgcgcgcccgaaacgaaatcgcgcaccaccgtccgcaacgacccaaaaaacaaaaaaaactacgtcgccctcgccccgccccgaaacgaaatttaaacgcgaaacccaacccctcccaaaacgaaaaccttctccgaaccccgcccacaccccgaaaccacactacaaaacgcctcttaaacgcgctccaacgctaaacgcgctccgcacgaacgccc

SEQ ID NO: 23139 - DNA, 665 bp, Artificial Sequence
  chemically treated genomic DNA (Homo sapiens) CpG-island No: 23139
ttttcgattgtattaattttagtttttaggttgggttatatttaggttaaaaatatttcgggatttcgataaatgtttttgtttttttcgagaagtcgtcggcgttttcgttttagtttttttaggagttttattatagtttcgcgttttcgaggttacgggcgcgtagatagtcggcgatttttacgcggttagacgtcgtaaaagtagattacgcgtttttagttcgttcggagttagtttaggcgtcgtttatcggaagagtcgcgtcgatttaatagatcgttcgtcgttcgcgtttattcggtaagcgaattttattacggtcgtcgtacgtgtgtcgtagtttaattcggcggtcgtttatagagatatttttcgggggttcgcgcggtatcgtttatagtacgtattttcgggaagcgacggcgtgtatcgtttatagcgcgcgcgttcgggacggggtcgcgtattatcgttcgtagcggtttaggaggtaggaggagttgcgtcgttttcgtttcgtttcgaggcggagtttgaacgcgaggtttaattttttttaaggcgggggtttttttcgggtttcgtttatatttcggagttatattgtagggcgttttttaggcgcgttttagcgttgggcgcgtttcgtacggacgttt

SEQ ID NO: 23140 - DNA, 665 bp, Artificial Sequence
  chemically treated genomic DNA (Homo sapiens) CpG-island No: 23140
aaacgtccgtacgaaacgcgcccaacgctaaaacgcgcctaaaaaacgccctacaatataactccgaaatataaacgaaacccgaaaaaaacccccgccttaaaaaaaattaaacctcgcgttcaaactccgcctcgaaacgaaacgaaaacgacgcaactcctcctacctcctaaaccgctacgaacgataatacgcgaccccgtcccgaacgcgcgcgctataaacgatacacgccgtcgcttcccgaaaatacgtactataaacgataccgcgcgaacccccgaaaaatatctctataaacgaccgccgaattaaactacgacacacgtacgacgaccgtaataaaattcgcttaccgaataaacgcgaacgacgaacgatctattaaatcgacgcgactcttccgataaacgacgcctaaactaactccgaacgaactaaaaacgcgtaatctacttttacgacgtctaaccgcgtaaaaatcgccgactatctacgcgcccgtaacctcgaaaacgcgaaactataataaaactcctaaaaaaactaaaacgaaaacgccgacgacttctcgaaaaaaacaaaaacatttatcgaaatcccgaaatatttttaacctaaatataacccaacctaaaaactaaaattaatacaatcgaaaa

SEQ ID NO: 23141 - DNA, 2005 bp, Artificial Sequence
  chemically treated genomic DNA (Homo sapiens) CpG-island No: 23141
aaatacgtagtagtttcggggtaatgcgcgggtaggaggagtagcgagcgcggggagcgtagggttttttggagagggcgttttatcggttttgcgtttcgtatttgtgtcgttacgtttatcggttttttgttgagtttagtatcgtttatttagatttagtattattcgttcggatcgaatttagtatcgttcgttcggatttagtagcgtttatttggatattgtatcgttcgtttagatttagaatcgttcgttcggatttagtattatttatcggatttagcgtcgtttatttagatttagtatcgttagttcgaatcgaatttagtatcgtttatgggatttatcgttcgttcggatttagtatcgttcgtttagatttagtattgtatttttatttggatttagtatcgttcgtttagattcggattcgttagttcggatcgaatttagtatcgtttatcggattcggcgtcgtttatttagatttagtattatttattcgaatcgaatttagtatcgtttatcggatttatcgttcgtttggatttagtatcgttcgtttggaattagtatcgttcgtttatagatttattattatttatttggatttagtatcgttcgttttcgttcgttcggatcgaacgtagtatcgtttatcggatttagtagcgtttatttagatttagtatcgttcgttcgaatcgaatatagtatcgtttatcggatttattatcgttcgtttagatttagtatcgtttatttggatttagtatcgttcgttcggattttgtatcgcgcgttcggatttaatatagtattatttatcggatttagtattgtttatttagatttagtagcgcgcgttcgaatcgaatttagtatcgttggtcgggaaggaattcggtatcgtcggttgggatttattatcgttagtttagacggaattttagtatcgcgcggggttcgtttttcgatatttttttttttggcggtcgcggtagtagtatttagtggagcggttcggaggtgcggcggcgtcgcgcggggcggcggcgcgtacggcgggcggcggcgcgtacggcggcgggcggggcgcgggcgggtgcgggcggcgggcggcgggcgtcgggcgtatatcggtcggcggggttgaggcggcgcggcgcggcgcggattgagttttaggcggaggttaagtcggaggacgcggcgcggtcgcggaggcggaggtagtcgcggaggcggaggcggtcggcggggggtggcgaggggcgtcgggttttcgcggatttgtcgttttcggttcgtttttcggtttcggtttcgcgcggttgaggaggcgcggttaggattatgtcggcgggcggtcgtgacgaggagcggcggaagttggtcgatattatttattattggaacgttaatcggttggatttgttcgagattagttagtcgatcgaggtgagtatcgtcgggcgcggggtttgcgcgattttcgttcgttgcgtcgcgtttcgtttttttttttcgtcgtcgttcgttagtcgcggattcgttttttttttttttttttttttttcgttttttttttttttttttttttttttaggtttatcgcgggtttcggcgtttttcgtagttttcgtttttttgtcgcggtgtatttcggggtcgcgcgggtcgagcgggggttggcggggcgcggtagttatttgttttttttttcggtcgtttatttggtggtttatttgggtcgtcgtttttattttcgcgagcgcggcgcggtttcggttttattttcggcggcgcggggggcgcggcggcgcgcggggtcggcgttttttatttgtagttcggttgtggttcgcggcgttttttcgtcgtggtcgggatggagtttgtgacgcgcgttgtgtttcgggtttataaatttgtaggttgttagttgggaggggaaagttagtattataaagttcgggaggtgcgggttgtttgatggtat

SEQ ID NO: 23142 - DNA, 2005 bp, Artificial Sequence
  chemically treated genomic DNA (Homo sapiens) CpG-island No: 23142
ataccatcaaacaacccgcacctcccgaactttataatactaactttcccctcccaactaacaacctacaaatttataaacccgaaacacaacgcgcgtcacaaactccatcccgaccacgacgaaaaaacgccgcgaaccacaaccgaactacaaataaaaaacgccgaccccgcgcgccgccgcgccccccgcgccgccgaaaataaaaccgaaaccgcgccgcgctcgcgaaaataaaaacgacgacccaaataaaccaccaaataaacgaccgaaaaaaaaaacaaataactaccgcgccccgccaacccccgctcgacccgcgcgaccccgaaatacaccgcgacaaaaaaacgaaaactacgaaaaacgccgaaacccgcgataaacctaaaaaaaaaaaaaaaaaaaaaaaaaacgaaaaaaaaaaaaaaaaaaaaaaaacgaatccgcgactaacgaacgacgacgaaaaaaaaaaacgaaacgcgacgcaacgaacgaaaatcgcgcaaaccccgcgcccgacgatactcacctcgatcgactaactaatctcgaacaaatccaaccgattaacgttccaataataaataatatcgaccaacttccgccgctcctcgtcacgaccgcccgccgacataatcctaaccgcgcctcctcaaccgcgcgaaaccgaaaccgaaaaacgaaccgaaaacgacaaatccgcgaaaacccgacgcccctcgccaccccccgccgaccgcctccgcctccgcgactacctccgcctccgcgaccgcgccgcgtcctccgacttaacctccgcctaaaactcaatccgcgccgcgccgcgccgcctcaaccccgccgaccgatatacgcccgacgcccgccgcccgccgcccgcacccgcccgcgccccgcccgccgccgtacgcgccgccgcccgccgtacgcgccgccgccccgcgcgacgccgccgcacctccgaaccgctccactaaatactactaccgcgaccgccaaaaaaaaaaatatcgaaaaacgaaccccgcgcgatactaaaattccgtctaaactaacgataataaatcccaaccgacgataccgaattccttcccgaccaacgatactaaattcgattcgaacgcgcgctactaaatctaaataaacaatactaaatccgataaataatactatattaaatccgaacgcgcgatacaaaatccgaacgaacgatactaaatccaaataaacgatactaaatctaaacgaacgataataaatccgataaacgatactatattcgattcgaacgaacgatactaaatctaaataaacgctactaaatccgataaacgatactacgttcgatccgaacgaacgaaaacgaacgatactaaatccaaataaataataataaatctataaacgaacgatactaattccaaacgaacgatactaaatccaaacgaacgataaatccgataaacgatactaaattcgattcgaataaataatactaaatctaaataaacgacgccgaatccgataaacgatactaaattcgatccgaactaacgaatccgaatctaaacgaacgatactaaatccaaataaaaatacaatactaaatctaaacgaacgatactaaatccgaacgaacgataaatcccataaacgatactaaattcgattcgaactaacgatactaaatctaaataaacgacgctaaatccgataaataatactaaatccgaacgaacgattctaaatctaaacgaacgatacaatatccaaataaacgctactaaatccgaacgaacgatactaaattcgatccgaacgaataatactaaatctaaataaacgatactaaactcaacaaaaaaccgataaacgtaacgacacaaatacgaaacgcaaaaccgataaaacgccctctccaaaaaaccctacgctccccgcgctcgctactcctcctacccgcgcattaccccgaaactactacgtattt

SEQ ID NO: 23143 - DNA, 2005 bp, Artificial Sequence
  chemically treated genomic DNA (Homo sapiens) CpG-island No: 23143
gtgttattaggtagttcgtatttttcgaattttgtgatattgattttttttttttagttggtagtttgtaagtttatgaattcgaagtatagcgcgcgttataggttttatttcggttacggcgaaggggcgtcgcgagttataatcgggttgtaggtggagggcgtcggtttcgcgcgtcgtcgcgtttttcgcgtcgtcggggatgaggtcggggtcgcgtcgcgttcgcgggggtgggggcggcggtttaggtgagttattaggtgagcggtcggagaggggaataagtgattgtcgcgtttcgttagttttcgttcggttcgcgcgatttcgggatatatcgcggtagggggacgggggttgcgggggacgtcggggttcgcggtgggtttgggggagggggaggggagagaaggggcggagggggggagggggaaaggagggcgggttcgcggttggcgggcggcggcgggggggaggggcggggcgcggcgtagcgggcgggggtcgcgtaggtttcgcgttcggcggtgtttatttcggtcggttggttgatttcgaataggtttagtcggttggcgttttagtggtggatgatgtcggttagttttcgtcgtttttcgttacggtcgttcgtcgatatggttttggtcgcgtttttttagtcgcgcggggtcggggtcggaggacgggtcgaggacgataggttcgcgggggttcggcgtttttcgttatttttcgtcggtcgttttcgttttcgcggttgttttcgttttcgcggtcgcgtcgcgtttttcgatttggttttcgtttggggtttagttcgcgtcgcgtcgcgtcgttttagtttcgtcggtcggtgtgcgttcggcgttcgtcgttcgtcgttcgtattcgttcgcgtttcgttcgtcgtcgtgcgcgtcgtcgttcgtcgtgcgcgtcgtcgtttcgcgcggcgtcgtcgtattttcgggtcgttttattaggtgttgttgtcgcggtcgttagggagggaggtgtcggagggcgggtttcgcgcggtgttagggtttcgtttggattggcggtggtgggttttaatcggcggtatcgggttttttttcgattagcggtgttaggttcggttcggacgcgcgttgttggatttaaatgggtagtgttgggttcgatgggtggtgttgtgttgggttcggacgcgcggtgtagagttcggacgggcggtgttggatttaaatgggcggtgttggatttggacgggcggtgatgggttcgatgggcggtgttatgttcggttcggacgggcggtgttaggtttaaatgggcgttgttgggttcgatgggcggtgttgcgttcggttcggacgggcggggacgggcggtgttgggtttaaatgggtggtgatggatttgtggacgggcggtgttggttttagacgggcggtgttgggtttagacgggcggtgggttcgatgggcggtgttaggttcggttcggatgggtggtgttaggtttaaatgggcggcgtcggattcgatgggcggtgttgggttcggttcggattggcgggttcgggtttggacgggcggtgttggatttaaatgggggtgtagtgttggatttggacgggcggtgttgggttcgaacgggcgatgggttttatgggcggtgttaggttcggttcggattggcggtgttgggtttaaatgggcggcgttgggttcgatgggtggtattgggttcggacgggcggttttgggtttggacgggcggtgtagtatttaaatgggcgttgttgggttcggacgggcggtgttaggttcggttcggacgggtggtgttgggtttaaatgggcggtgttaggtttagtaggggatcggtgggcgtggcggtataggtacggagcgtagggtcggtggagcgttttttttaaagggttttgcgtttttcgcgttcgttgttttttttgttcgcgtattgtttcggggttgttgcgtgttt

SEQ ID NO: 23144 - DNA, 2005 bp, Artificial Sequence
  chemically treated genomic DNA (Homo sapiens) CpG-island No: 23144
aaacacgcaacaaccccgaaacaatacgcgaacaaaaaaaacaacgaacgcgaaaaacgcaaaaccctttaaaaaaaacgctccaccgaccctacgctccgtacctataccgccacgcccaccgatcccctactaaacctaacaccgcccatttaaacccaacaccacccgtccgaaccgaacctaacaccgcccgtccgaacccaacaacgcccatttaaatactacaccgcccgtccaaacccaaaaccgcccgtccgaacccaataccacccatcgaacccaacgccgcccatttaaacccaacaccgccaatccgaaccgaacctaacaccgcccataaaacccatcgcccgttcgaacccaacaccgcccgtccaaatccaacactacacccccatttaaatccaacaccgcccgtccaaacccgaacccgccaatccgaaccgaacccaacaccgcccatcgaatccgacgccgcccatttaaacctaacaccacccatccgaaccgaacctaacaccgcccatcgaacccaccgcccgtctaaacccaacaccgcccgtctaaaaccaacaccgcccgtccacaaatccatcaccacccatttaaacccaacaccgcccgtccccgcccgtccgaaccgaacgcaacaccgcccatcgaacccaacaacgcccatttaaacctaacaccgcccgtccgaaccgaacataacaccgcccatcgaacccatcaccgcccgtccaaatccaacaccgcccatttaaatccaacaccgcccgtccgaactctacaccgcgcgtccgaacccaacacaacaccacccatcgaacccaacactacccatttaaatccaacaacgcgcgtccgaaccgaacctaacaccgctaatcgaaaaaaaacccgataccgccgattaaaacccaccaccgccaatccaaacgaaaccctaacaccgcgcgaaacccgccctccgacacctccctccctaacgaccgcgacaacaacacctaataaaacgacccgaaaatacgacgacgccgcgcgaaacgacgacgcgcacgacgaacgacgacgcgcacgacgacgaacgaaacgcgaacgaatacgaacgacgaacgacgaacgccgaacgcacaccgaccgacgaaactaaaacgacgcgacgcgacgcgaactaaaccccaaacgaaaaccaaatcgaaaaacgcgacgcgaccgcgaaaacgaaaacaaccgcgaaaacgaaaacgaccgacgaaaaataacgaaaaacgccgaacccccgcgaacctatcgtcctcgacccgtcctccgaccccgaccccgcgcgactaaaaaaacgcgaccaaaaccatatcgacgaacgaccgtaacgaaaaacgacgaaaactaaccgacatcatccaccactaaaacgccaaccgactaaacctattcgaaatcaaccaaccgaccgaaataaacaccgccgaacgcgaaacctacgcgacccccgcccgctacgccgcgccccgcccctcccccccgccgccgcccgccaaccgcgaacccgccctcctttccccctccccccctccgccccttctctcccctccccctcccccaaacccaccgcgaaccccgacgtcccccgcaacccccgtccccctaccgcgatatatcccgaaatcgcgcgaaccgaacgaaaactaacgaaacgcgacaatcacttattcccctctccgaccgctcacctaataactcacctaaaccgccgcccccacccccgcgaacgcgacgcgaccccgacctcatccccgacgacgcgaaaaacgcgacgacgcgcgaaaccgacgccctccacctacaacccgattataactcgcgacgccccttcgccgtaaccgaaataaaacctataacgcgcgctatacttcgaattcataaacttacaaactaccaactaaaaaaaaaaaatcaatatcacaaaattcgaaaaatacgaactacctaataacac

SEQ ID NO: 23145 - DNA, 589 bp, Artificial Sequence
  chemically treated genomic DNA (Homo sapiens) CpG-island No: 23145
tcggtttcgtttcgggttttttcggaaggatggttagttcggaggagggatattatttgaggaaagaatttttaggttcgtaaagagtgatcgttttttagaggagagcggatcgattattgtgttagcgttttaaaagttaatatttgagtttttagtttttgatttcggggttaggtaggtcggatgtgatttcgttttcggtgagaggggagcggttttgacgagggcgttgagtttttagtttttgatttcggggttaggtaggtcggatgtgatttcgttttcggtgagaggggagcggttttgacgagggcgttgagtttttagtttttgatttcggggttaggtaggtcggatgtgatttcgttttcggtgagaggggagcggttttgacgagggcgttgagtttttagtttttgatttcggggttaggtaggtcggatgtgatttcgttttcggtgagaggggagcggttttgacgagggcgttttttttttgatttagtttattattttaggatgttagtgggttgagttttcgtttttcggtaggcgttttcgtattttggtttgggtgggaagtggtt

SEQ ID NO: 23146 - DNA, 589 bp, Artificial Sequence
  chemically treated genomic DNA (Homo sapiens) CpG-island No: 23146
aaccacttcccacccaaaccaaaatacgaaaacgcctaccgaaaaacgaaaactcaacccactaacatcctaaaataataaactaaatcaaaaaaaaaacgccctcgtcaaaaccgctcccctctcaccgaaaacgaaatcacatccgacctacctaaccccgaaatcaaaaactaaaaactcaacgccctcgtcaaaaccgctcccctctcaccgaaaacgaaatcacatccgacctacctaaccccgaaatcaaaaactaaaaactcaacgccctcgtcaaaaccgctcccctctcaccgaaaacgaaatcacatccgacctacctaaccccgaaatcaaaaactaaaaactcaacgccctcgtcaaaaccgctcccctctcaccgaaaacgaaatcacatccgacctacctaaccccgaaatcaaaaactaaaaactcaaatattaacttttaaaacgctaacacaataatcgatccgctctcctctaaaaaacgatcactctttacgaacctaaaaattctttcctcaaataatatccctcctccgaactaaccatccttccgaaaaaacccgaaacgaaaccga

SEQ ID NO: 23147 - DNA, 589 bp, Artificial Sequence
  chemically treated genomic DNA (Homo sapiens) CpG-island No: 23147
gattattttttatttaaattaagatacgaaggcgtttatcggaaaacgaaggtttaatttattagtattttagagtaatgggttgagttaaaagagggacgttttcgttagggtcgttttttttttatcggaaacgaagttatattcgatttatttgatttcggggttagaagttgaggatttagcgttttcgttagggtcgttttttttttatcggaaacgaagttatattcgatttatttgatttcggggttagaagttgaggatttagcgttttcgttagggtcgttttttttttatcggaaacgaagttatattcgatttatttgatttcggggttagaagttgaggatttagcgttttcgttagggtcgttttttttttatcggaaacgaagttatattcgatttatttgatttcggggttagaagttgaggatttagatgttgatttttagggcgttgatatagtggtcgattcgtttttttttggaaggcggttattttttgcggatttgaaaattttttttttaggtggtgtttttttttcgagttggttattttttcgggggagttcggagcgagatcgg

SEQ ID NO: 23148 - DNA, 589 bp, Artificial Sequence
  chemically treated genomic DNA (Homo sapiens) CpG-island No: 23148
ccgatctcgctccgaactcccccgaaaaaataaccaactcgaaaaaaaaacaccacctaaaaaaaaaattttcaaatccgcaaaaaataaccgccttccaaaaaaaaacgaatcgaccactatatcaacgccctaaaaatcaacatctaaatcctcaacttctaaccccgaaatcaaataaatcgaatataacttcgtttccgataaaaaaaaaacgaccctaacgaaaacgctaaatcctcaacttctaaccccgaaatcaaataaatcgaatataacttcgtttccgataaaaaaaaaacgaccctaacgaaaacgctaaatcctcaacttctaaccccgaaatcaaataaatcgaatataacttcgtttccgataaaaaaaaaacgaccctaacgaaaacgctaaatcctcaacttctaaccccgaaatcaaataaatcgaatataacttcgtttccgataaaaaaaaaacgaccctaacgaaaacgtccctcttttaactcaacccattactctaaaatactaataaattaaaccttcgttttccgataaacgccttcgtatcttaatttaaataaaaaataatc

SEQ ID NO: 23149 - DNA, 1427 bp, Artificial Sequence
  chemically treated genomic DNA (Homo sapiens) CpG-island No: 23149
tttcgttgtgtatttttgtttttttcgaaagttcgagtagtaaagggaggttttttgcggttttcgcgggtttttagggattcgtaagttgaagcgcgagggttttacgcgggttgcggggacgcgggtttcggtgttgtagatttttttagggcgtttgggtcgcggtaggcgcggagtttcgcgcgtaatagttgtttcgtcggtttcgttttcgattttcgttttgcgttaagcgcggaagcgttcgcgatttaattgtttcgggtgtcgggcgtttagggaggggtcgttatcgttcgtttcgtttcgggggtttgcgtttagtagttttcgttttttcggaatttagaggtcgagtcggaggcggcggggttacggtgggagttcgcgaggtggttcgagcgagggtttcgtattttcgtagagttcgttcgagggcgtagtttgttacgttaggggaggcggtcgggcggcggggaacggcgggggcggagcgtagtttttcgacgtcgtcgttttagcgttttttttcgttttttcggttttcgttcgtagtcgtcgttttcgttttcgtcgggttgaggagtcgggagttcgtcgcgtcggttcggggttgcgggatggggagttagcgttacggcggcggtagtggtcgtagcgtatttcgtcgtcgtttaggagttcgtttagttaggggtgtcgggttcgtttagttcgtttcggagttaggttcgcgggcggcggcggagttgggtaggtggatgcggttggaagatggcgttttcgggttcgggtagtagcgttaggcggcggtgtcggcgggtgttgtattggatttcggtggtgtttattatttttttgttcggttggttttattacgtttacgttatttagttgtgtataggtgagtgcgtttttcgtcgcggcgtttttagcgtagcgtagtttatttcgattgtttcgggacgtttagtcgttttttcgttttcgtttttcggatgcgtttcgggcgttgttaatttgtcgcgtttcgtcggtttcgtcgttaaaagtagtttcggggtagttttttttacgcgtacgtttttcgttttttttttttaattttcgggttaaggtggcgtttacgtttcgtattcgtcgtcgagtttttcgtcgtttttcgtttatcgtcgtcgtttcggttatattttttagaggggcggaaggttttcgggatcgttgtggagaggggaggtcgaggtcggcgaggcgcgtcgggggttgaagggttgagttgggttcggtttcgagttgcgttagattcgcgcgggggtgttgggttttggcggcggagttggattttttgttggttggcgttaatgtatttgttaaaaatttgtgatagcgtttaggggcgtttttgttgtttttatgatttgagg

SEQ ID NO: 23150 - DNA, 1427 bp, Artificial Sequence
  chemically treated genomic DNA (Homo sapiens) CpG-island No: 23150
cctcaaatcataaaaacaacaaaaacgcccctaaacgctatcacaaatttttaacaaatacattaacgccaaccaacaaaaaatccaactccgccgccaaaacccaacacccccgcgcgaatctaacgcaactcgaaaccgaacccaactcaacccttcaacccccgacgcgcctcgccgacctcgacctcccctctccacaacgatcccgaaaaccttccgcccctctaaaaaatataaccgaaacgacgacgataaacgaaaaacgacgaaaaactcgacgacgaatacgaaacgtaaacgccaccttaacccgaaaattaaaaaaaaaaaacgaaaaacgtacgcgtaaaaaaaactaccccgaaactacttttaacgacgaaaccgacgaaacgcgacaaattaacaacgcccgaaacgcatccgaaaaacgaaaacgaaaaaacgactaaacgtcccgaaacaatcgaaataaactacgctacgctaaaaacgccgcgacgaaaaacgcactcacctatacacaactaaataacgtaaacgtaataaaaccaaccgaacaaaaaaataataaacaccaccgaaatccaatacaacacccgccgacaccgccgcctaacgctactacccgaacccgaaaacgccatcttccaaccgcatccacctacccaactccgccgccgcccgcgaacctaactccgaaacgaactaaacgaacccgacacccctaactaaacgaactcctaaacgacgacgaaatacgctacgaccactaccgccgccgtaacgctaactccccatcccgcaaccccgaaccgacgcgacgaactcccgactcctcaacccgacgaaaacgaaaacgacgactacgaacgaaaaccgaaaaaacgaaaaaaaacgctaaaacgacgacgtcgaaaaactacgctccgcccccgccgttccccgccgcccgaccgcctcccctaacgtaacaaactacgccctcgaacgaactctacgaaaatacgaaaccctcgctcgaaccacctcgcgaactcccaccgtaaccccgccgcctccgactcgacctctaaattccgaaaaaacgaaaactactaaacgcaaacccccgaaacgaaacgaacgataacgacccctccctaaacgcccgacacccgaaacaattaaatcgcgaacgcttccgcgcttaacgcaaaacgaaaatcgaaaacgaaaccgacgaaacaactattacgcgcgaaactccgcgcctaccgcgacccaaacgccctaaaaaaatctacaacaccgaaacccgcgtccccgcaacccgcgtaaaaccctcgcgcttcaacttacgaatccctaaaaacccgcgaaaaccgcaaaaaacctccctttactactcgaactttcgaaaaaaacaaaaatacacaacgaaa

SEQ ID NO: 23151 - DNA, 1427 bp, Artificial Sequence
  chemically treated genomic DNA (Homo sapiens) CpG-island No: 23151
ttttaaattataaaggtagtaaaaacgtttttgagcgttgttataaatttttaataagtgtattgacgttaattagtaagggatttagtttcgtcgttaaggtttagtattttcgcgcgggtttggcgtagttcggggtcgggtttagtttagttttttagttttcggcgcgtttcgtcggtttcggttttttttttttatagcggtttcggggatttttcgtttttttagggggtgtggtcggggcggcggcggtgagcggaaggcggcgggaggttcggcggcgagtgcggggcgtaggcgttattttaattcgagagttgggaggggagggcgaggggcgtgcgcgtggaaaaagttgtttcgaggttgtttttagcggcggagtcggcgggacgcggtaggttggtagcgttcggggcgtattcggggggcgagagcggaggagcggttgagcgtttcgggatagtcggggtgggttgcgttgcgttgggggcgtcgcggcggggggcgtatttatttatgtatagttggatggcgtaggcgtagtaggattagtcgagtaggagggtgatgaatattatcgggatttagtatagtattcgtcggtatcgtcgtttggcgttgttgttcgggttcgagggcgttattttttagtcgtatttatttgtttagtttcgtcgtcgttcgcgggtttggtttcggggcgggttgggcgggttcggtatttttggttggacgggtttttgggcggcggcggggtgcgttgcggttattgtcgtcgtcgtggcgttaattttttatttcgtagtttcgagtcggcgcggcggattttcggttttttagttcggcggaggcggaggcggcggttgcgagcggaggtcgaggaggcggagaggaacgttgaggcggcggcgtcgggagattgcgtttcgttttcgtcgtttttcgtcgttcggtcgttttttttggcgtggtaggttgcgttttcgggcgggttttgcggggatgcggggttttcgttcgggttatttcgcgggtttttatcgtggtttcgtcgttttcggttcggtttttggatttcggggaggcgggggttgttgggcgtaggttttcggggcggagcgggcggtggcggtttttttttaggcgttcggtattcggggtagttaggtcgcgagcgttttcgcgtttggcgtagggcgggggtcggaggcgaggtcggcggagtagttgttgcgcgcgggatttcgcgtttgtcgcgatttaggcgttttgagaaagtttgtagtatcgaggttcgcgttttcgtagttcgcgtggaattttcgcgttttaatttgcgggtttttgggagttcgcgggggtcgtaaggagtttttttttattattcgggttttcgggggaagtagaaatgtatagcgaag

SEQ ID NO: 23152 - DNA, 1427 bp, Artificial Sequence
  chemically treated genomic DNA (Homo sapiens) CpG-island No: 23152
cttcgctatacatttctacttcccccgaaaacccgaataataaaaaaaaactccttacgacccccgcgaactcccaaaaacccgcaaattaaaacgcgaaaattccacgcgaactacgaaaacgcgaacctcgatactacaaactttctcaaaacgcctaaatcgcgacaaacgcgaaatcccgcgcgcaacaactactccgccgacctcgcctccgacccccgccctacgccaaacgcgaaaacgctcgcgacctaactaccccgaataccgaacgcctaaaaaaaaaccgccaccgcccgctccgccccgaaaacctacgcccaacaacccccgcctccccgaaatccaaaaaccgaaccgaaaacgacgaaaccacgataaaaacccgcgaaataacccgaacgaaaaccccgcatccccgcaaaacccgcccgaaaacgcaacctaccacgccaaaaaaaacgaccgaacgacgaaaaacgacgaaaacgaaacgcaatctcccgacgccgccgcctcaacgttcctctccgcctcctcgacctccgctcgcaaccgccgcctccgcctccgccgaactaaaaaaccgaaaatccgccgcgccgactcgaaactacgaaataaaaaattaacgccacgacgacgacaataaccgcaacgcaccccgccgccgcccaaaaacccgtccaaccaaaaataccgaacccgcccaacccgccccgaaaccaaacccgcgaacgacgacgaaactaaacaaataaatacgactaaaaaataacgccctcgaacccgaacaacaacgccaaacgacgataccgacgaatactatactaaatcccgataatattcatcaccctcctactcgactaatcctactacgcctacgccatccaactatacataaataaatacgccccccgccgcgacgcccccaacgcaacgcaacccaccccgactatcccgaaacgctcaaccgctcctccgctctcgccccccgaatacgccccgaacgctaccaacctaccgcgtcccgccgactccgccgctaaaaacaacctcgaaacaactttttccacgcgcacgcccctcgccctcccctcccaactctcgaattaaaataacgcctacgccccgcactcgccgccgaacctcccgccgccttccgctcaccgccgccgccccgaccacaccccctaaaaaaacgaaaaatccccgaaaccgctataaaaaaaaaaaaccgaaaccgacgaaacgcgccgaaaactaaaaaactaaactaaacccgaccccgaactacgccaaacccgcgcgaaaatactaaaccttaacgacgaaactaaatcccttactaattaacgtcaatacacttattaaaaatttataacaacgctcaaaaacgtttttactacctttataatttaaaa

SEQ ID NO: 23153 - DNA, 610 bp, Artificial Sequence
  chemically treated genomic DNA (Homo sapiens) CpG-island No: 23153
attttcgttttattgcgaagttttaggtataaagtttttgcgttagttattacgcgttaattttttgataaatttttagttttagttatttagtttttaattcgtcgttaggttttttttttcgttagtcgtattttagttggcgttatcgcgtatttttttaggtttatcgttttcgttttttttttatttttttaattcgttttttttttcgtaaggttgtagcggatgtaagatttatttgtgtcgttgagttcgcgtttttttttttttttttcgttatagagatagtattcggcggcggtggcggtggcggtggcggtagcggcggcggtagcgggtgttttatagatatttttcgtttagcgaagggaaaggcgagtaggagttgcgtcgtatcgtgttgcgtcgtcgtttttcgtacgttttgacgggggcgttagatgatgacgcgatacgtagagggggcggagagcgttttcgggggcggggtacgtaagtgacggcggcgcgggtggtggagcgttgggcggttaggttttttggttggtcggtttgggcgtttgggtcgtgaaggtgggattttttgtttcgggtcgtaagttttttt

SEQ ID NO: 23154 - DNA, 610 bp, Artificial Sequence
  chemically treated genomic DNA (Homo sapiens) CpG-island No: 23154
aaaaaaacttacgacccgaaacaaaaaatcccaccttcacgacccaaacgcccaaaccgaccaaccaaaaaacctaaccgcccaacgctccaccacccgcgccgccgtcacttacgtaccccgcccccgaaaacgctctccgccccctctacgtatcgcgtcatcatctaacgcccccgtcaaaacgtacgaaaaacgacgacgcaacacgatacgacgcaactcctactcgcctttcccttcgctaaacgaaaaatatctataaaacacccgctaccgccgccgctaccgccaccgccaccgccaccgccgccgaatactatctctataacgaaaaaaaaaaaaaaaaacgcgaactcaacgacacaaataaatcttacatccgctacaaccttacgaaaaaaaaaacgaattaaaaaaataaaaaaaaaacgaaaacgataaacctaaaaaaatacgcgataacgccaactaaaatacgactaacgaaaaaaaaaacctaacgacgaattaaaaactaaataactaaaactaaaaatttatcaaaaaattaacgcgtaataactaacgcaaaaactttatacctaaaacttcgcaataaaacgaaaat

SEQ ID NO: 23155 - DNA, 610 bp, Artificial Sequence
  chemically treated genomic DNA (Homo sapiens) CpG-island No: 23155
agggaaatttgcggttcggaataggaggttttatttttacggtttagacgtttaaatcggttagttagggagtttggtcgtttagcgttttattattcgcgtcgtcgttatttgcgtgtttcgttttcgggggcgtttttcgttttttttgcgtgtcgcgttattatttagcgttttcgttaggacgtgcgaaaagcgacggcgtagtacggtgcggcgtagtttttgttcgttttttttttcgttgggcgagaggtgtttatggggtattcgttgtcgtcgtcgttatcgttatcgttatcgttatcgtcgtcgagtgttgtttttatggcgaggaggaggaggaggagcgcgagtttagcgatataagtagattttgtattcgttgtagttttacggggggaggggcgggttagggaagtagaaagggggcggggacgatgaatttgagagggtgcgcgatggcgttagttggagtgcggttggcggaggaaggagtttggcggcggattgggggttgggtaattggggttgggggtttgttaaggggttggcgcgtagtgattgacgtaaaggttttgtatttggggtttcgtagtgggacggaaat

SEQ ID NO: 23156 - DNA, 610 bp, Artificial Sequence
  chemically treated genomic DNA (Homo sapiens) CpG-island No: 23156
atttccgtcccactacgaaaccccaaatacaaaacctttacgtcaatcactacgcgccaaccccttaacaaacccccaaccccaattacccaacccccaatccgccgccaaactccttcctccgccaaccgcactccaactaacgccatcgcgcaccctctcaaattcatcgtccccgccccctttctacttccctaacccgcccctccccccgtaaaactacaacgaatacaaaatctacttatatcgctaaactcgcgctcctcctcctcctcctcgccataaaaacaacactcgacgacgataacgataacgataacgataacgacgacgacaacgaataccccataaacacctctcgcccaacgaaaaaaaaaacgaacaaaaactacgccgcaccgtactacgccgtcgcttttcgcacgtcctaacgaaaacgctaaataataacgcgacacgcaaaaaaaacgaaaaacgcccccgaaaacgaaacacgcaaataacgacgacgcgaataataaaacgctaaacgaccaaactccctaactaaccgatttaaacgtctaaaccgtaaaaataaaacctcctattccgaaccgcaaatttccct

SEQ ID NO: 23157 - DNA, 858 bp, Artificial Sequence
  chemically treated genomic DNA (Homo sapiens) CpG-island No: 23157
ttttcgcgcgtagtttttttttttcggttcgcgtttatcggtttagttcggggttagcgttcgtttacgtgtgttcggttttaggtaaatttcgttgagtagcggtcgtatatcgtttatttcggggattggttagcgcggtcggggttcggcgggaggcgggttcggggtcgcgtttcgggagcgcggaggaggcggtgtcgttcggtttcgcgtttcgttttcgtttcgggtggttatatagaggggcgtttacgtgtttagttttttttttgtagcgcggtcggcgggcgttttttttttcgggattagcgaggcggcggtcgttgttttagcgttttttagtcgcgggttttcgacgcgttgtagtcggtagtttatcgtcgtttttttggcgcgattttaatttagttttagtaagttgttaggtttttagtttcgtcgagagttcgcgggcgaggggtagttcggacgttggggtcggcggggaaggagcggggcgagggcgttttggggtcggcggggaattagagggtcgagggttttcggggacgagtttagttgcgcgtagttgttttgaggtcgcgttttagcgagttttcgttagggagtcggggtcgtgggttggggttgaagtcgtggattttcgttttcggggttgcgtttcggaatgcgtttcgtttcgttcggtttttgtgtagtcggttttgttcggggatttcggggatcgttggaattgggagaggggttggtacggcgatttcgcggggattttttagttattatttttagaggagttcggcgtattttttttcgggtgggtaggttgaattttttggttttgtacgttgtcggggt

SEQ ID NO: 23158 - DNA, 858 bp, Artificial Sequence
  chemically treated genomic DNA (Homo sapiens) CpG-island No: 23158
accccgacaacgtacaaaaccaaaaaattcaacctacccacccgaaaaaaaatacgccgaactcctctaaaaataataactaaaaaatccccgcgaaatcgccgtaccaacccctctcccaattccaacgatccccgaaatccccgaacaaaaccgactacacaaaaaccgaacgaaacgaaacgcattccgaaacgcaaccccgaaaacgaaaatccacgacttcaaccccaacccacgaccccgactccctaacgaaaactcgctaaaacgcgacctcaaaacaactacgcgcaactaaactcgtccccgaaaaccctcgaccctctaattccccgccgaccccaaaacgccctcgccccgctccttccccgccgaccccaacgtccgaactacccctcgcccgcgaactctcgacgaaactaaaaacctaacaacttactaaaactaaattaaaatcgcgccaaaaaaacgacgataaactaccgactacaacgcgtcgaaaacccgcgactaaaaaacgctaaaacaacgaccgccgcctcgctaatcccgaaaaaaaaaacgcccgccgaccgcgctacaaaaaaaaaactaaacacgtaaacgcccctctatataaccacccgaaacgaaaacgaaacgcgaaaccgaacgacaccgcctcctccgcgctcccgaaacgcgaccccgaacccgcctcccgccgaaccccgaccgcgctaaccaatccccgaaataaacgatatacgaccgctactcaacgaaatttacctaaaaccgaacacacgtaaacgaacgctaaccccgaactaaaccgataaacgcgaaccgaaaaaaaaaaactacgcgcgaaaa

SEQ ID NO: 23159 - DNA, 858 bp, Artificial Sequence
  chemically treated genomic DNA (Homo sapiens) CpG-island No: 23159
atttcggtagcgtgtagggttaggaggtttagtttgtttattcggagaggggtgcgtcgagtttttttggaaatagtgattgaagggttttcgcgaagtcgtcgtgttagttttttttttagttttagcggttttcgaagttttcgggtagagtcggttgtatagggatcggacgaggcgaggcgtatttcggggcgtagtttcgaggacgaaggtttacggttttagttttagtttacggtttcgattttttgacgaagattcgttggagcgcggttttagggtagttgcgcgtagttggattcgttttcgggagttttcgattttttagtttttcgtcggttttagggcgttttcgtttcgtttttttttcgtcggttttagcgttcgggttgtttttcgttcgcggattttcggcggggttggagatttagtaatttattggggttgggttggggtcgcgttaagaaggcggcggtgggttgtcggttgtagcgcgtcgggggttcgcggttgggggacgttggagtagcggtcgtcgtttcgttggtttcgggaagaggagcgttcgtcggtcgcgttgtagaaggagggttgggtacgtgggcgtttttttgtgtagttattcggggcgggggcggggcgcggggtcgggcggtatcgtttttttcgcgttttcggaacgcgatttcgagttcgtttttcgtcgggtttcggtcgcgttggttaattttcggggtgggcggtgtgcggtcgttgtttagcggggtttgtttggagtcgagtatacgtgggcgggcgttagtttcgggttaggtcggtgggcgcgggtcggggaagagaggttgcgcgcgagga

SEQ ID NO: 23160 - DNA, 858 bp, Artificial Sequence
  chemically treated genomic DNA (Homo sapiens) CpG-island No: 23160
tcctcgcgcgcaacctctcttccccgacccgcgcccaccgacctaacccgaaactaacgcccgcccacgtatactcgactccaaacaaaccccgctaaacaacgaccgcacaccgcccaccccgaaaattaaccaacgcgaccgaaacccgacgaaaaacgaactcgaaatcgcgttccgaaaacgcgaaaaaaacgataccgcccgaccccgcgccccgcccccgccccgaataactacacaaaaaaacgcccacgtacccaaccctccttctacaacgcgaccgacgaacgctcctcttcccgaaaccaacgaaacgacgaccgctactccaacgtcccccaaccgcgaacccccgacgcgctacaaccgacaacccaccgccgccttcttaacgcgaccccaacccaaccccaataaattactaaatctccaaccccgccgaaaatccgcgaacgaaaaacaacccgaacgctaaaaccgacgaaaaaaaaacgaaacgaaaacgccctaaaaccgacgaaaaactaaaaaatcgaaaactcccgaaaacgaatccaactacgcgcaactaccctaaaaccgcgctccaacgaatcttcgtcaaaaaatcgaaaccgtaaactaaaactaaaaccgtaaaccttcgtcctcgaaactacgccccgaaatacgcctcgcctcgtccgatccctatacaaccgactctacccgaaaacttcgaaaaccgctaaaactaaaaaaaaaactaacacgacgacttcgcgaaaacccttcaatcactatttccaaaaaaactcgacgcacccctctccgaataaacaaactaaacctcctaaccctacacgctaccgaaat

SEQ ID NO: 23161 - DNA, 865 bp, Artificial Sequence
  chemically treated genomic DNA (Homo sapiens) CpG-island No: 23161
tgtaagcgttttaggtttcgttttatttttttcgttagaggttatttcgaggcgagttgtcgtttttgcggttttcgaggtttttaggatattgtcgtttttcgttttcgggtcgttttcgaacgttggggtcgttttatcgtgtcggggtgtttacggagaaaagtgaggtttgagcggacgaaagagaagtttacgtgggcgataatattggtagtttagggagttgggacgacgcgggcgcgttagaaattcgtacgttcgcgtcgtttattaatttagttagttaggatttcgtttcgtttcgtttcggtggcgggggtattttcggttttttagtttttatggtattaattttcggcgcgcgttatttttcgcgagatttcggcggcgtagtaatggttagagcgtgagtgtcgttgatagaagttaagagaatcggttgggacggggttggggcgataacgggtcgggggggattcgataggttagagttttttggggaggagcggcggttggaggcgcgaggttttttcggatgttcggagagtcgtttgcgatttaattttcgttttttttttagatgtcgcgttattgtttcgtcgtcggttgttgtatacgggatacgcgcgagacgcgtaatcgcggtatttttttttataggttagcgcgcgtgcgtcgcgggtttacgtgcgtatgcgttagttgttgttcgtttcgggtcgtaattgcgtagaggtttcgcgttttttttagatattgaggaggtttgaatttgtgggtgggaggtgaagcggaacggtttcggcgggattgaatgtagtcgggaaggggaggacgggaagtttagtcggtttggattcgt

SEQ ID NO: 23162 - DNA, 865 bp, Artificial Sequence
  chemically treated genomic DNA (Homo sapiens) CpG-island No: 23162
acgaatccaaaccgactaaacttcccgtcctccccttcccgactacattcaatcccgccgaaaccgttccgcttcacctcccacccacaaattcaaacctcctcaatatctaaaaaaaacgcgaaacctctacgcaattacgacccgaaacgaacaacaactaacgcatacgcacgtaaacccgcgacgcacgcgcgctaacctataaaaaaaaataccgcgattacgcgtctcgcgcgtatcccgtatacaacaaccgacgacgaaacaataacgcgacatctaaaaaaaaaacgaaaattaaatcgcaaacgactctccgaacatccgaaaaaacctcgcgcctccaaccgccgctcctccccaaaaaactctaacctatcgaatcccccccgacccgttatcgccccaaccccgtcccaaccgattctcttaacttctatcaacgacactcacgctctaaccattactacgccgccgaaatctcgcgaaaaataacgcgcgccgaaaattaataccataaaaactaaaaaaccgaaaatacccccgccaccgaaacgaaacgaaacgaaatcctaactaactaaattaataaacgacgcgaacgtacgaatttctaacgcgcccgcgtcgtcccaactccctaaactaccaatattatcgcccacgtaaacttctctttcgtccgctcaaacctcacttttctccgtaaacaccccgacacgataaaacgaccccaacgttcgaaaacgacccgaaaacgaaaaacgacaatatcctaaaaacctcgaaaaccgcaaaaacgacaactcgcctcgaaataacctctaacgaaaaaaataaaacgaaacctaaaacgcttaca

SEQ ID NO: 23163 - DNA, 865 bp, Artificial Sequence
  chemically treated genomic DNA (Homo sapiens) CpG-island No: 23163
gcgggtttaagtcggttagatttttcgttttttttttttcgattgtatttagtttcgtcgggatcgtttcgttttattttttatttataggtttaagtttttttagtatttgagaaaggcgcgaagtttttacgtagttgcgattcgaggcgagtaataattagcgtatgcgtacgtgagttcgcggcgtacgcgcgttgatttgtggaaggagatgtcgcggttgcgcgtttcgcgcgtgtttcgtgtgtagtagtcggcggcggagtagtgacgcggtatttgggaaagaggcgggagttaagtcgtaagcggtttttcgggtattcggaggagtttcgcgtttttagtcgtcgtttttttttaaggggttttggtttgtcgggtttttttcggttcgttgtcgttttaatttcgttttagtcgatttttttgatttttgttagcggtatttacgttttggttattgttgcgtcgtcgaagtttcgcgaggggtagcgcgcgtcggaagttggtattatagagattggagagtcggaggtgttttcgttatcggggcggggcggggcgaggttttagttagttgggttagtaagcggcgcgagcgtgcgagtttttgacgcgttcgcgtcgttttagttttttggattattagtattgtcgtttacgtgggtttttttttcgttcgtttaggttttattttttttcgtaaatatttcggtacgatggagcggttttagcgttcgggagcggttcgggagcggaaagcggtagtgttttgggagtttcgaaagtcgtaggggcggtagttcgtttcggaatgatttttgacggaagaaataaaacggggtttgggacgtttgta

SEQ ID NO: 23164 - DNA, 865 bp, Artificial Sequence
  chemically treated genomic DNA (Homo sapiens) CpG-island No: 23164
tacaaacgtcccaaaccccgttttatttcttccgtcaaaaatcattccgaaacgaactaccgcccctacgactttcgaaactcccaaaacactaccgctttccgctcccgaaccgctcccgaacgctaaaaccgctccatcgtaccgaaatatttacgaaaaaaaataaaacctaaacgaacgaaaaaaaaacccacgtaaacgacaatactaataatccaaaaaactaaaacgacgcgaacgcgtcaaaaactcgcacgctcgcgccgcttactaacccaactaactaaaacctcgccccgccccgccccgataacgaaaacacctccgactctccaatctctataataccaacttccgacgcgcgctacccctcgcgaaacttcgacgacgcaacaataaccaaaacgtaaataccgctaacaaaaatcaaaaaaatcgactaaaacgaaattaaaacgacaacgaaccgaaaaaaacccgacaaaccaaaaccccttaaaaaaaaacgacgactaaaaacgcgaaactcctccgaatacccgaaaaaccgcttacgacttaactcccgcctctttcccaaataccgcgtcactactccgccgccgactactacacacgaaacacgcgcgaaacgcgcaaccgcgacatctccttccacaaatcaacgcgcgtacgccgcgaactcacgtacgcatacgctaattattactcgcctcgaatcgcaactacgtaaaaacttcgcgcctttctcaaatactaaaaaaacttaaacctataaataaaaaataaaacgaaacgatcccgacgaaactaaatacaatcgaaaaaaaaaaaacgaaaaatctaaccgacttaaacccgc

SEQ ID NO: 23165 - DNA, 721 bp, Artificial Sequence
  chemically treated genomic DNA (Homo sapiens) CpG-island No: 23165
tcgtatcgggtatttacgaattcgtcgtagggcgggaggcgtcgttagcgatgtattgtttcgaagggttcgaagttgagcgttaggtattcgatattgttcgagtagttatggtcgaagtttacgttcggggttattttggatcgcgcgtcgtttgttagggtcgtagtttcgatttgttttttcgtgttgttcggtttagttatttcgggtttacgtcggatcggtcgcgttgtaagtttaatttgcggttatcgtttcgggtcggttggagaaattatatttttcggcgagttttgcgttgacggtgcggtacgttcggttagcgtcgtatttgcgttttttagtttttttcgataagtttagcgtttgtcgagatatcgcgggcgagcgtaggatgcggttgtcgatcgcgcggcgagcgtgggattttttggggagcgttttaggttatgtattggcgttgcgttgttttttttagtgaatgtagtgtgtcgtttttagtttcgtcgcgattgtttttttcggcgttttttaggtttacgtagttcgaagattcgcggtcggttcgtagttttcggtatgttttgggtttgcgcgtggtttcggtttggatcgtttgtcgttgtcgggattttttatggagggtttcgggttcgtagcggtttttgtaggcggtttaacgtttttttttttgttagcgtttttagttttgattttt

SEQ ID NO: 23166 - DNA, 721 bp, Artificial Sequence
  chemically treated genomic DNA (Homo sapiens) CpG-island No: 23166
aaaaatcaaaactaaaaacgctaacaaaaaaaaaaacgttaaaccgcctacaaaaaccgctacgaacccgaaaccctccataaaaaatcccgacaacgacaaacgatccaaaccgaaaccacgcgcaaacccaaaacataccgaaaactacgaaccgaccgcgaatcttcgaactacgtaaacctaaaaaacgccgaaaaaaacaatcgcgacgaaactaaaaacgacacactacattcactaaaaaaaacaacgcaacgccaatacataacctaaaacgctccccaaaaaatcccacgctcgccgcgcgatcgacaaccgcatcctacgctcgcccgcgatatctcgacaaacgctaaacttatcgaaaaaaactaaaaaacgcaaatacgacgctaaccgaacgtaccgcaccgtcaacgcaaaactcgccgaaaaatataatttctccaaccgacccgaaacgataaccgcaaattaaacttacaacgcgaccgatccgacgtaaacccgaaataactaaaccgaacaacacgaaaaaacaaatcgaaactacgaccctaacaaacgacgcgcgatccaaaataaccccgaacgtaaacttcgaccataactactcgaacaatatcgaatacctaacgctcaacttcgaacccttcgaaacaatacatcgctaacgacgcctcccgccctacgacgaattcgtaaatacccgatacga

SEQ ID NO: 23167 - DNA, 721 bp, Artificial Sequence
  chemically treated genomic DNA (Homo sapiens) CpG-island No: 23167
gggggttagggttgagggcgttagtaggaaagggagcgttgagtcgtttgtagaggtcgttgcgagttcggaattttttatgggggatttcggtagcggtagacgatttaggtcggagttacgcgtagatttagggtatgtcgggaattgcgagtcggtcgcgggttttcgggttgcgtgggtttgggaggcgtcgggaagagtagtcgcgacggggttagggacgatatattgtatttattggaagggataacgtagcgttagtatatagtttgaaacgttttttagaaggttttacgttcgtcgcgcggtcgataatcgtattttgcgttcgttcgcggtgtttcggtaagcgttaggtttgtcgggaagagttggagggcgtaagtgcggcgttggtcggacgtgtcgtatcgttagcgtagggttcgtcgggaaatgtggtttttttagtcggttcggggcggtggtcgtaagttgggtttatagcgcggtcgattcggcgtggattcgggatggttggatcgggtagtacgggggggtagatcggggttgcggttttggtaggcggcgcgcggtttaaggtagtttcgagcgtggatttcgattatagttgttcggatagtgtcgagtatttgacgtttaatttcgggtttttcgaaatagtgtatcgttggcggcgtttttcgttttgcgacgagttcgtgggtgttcggtacgg

SEQ ID NO: 23168 - DNA, 721 bp, Artificial Sequence
  chemically treated genomic DNA (Homo sapiens) CpG-island No: 23168
ccgtaccgaacacccacgaactcgtcgcaaaacgaaaaacgccgccaacgatacactatttcgaaaaacccgaaattaaacgtcaaatactcgacactatccgaacaactataatcgaaatccacgctcgaaactaccttaaaccgcgcgccgcctaccaaaaccgcaaccccgatctacccccccgtactacccgatccaaccatcccgaatccacgccgaatcgaccgcgctataaacccaacttacgaccaccgccccgaaccgactaaaaaaaccacatttcccgacgaaccctacgctaacgatacgacacgtccgaccaacgccgcacttacgccctccaactcttcccgacaaacctaacgcttaccgaaacaccgcgaacgaacgcaaaatacgattatcgaccgcgcgacgaacgtaaaaccttctaaaaaacgtttcaaactatatactaacgctacgttatcccttccaataaatacaatatatcgtccctaaccccgtcgcgactactcttcccgacgcctcccaaacccacgcaacccgaaaacccgcgaccgactcgcaattcccgacataccctaaatctacgcgtaactccgacctaaatcgtctaccgctaccgaaatcccccataaaaaattccgaactcgcaacgacctctacaaacgactcaacgctccctttcctactaacgccctcaaccctaaccccc

SEQ ID NO: 23169 - DNA, 593 bp, Artificial Sequence
  chemically treated genomic DNA (Homo sapiens) CpG-island No: 23169
ggtttcgcggcgagtcgggaaggggtcgttgtgggacgagagaaggacgaggtgagtttcggatttcggttagtgtttttggtttcgtttgttaatttttagtttttaacgtgtcgggtcggggttcgagatttgggagcgtaagcgttggttttcggcgtcggggcgaagaggcggggcggcgggcggggatcggggtttcggggattagggttttcggggcgggcgtttatttgggttcggcgcgggtttgggttcgggaatcgtttggggtcgcgggcgcgggggggcggggaggcgcgggcggggcgtgtttggcgttgcgtttgtattgcggtcggggagttcgcgggtttagtatcgtttcgtcgggtcggagtaggtggggggcggtcgggggataggggtaggtcgaggttttcggcgttcggatcggagtcgcggggcgtagggaggtagttaggggtcgttttggtcgggggcgtttcgggttcgagtttgggttttcggggattttcgcgattttttagggatgtttagttggggcgcgggtagggttttttttttttttttttttttttaaagttttagaa

SEQ ID NO: 23170 - DNA, 593 bp, Artificial Sequence
  chemically treated genomic DNA (Homo sapiens) CpG-island No: 23170
ttctaaaactttaaaaaaaaaaaaaaaaaaaaaaaaccctacccgcgccccaactaaacatccctaaaaaatcgcgaaaatccccgaaaacccaaactcgaacccgaaacgcccccgaccaaaacgacccctaactacctccctacgccccgcgactccgatccgaacgccgaaaacctcgacctacccctatcccccgaccgccccccacctactccgacccgacgaaacgatactaaacccgcgaactccccgaccgcaatacaaacgcaacgccaaacacgccccgcccgcgcctccccgcccccccgcgcccgcgaccccaaacgattcccgaacccaaacccgcgccgaacccaaataaacgcccgccccgaaaaccctaatccccgaaaccccgatccccgcccgccgccccgcctcttcgccccgacgccgaaaaccaacgcttacgctcccaaatctcgaaccccgacccgacacgttaaaaactaaaaattaacaaacgaaaccaaaaacactaaccgaaatccgaaactcacctcgtccttctctcgtcccacaacgaccccttcccgactcgccgcgaaacc

SEQ ID NO: 23171 - DNA, 593 bp, Artificial Sequence
  chemically treated genomic DNA (Homo sapiens) CpG-island No: 23171
ttttgagattttggaaagaaagaaaaggaaaaaagattttgttcgcgttttagttgggtatttttgggaggtcgcgaggattttcggagatttagattcgggttcggggcgttttcggttagagcggtttttggttgtttttttacgtttcgcgatttcggttcggacgtcgagggtttcggtttgtttttgtttttcggtcgttttttatttgtttcggttcggcggggcggtgttgggttcgcgggtttttcggtcgtagtgtaaacgtagcgttagatacgtttcgttcgcgttttttcgttttttcgcgttcgcggttttaagcggttttcgagtttaggttcgcgtcgagtttaggtgagcgttcgtttcggggattttggttttcggaatttcggttttcgttcgtcgtttcgttttttcgtttcggcgtcgggggttagcgtttgcgtttttaagtttcggatttcggttcggtacgttaggggttgggggttggtaagcggggttagaggtattggtcggggttcgaagtttatttcgtttttttttcgttttataacggttttttttcggttcgtcgcggggtt

SEQ ID NO: 23172 - DNA, 593 bp, Artificial Sequence
  chemically treated genomic DNA (Homo sapiens) CpG-island No: 23172
aaccccgcgacgaaccgaaaaaaaaccgttataaaacgaaaaaaaaacgaaataaacttcgaaccccgaccaatacctctaaccccgcttaccaacccccaacccctaacgtaccgaaccgaaatccgaaacttaaaaacgcaaacgctaacccccgacgccgaaacgaaaaaacgaaacgacgaacgaaaaccgaaattccgaaaaccaaaatccccgaaacgaacgctcacctaaactcgacgcgaacctaaactcgaaaaccgcttaaaaccgcgaacgcgaaaaaacgaaaaaacgcgaacgaaacgtatctaacgctacgtttacactacgaccgaaaaacccgcgaacccaacaccgccccgccgaaccgaaacaaataaaaaacgaccgaaaaacaaaaacaaaccgaaaccctcgacgtccgaaccgaaatcgcgaaacgtaaaaaaacaaccaaaaaccgctctaaccgaaaacgccccgaacccgaatctaaatctccgaaaatcctcgcgacctcccaaaaatacccaactaaaacgcgaacaaaatcttttttccttttctttctttccaaaatctcaaaa

SEQ ID NO: 23173 - DNA, 537 bp, Artificial Sequence
  chemically treated genomic DNA (Homo sapiens) CpG-island No: 23173
gtttcgttcggttcgcgtttgttagcgtttaaagttagcgaagtacgggtttaatcgggttatgtcgggggagtttgagtttattgagttgcgggagttggtattcgttgggcgcgttgggaagggtcgtattcggttggagcgtgttaacgcgttgcgtatcgcgcggggtatcgcgtgtaattttatacggtagttggtttttggtcgtggttatcgtttttagttcgcggggttcgttacgtatacgtggtgcgatttttgtggcgattttatttggggcgtcgtgcgtaaaggtttgtagtgcgcgcgtgagtagtggtttcgcgcgtttacgagagcggaaggggtagttaaggggtagcgtagtcgtcgcgggttaagtcgcggtagagggggtcggcggggatagttttcgaggattaggttcgttattttcgttttatcgttgaagagtgcgcgaaaatggtttattttttgtcgtattttattcgtatttgggttatagatgagtagaggtggttgtttatatgtaaa

SEQ ID NO: 23174 - DNA, 537 bp, Artificial Sequence
  chemically treated genomic DNA (Homo sapiens) CpG-island No: 23174
tttacatataaacaaccacctctactcatctataacccaaatacgaataaaatacgacaaaaaataaaccattttcgcgcactcttcaacgataaaacgaaaataacgaacctaatcctcgaaaactatccccgccgaccccctctaccgcgacttaacccgcgacgactacgctaccccttaactaccccttccgctctcgtaaacgcgcgaaaccactactcacgcgcgcactacaaacctttacgcacgacgccccaaataaaatcgccacaaaaatcgcaccacgtatacgtaacgaaccccgcgaactaaaaacgataaccacgaccaaaaaccaactaccgtataaaattacacgcgataccccgcgcgatacgcaacgcgttaacacgctccaaccgaatacgacccttcccaacgcgcccaacgaataccaactcccgcaactcaataaactcaaactcccccgacataacccgattaaacccgtacttcgctaactttaaacgctaacaaacgcgaaccgaacgaaac

SEQ ID NO: 23175 - DNA, 537 bp, Artificial Sequence
  chemically treated genomic DNA (Homo sapiens) CpG-island No: 23175
tttatatataagtagttatttttgtttatttgtggtttagatacgagtggagtgcgataagggataaattattttcgcgtattttttagcgatggggcgaaagtaacggatttagttttcgggagttgttttcgtcgattttttttgtcgcgatttgattcgcggcgattgcgttgttttttggttgtttttttcgttttcgtaggcgcgcggggttattatttacgcgcgtattgtaggtttttgcgtacgacgttttagatgaagtcgttatagaggtcgtattacgtgtgcgtggcgggtttcgcgggttggaagcggtggttacggttagggattagttgtcgtgtggggttgtacgcggtgtttcgcgcgatgcgtagcgcgttggtacgttttagtcgggtgcggttttttttagcgcgtttagcgggtgttagttttcgtagtttaatgagtttaggttttttcgatatggttcggttgggttcgtgtttcgttggttttgggcgttagtaagcgcgggtcgggcggggt

SEQ ID NO: 23176 - DNA, 537 bp, Artificial Sequence
  chemically treated genomic DNA (Homo sapiens) CpG-island No: 23176
accccgcccgacccgcgcttactaacgcccaaaaccaacgaaacacgaacccaaccgaaccatatcgaaaaaacctaaactcattaaactacgaaaactaacacccgctaaacgcgctaaaaaaaaccgcacccgactaaaacgtaccaacgcgctacgcatcgcgcgaaacaccgcgtacaaccccacacgacaactaatccctaaccgtaaccaccgcttccaacccgcgaaacccgccacgcacacgtaatacgacctctataacgacttcatctaaaacgtcgtacgcaaaaacctacaatacgcgcgtaaataataaccccgcgcgcctacgaaaacgaaaaaaacaaccaaaaaacaacgcaatcgccgcgaatcaaatcgcgacaaaaaaaatcgacgaaaacaactcccgaaaactaaatccgttactttcgccccatcgctaaaaaatacgcgaaaataatttatcccttatcgcactccactcgtatctaaaccacaaataaacaaaaataactacttatatataaa

SEQ ID NO: 23177 - DNA, 760 bp, Artificial Sequence
  chemically treated genomic DNA (Homo sapiens) CpG-island No: 23177
ggtttcgcgtacgcgtatttttcgtattttttcgttttcgttttcggttagaggttatttttgtgcgtttgttcggacgttggtattcgttttcgttttttgtggtaggtggggtttgtgagtggagtttcggagcgatgaggttatttttgggggcgaagcgtgcgtgttttcgtttcggcgtttttgttttaatgagataagagttagatttcggcgatttacgttttagttttaacggttgcggcgcggttttggttcgggcgtacgcgtatattgatacgcgtatacgtacgtacgcgatcggggcggtggttggcggttacggacgcgtaggattgggggacgggcgggtacggttatgggcgaggcggaggcgttttttttcgaaatgatttggagtagtacgacgagtagtggttattgtagttaagaggattcggattcggagttcgagtagtattttatcgcgcgaatttcgttagttcgtaggtcgcgtcgggattaggtgggagttagggggtgtcggcgggcgggaggggaagcggtcgttggagtttcgtttttttcggttcgttgtcgcgttttgggtcggtgggtagttttatttttttggttacgtggtttttcgcgggttttggtcggggatttgttcgcggaatcgtgcgtaagatttcgattttatcgtttagatgttgggtgtcggggtttttttggtttttgttatagataggttgaatacggaaaaagtagttgtatg

SEQ ID NO: 23178 - DNA, 760 bp, Artificial Sequence
  chemically treated genomic DNA (Homo sapiens) CpG-island No: 23178
catacaactactttttccgtattcaacctatctataacaaaaaccaaaaaaaccccgacacccaacatctaaacgataaaatcgaaatcttacgcacgattccgcgaacaaatccccgaccaaaacccgcgaaaaaccacgtaaccaaaaaaataaaactacccaccgacccaaaacgcgacaacgaaccgaaaaaaacgaaactccaacgaccgcttcccctcccgcccgccgacaccccctaactcccacctaatcccgacgcgacctacgaactaacgaaattcgcgcgataaaatactactcgaactccgaatccgaatcctcttaactacaataaccactactcgtcgtactactccaaatcatttcgaaaaaaaacgcctccgcctcgcccataaccgtacccgcccgtcccccaatcctacgcgtccgtaaccgccaaccaccgccccgatcgcgtacgtacgtatacgcgtatcaatatacgcgtacgcccgaaccaaaaccgcgccgcaaccgttaaaactaaaacgtaaatcgccgaaatctaactcttatctcattaaaacaaaaacgccgaaacgaaaacacgcacgcttcgcccccaaaaataacctcatcgctccgaaactccactcacaaaccccacctaccacaaaaaacgaaaacgaataccaacgtccgaacaaacgcacaaaaataacctctaaccgaaaacgaaaacgaaaaaatacgaaaaatacgcgtacgcgaaacc

SEQ ID NO: 23179 - DNA, 760 bp, Artificial Sequence
  chemically treated genomic DNA (Homo sapiens) CpG-island No: 23179
tatatagttgtttttttcgtgtttaatttgtttgtgatagaaattaagggggtttcggtatttagtatttaggcggtggaatcggggttttacgtacggtttcgcgggtaggttttcggttaggattcgcggggagttacgtagttaggagggtggggttgtttatcgatttaggacgcggtaacggatcggggagggcggagttttagcgatcgttttttttttcgttcgtcggtattttttggtttttatttggtttcggcgcggtttgcgagttagcgaggttcgcgcggtgaagtattgttcgagtttcgagttcgagtttttttggttgtagtagttattgttcgtcgtgttgttttaggttatttcgaaagaaggcgttttcgtttcgtttatagtcgtattcgttcgttttttagttttgcgcgttcgtagtcgttaattatcgtttcggtcgcgtgcgtgcgtgtacgcgtgttagtgtgcgcgtgcgttcgggttagagtcgcgtcgtaatcgttaagattgaaacgtagatcgtcgggatttagtttttgttttattggggtaggaacgtcggggcggggatacgtacgtttcgtttttaggaatgattttatcgtttcggagttttatttatagattttatttattatagggaacgggggcgggtgttagcgttcgggtaagcgtataagagtggtttttggtcggaggcgagggcgggaaggtgcgggaagtgcgcgtgcgcggagtt

SEQ ID NO: 23180 - DNA, 760 bp, Artificial Sequence
  chemically treated genomic DNA (Homo sapiens) CpG-island No: 23180
aactccgcgcacgcgcacttcccgcaccttcccgccctcgcctccgaccaaaaaccactcttatacgcttacccgaacgctaacacccgcccccgttccctataataaataaaatctataaataaaactccgaaacgataaaatcattcctaaaaacgaaacgtacgtatccccgccccgacgttcctaccccaataaaacaaaaactaaatcccgacgatctacgtttcaatcttaacgattacgacgcgactctaacccgaacgcacgcgcacactaacacgcgtacacgcacgcacgcgaccgaaacgataattaacgactacgaacgcgcaaaactaaaaaacgaacgaatacgactataaacgaaacgaaaacgccttctttcgaaataacctaaaacaacacgacgaacaataactactacaaccaaaaaaactcgaactcgaaactcgaacaatacttcaccgcgcgaacctcgctaactcgcaaaccgcgccgaaaccaaataaaaaccaaaaaataccgacgaacgaaaaaaaaaacgatcgctaaaactccgccctccccgatccgttaccgcgtcctaaatcgataaacaaccccaccctcctaactacgtaactccccgcgaatcctaaccgaaaacctacccgcgaaaccgtacgtaaaaccccgattccaccgcctaaatactaaataccgaaacccccttaatttctatcacaaacaaattaaacacgaaaaaaacaactatata

SEQ ID NO: 23181 - DNA, 595 bp, Artificial Sequence
  chemically treated genomic DNA (Homo sapiens) CpG-island No: 23181
atgcggatttttcggtcgtcgtcgtacgaggttagtagggttttcgcggggttttaggttaggaattagtagcgggagttcgggtgcgtcgggatacggtttagtagtattagcgagttttttatgtcggttcgacgtagggggaggtgggggcgggtagagttcgttgagtagatagcgggttttatcgcgcgcgtttgcgtatcgtttattttaggttttcgcggtcgatagaggttttcgttttcgtcggaggatttgggtcgtttcggaaatttaattgtttattgttgcggtcgttatattttttgggagttgtagtcgttttttttatttcggtagggaaagtatcgcgggatcgtttcgagttattagtttcgtgaggttttgcgtagagtcggcggcgcgtttaggttgtgacgcgcgcgggggacggggcggggagtcggaggaggcggaggtagaggaggaggaagtcggaagtgtatcggtttcgggtttgttcgggcgttgcgggattggggtttgggaacgttcggttttcggtagtcgagaagttcgtgattgggttgagtagtattattttagttttggg

SEQ ID NO: 23182 - DNA, 595 bp, Artificial Sequence
  chemically treated genomic DNA (Homo sapiens) CpG-island No: 23182
cccaaaactaaaataatactactcaacccaatcacgaacttctcgactaccgaaaaccgaacgttcccaaaccccaatcccgcaacgcccgaacaaacccgaaaccgatacacttccgacttcctcctcctctacctccgcctcctccgactccccgccccgtcccccgcgcgcgtcacaacctaaacgcgccgccgactctacgcaaaacctcacgaaactaataactcgaaacgatcccgcgatactttccctaccgaaataaaaaaaacgactacaactcccaaaaaatataacgaccgcaacaataaacaattaaatttccgaaacgacccaaatcctccgacgaaaacgaaaacctctatcgaccgcgaaaacctaaaataaacgatacgcaaacgcgcgcgataaaacccgctatctactcaacgaactctacccgcccccacctccccctacgtcgaaccgacataaaaaactcgctaatactactaaaccgtatcccgacgcacccgaactcccgctactaattcctaacctaaaaccccgcgaaaaccctactaacctcgtacgacgacgaccgaaaaatccgcat

SEQ ID NO: 23183 - DNA, 595 bp, Artificial Sequence
  chemically treated genomic DNA (Homo sapiens) CpG-island No: 23183
tttagggttgggatggtgttgtttagtttagttacgggtttttcggttgtcgggggtcgagcgtttttaggttttaatttcgtaacgttcggatagattcggggtcgatgtattttcggttttttttttttttgttttcgtttttttcggtttttcgtttcgtttttcgcgcgcgttatagtttgggcgcgtcgtcggttttgcgtagggttttacgggattggtagttcgaggcggtttcgcgatgttttttttgtcgaggtgaggggagcgattataatttttagagggtatggcggtcgtagtagtgggtagttgagttttcggggcgatttaggtttttcggcggaagcgggagtttttgtcggtcgcggaagtttggagtgggcggtacgtagacgcgcgcggtgagattcgttgtttgtttagcggattttgttcgtttttatttttttttgcgtcgggtcgatatgaaggattcgttggtgttgttgggtcgtgtttcggcgtattcggattttcgttgttggtttttggtttggaatttcgcggggattttgttggtttcgtgcggcggcgatcggagaattcgtat

SEQ ID NO: 23184 - DNA, 595 bp, Artificial Sequence
  chemically treated genomic DNA (Homo sapiens) CpG-island No: 23184
atacgaattctccgatcgccgccgcacgaaaccaacaaaatccccgcgaaattccaaaccaaaaaccaacaacgaaaatccgaatacgccgaaacacgacccaacaacaccaacgaatccttcatatcgacccgacgcaaaaaaaaataaaaacgaacaaaatccgctaaacaaacaacgaatctcaccgcgcgcgtctacgtaccgcccactccaaacttccgcgaccgacaaaaactcccgcttccgccgaaaaacctaaatcgccccgaaaactcaactacccactactacgaccgccataccctctaaaaattataatcgctcccctcacctcgacaaaaaaaacatcgcgaaaccgcctcgaactaccaatcccgtaaaaccctacgcaaaaccgacgacgcgcccaaactataacgcgcgcgaaaaacgaaacgaaaaaccgaaaaaaacgaaaacaaaaaaaaaaaaaaccgaaaatacatcgaccccgaatctatccgaacgttacgaaattaaaacctaaaaacgctcgacccccgacaaccgaaaaacccgtaactaaactaaacaacaccatcccaaccctaaa

SEQ ID NO: 23185 - DNA, 704 bp, Artificial Sequence
  chemically treated genomic DNA (Homo sapiens) CpG-island No: 23185
agtcgggcgcgttaaggagacgtcggaacgcggcggggacgcgcgggcgtcgagcggggaggcgcgggttggcgcggtcggaggggcgttcgggttggcgagggggagaaggaggacgacgaaggggcggggaggttcgtcgagattaaggagtcgtcgggagtcgggtcgaaacgcgtcgtcgtcgttgtcgttgttattaaaatagtttgaggcggagggaggcgagttttgtcgggagggaggggggtcggggtcgggcggaggaagggcggcggagggatacggtttcggggtcgcgttatcgtcgtttcgttcgtttcgtcgcgtcggtcgttggagcgagcgttattcgggttatttggttgcggcgaacggcgagattcggtggttatcgcgggatttcgaggagttgcggtcgttgagcgtatcggagggcgggcgcgtcgaggcgtcgggtgggagcggaggtgcggatagggattttttatcggaagtcggaggggttagacggaagtagaacgtgaggtggtttcggggtcgggagggatacgtgaggagcgggcggcgcgttgggttgttttttcgggggtcgggtgagggttaggcggcggtttttattcggattcgttttttttaaggcgggtttgtttttcggggagggcgtgtcggttttagtttttggggtttgtttggtgtggagg

SEQ ID NO: 23186 - DNA, 704 bp, Artificial Sequence
  chemically treated genomic DNA (Homo sapiens) CpG-island No: 23186
cctccacaccaaacaaaccccaaaaactaaaaccgacacgccctccccgaaaaacaaacccgccttaaaaaaaacgaatccgaataaaaaccgccgcctaaccctcacccgacccccgaaaaaacaacccaacgcgccgcccgctcctcacgtatccctcccgaccccgaaaccacctcacgttctacttccgtctaacccctccgacttccgataaaaaatccctatccgcacctccgctcccacccgacgcctcgacgcgcccgccctccgatacgctcaacgaccgcaactcctcgaaatcccgcgataaccaccgaatctcgccgttcgccgcaaccaaataacccgaataacgctcgctccaacgaccgacgcgacgaaacgaacgaaacgacgataacgcgaccccgaaaccgtatccctccgccgcccttcctccgcccgaccccgacccccctccctcccgacaaaactcgcctccctccgcctcaaactattttaataacaacgacaacgacgacgacgcgtttcgacccgactcccgacgactccttaatctcgacgaacctccccgccccttcgtcgtcctccttctccccctcgccaacccgaacgcccctccgaccgcgccaacccgcgcctccccgctcgacgcccgcgcgtccccgccgcgttccgacgtctccttaacgcgcccgact

SEQ ID NO: 23187 - DNA, 704 bp, Artificial Sequence
  chemically treated genomic DNA (Homo sapiens) CpG-island No: 23187
tttttatattaggtaggttttagaggttgagatcgatacgtttttttcgaagggtagattcgttttgaggaaggcggattcgggtagggatcgtcgtttggtttttattcgattttcgagaaagtaatttagcgcgtcgttcgttttttacgtgtttttttcggtttcggggttattttacgttttgttttcgtttgattttttcgattttcggtaaagagtttttattcgtattttcgtttttattcggcgtttcggcgcgttcgtttttcgatgcgtttagcggtcgtagtttttcggagtttcgcggtggttatcgagtttcgtcgttcgtcgtagttaggtggttcgggtggcgttcgttttagcggtcggcgcggcggagcgggcggggcggcggtggcgcggtttcgggatcgtattttttcgtcgtttttttttcgttcggtttcggtttttttttttttcggtagagttcgttttttttcgttttagattgttttggtagtaacggtaacggcggcggcgcgtttcggttcggttttcggcggttttttggtttcggcgggttttttcgttttttcgtcgttttttttttttttttcgttagttcgggcgttttttcggtcgcgttaattcgcgttttttcgttcggcgttcgcgcgttttcgtcgcgtttcggcgtttttttggcgcgttcggtt

SEQ ID NO: 23188 - DNA, 704 bp, Artificial Sequence
  chemically treated genomic DNA (Homo sapiens) CpG-island No: 23188
aaccgaacgcgccaaaaaaacgccgaaacgcgacgaaaacgcgcgaacgccgaacgaaaaaacgcgaattaacgcgaccgaaaaaacgcccgaactaacgaaaaaaaaaaaaaaaacgacgaaaaaacgaaaaaacccgccgaaaccaaaaaaccgccgaaaaccgaaccgaaacgcgccgccgccgttaccgttactaccaaaacaatctaaaacgaaaaaaaacgaactctaccgaaaaaaaaaaaaaccgaaaccgaacgaaaaaaaaacgacgaaaaaatacgatcccgaaaccgcgccaccgccgccccgcccgctccgccgcgccgaccgctaaaacgaacgccacccgaaccacctaactacgacgaacgacgaaactcgataaccaccgcgaaactccgaaaaactacgaccgctaaacgcatcgaaaaacgaacgcgccgaaacgccgaataaaaacgaaaatacgaataaaaactctttaccgaaaatcgaaaaaatcaaacgaaaacaaaacgtaaaataaccccgaaaccgaaaaaaacacgtaaaaaacgaacgacgcgctaaattactttctcgaaaatcgaataaaaaccaaacgacgatccctacccgaatccgccttcctcaaaacgaatctacccttcgaaaaaaacgtatcgatctcaacctctaaaacctacctaatataaaaa

SEQ ID NO: 23189 - DNA, 824 bp, Artificial Sequence
  chemically treated genomic DNA (Homo sapiens) CpG-island No: 23189
ttttagacgtattgttggtcgtattgttgagttgtattattttttttttcgtcgtatttgtatttttaagcgttacggcggatgtaatattttttgttcgtttagttgttgtttcggcgcgcgttgtcgcggatttcgtcgtatttttgttttgagttgtcgtcgtcgtattgttagtagtttttgtcgttttcgtggatgtcgtcgtggcgttgtttttcgttgttgacgtttgtttggtcgttttattttttgaagtagacgtcgatgatgtcgatgacgtcgtcgaattggttgacgatgcggtagtcgtttttgaggattttgcgtttgttttcgacgttttcgcgttcgtttcggatgttttcgttgcggaagtagatttcgttgttgcgttggtttgtttagtggtttcgttagttttcgttgtggttgttgaagtagacgatgcggcgttttttgtcgatttttcggcggcggtggtattggttgatgttttttcggtatttgttgacgttgtattggtagacgacgtagtcgttgtttttgagtttttcgtagtcgaggcgttttgtttcgttgtcgttttagaagatttggcgttcgtttcggacgttttttcgttttcgcggaattttttgtcgtcgtttgtcgaggaagttgtattattggcgtttgatgattcgtttcgttcggatgatttttatcgtttttttttaaggtcgtcgtaattcggtgtcgaggtttgtatttttttgaattttttcgttgttttcggtgtgatttaaatgttggtttgttgattttaaaattaattcgtgaat

SEQ ID NO: 23190 - DNA, 824 bp, Artificial Sequence
  chemically treated genomic DNA (Homo sapiens) CpG-island No: 23190
attcacgaattaattttaaaatcaacaaaccaacatttaaatcacaccgaaaacaacgaaaaaattcaaaaaaatacaaacctcgacaccgaattacgacgaccttaaaaaaaaacgataaaaatcatccgaacgaaacgaatcatcaaacgccaataatacaacttcctcgacaaacgacgacaaaaaattccgcgaaaacgaaaaaacgtccgaaacgaacgccaaatcttctaaaacgacaacgaaacaaaacgcctcgactacgaaaaactcaaaaacaacgactacgtcgtctaccaatacaacgtcaacaaataccgaaaaaacatcaaccaataccaccgccgccgaaaaatcgacaaaaaacgccgcatcgtctacttcaacaaccacaacgaaaactaacgaaaccactaaacaaaccaacgcaacaacgaaatctacttccgcaacgaaaacatccgaaacgaacgcgaaaacgtcgaaaacaaacgcaaaatcctcaaaaacgactaccgcatcgtcaaccaattcgacgacgtcatcgacatcatcgacgtctacttcaaaaaataaaacgaccaaacaaacgtcaacaacgaaaaacaacgccacgacgacatccacgaaaacgacaaaaactactaacaatacgacgacgacaactcaaaacaaaaatacgacgaaatccgcgacaacgcgcgccgaaacaacaactaaacgaacaaaaaatattacatccgccgtaacgcttaaaaatacaaatacgacgaaaaaaaaaataatacaactcaacaatacgaccaacaatacgtctaaaa

SEQ ID NO: 23191 - DNA, 824 bp, Artificial Sequence
  chemically treated genomic DNA (Homo sapiens) CpG-island No: 23191
gtttacgggttaattttaaaattagtaggttaatatttggattatatcggggataacggagggatttagaaagatgtagatttcggtatcggattacggcggttttaaaagaaagcggtaaaaattattcgaacggaacgaattattaagcgttagtagtgtagttttttcggtaaacggcggtaggaaatttcgcgaaggcggaaaaacgttcgagacgaacgttaagttttttgaaacggtaacgggatagagcgtttcggttgcggaaggtttaaaaatagcggttgcgtcgtttgttagtgtagcgttaataagtgtcgggaaagtattagttagtgttatcgtcgtcgggaaatcggtagaaagcgtcgtatcgtttgttttaatagttataacgaaggttggcgaagttattgaataggttagcgtagtagcgaggtttgttttcgtagcgaagatattcgaaacgaacgcgaaagcgtcggaaataagcgtagaatttttaaaaacggttgtcgtatcgttagttagttcggcggcgttatcggtattatcggcgtttgttttaaaagatgaggcgattagataagcgttagtagcgaagagtagcgttacgacggtatttacgaaggcgatagaggttgttggtagtgcgacggcggtagtttagagtaaaagtacggcggaattcgcggtaacgcgcgtcgagatagtagttaaacgggtagaggatattgtattcgtcgtggcgtttgaggatgtaagtacgacgaaaaaggggatagtatagtttagtagtgcgattaatagtacgtttgaaa

SEQ ID NO: 23192 - DNA, 824 bp, Artificial Sequence
  chemically treated genomic DNA (Homo sapiens) CpG-island No: 23192
tttcaaacgtactattaatcgcactactaaactatactatcccctttttcgtcgtacttacatcctcaaacgccacgacgaatacaatatcctctacccgtttaactactatctcgacgcgcgttaccgcgaattccgccgtacttttactctaaactaccgccgtcgcactaccaacaacctctatcgccttcgtaaataccgtcgtaacgctactcttcgctactaacgcttatctaatcgcctcatcttttaaaacaaacgccgataataccgataacgccgccgaactaactaacgatacgacaaccgtttttaaaaattctacgcttatttccgacgctttcgcgttcgtttcgaatatcttcgctacgaaaacaaacctcgctactacgctaacctattcaataacttcgccaaccttcgttataactattaaaacaaacgatacgacgctttctaccgatttcccgacgacgataacactaactaatactttcccgacacttattaacgctacactaacaaacgacgcaaccgctatttttaaaccttccgcaaccgaaacgctctatcccgttaccgtttcaaaaaacttaacgttcgtctcgaacgtttttccgccttcgcgaaatttcctaccgccgtttaccgaaaaaactacactactaacgcttaataattcgttccgttcgaataatttttaccgctttcttttaaaaccgccgtaatccgataccgaaatctacatctttctaaatccctccgttatccccgatataatccaaatattaacctactaattttaaaattaacccgtaaac

SEQ ID NO: 23193 - DNA, 522 bp, Artificial Sequence
  chemically treated genomic DNA (Homo sapiens) CpG-island No: 23193
  misc_feature (361)..(361): n is either a, c, g or t
gtttttcgttacgttagttgttaaacgtagaaatagcggtaaaagcggcgatttaggttttgattttatgtgtcgatttttcggtaatggcggaaagtttttcgttattgacggtatttagtttttgtatgcgtttttgttttagtaaagttatgaattggttattttaaatcgggttgagcggatgtagcgttttttgatttttaataaattttttagcggcgttaattattcgttgttgacgtaattcgcgtttattggcgggtaaatttttttcgttttttaatagacggtcgcgtatatgggtatcggttttcgttagttcggtacggcggttgatggggaagtttatcgaatttangatagtacgcgtttattgagagtgttgtgaaagttaaatgttttattttatatgcgggtatttgggaatcggggtatcgcgttgcgatatcgtttgatgaattattgtatcgcgtaattatggttatagttgttttttgtgtgaaattgttattcgtttat

SEQ ID NO: 23194 - DNA, 522 bp, Artificial Sequence
  chemically treated genomic DNA (Homo sapiens) CpG-island No: 23194
  misc_feature (162)..(162): n is either a, c, g or t
ataaacgaataacaatttcacacaaaaaacaactataaccataattacgcgatacaataattcatcaaacgatatcgcaacgcgataccccgattcccaaatacccgcatataaaataaaacatttaactttcacaacactctcaataaacgcgtactatcntaaattcgataaacttccccatcaaccgccgtaccgaactaacgaaaaccgatacccatatacgcgaccgtctattaaaaaacgaaaaaaatttacccgccaataaacgcgaattacgtcaacaacgaataattaacgccgctaaaaaatttattaaaaatcaaaaaacgctacatccgctcaacccgatttaaaataaccaattcataactttactaaaacaaaaacgcatacaaaaactaaataccgtcaataacgaaaaactttccgccattaccgaaaaatcgacacataaaatcaaaacctaaatcgccgcttttaccgctatttctacgtttaacaactaacgtaacgaaaaac

SEQ ID NO: 23195 - DNA, 522 bp, Artificial Sequence
  chemically treated genomic DNA (Homo sapiens) CpG-island No: 23195
  misc_feature (162)..(162): n is either a, c, g or t
gtgagcggataataattttatataggaaatagttatgattatgattacgcggtatagtagtttattaaacggtgtcgtaacgcggtgtttcggtttttaagtattcgtatgtagggtaaagtatttgatttttatagtatttttaataaacgcgtgttgttntgggttcggtgggtttttttattagtcgtcgtgtcgaattggcgaaagtcgatgtttatatgcgcgatcgtttgttggggagcgggaaagatttattcgttagtgagcgcgaattgcgttagtaacgggtgattagcgtcgttgagaagtttgttgaggattagagaacgttgtattcgtttaattcgatttgggataattagtttatgattttgttggagtagggacgtatataggaattggatgtcgttagtaacgaagagtttttcgttattgtcggaaagtcgatatatgaaattaaaatttgggtcgtcgtttttgtcgttatttttgcgtttggtaattggcgtagcgaagggt

SEQ ID NO: 23196 - DNA, 522 bp, Artificial Sequence
  chemically treated genomic DNA (Homo sapiens) CpG-island No: 23196
  misc_feature (361)..(361): n is either a, c, g or t
acccttcgctacgccaattaccaaacgcaaaaataacgacaaaaacgacgacccaaattttaatttcatatatcgactttccgacaataacgaaaaactcttcgttactaacgacatccaattcctatatacgtccctactccaacaaaatcataaactaattatcccaaatcgaattaaacgaatacaacgttctctaatcctcaacaaacttctcaacgacgctaatcacccgttactaacgcaattcgcgctcactaacgaataaatctttcccgctccccaacaaacgatcgcgcatataaacatcgactttcgccaattcgacacgacgactaataaaaaaacccaccgaacccanaacaacacgcgtttattaaaaatactataaaaatcaaatactttaccctacatacgaatacttaaaaaccgaaacaccgcgttacgacaccgtttaataaactactataccgcgtaatcataatcataactatttcctatataaaattattatccgctcac

SEQ ID NO: 23197 - DNA, 571 bp, Artificial Sequence
  chemically treated genomic DNA (Homo sapiens) CpG-island No: 23197
cgatacgtgtcgttgttacgtacggtgttagtattagaataacgcggataaacgtgatgattggatttatttagtgatgggtttaggcgttgacgggatatttttagtaggttaaagcgagaaatatggttgatttgaatacgcgtacggttttgacgtatcgttttacgtagacggttttttatcgtacgttggtggcgtattggcgttatgtcgatgaagtcgataataattaggtcgtcgaggttacgtaggcgtattgacgagtaattttatcggtagtttcgaggttagtgttaaacgcggttttttcgatatcgtcgtcgcgggtcgcgcgtgcggagttgatgtcgatggtcgttaacgtttcggtgttgtcgataataatggaattattagacggtagacgaattttacgttggaaggcggattcgatttgtgattcgatttggtagtggttgaatagcgggatttcgtcggtgtatagtttgattttgttgttgaaattcgggcgatttaatgtagcgatatgttgacgtgttagttcgagtattttcgggttatcgataag

SEQ ID NO: 23198 - DNA, 571 bp, Artificial Sequence
  chemically treated genomic DNA (Homo sapiens) CpG-island No: 23198
cttatcgataacccgaaaatactcgaactaacacgtcaacatatcgctacattaaatcgcccgaatttcaacaacaaaatcaaactatacaccgacgaaatcccgctattcaaccactaccaaatcgaatcacaaatcgaatccgccttccaacgtaaaattcgtctaccgtctaataattccattattatcgacaacaccgaaacgttaacgaccatcgacatcaactccgcacgcgcgacccgcgacgacgatatcgaaaaaaccgcgtttaacactaacctcgaaactaccgataaaattactcgtcaatacgcctacgtaacctcgacgacctaattattatcgacttcatcgacataacgccaatacgccaccaacgtacgataaaaaaccgtctacgtaaaacgatacgtcaaaaccgtacgcgtattcaaatcaaccatatttctcgctttaacctactaaaaatatcccgtcaacgcctaaacccatcactaaataaatccaatcatcacgtttatccgcgttattctaatactaacaccgtacgtaacaacgacacgtatcg

SEQ ID NO: 23199 - DNA, 571 bp, Artificial Sequence
  chemically treated genomic DNA (Homo sapiens) CpG-island No: 23199
tttatcgataattcgaaagtgttcgaattggtacgttagtatatcgttgtattaggtcgttcggattttagtagtaaaattaaattgtatatcggcgagatttcgttgtttagttattattagatcgagttatagatcgagttcgttttttagcgtgaagttcgtttgtcgtttggtggttttattgttatcgatagtatcgaagcgttaacggttatcgatattaatttcgtacgcgcgattcgcggcggcgatatcgaagaaatcgcgtttaatattaatttcgaagttgtcgatgagattgttcgttagtgcgtttgcgtgatttcggcggtttgattgttatcgattttatcgatatgacgttagtacgttattagcgtgcggtagaaaatcgtttgcgtgaagcggtgcgttaggatcgtgcgcgtatttaaattagttatatttttcgttttggtttgttggaaatgtttcgttagcgtttgagtttattattgggtgaatttagttattacgtttgttcgcgttgttttggtattggtatcgtgcgtgataacgatacgtgtcg

SEQ ID NO: 23200 - DNA, 571 bp, Artificial Sequence
  chemically treated genomic DNA (Homo sapiens) CpG-island No: 23200
cgacacgtatcgttatcacgcacgataccaataccaaaacaacgcgaacaaacgtaataactaaattcacccaataataaactcaaacgctaacgaaacatttccaacaaaccaaaacgaaaaatataactaatttaaatacgcgcacgatcctaacgcaccgcttcacgcaaacgattttctaccgcacgctaataacgtactaacgtcatatcgataaaatcgataacaatcaaaccgccgaaatcacgcaaacgcactaacgaacaatctcatcgacaacttcgaaattaatattaaacgcgatttcttcgatatcgccgccgcgaatcgcgcgtacgaaattaatatcgataaccgttaacgcttcgatactatcgataacaataaaaccaccaaacgacaaacgaacttcacgctaaaaaacgaactcgatctataactcgatctaataataactaaacaacgaaatctcgccgatatacaatttaattttactactaaaatccgaacgacctaatacaacgatatactaacgtaccaattcgaacactttcgaattatcgataaa

SEQ ID NO: 23201 - DNA, 695 bp, Artificial Sequence
  chemically treated genomic DNA (Homo sapiens) CpG-island No: 23201
  misc_feature (469)..(469): n is either a, c, g or t
taatttgcggacgcgtcgtagttatatcggatgcgattatggcgtttttgtaggtttttagcgtttgcgttggatcgttcgtttgcgttttaaatttcgtattattacgtagtattatcgcgttttttatcgacggtggttgagattttgtttgcgggattaatttattaaacgttcgttgcgttgttgcggtatcgttaagttgcgtttgtgttagcgttacgcgtcgttgtgtgtttagcgaggcgttatcggtagcgggtagtttcgttagttggttacgtgtcgtcgttttgttatcggtagtaatatttattttcgttagattaagaatggcgtcggcgttagttggttttcgcgttaggatattttgatatgtagcgcgggcggcggtgtaattacgtcgttgttgcgtttagttagttagcgtgaggttaatacgcgtggaaggtggttgttggcgtagtantgttttcgtttttgtttttttgtcgttttttcgtaggcggttagcggtttttagtatttgatcgttttgtagtcgattaattagtttttgaatattgttgttttattgcgtacgcggtaggttattgatatgcgttacgtcgttttgttttggttatgatagagaggtatagtcgtaagcgtaatttgttcgggtcgtcgatttttgtgcgttagatgcgtattaa

SEQ ID NO: 23202 - DNA, 695 bp, Artificial Sequence
  chemically treated genomic DNA (Homo sapiens) CpG-island No: 23202
  misc_feature (227)..(227): n is either a, c, g or t
ttaatacgcatctaacgcacaaaaatcgacgacccgaacaaattacgcttacgactatacctctctatcataaccaaaacaaaacgacgtaacgcatatcaataacctaccgcgtacgcaataaaacaacaatattcaaaaactaattaatcgactacaaaacgatcaaatactaaaaaccgctaaccgcctacgaaaaaacgacaaaaaaacaaaaacgaaaacantactacgccaacaaccaccttccacgcgtattaacctcacgctaactaactaaacgcaacaacgacgtaattacaccgccgcccgcgctacatatcaaaatatcctaacgcgaaaaccaactaacgccgacgccattcttaatctaacgaaaataaatattactaccgataacaaaacgacgacacgtaaccaactaacgaaactacccgctaccgataacgcctcgctaaacacacaacgacgcgtaacgctaacacaaacgcaacttaacgataccgcaacaacgcaacgaacgtttaataaattaatcccgcaaacaaaatctcaaccaccgtcgataaaaaacgcgataatactacgtaataatacgaaatttaaaacgcaaacgaacgatccaacgcaaacgctaaaaacctacaaaaacgccataatcgcatccgatataactacgacgcgtccgcaaatta

SEQ ID NO: 23203 - DNA, 695 bp, Artificial Sequence
  chemically treated genomic DNA (Homo sapiens) CpG-island No: 23203
  misc_feature (227)..(227): n is either a, c, g or t
ttaatgcgtatttggcgtatagaaatcgacgattcgggtaggttacgtttacggttgtatttttttgttatgattaggatagagcggcgtggcgtatattaatagtttgtcgcgtgcgtagtggaatagtaatatttaggagttggttaatcgattgtaaagcgattaggtgttggaaatcgttaatcgtttgcgagaaagcggtaaagaggtagaagcggaagtantgttgcgttagtaattattttttacgcgtattgattttacgttggttgattgggcgtaataacgacgtgattatatcgtcgttcgcgttgtatattagaatgttttgacgcgggagttagttaacgtcgacgttatttttggtttgacggaagtggatattgttgtcggtgataaagcggcggtacgtagttagttggcgaaattgttcgttatcgataacgtttcgttgaatatatagcggcgcgtggcgttggtataggcgtagtttggcgatatcgtagtagcgtagcggacgtttaataagttgatttcgtaggtaaaattttagttatcgtcgatggaaagcgcgatggtgttgcgtgatggtgcgaagtttgaagcgtaggcgggcgatttaacgtaggcgttggaaatttataaagacgttatggtcgtattcggtgtgattacgacgcgttcgtagatta

SEQ ID NO: 23204 - DNA, 695 bp, Artificial Sequence
  chemically treated genomic DNA (Homo sapiens) CpG-island No: 23204
  misc_feature (469)..(469): n is either a, c, g or t
taatctacgaacgcgtcgtaatcacaccgaatacgaccataacgtctttataaatttccaacgcctacgttaaatcgcccgcctacgcttcaaacttcgcaccatcacgcaacaccatcgcgctttccatcgacgataactaaaattttacctacgaaatcaacttattaaacgtccgctacgctactacgatatcgccaaactacgcctataccaacgccacgcgccgctatatattcaacgaaacgttatcgataacgaacaatttcgccaactaactacgtaccgccgctttatcaccgacaacaatatccacttccgtcaaaccaaaaataacgtcgacgttaactaactcccgcgtcaaaacattctaatatacaacgcgaacgacgatataatcacgtcgttattacgcccaatcaaccaacgtaaaatcaatacgcgtaaaaaataattactaacgcaacantacttccgcttctacctctttaccgctttctcgcaaacgattaacgatttccaacacctaatcgctttacaatcgattaaccaactcctaaatattactattccactacgcacgcgacaaactattaatatacgccacgccgctctatcctaatcataacaaaaaaatacaaccgtaaacgtaacctacccgaatcgtcgatttctatacgccaaatacgcattaa

SEQ ID NO: 23205 - DNA, 528 bp, Artificial Sequence
  chemically treated genomic DNA (Homo sapiens) CpG-island No: 23205
acgcgttaagtttttgggttagaaaaaaaaaaaaaaaacgggtcgggattggtttaggttgggggaggcgggtttacgacgagatacgattttttattggtttattcgttaggattttgtttaatcgacgcgatcgttttttttagaagattttcgtttttttttcgtcggcggtcgcggaggcggaagaaggcgttttttcgtcgttttagtaatcgttagcggattttcgtcgttcgggtaattgttttaggtttttcgttagtttttgtttgggttttttcggttattcggataatcgttattcgtttcggttaattattaattcgtttttcgttatttcggtaattatcgtcggatttatttatttttggacgtcgttttggttttgttcgtaggttttttcgttttaaattttcgtcgcgggtttcgacgttcgcgattttacgttttaggggtttttttttttttttgttcgttttttcgttttttcggggcggggggtattgttttttttttggtaggggg

SEQ ID NO: 23206 - DNA, 528 bp, Artificial Sequence
  chemically treated genomic DNA (Homo sapiens) CpG-island No: 23206
ccccctaccaaaaaaaaaacaataccccccgccccgaaaaaacgaaaaaacgaacaaaaaaaaaaaaaaacccctaaaacgtaaaatcgcgaacgtcgaaacccgcgacgaaaatttaaaacgaaaaaacctacgaacaaaaccaaaacgacgtccaaaaataaataaatccgacgataattaccgaaataacgaaaaacgaattaataattaaccgaaacgaataacgattatccgaataaccgaaaaaacccaaacaaaaactaacgaaaaacctaaaacaattacccgaacgacgaaaatccgctaacgattactaaaacgacgaaaaaacgccttcttccgcctccgcgaccgccgacgaaaaaaaaacgaaaatcttctaaaaaaaacgatcgcgtcgattaaacaaaatcctaacgaataaaccaataaaaaatcgtatctcgtcgtaaacccgcctcccccaacctaaaccaatcccgacccgttttttttttttttttctaacccaaaaacttaacgcgt

SEQ ID NO: 23207 - DNA, 528 bp, Artificial Sequence
  chemically treated genomic DNA (Homo sapiens) CpG-island No: 23207
ttttttgttaggggaggagtaatgtttttcgtttcggggaggcgagaagacgggtaggaggaggagggagtttttgagacgtggggtcgcggacgtcggagttcgcggcggaggtttggggcgaggaggtttgcggataggattaggacggcgtttaggggtaggtgggttcggcgatggttgtcggggtgacgggggacgggttgatggttgatcggaacgggtagcggttgttcgagtgatcggaggggtttaggtaaaggttgacgggaggtttgggatagttgttcgggcgacggagattcgttgacggttgttagggcgacggaaaggcgttttttttcgttttcgcggtcgtcggcgggagggaggcgggggttttttggggaagacgatcgcgtcgattgggtagagttttggcgagtaagttaatagaaaatcgtgtttcgtcgtagattcgttttttttagtttgagttaatttcggttcgttttttttttttttttttggtttaagggtttggcgcgt

SEQ ID NO: 23208 - DNA, 528 bp, Artificial Sequence
  chemically treated genomic DNA (Homo sapiens) CpG-island No: 23208
acgcgccaaacccttaaaccaaaaaaaaaaaaaaaaaacgaaccgaaattaactcaaactaaaaaaaacgaatctacgacgaaacacgattttctattaacttactcgccaaaactctacccaatcgacgcgatcgtcttccccaaaaaacccccgcctccctcccgccgacgaccgcgaaaacgaaaaaaaacgcctttccgtcgccctaacaaccgtcaacgaatctccgtcgcccgaacaactatcccaaacctcccgtcaacctttacctaaacccctccgatcactcgaacaaccgctacccgttccgatcaaccatcaacccgtcccccgtcaccccgacaaccatcgccgaacccacctacccctaaacgccgtcctaatcctatccgcaaacctcctcgccccaaacctccgccgcgaactccgacgtccgcgaccccacgtctcaaaaactccctcctcctcctacccgtcttctcgcctccccgaaacgaaaaacattactcctcccctaacaaaaaa

SEQ ID NO: 23209 - DNA, 532 bp, Artificial Sequence
  chemically treated genomic DNA (Homo sapiens) CpG-island No: 23209
ttacgcgatttcgtagtttcgatagcgttttcgtgcgattattttgaggtttaggaaatcgtgtttatttagcgaggggtcgtttaggtaggcgggggacgcgtttcgacggcgttcgtagtagtcgcgtcggggtcggtatagtacgtgcgtgagcgttatgtagtcgtagatcgtcgcggttattagcgttatcgagaatattaggttttatatgaaggcgcgtagtagttttagcgataggcgcgacggcgttagtagcgcggttattattagtttcggtatgtcgtcgcgtttcgggattacggcggcgttgtcggttaggggtatttgtagtagcggcgaagcggtgttagggtttaggggtttatcgtttttggtttggggttttttcgtgtcgtcgggatttgtgggacgcgttgaaggaagaggcgggcggtttcgatagaaaatagttagagcgtattatttatttgagtgttaggtaaatatttgggcgcgatagggataggaaataagggtagggtgcgga

SEQ ID NO: 23210 - DNA, 532 bp, Artificial Sequence
  chemically treated genomic DNA (Homo sapiens) CpG-island No: 23210
tccgcaccctacccttatttcctatccctatcgcgcccaaatatttacctaacactcaaataaataatacgctctaactattttctatcgaaaccgcccgcctcttccttcaacgcgtcccacaaatcccgacgacacgaaaaaaccccaaaccaaaaacgataaacccctaaaccctaacaccgcttcgccgctactacaaatacccctaaccgacaacgccgccgtaatcccgaaacgcgacgacataccgaaactaataataaccgcgctactaacgccgtcgcgcctatcgctaaaactactacgcgccttcatataaaacctaatattctcgataacgctaataaccgcgacgatctacgactacataacgctcacgcacgtactataccgaccccgacgcgactactacgaacgccgtcgaaacgcgtcccccgcctacctaaacgacccctcgctaaataaacacgatttcctaaacctcaaaataatcgcacgaaaacgctatcgaaactacgaaatcgcgtaa

SEQ ID NO: 23211 - DNA, 532 bp, Artificial Sequence
  chemically treated genomic DNA (Homo sapiens) CpG-island No: 23211
ttcgtattttatttttgttttttgtttttgtcgcgtttaggtgtttatttggtatttaggtgagtggtgcgttttggttgttttttgtcggagtcgttcgtttttttttttagcgcgttttataaatttcgacggtacggaggggttttaggttaagggcgatgggtttttgagttttgatatcgtttcgtcgttgttgtaggtgtttttggtcggtagcgtcgtcgtggtttcggagcgcggcgatatgtcggagttggtggtgatcgcgttgttggcgtcgtcgcgtttgtcgttgaagttgttgcgcgtttttatgtggagtttggtgttttcggtggcgttggtggtcgcggcggtttacggttgtatagcgtttacgtacgtgttgtgtcggtttcggcgcggttgttgcgggcgtcgtcggagcgcgtttttcgtttgtttgagcgatttttcgttgggtgagtacggttttttgaattttaaggtgatcgtacgggggcgttatcggggttgcggggtcgcgtgg

SEQ ID NO: 23212 - DNA, 532 bp, Artificial Sequence
  chemically treated genomic DNA (Homo sapiens) CpG-island No: 23212
ccacgcgaccccgcaaccccgataacgcccccgtacgatcaccttaaaattcaaaaaaccgtactcacccaacgaaaaatcgctcaaacaaacgaaaaacgcgctccgacgacgcccgcaacaaccgcgccgaaaccgacacaacacgtacgtaaacgctatacaaccgtaaaccgccgcgaccaccaacgccaccgaaaacaccaaactccacataaaaacgcgcaacaacttcaacgacaaacgcgacgacgccaacaacgcgatcaccaccaactccgacatatcgccgcgctccgaaaccacgacgacgctaccgaccaaaaacacctacaacaacgacgaaacgatatcaaaactcaaaaacccatcgcccttaacctaaaacccctccgtaccgtcgaaatttataaaacgcgctaaaaaaaaaaacgaacgactccgacaaaaaacaaccaaaacgcaccactcacctaaataccaaataaacacctaaacgcgacaaaaacaaaaaacaaaaataaaatacgaa

SEQ ID NO: 23213 - DNA, 902 bp, Artificial Sequence
  chemically treated genomic DNA (Homo sapiens) CpG-island No: 23213
tttcgtcgcgcgttggttacgttttttcgagcgcgggtggaggattgcggattgtaaacgtttcggttaatagtcgagttcgatattagttcgcgggagggggcggaatcgagatagattcggtttttagtttatgaatataagacgtaggcgcgttttttgattggtttaggatgtgtagggggcggggttcggcggaagcgtatataaggtcgggttcggggacgttttttttttattcgcgcgttaggaggttcgggtcgttgtggtgcgttgttttttcgtttgcgttagggatttgttcgatttagtggtgagggttttggttgtatcggtttcgaggagttcggggcggcgggcggtttgcggcggttaggcgaggcggggtcgtagcggtacgtttttgggagggggcgggttcggggtggagttcgtttcgtcggcggcgagggatagcgggagattgggtcgagtagcggttagagggttttttttcgtcggttcgggtcgtcggcgattcggttgtcgtcgtaaaatggcggtcgcgagttcgaggttgtgtttagcgaaatggcgggagcgtcgagttttcggatggagtggcgtagggtgcgcgcggggcgtatgcgtacgcggcgggggcggggttacgtggcgttttcggtttttagggtcgttttttcggttttggggttggaggtatttatatattaacgtttttgtttatcgagttttagtttttttttttttttattgcgattgtatgagggaaaggacggtttcgtaaattttgggtaggcgtggttcgttttagtgtggtttttcgtttgttacgtcgtgttttgcgtttaaagtttggtttaagttggtatagtttttagtgttagatttttaagtttagt

SEQ ID NO: 23214 - DNA, 902 bp, Artificial Sequence
  chemically treated genomic DNA (Homo sapiens) CpG-island No: 23214
actaaacttaaaaatctaacactaaaaactataccaacttaaaccaaactttaaacgcaaaacacgacgtaacaaacgaaaaaccacactaaaacgaaccacgcctacccaaaatttacgaaaccgtcctttccctcatacaatcgcaataaaaaaaaaaaaaaactaaaactcgataaacaaaaacgttaatatataaatacctccaaccccaaaaccgaaaaaacgaccctaaaaaccgaaaacgccacgtaaccccgcccccgccgcgtacgcatacgccccgcgcgcaccctacgccactccatccgaaaactcgacgctcccgccatttcgctaaacacaacctcgaactcgcgaccgccattttacgacgacaaccgaatcgccgacgacccgaaccgacgaaaaaaaaccctctaaccgctactcgacccaatctcccgctatccctcgccgccgacgaaacgaactccaccccgaacccgccccctcccaaaaacgtaccgctacgaccccgcctcgcctaaccgccgcaaaccgcccgccgccccgaactcctcgaaaccgatacaaccaaaaccctcaccactaaatcgaacaaatccctaacgcaaacgaaaaaacaacgcaccacaacgacccgaacctcctaacgcgcgaataaaaaaaaaacgtccccgaacccgaccttatatacgcttccgccgaaccccgccccctacacatcctaaaccaatcaaaaaacgcgcctacgtcttatattcataaactaaaaaccgaatctatctcgattccgccccctcccgcgaactaatatcgaactcgactattaaccgaaacgtttacaatccgcaatcctccacccgcgctcgaaaaaacgtaaccaacgcgcgacgaaa

SEQ ID NO: 23215 - DNA, 902 bp, Artificial Sequence
  chemically treated genomic DNA (Homo sapiens) CpG-island No: 23215
attagatttggaagtttggtattgggagttgtgttaatttggattaaattttgggcgtaaagtacgacgtggtagacgaggaattatattagaacgggttacgtttatttaagatttacgaggtcgtttttttttttatgtaatcgtaatgggaaaaggaggaaattaaggttcggtaagtaaaagcgttggtgtgtggatatttttagttttaaggtcgggaaagcggttttggagatcgggggcgttacgtggtttcgttttcgtcgcgtgcgtatgcgtttcgcgcgtattttgcgttattttattcgggaattcggcgttttcgttatttcgttgggtatagtttcgagttcgcggtcgttattttgcggcggtaatcgggtcgtcggcggttcggatcggcggggagaggttttttggtcgttattcggtttaatttttcgttgtttttcgtcgtcggcggggcggattttatttcgggttcgtttttttttaggggcgtgtcgttgcggtttcgtttcgtttggtcgtcgtaggtcgttcgtcgtttcgagtttttcggagtcggtgtagttagggtttttattattgagtcgggtaggtttttgacgtaagcgggaagatagcgtattataacgattcgagttttttaacgcgcgagtgaggggggggcgttttcgagttcggttttatatacgttttcgtcgggtttcgttttttatatattttgggttaattagagggcgcgtttgcgttttatatttatgagttgggggtcgagtttatttcggtttcgttttttttcgcggattggtgtcgggttcgattattggtcgagacgtttgtagttcgtagttttttattcgcgttcgagggggcgtgattagcgcgcggcgggg

SEQ ID NO: 23216 - DNA, 902 bp, Artificial Sequence
  chemically treated genomic DNA (Homo sapiens) CpG-island No: 23216
ccccgccgcgcgctaatcacgccccctcgaacgcgaataaaaaactacgaactacaaacgtctcgaccaataatcgaacccgacaccaatccgcgaaaaaaaacgaaaccgaaataaactcgacccccaactcataaatataaaacgcaaacgcgccctctaattaacccaaaatatataaaaaacgaaacccgacgaaaacgtatataaaaccgaactcgaaaacgcccccccctcactcgcgcgttaaaaaactcgaatcgttataatacgctatcttcccgcttacgtcaaaaacctacccgactcaataataaaaaccctaactacaccgactccgaaaaactcgaaacgacgaacgacctacgacgaccaaacgaaacgaaaccgcaacgacacgcccctaaaaaaaaacgaacccgaaataaaatccgccccgccgacgacgaaaaacaacgaaaaattaaaccgaataacgaccaaaaaacctctccccgccgatccgaaccgccgacgacccgattaccgccgcaaaataacgaccgcgaactcgaaactatacccaacgaaataacgaaaacgccgaattcccgaataaaataacgcaaaatacgcgcgaaacgcatacgcacgcgacgaaaacgaaaccacgtaacgcccccgatctccaaaaccgctttcccgaccttaaaactaaaaatatccacacaccaacgcttttacttaccgaaccttaatttcctccttttcccattacgattacataaaaaaaaaaacgacctcgtaaatcttaaataaacgtaacccgttctaatataattcctcgtctaccacgtcgtactttacgcccaaaatttaatccaaattaacacaactcccaataccaaacttccaaatctaat

SEQ ID NO: 23217 - DNA, 1295 bp, Artificial Sequence
  chemically treated genomic DNA (Homo sapiens) CpG-island No: 23217
acgggttgcggtgcgtcggtagtttacggggcggttagtttttgtttataacgatgtggagttttgtgaaagtcggattcgaataaagggttacgtgtgtatttagaaagtcgagtttgtggtttaggggggtttgtcggcggagcggggttattggaagaaaagtttgcggatttcggtttagcgtacgagtaggattcgatagggaagattgtaagggttattgttcgagtagtgatcgcggggggttcgttattgagggggttcgtagcgcggagattttagtttcgcgggatttgaggcgtattcggtttcgagggagcggcggtcgcgtagtcgttgttaggtttcgttttgggtcgagtttcgggttttttgtagtaggtttgggagcggggcgttatttttttgggttttggacgtggtcgacgcgtttttagtgttcgtgaggtcggggtaggagtggcgggggtcgtttcgaagtgggtgggaatgagcggttcgaggttttgaagtcggggttcgtttcgttttttcgttgttagttcgattttttcggaagtcgcgattttttacgttgggttggtagttttgggttttgtcggttgcgttttgtcgggatttttacgggcgggtttcgggttttcgttttgattttttggagcggttcgacgaagtaagtttcgcggcgggcgcgcggggtattgtgggtagcgtcggggtttattaggcggaggcggggttcggcgttaagtttcgttttcgcgttttattggttggtattattttcgcgcgtttgattgatagcgcgtataggggcggggcgtcgttatcgttttcgtcgggttatggggtcgcgcgtgttgtagtcgtcgttgttgttgtttttgttggcgttgttgttggcggcgttgtcgtgcggtgtcgaagaggtttcgtcgttgcgtttcgcgtaggttacgttgtcgtcgtcgtcggtcgtgacgaacgggagttagtcgggcgcgttatataatagtacgtatacgcgttcgtcgggggcgtcgggttcggcgttgacgcgttttttttacgtgattttgggtttttgcggtttgatcgcgttttattttttgattcgggcgtttaggtgcgttaggcgtacgtgggcgtcgttttttagttttggttaattagcgcgcgtttagtgcgttacgtgtcgggtcgcggggtttttttttttttttttttttttttttttttttttttgttggagtgggcgtgggcggtgttgtgcggggtcgttacgtggtgtg

SEQ ID NO: 23218 - DNA, 1295 bp, Artificial Sequence
  chemically treated genomic DNA (Homo sapiens) CpG-island No: 23218
cacaccacgtaacgaccccgcacaacaccgcccacgcccactccaacaaaaaaaaaaaaaaaaaaaaaaaaaaaaaaaaaaaaaccccgcgacccgacacgtaacgcactaaacgcgcgctaattaaccaaaactaaaaaacgacgcccacgtacgcctaacgcacctaaacgcccgaatcaaaaaataaaacgcgatcaaaccgcaaaaacccaaaatcacgtaaaaaaaacgcgtcaacgccgaacccgacgcccccgacgaacgcgtatacgtactattatataacgcgcccgactaactcccgttcgtcacgaccgacgacgacgacaacgtaacctacgcgaaacgcaacgacgaaacctcttcgacaccgcacgacaacgccgccaacaacaacgccaacaaaaacaacaacaacgacgactacaacacgcgcgaccccataacccgacgaaaacgataacgacgccccgcccctatacgcgctatcaatcaaacgcgcgaaaataataccaaccaataaaacgcgaaaacgaaacttaacgccgaaccccgcctccgcctaataaaccccgacgctacccacaataccccgcgcgcccgccgcgaaacttacttcgtcgaaccgctccaaaaaatcaaaacgaaaacccgaaacccgcccgtaaaaatcccgacaaaacgcaaccgacaaaacccaaaactaccaacccaacgtaaaaaatcgcgacttccgaaaaaatcgaactaacaacgaaaaaacgaaacgaaccccgacttcaaaacctcgaaccgctcattcccacccacttcgaaacgacccccgccactcctaccccgacctcacgaacactaaaaacgcgtcgaccacgtccaaaacccaaaaaaataacgccccgctcccaaacctactacaaaaaacccgaaactcgacccaaaacgaaacctaacaacgactacgcgaccgccgctccctcgaaaccgaatacgcctcaaatcccgcgaaactaaaatctccgcgctacgaaccccctcaataacgaaccccccgcgatcactactcgaacaataacccttacaatcttccctatcgaatcctactcgtacgctaaaccgaaatccgcaaacttttcttccaataaccccgctccgccgacaaacccccctaaaccacaaactcgactttctaaatacacacgtaaccctttattcgaatccgactttcacaaaactccacatcgttataaacaaaaactaaccgccccgtaaactaccgacgcaccgcaacccgt

SEQ ID NO: 23219 - DNA, 1295 bp, Artificial Sequence
  chemically treated genomic DNA (Homo sapiens) CpG-island No: 23219
tatattacgtgacgatttcgtatagtatcgtttacgtttattttaatagggagagagggagggagggagggagggaggggaggatttcgcggttcggtacgtgacgtattaggcgcgcgttaattggttaaggttgagagacggcgtttacgtgcgtttgacgtatttaaacgttcggattaggaagtagagcgcggttaggtcgtagaagtttaggattacgtagaaggagcgcgttagcgtcgagttcgacgttttcggcggacgcgtgtgcgtgttgttgtgtggcgcgttcggttggttttcgttcgttacggtcggcggcggcgataacgtgatttgcgcggggcgtagcggcgaggttttttcggtatcgtacggtagcgtcgttagtagtagcgttagtaggagtagtagtagcggcggttgtagtacgcgcggttttatggttcggcggaagcggtggcggcgtttcgtttttatgcgcgttgttagttaggcgcgcggaggtgatgttagttaatggggcgcggaggcggagtttgacgtcgggtttcgttttcgtttggtgagtttcggcgttatttatagtgtttcgcgcgttcgtcgcggaatttgtttcgtcgaatcgttttaagggattaggacggaggttcggagttcgttcgtgggagtttcggtaaggcgtagtcggtagagtttagaattgttagtttagcgtggggggtcgcggttttcgaggaaatcgggttggtagcggggagacggggcggatttcgattttaggatttcgggtcgtttatttttatttatttcggggcgattttcgttatttttgtttcggttttacggatattgagaacgcgtcggttacgtttagggtttaggaaggtggcgtttcgtttttaagtttgttatagggaattcgggattcggtttaagacggggtttgatagcggttgcgcggtcgtcgttttttcgaagtcgagtgcgttttagatttcgcgagattggagttttcgcgttgcgaatttttttagtggcgagtttttcgcggttattgttcggataatgatttttgtagttttttttgtcgggttttattcgtgcgttgaatcgaggttcgtaggttttttttttagtggtttcgtttcgtcgatagatttttttgaattatagattcggttttttgggtgtatacgtggttttttattcgaattcgatttttatagggttttatatcgttgtgggtaaggattggtcgtttcgtaagttgtcggcgtatcgtagttcgt

SEQ ID NO: 23220 - DNA, 1295 bp, Artificial Sequence
  chemically treated genomic DNA (Homo sapiens) CpG-island No: 23220
acgaactacgatacgccgacaacttacgaaacgaccaatccttacccacaacgatataaaaccctataaaaatcgaattcgaataaaaaaccacgtatacacccaaaaaaccgaatctataattcaaaaaaatctatcgacgaaacgaaaccactaaaaaaaaaacctacgaacctcgattcaacgcacgaataaaacccgacaaaaaaaactacaaaaatcattatccgaacaataaccgcgaaaaactcgccactaaaaaaattcgcaacgcgaaaactccaatctcgcgaaatctaaaacgcactcgacttcgaaaaaacgacgaccgcgcaaccgctatcaaaccccgtcttaaaccgaatcccgaattccctataacaaacttaaaaacgaaacgccaccttcctaaaccctaaacgtaaccgacgcgttctcaatatccgtaaaaccgaaacaaaaataacgaaaatcgccccgaaataaataaaaataaacgacccgaaatcctaaaatcgaaatccgccccgtctccccgctaccaacccgatttcctcgaaaaccgcgaccccccacgctaaactaacaattctaaactctaccgactacgccttaccgaaactcccacgaacgaactccgaacctccgtcctaatcccttaaaacgattcgacgaaacaaattccgcgacgaacgcgcgaaacactataaataacgccgaaactcaccaaacgaaaacgaaacccgacgtcaaactccgcctccgcgccccattaactaacatcacctccgcgcgcctaactaacaacgcgcataaaaacgaaacgccgccaccgcttccgccgaaccataaaaccgcgcgtactacaaccgccgctactactactcctactaacgctactactaacgacgctaccgtacgataccgaaaaaacctcgccgctacgccccgcgcaaatcacgttatcgccgccgccgaccgtaacgaacgaaaaccaaccgaacgcgccacacaacaacacgcacacgcgtccgccgaaaacgtcgaactcgacgctaacgcgctccttctacgtaatcctaaacttctacgacctaaccgcgctctacttcctaatccgaacgtttaaatacgtcaaacgcacgtaaacgccgtctctcaaccttaaccaattaacgcgcgcctaatacgtcacgtaccgaaccgcgaaatcctcccctccctccctccctccctccctctctccctattaaaataaacgtaaacgatactatacgaaatcgtcacgtaatata

SEQ ID NO: 23221 - DNA, 1112 bp, Artificial Sequence
  chemically treated genomic DNA (Homo sapiens) CpG-island No: 23221
atttgggacgcgtgcgtcggggttggtgaggttgcggatagcgttggaatcgggtaggtgagaggttcgggatttagggtcgggtcgggtggagcgcgtgggggcgcgggaggtagggtgcgttttcgtttttcggagattttaggtcgggttacgcggatgtcggcggggggcgcgtagaatcggggtcgttgggggtaggtttcgggggacgagtttgagacggggtgggtcggggtagggggcgggcgtaggttggagattttcgtttagttttcgcgcggtcggggtacggcgggagggggcgttcgcggttttttcgacgttcgggcgggataaaggtcggagttcgggttttttttcggcgggtgcggcggcggcggttcgcgtttcgatagttcgcgcggtcgggttttgcgttcggggcgatttcggcgtttcgtttcgtcgtcgtttgatttttcggcgttcgaggtcgcgcgcgcggaggcgggggcggttcgggatttttaagcgtcgtcgcgtttttttttcgttcgtttttcgttcgttcgttcggcggcggcggcggcggcggaggaggcggagaaggttggtaggcggcggtcgggagagcgagcgcggcggtcggatcggggttatggcgttcgcgtagcgttcgttgttttcgttgttgtttttgttgttatcgttgtcgtcgtcgtttttcgcgcgcgtcgaggacgtcgttcgcgttaattcggatcgttacgtcgtttattggaatcgtagtaattttaggtgagcgcggtcgcgcgcggggggcgttcggggattttttaacgttttttaagtcgcgttcggtttcgcgttttcggagtttcgggcgttttttacgcgcgcgtcgtcgtcgggatgcgggcgttcggttttcgcgggagttttttagggagtttcggtttttcggagtttgggggattcgtttttttcgcgtttgtttttttcggggcgttttattgttttacggattgtggggattcgcgttttatattttttagagcgtcgacgttttttggagtttggggaatttttttggtatttttcgatgtcgggtagtttttgagttgtttgtt

SEQ ID NO: 23222 - DNA, 1112 bp, Artificial Sequence
  chemically treated genomic DNA (Homo sapiens) CpG-island No: 23222
aacaaacaactcaaaaactacccgacatcgaaaaataccaaaaaaattccccaaactccaaaaaacgtcgacgctctaaaaaatataaaacgcgaatccccacaatccgtaaaacaataaaacgccccgaaaaaaacaaacgcgaaaaaaacgaatcccccaaactccgaaaaaccgaaactccctaaaaaactcccgcgaaaaccgaacgcccgcatcccgacgacgacgcgcgcgtaaaaaacgcccgaaactccgaaaacgcgaaaccgaacgcgacttaaaaaacgttaaaaaatccccgaacgccccccgcgcgcgaccgcgctcacctaaaattactacgattccaataaacgacgtaacgatccgaattaacgcgaacgacgtcctcgacgcgcgcgaaaaacgacgacgacaacgataacaacaaaaacaacaacgaaaacaacgaacgctacgcgaacgccataaccccgatccgaccgccgcgctcgctctcccgaccgccgcctaccaaccttctccgcctcctccgccgccgccgccgccgccgaacgaacgaacgaaaaacgaacgaaaaaaaaacgcgacgacgcttaaaaatcccgaaccgcccccgcctccgcgcgcgcgacctcgaacgccgaaaaatcaaacgacgacgaaacgaaacgccgaaatcgccccgaacgcaaaacccgaccgcgcgaactatcgaaacgcgaaccgccgccgccgcacccgccgaaaaaaaacccgaactccgacctttatcccgcccgaacgtcgaaaaaaccgcgaacgccccctcccgccgtaccccgaccgcgcgaaaactaaacgaaaatctccaacctacgcccgccccctaccccgacccaccccgtctcaaactcgtcccccgaaacctacccccaacgaccccgattctacgcgccccccgccgacatccgcgtaacccgacctaaaatctccgaaaaacgaaaacgcaccctacctcccgcgcccccacgcgctccacccgacccgaccctaaatcccgaacctctcacctacccgattccaacgctatccgcaacctcaccaaccccgacgcacgcgtcccaaat

SEQ ID NO: 23223 - DNA, 1112 bp, Artificial Sequence
  chemically treated genomic DNA (Homo sapiens) CpG-island No: 23223
ggtaggtaatttaggggttattcggtatcggagggtattagaggggttttttaaattttaggagacgtcggcgttttgggggatgtggggcgcgagtttttatagttcgtagggtaatggggcgtttcggggaaggtaggcgcgaaaagggcgagttttttaaatttcggggggtcggagttttttggggggttttcgcgggaatcgggcgttcgtatttcggcggcggcgcgcgcgtggggggcgttcggagtttcgggggcgcgaggtcgggcgcggtttggggggcgttggggggttttcgggcgtttttcgcgcgcggtcgcgtttatttggggttgttgcggttttagtagacggcgtagcggttcgagttggcgcgggcggcgttttcggcgcgcgcgaagggcggcggcggtagcggtaatagtaggagtagtagcgggagtagcgggcgttgcgcgggcgttatggtttcggttcggtcgtcgcgttcgttttttcggtcgtcgtttgttagtttttttcgtttttttcgtcgtcgtcgtcgtcgtcgagcgggcgggcggagggcgggcgggaggagggcgcggcggcgtttggagatttcgggtcgttttcgttttcgcgcgcgcgatttcgggcgtcgagaagttaggcggcggcggggcggggcgtcggggtcgtttcgggcgtaggattcggtcgcgcggattgtcggagcgcgggtcgtcgtcgtcgtattcgtcggggaggggttcgggtttcggtttttgtttcgttcgagcgtcgggagggtcgcgggcgttttttttcgtcgtgtttcggtcgcgcggggattgggcgggggtttttagtttgcgttcgttttttgtttcggtttatttcgttttaggttcgtttttcggggtttgtttttagcgatttcgattttgcgcgtttttcgtcggtattcgcgtggttcggtttggggttttcgaggggcgggggcgtattttgtttttcgcgtttttacgcgttttattcggttcggttttgggtttcgggttttttatttgttcggttttagcgttattcgtagttttattaatttcgacgtacgcgttttaaat

SEQ ID NO: 23224 - DNA, 1112 bp, Artificial Sequence
  chemically treated genomic DNA (Homo sapiens) CpG-island No: 23224
atttaaaacgcgtacgtcgaaattaataaaactacgaataacgctaaaaccgaacaaataaaaaacccgaaacccaaaaccgaaccgaataaaacgcgtaaaaacgcgaaaaacaaaatacgcccccgcccctcgaaaaccccaaaccgaaccacgcgaataccgacgaaaaacgcgcaaaatcgaaatcgctaaaaacaaaccccgaaaaacgaacctaaaacgaaataaaccgaaacaaaaaacgaacgcaaactaaaaacccccgcccaatccccgcgcgaccgaaacacgacgaaaaaaaacgcccgcgaccctcccgacgctcgaacgaaacaaaaaccgaaacccgaacccctccccgacgaatacgacgacgacgacccgcgctccgacaatccgcgcgaccgaatcctacgcccgaaacgaccccgacgccccgccccgccgccgcctaacttctcgacgcccgaaatcgcgcgcgcgaaaacgaaaacgacccgaaatctccaaacgccgccgcgccctcctcccgcccgccctccgcccgcccgctcgacgacgacgacgacgacgaaaaaaacgaaaaaaactaacaaacgacgaccgaaaaaacgaacgcgacgaccgaaccgaaaccataacgcccgcgcaacgcccgctactcccgctactactcctactattaccgctaccgccgccgcccttcgcgcgcgccgaaaacgccgcccgcgccaactcgaaccgctacgccgtctactaaaaccgcaacaaccccaaataaacgcgaccgcgcgcgaaaaacgcccgaaaaccccccaacgccccccaaaccgcgcccgacctcgcgcccccgaaactccgaacgccccccacgcgcgcgccgccgccgaaatacgaacgcccgattcccgcgaaaaccccccaaaaaactccgaccccccgaaatttaaaaaactcgcccttttcgcgcctaccttccccgaaacgccccattaccctacgaactataaaaactcgcgccccacatcccccaaaacgccgacgtctcctaaaatttaaaaaacccctctaataccctccgataccgaataacccctaaattacctacc

SEQ ID NO: 23225 - DNA, 686 bp, Artificial Sequence
  chemically treated genomic DNA (Homo sapiens) CpG-island No: 23225
gtttttcgtgtttttgatttcggttttcgtcgcgtatttcgattcgtttttcgtgtttttgttttttgattttggtttttttcgcgtatttcgattcgtgtttcgtttttcgtttcgggcgttgatttttggtcgttttgttttcgtaggttttacgtaggcgcgggggacgacggcgggggttatacggtggaggtgagtattaatgattatttggatatttattgttcgtattatggggcgtcgttgtcgtcggtcgagcgtatggagtattacgtgttgtatatggttaacggcgagggttacgttttttgcgattatcgttagcgcggttttaagcgttgggagtgtaatcggttcgcggcgttcggggggtcgtttaagttttcggagaagttttagttttttacgtttttttttttgggtttcgagtttcggttcggttacgagtattattatatttgtgagtggggtcgggtcggggttgtcggggttcgagtgggcggggacgcgggggcggggttaggaagtgggcgggattattggggtggggtcggggagtgggcggggtagcgtagtgggcggggtcgcggtgtggggttaggggggagtgggcggggtcgcggaatggggttaggggggagtgggcggggtcgcggagtggggttagggtcggtgttggttat

SEQ ID NO: 23226 - DNA, 686 bp, Artificial Sequence
  chemically treated genomic DNA (Homo sapiens) CpG-island No: 23226
ataaccaacaccgaccctaaccccactccgcgaccccgcccactcccccctaaccccattccgcgaccccgcccactcccccctaaccccacaccgcgaccccgcccactacgctaccccgcccactccccgaccccaccccaataatcccgcccacttcctaaccccgcccccgcgtccccgcccactcgaaccccgacaaccccgacccgaccccactcacaaatataataatactcgtaaccgaaccgaaactcgaaacccaaaaaaaaaaacgtaaaaaactaaaacttctccgaaaacttaaacgaccccccgaacgccgcgaaccgattacactcccaacgcttaaaaccgcgctaacgataatcgcaaaaaacgtaaccctcgccgttaaccatatacaacacgtaatactccatacgctcgaccgacgacaacgacgccccataatacgaacaataaatatccaaataatcattaatactcacctccaccgtataacccccgccgtcgtcccccgcgcctacgtaaaacctacgaaaacaaaacgaccaaaaatcaacgcccgaaacgaaaaacgaaacacgaatcgaaatacgcgaaaaaaaccaaaatcaaaaaacaaaaacacgaaaaacgaatcgaaatacgcgacgaaaaccgaaatcaaaaacacgaaaaac

SEQ ID NO: 23227 - DNA, 686 bp, Artificial Sequence
  chemically treated genomic DNA (Homo sapiens) CpG-island No: 23227
gtggttagtatcggttttggttttatttcgcggtttcgtttatttttttttggttttatttcgcggtttcgtttatttttttttggttttatatcgcggtttcgtttattgcgttgtttcgtttatttttcggttttattttagtggtttcgtttattttttggtttcgttttcgcgttttcgtttattcgggtttcggtagtttcggttcgattttatttatagatgtagtaatattcgtggtcgggtcggaattcgaagtttagggagaagggcgtgaagagttggaattttttcgagaatttgagcggtttttcgggcgtcgcgggtcggttgtatttttagcgtttgaagtcgcgttggcggtggtcgtaggaggcgtggttttcgtcgttgattatgtatagtacgtagtgttttatgcgttcggtcggcggtagcggcgttttatagtgcgggtagtagatgtttaggtagttattgatgtttatttttatcgtgtagttttcgtcgtcgtttttcgcgtttgcgtggaatttgcggggataaggcggttagaggttagcgttcggagcgaggaacggggtacgggtcggggtgcgcggggagggttagggttaggggataggagtacgagggacgggtcggggtgcgcggcgagggtcggggttaggagtacgggggat

SEQ ID NO: 23228 - DNA, 686 bp, Artificial Sequence
  chemically treated genomic DNA (Homo sapiens) CpG-island No: 23228
atcccccgtactcctaaccccgaccctcgccgcgcaccccgacccgtccctcgtactcctatcccctaaccctaaccctccccgcgcaccccgacccgtaccccgttcctcgctccgaacgctaacctctaaccgccttatccccgcaaattccacgcaaacgcgaaaaacgacgacgaaaactacacgataaaaataaacatcaataactacctaaacatctactacccgcactataaaacgccgctaccgccgaccgaacgcataaaacactacgtactatacataatcaacgacgaaaaccacgcctcctacgaccaccgccaacgcgacttcaaacgctaaaaatacaaccgacccgcgacgcccgaaaaaccgctcaaattctcgaaaaaattccaactcttcacgcccttctccctaaacttcgaattccgacccgaccacgaatattactacatctataaataaaatcgaaccgaaactaccgaaacccgaataaacgaaaacgcgaaaacgaaaccaaaaaataaacgaaaccactaaaataaaaccgaaaaataaacgaaacaacgcaataaacgaaaccgcgatataaaaccaaaaaaaaataaacgaaaccgcgaaataaaaccaaaaaaaaataaacgaaaccgcgaaataaaaccaaaaccgatactaaccac

SEQ ID NO: 23229 - DNA, 595 bp, Artificial Sequence
  chemically treated genomic DNA (Homo sapiens) CpG-island No: 23229
gttgaagtcgaggcgggagtttcggatttttcgagttcgcggtttgtttgcgtcgttcgggtcgggttaagttcgtagttttgagagtttagtttgagacggtttcgagattacgatttttatagttattatttttaacgtttttaagtcgaggagcgagaggggtttcgttcgacggttatcgttcgtatttagtttttggtcgcgttggtttcgtagtcgttcgttttatttgcgtgttcgtcgttattttgtcggggttgatttcggaatcgttttcggaacgttttcgggttatagcgtggtttacgcggtagggcgaggtcgggagttagcgggggtagggtttcgggtttggtgttttcgggtaggacggcggtcgttgtagttcgggtagtcggattacgggtttaaagttggttcgcgttcgagttataaggttttttttttagggttcgttttttagtttcgggcgtttcgtgggagattagcgtttgtaacgtggtgagttcgcggtgtaacgttatgggttcgttttgtagtttttgatttatttttagttcgtagggttagttttacgtgggttttttttgag

SEQ ID NO: 23230 - DNA, 595 bp, Artificial Sequence
  chemically treated genomic DNA (Homo sapiens) CpG-island No: 23230
ctcaaaaaaaacccacgtaaaactaaccctacgaactaaaaataaatcaaaaactacaaaacgaacccataacgttacaccgcgaactcaccacgttacaaacgctaatctcccacgaaacgcccgaaactaaaaaacgaaccctaaaaaaaaaaccttataactcgaacgcgaaccaactttaaacccgtaatccgactacccgaactacaacgaccgccgtcctacccgaaaacaccaaacccgaaaccctacccccgctaactcccgacctcgccctaccgcgtaaaccacgctataacccgaaaacgttccgaaaacgattccgaaatcaaccccgacaaaataacgacgaacacgcaaataaaacgaacgactacgaaaccaacgcgaccaaaaactaaatacgaacgataaccgtcgaacgaaacccctctcgctcctcgacttaaaaacgttaaaaataataactataaaaatcgtaatctcgaaaccgtctcaaactaaactctcaaaactacgaacttaacccgacccgaacgacgcaaacaaaccgcgaactcgaaaaatccgaaactcccgcctcgacttcaac

SEQ ID NO: 23231 - DNA, 595 bp, Artificial Sequence
  chemically treated genomic DNA (Homo sapiens) CpG-island No: 23231
tttaggaaaggtttacgtagggttggttttgcgggttggaagtgggttaggggttgtaaggcgggtttatagcgttatatcgcgggtttattacgttataagcgttagttttttacgaggcgttcggggttgaagagcgggttttggggaggaggttttgtggttcgggcgcgggttaattttaagttcgtgattcggttgttcgggttgtagcggtcgtcgttttgttcgggggtattaagttcggggttttgttttcgttggttttcggtttcgttttgtcgcgtgggttacgttgtgattcggaagcgtttcggaagcggtttcggagttagtttcggtaggatggcggcggatacgtaggtgaggcgggcggttgcggggttaacgcggttagggattgggtgcggacggtggtcgtcgggcggggtttttttcgtttttcggtttaggggcgttggaggtggtggttgtggaggtcgtagtttcggggtcgttttaggttggatttttagggttgcgggtttggttcggttcgggcggcgtaggtagatcgcgggttcgaggagttcggggttttcgtttcgattttagt

SEQ ID NO: 23232 - DNA, 595 bp, Artificial Sequence
  chemically treated genomic DNA (Homo sapiens) CpG-island No: 23232
actaaaatcgaaacgaaaaccccgaactcctcgaacccgcgatctacctacgccgcccgaaccgaaccaaacccgcaaccctaaaaatccaacctaaaacgaccccgaaactacgacctccacaaccaccacctccaacgcccctaaaccgaaaaacgaaaaaaaccccgcccgacgaccaccgtccgcacccaatccctaaccgcgttaaccccgcaaccgcccgcctcacctacgtatccgccgccatcctaccgaaactaactccgaaaccgcttccgaaacgcttccgaatcacaacgtaacccacgcgacaaaacgaaaccgaaaaccaacgaaaacaaaaccccgaacttaatacccccgaacaaaacgacgaccgctacaacccgaacaaccgaatcacgaacttaaaattaacccgcgcccgaaccacaaaacctcctccccaaaacccgctcttcaaccccgaacgcctcgtaaaaaactaacgcttataacgtaataaacccgcgatataacgctataaacccgccttacaacccctaacccacttccaacccgcaaaaccaaccctacgtaaacctttcctaaa

SEQ ID NO: 23233 - DNA, 604 bp, Artificial Sequence
  chemically treated genomic DNA (Homo sapiens) CpG-island No: 23233
ggcggtgcgttagggattgttacgtagggtttaaagacgatgttattgaggagagatagggagtttaggtttggttacgtcgatatttatttcgcggtttcgggtttaagaggagtaggatacgcgtaatcgttcgtcggttttgtttagggtagcggtcgttatttcggggcgtgtaagtcgttatcgaggttttaggcggaatagaataggattttatgtttttaaaggtttttaaagatttttttatgtttttcgtcggcgatttttggcgtttatttaattagtatacgaattttttacgaggacgtttggcgagagaagggtttcgcgttcgcgcgtgttttttataatgcgaataaagtagttaattagaaatcgcggatagcgtttttgtttattggttgcgttatcgttcgttagataaagttgaacgaatataggtaattattggataatatcgttgttattttagttaacggaaagtcgtttttaagtagggtcgcgaaggaaggcgttgtttcgcgttggaggagtttgttttgagttgttgttatttgttgggttggagttggagttggagttgcgaattcggagtttcggt

SEQ ID NO: 23234 - DNA, 604 bp, Artificial Sequence
  chemically treated genomic DNA (Homo sapiens) CpG-island No: 23234
accgaaactccgaattcgcaactccaactccaactccaacccaacaaataacaacaactcaaaacaaactcctccaacgcgaaacaacgccttccttcgcgaccctacttaaaaacgactttccgttaactaaaataacaacgatattatccaataattacctatattcgttcaactttatctaacgaacgataacgcaaccaataaacaaaaacgctatccgcgatttctaattaactactttattcgcattataaaaaacacgcgcgaacgcgaaacccttctctcgccaaacgtcctcgtaaaaaattcgtatactaattaaataaacgccaaaaatcgccgacgaaaaacataaaaaaatctttaaaaacctttaaaaacataaaatcctattctattccgcctaaaacctcgataacgacttacacgccccgaaataacgaccgctaccctaaacaaaaccgacgaacgattacgcgtatcctactcctcttaaacccgaaaccgcgaaataaatatcgacgtaaccaaacctaaactccctatctctcctcaataacatcgtctttaaaccctacgtaacaatccctaacgcaccgcc

SEQ ID NO: 23235 - DNA, 604 bp, Artificial Sequence
  chemically treated genomic DNA (Homo sapiens) CpG-island No: 23235
atcgggatttcgaattcgtagttttagttttagttttagtttagtaggtggtagtagtttagagtaagtttttttaacgcgaggtagcgttttttttcgcgattttatttaaaggcggtttttcgttggttggagtggtagcgatattatttaatggttgtttgtattcgtttagttttgtttgacgggcgatggcgtagttaatagataggagcgttattcgcggtttttgattggttattttgttcgtattataaaaggtacgcgcgggcgcgaggtttttttttcgttaggcgttttcgtggaaggttcgtgtgttagttagatgggcgttaggggtcgtcggcgggaagtatggaggggtttttgggggtttttgggaatatggagttttattttgtttcgtttggggtttcggtggcggtttgtacgtttcgagatgacggtcgttgttttaggtagggtcggcgggcgattgcgcgtgttttgttttttttaggttcgggatcgcgggatgggtgtcggcgtgattaggtttgagttttttgtttttttttagtgatatcgtttttaaattttgcgtggtaatttttgacgtatcgtt

SEQ ID NO: 23236 - DNA, 604 bp, Artificial Sequence
  chemically treated genomic DNA (Homo sapiens) CpG-island No: 23236
aacgatacgtcaaaaattaccacgcaaaatttaaaaacgatatcactaaaaaaaaacaaaaaactcaaacctaatcacgccgacacccatcccgcgatcccgaacctaaaaaaaacaaaacacgcgcaatcgcccgccgaccctacctaaaacaacgaccgtcatctcgaaacgtacaaaccgccaccgaaaccccaaacgaaacaaaataaaactccatattcccaaaaacccccaaaaacccctccatacttcccgccgacgacccctaacgcccatctaactaacacacgaaccttccacgaaaacgcctaacgaaaaaaaaacctcgcgcccgcgcgtaccttttataatacgaacaaaataaccaatcaaaaaccgcgaataacgctcctatctattaactacgccatcgcccgtcaaacaaaactaaacgaatacaaacaaccattaaataatatcgctaccactccaaccaacgaaaaaccgcctttaaataaaatcgcgaaaaaaaacgctacctcgcgttaaaaaaacttactctaaactactaccacctactaaactaaaactaaaactaaaactacgaattcgaaatcccgat

SEQ ID NO: 23237 - DNA, 580 bp, Artificial Sequence
  chemically treated genomic DNA (Homo sapiens) CpG-island No: 23237
tcggtgtcggggtcggtttggttcgagattaaggttcggttagggattttagtttcgcggagtttcggtcggtagggataggagttgaggtcggggtcgtcgagggtgggatttcgcggtttttgtcgttcgttggcgtttttttggttttaagttgcgcgtttttcgtttttttttttttcggtttttcgtttatttatcgaggtcgtttatggtcggattacgggcgtcggtttagggtcgcgttagttgttcgtttcggggtcgttcgtttatgtttcgtaattttttcgtcgcgagtttcggttcggaacggaacgcgtcgtcgtcgcgcgcgttcgcgttcgcgttcgtcgcgcgtttcgttttcggtcgttttttgtgtacgcgcgtttcgttttcggatattttcgcgagtttgttggtttcgttttttgcgtacgttggtttcgttttcgttaagagttcgggtagtgggcgtcgttgggcggggcggtggcgttttttcgcggttaagcgggtaggtgggcggtttttaggtttttagttatttttatttatttttttgttttttttaaag

SEQ ID NO: 23238 - DNA, 580 bp, Artificial Sequence
  chemically treated genomic DNA (Homo sapiens) CpG-island No: 23238
ctttaaaaaaaacaaaaaaataaataaaaataactaaaaacctaaaaaccgcccacctacccgcttaaccgcgaaaaaacgccaccgccccgcccaacgacgcccactacccgaactcttaacgaaaacgaaaccaacgtacgcaaaaaacgaaaccaacaaactcgcgaaaatatccgaaaacgaaacgcgcgtacacaaaaaacgaccgaaaacgaaacgcgcgacgaacgcgaacgcgaacgcgcgcgacgacgacgcgttccgttccgaaccgaaactcgcgacgaaaaaattacgaaacataaacgaacgaccccgaaacgaacaactaacgcgaccctaaaccgacgcccgtaatccgaccataaacgacctcgataaataaacgaaaaaccgaaaaaaaaaaaaacgaaaaacgcgcaacttaaaaccaaaaaaacgccaacgaacgacaaaaaccgcgaaatcccaccctcgacgaccccgacctcaactcctatccctaccgaccgaaactccgcgaaactaaaatccctaaccgaaccttaatctcgaaccaaaccgaccccgacaccga

SEQ ID NO: 23239 - DNA, 580 bp, Artificial Sequence
  chemically treated genomic DNA (Homo sapiens) CpG-island No: 23239
ttttgagagggatagaaagatggatgggagtggttggaggtttgggagtcgtttatttgttcgtttagtcgcgagggggcgttatcgtttcgtttagcgacgtttattgttcgggtttttggcgggggcgggattagcgtgcgtagggggcggggttagtaagttcgcgggggtgttcgggggcggggcgcgcgtgtatagggggcggtcgggggcggggcgcgcggcgggcgcgggcgcgggcgcgcgcggcggcggcgcgtttcgtttcgggtcgaggttcgcggcggaaaagttgcggggtatagacgagcggtttcgggacgggtagttagcgcgattttgagtcggcgttcgtggttcggttatggacgatttcggtgagtgagcgggaggtcgagggaggaggaggcgagaggcgcgtagtttggggttaggagggcgttagcgagcggtaggggtcgcgggattttattttcggcggtttcggttttagtttttgtttttgtcggtcggggtttcgcggggttgggatttttaatcgggttttagtttcgggttaggtcggtttcggtatcga

SEQ ID NO: 23240 - DNA, 580 bp, Artificial Sequence
  chemically treated genomic DNA (Homo sapiens) CpG-island No: 23240
tcgataccgaaaccgacctaacccgaaactaaaacccgattaaaaatcccaaccccgcgaaaccccgaccgacaaaaacaaaaactaaaaccgaaaccgccgaaaataaaatcccgcgacccctaccgctcgctaacgccctcctaaccccaaactacgcgcctctcgcctcctcctccctcgacctcccgctcactcaccgaaatcgtccataaccgaaccacgaacgccgactcaaaatcgcgctaactacccgtcccgaaaccgctcgtctataccccgcaacttttccgccgcgaacctcgacccgaaacgaaacgcgccgccgccgcgcgcgcccgcgcccgcgcccgccgcgcgccccgcccccgaccgccccctatacacgcgcgccccgcccccgaacacccccgcgaacttactaaccccgccccctacgcacgctaatcccgcccccgccaaaaacccgaacaataaacgtcgctaaacgaaacgataacgccccctcgcgactaaacgaacaaataaacgactcccaaacctccaaccactcccatccatctttctatccctctcaaaa

SEQ ID NO: 23241 - DNA, 593 bp, Artificial Sequence
  chemically treated genomic DNA (Homo sapiens) CpG-island No: 23241
cgaacgtttcgttcgcgtcgcgtatttggttgtttggcggtttttcggattcgacgttacgtattggttcgcgtttcgttttcggttcggggtcgtcgcgcgtttggtcggcgatttttcgggcgttttttagtcgcgttagttcgcggtttcgtgtttcgtattcgttttgcgttttttggcgttcgcgtcgtgcgttcgttagttttttggtgagcgcgtttaggcgttggcgtagttggcgtattttttcgcgcgcgcggttgcgtttagcgcgtattttgttttatttttcgcgttaattggtagtgtagttcgattatcggcgtatggttttttttatttgcgtcgttcgcgttcgcgttttttttagttttcgtagtcgtagtttttcgcggtttttttagtcgtcgtcggttagtagcgcgggcgcggggggtaggggtagtgcgggcggcggttcgggcgagggcgtgtcgttgggcggcgtgggcggtaaggagtcggtaggttttatgcgtttcggcgacgggttgtttaggatggttaggaggttgtttttggatagttgcggggattcggttagtcggggg

SEQ ID NO: 23242 - DNA, 593 bp, Artificial Sequence
  chemically treated genomic DNA (Homo sapiens) CpG-island No: 23242
cccccgactaaccgaatccccgcaactatccaaaaacaacctcctaaccatcctaaacaacccgtcgccgaaacgcataaaacctaccgactccttaccgcccacgccgcccaacgacacgccctcgcccgaaccgccgcccgcactacccctaccccccgcgcccgcgctactaaccgacgacgactaaaaaaaccgcgaaaaactacgactacgaaaactaaaaaaaacgcgaacgcgaacgacgcaaataaaaaaaaccatacgccgataatcgaactacactaccaattaacgcgaaaaataaaacaaaatacgcgctaaacgcaaccgcgcgcgcgaaaaaatacgccaactacgccaacgcctaaacgcgctcaccaaaaaactaacgaacgcacgacgcgaacgccaaaaaacgcaaaacgaatacgaaacacgaaaccgcgaactaacgcgactaaaaaacgcccgaaaaatcgccgaccaaacgcgcgacgaccccgaaccgaaaacgaaacgcgaaccaatacgtaacgtcgaatccgaaaaaccgccaaacaaccaaatacgcgacgcgaacgaaacgttcg

SEQ ID NO: 23243 - DNA, 593 bp, Artificial Sequence
  chemically treated genomic DNA (Homo sapiens) CpG-island No: 23243
ttttcggttggtcgagttttcgtagttgtttaagggtagttttttgattattttgggtagttcgtcgtcggagcgtatggggtttgtcgattttttgtcgtttacgtcgtttagcggtacgttttcgttcgggtcgtcgttcgtattgtttttgtttttcgcgttcgcgttgttggtcgacggcgattgggagagtcgcgaggagttgcggttgcgggagttggaggaggcgcgggcgcgggcggcgtagatggagaagattatgcgtcggtggtcggattgtattgttaattggcgcgagaaatggagtaaggtgcgcgttgagcgtaatcgcgcgcgcgaggaggtgcgttagttgcgttagcgtttggacgcgtttattaaggagttggcgggcgtacggcgcgagcgttaagaggcgtagggcgagtgcgaggtacggggtcgcgagttggcgcggttgaggggcgttcggggggtcgtcgattagacgcgcgacggtttcgagtcggaagcggagcgcgagttagtgcgtgacgtcgggttcgagaggtcgttaggtagttaggtgcgcggcgcgggcggggcgttcg

SEQ ID NO: 23244 - DNA, 593 bp, Artificial Sequence
  chemically treated genomic DNA (Homo sapiens) CpG-island No: 23244
cgaacgccccgcccgcgccgcgcacctaactacctaacgacctctcgaacccgacgtcacgcactaactcgcgctccgcttccgactcgaaaccgtcgcgcgtctaatcgacgaccccccgaacgcccctcaaccgcgccaactcgcgaccccgtacctcgcactcgccctacgcctcttaacgctcgcgccgtacgcccgccaactccttaataaacgcgtccaaacgctaacgcaactaacgcacctcctcgcgcgcgcgattacgctcaacgcgcaccttactccatttctcgcgccaattaacaatacaatccgaccaccgacgcataatcttctccatctacgccgcccgcgcccgcgcctcctccaactcccgcaaccgcaactcctcgcgactctcccaatcgccgtcgaccaacaacgcgaacgcgaaaaacaaaaacaatacgaacgacgacccgaacgaaaacgtaccgctaaacgacgtaaacgacaaaaaatcgacaaaccccatacgctccgacgacgaactacccaaaataatcaaaaaactacccttaaacaactacgaaaactcgaccaaccgaaaa

SEQ ID NO: 23245 - DNA, 789 bp, Artificial Sequence
  chemically treated genomic DNA (Homo sapiens) CpG-island No: 23245
ttagcgagggagatagggaggaaggaagggttggggaggcggagagatagatcgagcgagcgatatacggatagcgacggatagcgatagaagcggggttcgggatttgggagacggcgaggttgcggggcgcgaggtgttgggtacggagttatagggacggagagtcgagagtcggggtcgtagcgtggagggggcgttggttgttgtcgaagttcggagagcggcgtggcggaggcggagcggagtcgagcgaggggttagtacggaacgtttttttggaggcgagcggcgtagtcggcggagaggttttcggagtcgttttagaaaaagtcggttcggggggcgtggttacgcgttgtggcgtttttcgtttttcggtggtttcgttcggtttcggggttcgggggcggaaggggggaggggaggagaggagttgtagggaagggggttgtgtaggcgttcgacgtcgtagttttggttcgttgcgggggagggtcgagaagggtattgggcgtttagagtaattaatatcgagacgaatagcgagggttcggggagaaaaaacggaggatggtaaacggtaaagttaagggtacgaggtagcgtagcgcgtatttagaggtttttgggacggatattattttacgtttacgggttttttggcggtgttttttgagttgtcgggacggcgtaaggtggttgagcgaagttttttgttcggtgtttatagggagtatttgagatggtttgggaaaggaaatagggggttttagatcgtttgggtgt

SEQ ID NO: 23246 - DNA, 789 bp, Artificial Sequence
  chemically treated genomic DNA (Homo sapiens) CpG-island No: 23246
acacccaaacgatctaaaaccccctatttcctttcccaaaccatctcaaatactccctataaacaccgaacaaaaaacttcgctcaaccaccttacgccgtcccgacaactcaaaaaacaccgccaaaaaacccgtaaacgtaaaataatatccgtcccaaaaacctctaaatacgcgctacgctacctcgtacccttaactttaccgtttaccatcctccgttttttctccccgaaccctcgctattcgtctcgatattaattactctaaacgcccaatacccttctcgaccctcccccgcaacgaaccaaaactacgacgtcgaacgcctacacaacccccttccctacaactcctctcctcccctccccccttccgcccccgaaccccgaaaccgaacgaaaccaccgaaaaacgaaaaacgccacaacgcgtaaccacgccccccgaaccgactttttctaaaacgactccgaaaacctctccgccgactacgccgctcgcctccaaaaaaacgttccgtactaacccctcgctcgactccgctccgcctccgccacgccgctctccgaacttcgacaacaaccaacgccccctccacgctacgaccccgactctcgactctccgtccctataactccgtacccaacacctcgcgccccgcaacctcgccgtctcccaaatcccgaaccccgcttctatcgctatccgtcgctatccgtatatcgctcgctcgatctatctctccgcctccccaacccttccttcctccctatctccctcgctaa

SEQ ID NO: 23247 - DNA, 789 bp, Artificial Sequence
  chemically treated genomic DNA (Homo sapiens) CpG-island No: 23247
gtatttaagcggtttgagattttttgtttttttttttaaattattttaggtattttttgtaagtatcgagtaaaaagtttcgtttagttattttgcgtcgtttcggtagtttaaaggatatcgttagaggattcgtgagcgtggggtggtgttcgttttaggagtttttgggtgcgcgttgcgttatttcgtgtttttggttttgtcgtttgttatttttcgtttttttttttcgagttttcgttattcgtttcggtgttggttattttgggcgtttagtgtttttttcggttttttttcgtagcgggttaaggttgcggcgtcgagcgtttgtataatttttttttttatagttttttttttttttttttttttttcgttttcgggtttcggagtcgagcggggttatcggggggcggggagcgttatagcgcgtggttacgtttttcgagtcggttttttttagggcggtttcgggagttttttcgtcggttgcgtcgttcgtttttaagggagcgtttcgtgttggtttttcgttcggtttcgtttcgttttcgttacgtcgtttttcgagtttcggtagtagttagcgttttttttacgttgcgatttcggttttcggtttttcgtttttgtagtttcgtgtttagtatttcgcgtttcgtaatttcgtcgttttttaagtttcgggtttcgtttttgtcgttgttcgtcgttgttcgtgtgtcgttcgttcggtttgttttttcgtttttttagttttttttttttttttgtttttttcgttgg

SEQ ID NO: 23248 - DNA, 789 bp, Artificial Sequence
  chemically treated genomic DNA (Homo sapiens) CpG-island No: 23248
ccaacgaaaaaaacaaaaaaaaaaaaaaaactaaaaaaacgaaaaaacaaaccgaacgaacgacacacgaacaacgacgaacaacgacaaaaacgaaacccgaaacttaaaaaacgacgaaattacgaaacgcgaaatactaaacacgaaactacaaaaacgaaaaaccgaaaaccgaaatcgcaacgtaaaaaaaacgctaactactaccgaaactcgaaaaacgacgtaacgaaaacgaaacgaaaccgaacgaaaaaccaacacgaaacgctcccttaaaaacgaacgacgcaaccgacgaaaaaactcccgaaaccgccctaaaaaaaaccgactcgaaaaacgtaaccacgcgctataacgctccccgccccccgataaccccgctcgactccgaaacccgaaaacgaaaaaaaaaaaaaaaaaaaaaaaactataaaaaaaaaaattatacaaacgctcgacgccgcaaccttaacccgctacgaaaaaaaaccgaaaaaaacactaaacgcccaaaataaccaacaccgaaacgaataacgaaaactcgaaaaaaaaaaacgaaaaataacaaacgacaaaaccaaaaacacgaaataacgcaacgcgcacccaaaaactcctaaaacgaacaccaccccacgctcacgaatcctctaacgatatcctttaaactaccgaaacgacgcaaaataactaaacgaaactttttactcgatacttacaaaaaatacctaaaataatttaaaaaaaaaaacaaaaaatctcaaaccgcttaaatac

SEQ ID NO: 23249 - DNA, 762 bp, Artificial Sequence
  chemically treated genomic DNA (Homo sapiens) CpG-island No: 23249
ggtacgttttatttttttcgcgcggttgttgggaattcggaggtcgttcgggcggagcgcggagggcgcgtcggaatttggtcggggttttttattcgcgtcgtggtttcggtggttgcgtttcgtggcgagcgacgtcgataattttgcgatggagtttgtgcgggcgttgtggttgggtttggcgttggcgttggggtcggggttcgcggggggttatttttagtcgtgcggcgttttggcgcgtttcgggggtttcgtgcgtttgggcgtttttttgtttcgcgcgtttttcgttcgcgttcgcgttcgcgtcgttttggttcgggtcgttttggcgtcgcggttgtcgtataatttgagtttggagttggtggtcgtcgcgtttttcgttcgcgatttcgtttcgttgattcgcggtttgtgttaggcgttggtgttttcgggcgtggcggttttgttcgtttttttcgaggttcggttcgagttgttgtagttgtattttttggcggcggttatcgagattttcgtgtttagtttgttgcggcgggaggcgcgcgcgtttttcggagtttcggtacgcgggacgttcggagttaggacgagggggattcggggcgggagcggggtcgggagttttggggacgttcggagttaggatgggggtgtcgggattacgtagggaagggggatttcgggacgttggacgggttttagggattagggatggggaagattcgggtgttttcggagtaaggaaat

SEQ ID NO: 23250 - DNA, 762 bp, Artificial Sequence
  chemically treated genomic DNA (Homo sapiens) CpG-island No: 23250
atttccttactccgaaaacacccgaatcttccccatccctaatccctaaaacccgtccaacgtcccgaaatcccccttccctacgtaatcccgacacccccatcctaactccgaacgtccccaaaactcccgaccccgctcccgccccgaatccccctcgtcctaactccgaacgtcccgcgtaccgaaactccgaaaaacgcgcgcgcctcccgccgcaacaaactaaacacgaaaatctcgataaccgccgccaaaaaatacaactacaacaactcgaaccgaacctcgaaaaaaacgaacaaaaccgccacgcccgaaaacaccaacgcctaacacaaaccgcgaatcaacgaaacgaaatcgcgaacgaaaaacgcgacgaccaccaactccaaactcaaattatacgacaaccgcgacgccaaaacgacccgaaccaaaacgacgcgaacgcgaacgcgaacgaaaaacgcgcgaaacaaaaaaacgcccaaacgcacgaaacccccgaaacgcgccaaaacgccgcacgactaaaaataaccccccgcgaaccccgaccccaacgccaacgccaaacccaaccacaacgcccgcacaaactccatcgcaaaattatcgacgtcgctcgccacgaaacgcaaccaccgaaaccacgacgcgaataaaaaaccccgaccaaattccgacgcgccctccgcgctccgcccgaacgacctccgaattcccaacaaccgcgcgaaaaaaataaaacgtacc

SEQ ID NO: 23251 - DNA, 762 bp, Artificial Sequence
  chemically treated genomic DNA (Homo sapiens) CpG-island No: 23251
gtttttttgtttcggggatattcgggttttttttatttttgatttttggggttcgtttagcgtttcgggattttttttttttgcgtagtttcggtatttttattttgatttcggacgtttttagggttttcgatttcgttttcgtttcgggtttttttcgttttgatttcgggcgtttcgcgtatcggggtttcgaggggcgcgcgcgtttttcgtcgtagtaggttgagtacgggggtttcggtggtcgtcgttaggaagtgtagttgtagtagttcgggtcgagtttcgggaaaggcgagtagggtcgttacgttcggaggtattagcgtttggtataggtcgcgggttagcgaggcggggtcgcgggcggggggcgcggcgattattagttttaagtttaggttgtgcggtagtcgcggcgttagggcggttcgggttagggcggcgcgggcgcgggcgcgggcgagaggcgcgcggggtaggagggcgtttaggcgtacggagttttcgaggcgcgttaggacgtcgtacggttgagggtggtttttcgcggatttcggttttagcgttagcgttaggtttagttatagcgttcgtataaattttatcgtaaagttgtcggcgtcgttcgttacggggcgtaattatcgggattacggcgcgggtggagggtttcggttaggtttcgacgcgtttttcgcgtttcgttcgggcggttttcgggtttttagtaatcgcgcggggggagtgggacgtgtt

SEQ ID NO: 23252 - DNA, 762 bp, Artificial Sequence
  chemically treated genomic DNA (Homo sapiens) CpG-island No: 23252
aacacgtcccactccccccgcgcgattactaaaaacccgaaaaccgcccgaacgaaacgcgaaaaacgcgtcgaaacctaaccgaaaccctccacccgcgccgtaatcccgataattacgccccgtaacgaacgacgccgacaactttacgataaaatttatacgaacgctataactaaacctaacgctaacgctaaaaccgaaatccgcgaaaaaccaccctcaaccgtacgacgtcctaacgcgcctcgaaaactccgtacgcctaaacgccctcctaccccgcgcgcctctcgcccgcgcccgcgcccgcgccgccctaacccgaaccgccctaacgccgcgactaccgcacaacctaaacttaaaactaataatcgccgcgccccccgcccgcgaccccgcctcgctaacccgcgacctataccaaacgctaatacctccgaacgtaacgaccctactcgcctttcccgaaactcgacccgaactactacaactacacttcctaacgacgaccaccgaaacccccgtactcaacctactacgacgaaaaacgcgcgcgcccctcgaaaccccgatacgcgaaacgcccgaaatcaaaacgaaaaaaacccgaaacgaaaacgaaatcgaaaaccctaaaaacgtccgaaatcaaaataaaaataccgaaactacgcaaaaaaaaaaaatcccgaaacgctaaacgaaccccaaaaatcaaaaataaaaaaaacccgaatatccccgaaacaaaaaaac

SEQ ID NO: 23253 - DNA, 708 bp, Artificial Sequence
  chemically treated genomic DNA (Homo sapiens) CpG-island No: 23253
gtttcgaagtcggtcgcggggtgtaggaggttttcggaggtttttcgtttattttcggacgtgtatatcgtggttttttggttgtgtttgtcggttattttttgtcgttagcggtttttgtagaggtttagggcgcgagacggttgtttcggcggatattgattaggtcggtttcgtttttagcggtttcgaggtggagtagtagtagtagtagtaggattagttaacggtttcggagggttggaaacgggcgcgtcgggtcgtggataaggagcgtcgcgtgcgttttttgttggagttcgtcgtggttgtggtattcgaagcggacgcggaggcggaggttgcgtcgcgagagggtttcgtttggttgtgtttttacggtcgttcgttcgtcgtaaggtttacgggggttttttagttcggggagttgtaggagttggagcgtcgtatcgaagtcgcgcgtgagcggtttcgttaggttttggtgcggcgcggttagtttttggtatagttcggggatagcgtacgttatcggtttcggcgtttgttttaggttagagcggttttcgcggaggttttattatattttggtcgatcggggagttaggaatgaggcggtagtcgggtcgtttgggtttaagatatatatatagcgtagtgagtcgttgttaatagatagtttattttatatataaatataattttgta

SEQ ID NO: 23254 - DNA, 708 bp, Artificial Sequence
  chemically treated genomic DNA (Homo sapiens) CpG-island No: 23254
tacaaaattatatttatatataaaataaactatctattaacaacgactcactacgctatatatatatcttaaacccaaacgacccgactaccgcctcattcctaactccccgatcgaccaaaatataataaaacctccgcgaaaaccgctctaacctaaaacaaacgccgaaaccgataacgtacgctatccccgaactataccaaaaactaaccgcgccgcaccaaaacctaacgaaaccgctcacgcgcgacttcgatacgacgctccaactcctacaactccccgaactaaaaaacccccgtaaaccttacgacgaacgaacgaccgtaaaaacacaaccaaacgaaaccctctcgcgacgcaacctccgcctccgcgtccgcttcgaataccacaaccacgacgaactccaacaaaaaacgcacgcgacgctccttatccacgacccgacgcgcccgtttccaaccctccgaaaccgttaactaatcctactactactactactactccacctcgaaaccgctaaaaacgaaaccgacctaatcaatatccgccgaaacaaccgtctcgcgccctaaacctctacaaaaaccgctaacgacaaaaaataaccgacaaacacaaccaaaaaaccacgatatacacgtccgaaaataaacgaaaaacctccgaaaacctcctacaccccgcgaccgacttcgaaac

SEQ ID NO: 23255 - DNA, 708 bp, Artificial Sequence
  chemically treated genomic DNA (Homo sapiens) CpG-island No: 23255
tataaaattgtgtttgtatatagaataaattgtttgttgatagcggtttattgcgttgtgtgtgtgttttgagtttaaacggttcggttgtcgttttatttttggtttttcggtcggttagagtgtggtggggttttcgcgggggtcgttttggtttgaagtaagcgtcgaggtcggtgacgtgcgttgttttcgagttgtgttaggagttggtcgcgtcgtattagggtttggcggagtcgtttacgcgcgatttcgatgcggcgttttagtttttgtagtttttcgggttggggggttttcgtgggttttgcggcgggcgggcggtcgtaggagtatagttagacggggttttttcgcggcgtagttttcgttttcgcgttcgtttcgggtgttataattacggcgggttttagtaggaagcgtacgcggcgttttttgtttacggttcggcgcgttcgtttttagtttttcggagtcgttggttggttttgttgttgttgttgttgttttatttcggggtcgttggggacggaatcggtttggttagtgttcgtcggggtagtcgtttcgcgttttgggtttttgtagaggtcgttgacggtagaggatggtcgataggtataattagggagttacggtgtgtacgttcgggggtgggcgggggattttcgggaattttttgtatttcgcggtcggtttcggggt

SEQ ID NO: 23256 - DNA, 708 bp, Artificial Sequence
  chemically treated genomic DNA (Homo sapiens) CpG-island No: 23256
accccgaaaccgaccgcgaaatacaaaaaattcccgaaaatcccccgcccacccccgaacgtacacaccgtaactccctaattatacctatcgaccatcctctaccgtcaacgacctctacaaaaacccaaaacgcgaaacgactaccccgacgaacactaaccaaaccgattccgtccccaacgaccccgaaataaaacaacaacaacaacaacaaaaccaaccaacgactccgaaaaactaaaaacgaacgcgccgaaccgtaaacaaaaaacgccgcgtacgcttcctactaaaacccgccgtaattataacacccgaaacgaacgcgaaaacgaaaactacgccgcgaaaaaaccccgtctaactatactcctacgaccgcccgcccgccgcaaaacccacgaaaaccccccaacccgaaaaactacaaaaactaaaacgccgcatcgaaatcgcgcgtaaacgactccgccaaaccctaatacgacgcgaccaactcctaacacaactcgaaaacaacgcacgtcaccgacctcgacgcttacttcaaaccaaaacgacccccgcgaaaaccccaccacactctaaccgaccgaaaaaccaaaaataaaacgacaaccgaaccgtttaaactcaaaacacacacacaacgcaataaaccgctatcaacaaacaatttattctatatacaaacacaattttata

SEQ ID NO: 23257 - DNA, 721 bp, Artificial Sequence
  chemically treated genomic DNA (Homo sapiens) CpG-island No: 23257
ggttcgcgagttatacgatgaggatgatgtagaaggcggtggtggtgtcgttgaagaatttcgatatgatggtttttatttttgtagggagaggcggcgtcggttgaagcgggcggggcggggtgtagcgcggggcgggggaggtcgggtggggtttttatcgacgagggttaggatgacggttagtaggggcgttgcggggaaggcgatggttatgtttatttttagtatttgtagtaggtttattgcgggtatagggcggcgggcgttcggtgagggtttggaggacgttcgtttcgttttgcgtcggcgggatatttatcgatgaagacgaagatttggtggtgtgagtatcgtagtagtatggatacgtttagcgtttgtaaggggcgcgtaggaagcgttatgaggggttgcgagggtttgtttggttttcgttcggttagttttcgtattcgtttcgaggtatttacgaagatgattatgatggcgaaggcggttaggtaggacgttcgcgttatttatatgtttataaagcggtagtgttcgttcgatattatatttcgtaggaagtttgtagtagaaggagtcgtgagcgttcgtttttattcgcgttttcgtattttcggtttcggggtatgttttatttttgtttttttcgttttcggttaggttttttacgttggatatgaggatgttatcgtagtttaggaatttattt

SEQ ID NO: 23258 - DNA, 721 bp, Artificial Sequence
  chemically treated genomic DNA (Homo sapiens) CpG-island No: 23258
aaataaattcctaaactacgataacatcctcatatccaacgtaaaaaacctaaccgaaaacgaaaaaaacaaaaataaaacataccccgaaaccgaaaatacgaaaacgcgaataaaaacgaacgctcacgactccttctactacaaacttcctacgaaatataatatcgaacgaacactaccgctttataaacatataaataacgcgaacgtcctacctaaccgccttcgccatcataatcatcttcgtaaatacctcgaaacgaatacgaaaactaaccgaacgaaaaccaaacaaaccctcgcaacccctcataacgcttcctacgcgccccttacaaacgctaaacgtatccatactactacgatactcacaccaccaaatcttcgtcttcatcgataaatatcccgccgacgcaaaacgaaacgaacgtcctccaaaccctcaccgaacgcccgccgccctatacccgcaataaacctactacaaatactaaaaataaacataaccatcgccttccccgcaacgcccctactaaccgtcatcctaaccctcgtcgataaaaaccccacccgacctcccccgccccgcgctacaccccgccccgcccgcttcaaccgacgccgcctctccctacaaaaataaaaaccatcatatcgaaattcttcaacgacaccaccaccgccttctacatcatcctcatcgtataactcgcgaacc

SEQ ID NO: 23259 - DNA, 721 bp, Artificial Sequence
  chemically treated genomic DNA (Homo sapiens) CpG-island No: 23259
ggatgagtttttgggttacgatgatatttttatgtttagcgtgaagggtttggtcgagaacgaggagaataagggtgaggtatgtttcggggtcgagggtgcgagggcgcgggtgggggcgggcgtttacggttttttttgttgtaggttttttgcggaatgtggtgtcgggcgagtattatcgttttgtgagtatgtggatggcgcggacgttttatttggtcgttttcgttattatggttattttcgtgagtgtttcggggcgggtgcgggggttggtcgggcgggagttaagtaggttttcgtagttttttatagcgttttttgcgcgttttttgtagacgttgagcgtgtttatgttgttgcggtatttatattattagattttcgtttttatcggtgagtgtttcgtcggcgtagggcggggcgggcgttttttaggtttttatcgggcgttcgtcgttttgtgttcgtagtggatttgttgtagatgttggagatgaatatggttatcgtttttttcgtagcgtttttgttgatcgttattttggttttcgtcggtgaggattttattcggtttttttcgtttcgcgttgtatttcgtttcgttcgttttaatcggcgtcgtttttttttgtagggatggaggttattatgtcggagttttttaacgatattattatcgttttttatattatttttatcgtgtggttcgcggatt

SEQ ID NO: 23260 - DNA, 721 bp, Artificial Sequence
  chemically treated genomic DNA (Homo sapiens) CpG-island No: 23260
aatccgcgaaccacacgataaaaataatataaaaaacgataataatatcgttaaaaaactccgacataataacctccatccctacaaaaaaaaacgacgccgattaaaacgaacgaaacgaaatacaacgcgaaacgaaaaaaaccgaataaaatcctcaccgacgaaaaccaaaataacgatcaacaaaaacgctacgaaaaaaacgataaccatattcatctccaacatctacaacaaatccactacgaacacaaaacgacgaacgcccgataaaaacctaaaaaacgcccgccccgccctacgccgacgaaacactcaccgataaaaacgaaaatctaataatataaataccgcaacaacataaacacgctcaacgtctacaaaaaacgcgcaaaaaacgctataaaaaactacgaaaacctacttaactcccgcccgaccaacccccgcacccgccccgaaacactcacgaaaataaccataataacgaaaacgaccaaataaaacgtccgcgccatccacatactcacaaaacgataatactcgcccgacaccacattccgcaaaaaacctacaacaaaaaaaaccgtaaacgcccgcccccacccgcgccctcgcaccctcgaccccgaaacatacctcacccttattctcctcgttctcgaccaaacccttcacgctaaacataaaaatatcatcgtaacccaaaaactcatcc

SEQ ID NO: 23261 - DNA, 610 bp, Artificial Sequence
  chemically treated genomic DNA (Homo sapiens) CpG-island No: 23261
ggggttaggggtcgcggtcggaggtagtagatttgggggtcgggatagtcgttggggttaagggtcgggggtcggggtcgcggttattttgagtagtacgaagaattcgaagagacggcggaaggcgggcgggaagagtcgcgaataggtgatagttattttgaagaatagcgcgtggaagagtcggtcgcgtacgttgatgagggggttggggttgagattgggggtgcgaggttcgcgcgcgggggtcgggtcgtcgtcgtcgtcgttgggttcgggtttcggagttgcgggttttacgtgtttcgatatgttttttagcgtcgcgttttaacgattcgtaagtgttcgagggcgtttttcggtcgttatcggtcgttttcgtagtcgtcgttttttttacggtttttcggtcgtcgtcgttatttttcgttttttcgttcggttgcggcgttgttgacgttagcgagtcgttacgtcgggtaagagcggtttttttgcgttcgtagagaacgttgggatgttagcggcgttcgcggaggttttattttttatttcggtcgttttagggggcgggtttgtatttgggttattttttttgtatattggt

SEQ ID NO: 23262 - DNA, 610 bp, Artificial Sequence
  chemically treated genomic DNA (Homo sapiens) CpG-island No: 23262
accaatatacaaaaaaaataacccaaatacaaacccgccccctaaaacgaccgaaataaaaaataaaacctccgcgaacgccgctaacatcccaacgttctctacgaacgcaaaaaaaccgctcttacccgacgtaacgactcgctaacgtcaacaacgccgcaaccgaacgaaaaaacgaaaaataacgacgacgaccgaaaaaccgtaaaaaaaacgacgactacgaaaacgaccgataacgaccgaaaaacgccctcgaacacttacgaatcgttaaaacgcgacgctaaaaaacatatcgaaacacgtaaaacccgcaactccgaaacccgaacccaacgacgacgacgacgacccgacccccgcgcgcgaacctcgcacccccaatctcaaccccaaccccctcatcaacgtacgcgaccgactcttccacgcgctattcttcaaaataactatcacctattcgcgactcttcccgcccgccttccgccgtctcttcgaattcttcgtactactcaaaataaccgcgaccccgacccccgacccttaaccccaacgactatcccgacccccaaatctactacctccgaccgcgacccctaacccc

SEQ ID NO: 23263 - DNA, 610 bp, Artificial Sequence
  chemically treated genomic DNA (Homo sapiens) CpG-island No: 23263
gttaatatgtaaaagaggtggtttagatgtaggttcgttttttggagcggtcgaggtagggggtgaggttttcgcgggcgtcgttggtattttagcgttttttgcgggcgtaggggggtcgtttttgttcggcgtggcgattcgttagcgttagtagcgtcgtagtcggacgagaaagcggaagatggcggcggcggtcgggaggtcgtgaggagagcggcggttgcgagggcggtcgatggcggtcgggaggcgttttcggatatttgcgggtcgttagggcgcgacgttgggaggtatgtcggagtacgtggagttcgtagtttcggggttcgggtttaacggcggcggcggcggttcggttttcgcgcgcgggtttcgtatttttaattttaattttaatttttttattaacgtgcgcgatcggtttttttacgcgttgttttttaagatggttgttatttattcgcggtttttttcgttcgtttttcgtcgttttttcgagtttttcgtgttgtttaaggtgatcgcggtttcgattttcgatttttgattttagcggttgtttcgatttttaagtttgttattttcgatcgcgatttttggtttt

SEQ ID NO: 23264 - DNA, 610 bp, Artificial Sequence
  chemically treated genomic DNA (Homo sapiens) CpG-island No: 23264
aaaaccaaaaatcgcgatcgaaaataacaaacttaaaaatcgaaacaaccgctaaaatcaaaaatcgaaaatcgaaaccgcgatcaccttaaacaacacgaaaaactcgaaaaaacgacgaaaaacgaacgaaaaaaaccgcgaataaataacaaccatcttaaaaaacaacgcgtaaaaaaaccgatcgcgcacgttaataaaaaaattaaaattaaaattaaaaatacgaaacccgcgcgcgaaaaccgaaccgccgccgccgccgttaaacccgaaccccgaaactacgaactccacgtactccgacatacctcccaacgtcgcgccctaacgacccgcaaatatccgaaaacgcctcccgaccgccatcgaccgccctcgcaaccgccgctctcctcacgacctcccgaccgccgccgccatcttccgctttctcgtccgactacgacgctactaacgctaacgaatcgccacgccgaacaaaaacgacccccctacgcccgcaaaaaacgctaaaataccaacgacgcccgcgaaaacctcaccccctacctcgaccgctccaaaaaacgaacctacatctaaaccacctcttttacatattaac

SEQ ID NO: 23265 - DNA, 982 bp, Artificial Sequence
  chemically treated genomic DNA (Homo sapiens) CpG-island No: 23265
atcgtttcggagtcgagttttttattagtttgtttttagttaagttcgttattatttttacgtcgtagcgatttatacgtttttttagcgatttaaattcgtttttaatttattatatatacgcgcgcgtatatatatatatagggttatcggttttcggttatttaagggaatagggagggagcgagagattttgcgagcgagaagcggggtcgttttacggtttcgtttggttcggtatttatttgtaggtcgcgagttcgggggcggcggcgtcggcgtttcgttttcgttaaagacgagtttgaagtcgagttcgtcgtgggcgttatagtttgtagtagttatcggcgtggtttagggtgttgtagtttttttttaggcggcggcggcggtagcggtaagcggcggtagtagttttttaacgtcgttttatgtcgggtcgcgcgggttaagaggtcgcgattttacggtaaatttttcgggcggggttcgcgacgtcgagcgtttcgtttcgaaagttggtcgcgcgtcgagtagtattaggaatcgtagtcgttcgttatcggtgtttaagtttttattgtcggtttagttaatgtttttcgtcgtttttttatagtcgtcgttatcgtcgtcgcgggtgcgttttcgcgttttgtcgcgcgttcggtttcgttttttacgcgcgtttattttgtttggttgtcgattggttattaatacggcgaataggcgtcgggtttcgtttttttataggtttatcgcgtaattcggttttcgcgagaaggaaggaagttacgtgaatacgtaggcgttttttttttttttttcgtagagtttagttatttttcgggaattgtagtttggtttgtattttttcggcgattttttttaaattagacgagagaaggtcgttagtttttttaattggataggggattattatcggttaatgtagaagatttttttttttattggg

SEQ ID NO: 23266 - DNA, 982 bp, Artificial Sequence
  chemically treated genomic DNA (Homo sapiens) CpG-island No: 23266
cccaataaaaaaaaaaatcttctacattaaccgataataatcccctatccaattaaaaaaactaacgaccttctctcgtctaatttaaaaaaaatcgccgaaaaaatacaaaccaaactacaattcccgaaaaataactaaactctacgaaaaaaaaaaaaaaaacgcctacgtattcacgtaacttccttccttctcgcgaaaaccgaattacgcgataaacctataaaaaaacgaaacccgacgcctattcgccgtattaataaccaatcgacaaccaaacaaaataaacgcgcgtaaaaaacgaaaccgaacgcgcgacaaaacgcgaaaacgcacccgcgacgacgataacgacgactataaaaaaacgacgaaaaacattaactaaaccgacaataaaaacttaaacaccgataacgaacgactacgattcctaatactactcgacgcgcgaccaactttcgaaacgaaacgctcgacgtcgcgaaccccgcccgaaaaatttaccgtaaaatcgcgacctcttaacccgcgcgacccgacataaaacgacgttaaaaaactactaccgccgcttaccgctaccgccgccgccgcctaaaaaaaaactacaacaccctaaaccacgccgataactactacaaactataacgcccacgacgaactcgacttcaaactcgtctttaacgaaaacgaaacgccgacgccgccgcccccgaactcgcgacctacaaataaataccgaaccaaacgaaaccgtaaaacgaccccgcttctcgctcgcaaaatctctcgctccctccctattcccttaaataaccgaaaaccgataaccctatatatatatatacgcgcgcgtatatataataaattaaaaacgaatttaaatcgctaaaaaaacgtataaatcgctacgacgtaaaaataataacgaacttaactaaaaacaaactaataaaaaactcgactccgaaacgat

SEQ ID NO: 23267 - DNA, 982 bp, Artificial Sequence
  chemically treated genomic DNA (Homo sapiens) CpG-island No: 23267
tttaatgaggagaagggttttttgtattggtcggtggtggttttttatttaattagagaggttaacggttttttttcgtttggtttagaaggaatcgtcgggggaatataggttaaattataattttcgagaggtagttgggttttgcgggggggggggggggggcgtttgcgtgtttacgtgatttttttttttttcgcggagatcgagttacgcgataggtttgtgagggggcggggttcggcgtttgttcgtcgtgttagtggttaatcggtagttaggtagggtgggcgcgcgtagggggcggggtcgggcgcgcggtagggcgcgagagcgtattcgcggcggcggtggcggcgattgtgggggggcggcggggaatattggttaagtcgatagtggaggtttaggtatcggtggcgggcggttgcggtttttggtgttgttcggcgcgcggttagttttcggaacggaacgttcggcgtcgcgggtttcgttcggaaagtttgtcgtggagtcgcgattttttggttcgcgcggttcggtatgaagcggcgttgaggagttgttgtcgtcgtttgtcgttgtcgtcgtcgtcgtttgaggaggagttgtagtattttgggttacgtcgatgattattgtaaattgtggcgtttacgacgagttcgattttaaattcgtttttggcgaggacggggcgtcggcgtcgtcgttttcgggttcgcggtttgtaggtgggtgtcgggttaggcgggatcgtggagcgatttcgtttttcgttcgtaggatttttcgttttttttttgtttttttggatgatcggagatcgataattttgtgtgtgtgtgtgcgcgcgcgtgtgtgtggtgagttaaaaacggatttaaatcgttgaggaggcgtgtgggtcgttgcgacgtggaagtggtggcgggtttggttggaagtaaattagtggggaattcgatttcgggacgat

SEQ ID NO: 23268 - DNA, 982 bp, Artificial Sequence
  chemically treated genomic DNA (Homo sapiens) CpG-island No: 23268
atcgtcccgaaatcgaattccccactaatttacttccaaccaaacccgccaccacttccacgtcgcaacgacccacacgcctcctcaacgatttaaatccgtttttaactcaccacacacacgcgcgcgcacacacacacacaaaattatcgatctccgatcatccaaaaaaacaaaaaaaaaacgaaaaatcctacgaacgaaaaacgaaatcgctccacgatcccgcctaacccgacacccacctacaaaccgcgaacccgaaaacgacgacgccgacgccccgtcctcgccaaaaacgaatttaaaatcgaactcgtcgtaaacgccacaatttacaataatcatcgacgtaacccaaaatactacaactcctcctcaaacgacgacgacgacaacgacaaacgacgacaacaactcctcaacgccgcttcataccgaaccgcgcgaaccaaaaaatcgcgactccacgacaaactttccgaacgaaacccgcgacgccgaacgttccgttccgaaaactaaccgcgcgccgaacaacaccaaaaaccgcaaccgcccgccaccgatacctaaacctccactatcgacttaaccaatattccccgccgcccccccacaatcgccgccaccgccgccgcgaatacgctctcgcgccctaccgcgcgcccgaccccgccccctacgcgcgcccaccctacctaactaccgattaaccactaacacgacgaacaaacgccgaaccccgccccctcacaaacctatcgcgtaactcgatctccgcgaaaaaaaaaaaaatcacgtaaacacgcaaacgcccccccccccccccccgcaaaacccaactacctctcgaaaattataatttaacctatattcccccgacgattccttctaaaccaaacgaaaaaaaaccgttaacctctctaattaaataaaaaaccaccaccgaccaatacaaaaaacccttctcctcattaaa

SEQ ID NO: 23269 - DNA, 671 bp, Artificial Sequence
  chemically treated genomic DNA (Homo sapiens) CpG-island No: 23269
tttacgacgcgtttttttttaaggttggtcgggtttggatgtcgttattttttattcggagttatagatttcgtagttgaatttttaaaaagaatttcgttttttttttacggtgttttagttttatatatcgtattgagtttcgttagttatcgtacgcgaggtcgcggcgcgttcgtgacgttattgatgtgcgtttttttcgtattaagggaaatatggttttaacgcggtcggtgcggtttttttttttcgtgattcggttgtttttggcgtcgcgacggggttttacggttcgtagtttcgacgaatttttgtcggtggtgcgtattttagtggttttatagcggtagttggaatagcggtagagtaggcggcggaatttttcgaggtcggtgttggttcgattcggatcgttgttggtttcggcgcggcggtcggagttgaattagtcggcgcgttttatattgggtcgttgggagcgcgcgtcgttagttttttaaggttggaagagtcgacgcgcgcgtcgggattatttttttatcgagcgcgcgtaataggaggcgttagcggtgcgaaagttttcgtttaagggtagttttgttgatttgggtttggagtttcgtgtgttgtacgtattataggaggttgcgtttgaagtcgtttagttt

SEQ ID NO: 23270 - DNA, 671 bp, Artificial Sequence
  chemically treated genomic DNA (Homo sapiens) CpG-island No: 23270
aaactaaacgacttcaaacgcaacctcctataatacgtacaacacacgaaactccaaacccaaatcaacaaaactacccttaaacgaaaactttcgcaccgctaacgcctcctattacgcgcgctcgataaaaaaataatcccgacgcgcgcgtcgactcttccaaccttaaaaaactaacgacgcgcgctcccaacgacccaatataaaacgcgccgactaattcaactccgaccgccgcgccgaaaccaacaacgatccgaatcgaaccaacaccgacctcgaaaaattccgccgcctactctaccgctattccaactaccgctataaaaccactaaaatacgcaccaccgacaaaaattcgtcgaaactacgaaccgtaaaaccccgtcgcgacgccaaaaacaaccgaatcacgaaaaaaaaaaaccgcaccgaccgcgttaaaaccatatttcccttaatacgaaaaaaacgcacatcaataacgtcacgaacgcgccgcgacctcgcgtacgataactaacgaaactcaatacgatatataaaactaaaacaccgtaaaaaaaaaacgaaattctttttaaaaattcaactacgaaatctataactccgaataaaaaataacgacatccaaacccgaccaaccttaaaaaaaaacgcgtcgtaaa

SEQ ID NO: 23271 - DNA, 671 bp, Artificial Sequence
  chemically treated genomic DNA (Homo sapiens) CpG-island No: 23271
gggttgaacgattttaggcgtagttttttgtagtgcgtgtagtatacggggttttaggtttaggttagtaaagttgtttttagacgagagttttcgtatcgttggcgttttttgttgcgcgcgttcgatggagaagtggtttcgacgcgcgcgtcgatttttttagttttgagaggttagcggcgcgcgtttttaacggtttagtgtgaggcgcgtcggttggtttaatttcggtcgtcgcgtcgaaattagtagcggttcgggtcgaattagtatcggtttcgggaggtttcgtcgtttgttttgtcgttgttttaattgtcgttgtagagttattgggatgcgtattatcggtaggggttcgtcgggattgcggatcgtgaggtttcgtcgcggcgttaggagtaatcgagttacgagggaaaagagtcgtatcggtcgcgttagagttatgttttttttagtgcgggagaagcgtatattagtgacgttacggacgcgtcgcgatttcgcgtacggtggttggcgaggtttagtacggtgtgtggagttggagtatcgtgaggaagaagcgaggttttttttaagagtttagttgcgaggtttgtagtttcgaataggggatggcgatatttagattcggttagttttggggaagggcgcgtcgtgga

SEQ ID NO: 23272 - DNA, 671 bp, Artificial Sequence
  chemically treated genomic DNA (Homo sapiens) CpG-island No: 23272
tccacgacgcgcccttccccaaaactaaccgaatctaaatatcgccatcccctattcgaaactacaaacctcgcaactaaactcttaaaaaaaacctcgcttcttcctcacgatactccaactccacacaccgtactaaacctcgccaaccaccgtacgcgaaatcgcgacgcgtccgtaacgtcactaatatacgcttctcccgcactaaaaaaaacataactctaacgcgaccgatacgactcttttccctcgtaactcgattactcctaacgccgcgacgaaacctcacgatccgcaatcccgacgaacccctaccgataatacgcatcccaataactctacaacgacaattaaaacaacgacaaaacaaacgacgaaacctcccgaaaccgatactaattcgacccgaaccgctactaatttcgacgcgacgaccgaaattaaaccaaccgacgcgcctcacactaaaccgttaaaaacgcgcgccgctaacctctcaaaactaaaaaaatcgacgcgcgcgtcgaaaccacttctccatcgaacgcgcgcaacaaaaaacgccaacgatacgaaaactctcgtctaaaaacaactttactaacctaaacctaaaaccccgtatactacacgcactacaaaaaactacgcctaaaatcgttcaaccc

SEQ ID NO: 23273 - DNA, 514 bp, Artificial Sequence
  chemically treated genomic DNA (Homo sapiens) CpG-island No: 23273
aaataaatttttggatttttttgtttttttagttttaagggtcgcgatgttgtatttagaagattatttggaaagtgagtgcgcggcgttggcggcggtcgttagtgggacgtgcgggcgggtaagagcgcgagtggacgggtagcgagatggcgggagggagggggcggcgggggatgttttttttttacggtaattggtagtttcgttgtgggttgtcggttttttcgatttttttgacgtacgcgcgtagtgacgtaagcgcgtatttcgtcgttggtttcgtttttttgacggattttttttttgatagtgattgagtagttttttatggatttgcgggatcgttttacggaaatgcgcgagatggatttgtaggtgtagagtaagtcggcgcgtttattatttttgttcgttgcgcgcgtttagtgttagatttgtttgttattattgttagcgtttagtgtttttttattgttttttggtttatttcgttagtgtataaggagttgtt

SEQ ID NO: 23274 - DNA, 514 bp, Artificial Sequence
  chemically treated genomic DNA (Homo sapiens) CpG-island No: 23274
aacaactccttatacactaacgaaataaaccaaaaaacaataaaaaaacactaaacgctaacaataataacaaacaaatctaacactaaacgcgcgcaacgaacaaaaataataaacgcgccgacttactctacacctacaaatccatctcgcgcatttccgtaaaacgatcccgcaaatccataaaaaactactcaatcactatcaaaaaaaaaatccgtcaaaaaaacgaaaccaacgacgaaatacgcgcttacgtcactacgcgcgtacgtcaaaaaaatcgaaaaaaccgacaacccacaacgaaactaccaattaccgtaaaaaaaaaacatcccccgccgccccctccctcccgccatctcgctacccgtccactcgcgctcttacccgcccgcacgtcccactaacgaccgccgccaacgccgcgcactcactttccaaataatcttctaaatacaacatcgcgacccttaaaactaaaaaaacaaaaaaatccaaaaatttattt

SEQ ID NO: 23275 - DNA, 514 bp, Artificial Sequence
  chemically treated genomic DNA (Homo sapiens) CpG-island No: 23275
gataattttttatgtattagcggagtgagttagaggatagtgaaagagtattaggcgttagtagtgatgataagtaagtttggtattgaacgcgcgtagcgaataggagtagtagacgcgtcgatttattttgtatttgtaggtttatttcgcgtattttcgtgaagcggtttcgtagatttataggaagttgtttaattattgttaaagggagagttcgttagaggggcggggttaacggcgaaatacgcgtttacgttattgcgcgcgtgcgttaggggggtcgagggggtcggtagtttataacgaggttgttagttatcgtgagaaagaaatatttttcgtcgttttttttttttcgttatttcgttgttcgtttattcgcgtttttgttcgttcgtacgttttattggcggtcgtcgttagcgtcgcgtatttattttttagatagttttttaggtataatatcgcggtttttagagttgagggaataagggggtttaggggtttattt

SEQ ID NO: 23276 - DNA, 514 bp, Artificial Sequence
  chemically treated genomic DNA (Homo sapiens) CpG-island No: 23276
aaataaacccctaaacccccttattccctcaactctaaaaaccgcgatattatacctaaaaaactatctaaaaaataaatacgcgacgctaacgacgaccgccaataaaacgtacgaacgaacaaaaacgcgaataaacgaacaacgaaataacgaaaaaaaaaaaacgacgaaaaatatttctttctcacgataactaacaacctcgttataaactaccgaccccctcgacccccctaacgcacgcgcgcaataacgtaaacgcgtatttcgccgttaaccccgcccctctaacgaactctccctttaacaataattaaacaacttcctataaatctacgaaaccgcttcacgaaaatacgcgaaataaacctacaaatacaaaataaatcgacgcgtctactactcctattcgctacgcgcgttcaataccaaacttacttatcatcactactaacgcctaatactctttcactatcctctaactcactccgctaatacataaaaaattatc

SEQ ID NO: 23277 - DNA, 899 bp, Artificial Sequence
  chemically treated genomic DNA (Homo sapiens) CpG-island No: 23277
tcggtcgtttgttggttgcggcgttttcgcggttcgcgcgtatttttcgcgttgcgtttcgtatacgcgcgttttcgtcgcgtttcgttcgggtcgtttcgttggcggcggcgattgggttgtaggtagcgagttagtcggtttcggttcggtaatttatggtaatcgttttggtaatttatggtaattgcgcggcggaaagaaaaaaaagaatcgtggtggggcggggggcggcgggcggtgaatgggaataacgatcgtaaagagatagcgatttatcgcgcgggtttgcggttttcggtcgtatttgttgtagacggttcgcgaggttttttttcgcgttacggtgacgattttggttgttggggaaaagagtaataagtagaaagttttcgtgtagaggggattcgggcggtgtatttggtgtgggaggttgttttaaacgtcgatgattttttcggttttcgcgtgtttcggtttttagggtttcgttaggttggagagcgcgcgtggagagggttttgtcgtttgggggttggttgaggggcggtcgcgtcggggtcggggttggattttaggttttgttttgtagacgttcgcgttcggtcggaggaggggttatatcgtgttgtttcggttttatggggttcggttttcgagggttttcgcgagcggacgcggtggggtcgggtaaattttacgtgttttaaattttgttatttgtatacgtatcgtatatattagttaattttttttttttttaggttttcgagaatttaatttgttcggcgggcgcgcggttgcgttaatttggtttttttcgtttggagagggaggggacggtcgcgtttggtggtaggattgggttgtgtgtgtgtgtgtgtgtgtgtgtgtgtgtg

SEQ ID NO: 23278 - DNA, 899 bp, Artificial Sequence
  chemically treated genomic DNA (Homo sapiens) CpG-island No: 23278
cacacacacacacacacacacacacacacacaacccaatcctaccaccaaacgcgaccgtcccctccctctccaaacgaaaaaaaccaaattaacgcaaccgcgcgcccgccgaacaaattaaattctcgaaaacctaaaaaaaaaaaaaattaactaatatatacgatacgtatacaaataacaaaatttaaaacacgtaaaatttacccgaccccaccgcgtccgctcgcgaaaaccctcgaaaaccgaaccccataaaaccgaaacaacacgatataacccctcctccgaccgaacgcgaacgtctacaaaacaaaacctaaaatccaaccccgaccccgacgcgaccgcccctcaaccaacccccaaacgacaaaaccctctccacgcgcgctctccaacctaacgaaaccctaaaaaccgaaacacgcgaaaaccgaaaaaatcatcgacgtttaaaacaacctcccacaccaaatacaccgcccgaatcccctctacacgaaaactttctacttattactcttttccccaacaaccaaaatcgtcaccgtaacgcgaaaaaaaacctcgcgaaccgtctacaacaaatacgaccgaaaaccgcaaacccgcgcgataaatcgctatctctttacgatcgttattcccattcaccgcccgccgccccccgccccaccacgattcttttttttctttccgccgcgcaattaccataaattaccaaaacgattaccataaattaccgaaccgaaaccgactaactcgctacctacaacccaatcgccgccgccaacgaaacgacccgaacgaaacgcgacgaaaacgcgcgtatacgaaacgcaacgcgaaaaatacgcgcgaaccgcgaaaacgccgcaaccaacaaacgaccga

SEQ ID NO: 23279 - DNA, 899 bp, Artificial Sequence
  chemically treated genomic DNA (Homo sapiens) CpG-island No: 23279
tatatatatatatatatatatatatatatatagtttagttttattattaggcgcgatcgttttttttttttttagacggaaggggttaggttaacgtagtcgcgcgttcgtcgggtaggttaggttttcgggggtttagaagggaaaggggttaattaatgtgtgcgatgcgtgtgtagatgataaaatttagggtacgtagagtttgttcggttttatcgcgttcgttcgcggggattttcgggggtcgggttttatggggtcggggtagtacggtgtagtttttttttcggtcgggcgcgagcgtttgtagaataaagtttggagtttagtttcggtttcggcgcggtcgttttttaattaatttttaggcggtaaggttttttttacgcgcgttttttagtttggcggggttttggaagtcgggatacgcggaggtcgggagggttatcggcgtttaaggtagttttttatattaagtgtatcgttcggattttttttgtacgagggttttttgtttattgtttttttttttagtagttagaatcgttatcgtagcgcgggaaggggtttcgcgggtcgtttgtagtaggtgcggtcgggagtcgtaggttcgcgcggtaaatcgttgtttttttgcggtcgttgtttttatttatcgttcgtcgtttttcgttttattacggttttttttttttttttcgtcgcgtagttgttatgggttattagggcggttgttatgggttatcggatcgaggtcggttggttcgttatttgtagtttagtcgtcgtcgttagcggagcggttcgggcgggacgcggcgggagcgcgcgtgtgcgggacgtagcgcgggggatgcgcgcgggtcgcggaggcgtcgtaattaataggcggtcga

SEQ ID NO: 23280 - DNA, 899 bp, Artificial Sequence
  chemically treated genomic DNA (Homo sapiens) CpG-island No: 23280
tcgaccgcctattaattacgacgcctccgcgacccgcgcgcatcccccgcgctacgtcccgcacacgcgcgctcccgccgcgtcccgcccgaaccgctccgctaacgacgacgactaaactacaaataacgaaccaaccgacctcgatccgataacccataacaaccgccctaataacccataacaactacgcgacgaaaaaaaaaaaaaaaaccgtaataaaacgaaaaacgacgaacgataaataaaaacaacgaccgcaaaaaaacaacgatttaccgcgcgaacctacgactcccgaccgcacctactacaaacgacccgcgaaaccccttcccgcgctacgataacgattctaactactaaaaaaaaaaacaataaacaaaaaaccctcgtacaaaaaaaatccgaacgatacacttaatataaaaaactaccttaaacgccgataaccctcccgacctccgcgtatcccgacttccaaaaccccgccaaactaaaaaacgcgcgtaaaaaaaaccttaccgcctaaaaattaattaaaaaacgaccgcgccgaaaccgaaactaaactccaaactttattctacaaacgctcgcgcccgaccgaaaaaaaaactacaccgtactaccccgaccccataaaacccgacccccgaaaatccccgcgaacgaacgcgataaaaccgaacaaactctacgtaccctaaattttatcatctacacacgcatcgcacacattaattaacccctttcccttctaaacccccgaaaacctaacctacccgacgaacgcgcgactacgttaacctaaccccttccgtctaaaaaaaaaaaaaacgatcgcgcctaataataaaactaaactatatatatatatatatatatatatatatata

SEQ ID NO: 23281 - DNA, 702 bp, Artificial Sequence
  chemically treated genomic DNA (Homo sapiens) CpG-island No: 23281
gcgcggtttttgagtcgcgttcggtcgtttattttttttttttttagtatcgggtcggttttttttttcggttcggttcggcggttggggggtgggcggagtcgcggtcgggtagtttattatgttggatagggcgcgtttgcgttttcggtcgtcgcggttttcggggttttcgtttgtagtcggcggcggaacgagggtaggcggttgagataggcgagttatttgtatttttcggtagttatttttatatgcggaggtaatgaagttgttagcggcgtttcgagtgtggtagagtttgatatttaaatcgttttgttcgtttcgtttgttttcgttcgttggtttcgggagttttaggttgcgcgcgttcgtatcgtatcgtcgttttgtttcgcgatcgcgcgcgttttttcgttttttttcgcgtttttgttttcgttttttttttttttttttttttttttgtgtcgggttagatttagttttagaaattagttattttgtcgcgttcgattgttagggattttttacgtcgcgaggtgagttggtcgtaggtgtggggaagttcgcgggtgtagttaggtcgtcgttttcgcgttcgacgttacgttcgttttttttttttttttttaggggttttttgttttttttttattttcgtttttaagaaagatgatttagtattgttattatcgtttg

SEQ ID NO: 23282 - DNA, 702 bp, Artificial Sequence
  chemically treated genomic DNA (Homo sapiens) CpG-island No: 23282
caaacgataataacaatactaaatcatctttcttaaaaacgaaaataaaaaaaaaacaaaaaacccctaaaaaaaaaaaaaaaaaacgaacgtaacgtcgaacgcgaaaacgacgacctaactacacccgcgaacttccccacacctacgaccaactcacctcgcgacgtaaaaaatccctaacaatcgaacgcgacaaaataactaatttctaaaactaaatctaacccgacacaaaaaaaaaaaaaaaaaaaaaaaaaacgaaaacaaaaacgcgaaaaaaaacgaaaaaacgcgcgcgatcgcgaaacaaaacgacgatacgatacgaacgcgcgcaacctaaaactcccgaaaccaacgaacgaaaacaaacgaaacgaacaaaacgatttaaatatcaaactctaccacactcgaaacgccgctaacaacttcattacctccgcatataaaaataactaccgaaaaatacaaataactcgcctatctcaaccgcctaccctcgttccgccgccgactacaaacgaaaaccccgaaaaccgcgacgaccgaaaacgcaaacgcgccctatccaacataataaactacccgaccgcgactccgcccaccccccaaccgccgaaccgaaccgaaaaaaaaaaccgacccgatactaaaaaaaaaaaaaataaacgaccgaacgcgactcaaaaaccgcgc

SEQ ID NO: 23283 - DNA, 702 bp, Artificial Sequence
  chemically treated genomic DNA (Homo sapiens) CpG-island No: 23283
taaacggtaatggtagtattaggttattttttttggagacggaggtgaagggagggtaaggggtttttggggaaggaaagaggaggcgggcgtggcgtcgagcgcgagggcggcggtttagttgtattcgcgaatttttttatatttgcgattagtttatttcgcggcgtgagggatttttggtagtcggacgcggtagggtggttggtttttggggttgagtttggttcgatataaaagaggagggaaaggagaaggagacggaaataaaggcgcgggggaggacgaggaggcgcgcgcggtcgcggggtaaagcggcgatgcggtgcgggcgcgcgtagtttggggttttcgggattagcgggcgggagtaggcggagcgggtagggcgatttgaatattaggttttgttatattcggggcgtcgttgataattttattattttcgtatataaaaatgattgtcggggaatgtaaatagttcgtttgttttagtcgtttgttttcgtttcgtcgtcggttgtaggcggaggtttcgggagtcgcggcggtcggaggcgtagacgcgttttgtttaatataatgaattgttcggtcgcggtttcgtttattttttagtcgtcgagtcgggtcgggagggggagtcggttcggtgttggaggaggaaggggtgggcggtcgggcgcggtttagaggtcgcgt

SEQ ID NO: 23284 - DNA, 702 bp, Artificial Sequence
  chemically treated genomic DNA (Homo sapiens) CpG-island No: 23284
acgcgacctctaaaccgcgcccgaccgcccaccccttcctcctccaacaccgaaccgactccccctcccgacccgactcgacgactaaaaaataaacgaaaccgcgaccgaacaattcattatattaaacaaaacgcgtctacgcctccgaccgccgcgactcccgaaacctccgcctacaaccgacgacgaaacgaaaacaaacgactaaaacaaacgaactatttacattccccgacaatcatttttatatacgaaaataataaaattatcaacgacgccccgaatataacaaaacctaatattcaaatcgccctacccgctccgcctactcccgcccgctaatcccgaaaaccccaaactacgcgcgcccgcaccgcatcgccgctttaccccgcgaccgcgcgcgcctcctcgtcctcccccgcgcctttatttccgtctccttctcctttccctcctcttttatatcgaaccaaactcaaccccaaaaaccaaccaccctaccgcgtccgactaccaaaaatccctcacgccgcgaaataaactaatcgcaaatataaaaaaattcgcgaatacaactaaaccgccgccctcgcgctcgacgccacgcccgcctcctctttccttccccaaaaaccccttaccctcccttcacctccgtctccaaaaaaaataacctaatactaccattaccgttta

SEQ ID NO: 23285 - DNA, 577 bp, Artificial Sequence
  chemically treated genomic DNA (Homo sapiens) CpG-island No: 23285
cggtttcgtttttgttacgtgatagcgtgcgtttttttttttgtttttttgatttttttcgttatttaaagaaatagtatcgggggcgggtcgagcgacgtagtcgggacggtagttgcggtgcggatcggaggagttattttgtttcgtcgtcggggagttaggtttttaaatcgaagaagttttggcgcgttttttttttttttcgggtttggtagggcgaaggaacgggcgtgcggtcgatcgagcgatcggttggcggtttttttttttgttttggtatttagtttttggggcgtaggttcggtcgtcgcggcgcgcgttcggtggtcgttggcgttcgcgtcgcgttttttttttcgtacgtagaattcgggcggcggtttatgcgtttgcgattcgacgaggagtcgttcgggtggtcggcggcggcgggtagttgtttcgtttcgtttcgggggaggcggcggcggtagcggtcgcgggatttggagcggtcggggaggcgggggtggtcggggtcggtttggaggtttggcgttatttttcggggtttgtaaggatttagttggggggg

SEQ ID NO: 23286 - DNA, 577 bp, Artificial Sequence
  chemically treated genomic DNA (Homo sapiens) CpG-island No: 23286
cccccccaactaaatccttacaaaccccgaaaaataacgccaaacctccaaaccgaccccgaccacccccgcctccccgaccgctccaaatcccgcgaccgctaccgccgccgcctcccccgaaacgaaacgaaacaactacccgccgccgccgaccacccgaacgactcctcgtcgaatcgcaaacgcataaaccgccgcccgaattctacgtacgaaaaaaaaaacgcgacgcgaacgccaacgaccaccgaacgcgcgccgcgacgaccgaacctacgccccaaaaactaaataccaaaacaaaaaaaaaaaccgccaaccgatcgctcgatcgaccgcacgcccgttccttcgccctaccaaacccgaaaaaaaaaaaaaacgcgccaaaacttcttcgatttaaaaacctaactccccgacgacgaaacaaaataactcctccgatccgcaccgcaactaccgtcccgactacgtcgctcgacccgcccccgatactatttctttaaataacgaaaaaaatcaaaaaaacaaaaaaaaaaacgcacgctatcacgtaacaaaaacgaaaccg

SEQ ID NO: 23287 - DNA, 577 bp, Artificial Sequence
  chemically treated genomic DNA (Homo sapiens) CpG-island No: 23287
tttttttaattgggtttttgtaggtttcgaagggtggcgttaggtttttaagtcggtttcggttattttcgttttttcggtcgttttaaatttcgcggtcgttgtcgtcgtcgtttttttcggagcggggcggagtagttgttcgtcgtcgtcgattattcggacgatttttcgtcgaatcgtaaacgtataggtcgtcgttcgagttttgcgtacgagaagaaagacgcggcgcgagcgttaacggttatcgggcgcgcgtcgcggcggtcgggtttgcgttttaagagttggatgttagagtaggagaaagagtcgttaatcgatcgttcgatcgatcgtacgttcgttttttcgttttattagattcgggagggggggagggcgcgttagggttttttcgatttaggggtttgatttttcggcgacgagataagatggttttttcggttcgtatcgtagttatcgtttcggttgcgtcgttcggttcgttttcggtattgtttttttaaatggcggagagggttaggaaagtaggaagagaggcgtacgttgttacgtgataggggcgggatcg

SEQ ID NO: 23288 - DNA, 577 bp, Artificial Sequence
  chemically treated genomic DNA (Homo sapiens) CpG-island No: 23288
cgatcccgcccctatcacgtaacaacgtacgcctctcttcctactttcctaaccctctccgccatttaaaaaaacaataccgaaaacgaaccgaacgacgcaaccgaaacgataactacgatacgaaccgaaaaaaccatcttatctcgtcgccgaaaaatcaaacccctaaatcgaaaaaaccctaacgcgccctccccccctcccgaatctaataaaacgaaaaaacgaacgtacgatcgatcgaacgatcgattaacgactctttctcctactctaacatccaactcttaaaacgcaaacccgaccgccgcgacgcgcgcccgataaccgttaacgctcgcgccgcgtctttcttctcgtacgcaaaactcgaacgacgacctatacgtttacgattcgacgaaaaatcgtccgaataatcgacgacgacgaacaactactccgccccgctccgaaaaaaacgacgacgacaacgaccgcgaaatttaaaacgaccgaaaaaacgaaaataaccgaaaccgacttaaaaacctaacgccacccttcgaaacctacaaaaacccaattaaaaaaa

SEQ ID NO: 23289 - DNA, 839 bp, Artificial Sequence
  chemically treated genomic DNA (Homo sapiens) CpG-island No: 23289
agcgttataagcgtcgggatagatttattcggttcggaatagatttcgcgttttattcggttaggtttagtttttattcggggattcgtgtcgggtttcgtagttgggatatggcgtttttcgggggcggcgatggggttcggcggacgaagtttagatattcgtaaattttcgattttataggtagcggcgtcgacgtagggttttcgcgttttgtttttttaggtttcgtgttttcggtttattcggtcgtttttattatgttttcggcgtcgatttcgttttcgttcggtcgcgcgttttttcgttgtcgattcgcgtcgtcgtcgtcgttttcgtagtatcgatcgtcgtcgtcggagtcggataatatttcgtgttcgtttcgcgttgttgtggttaatgttcgtttgttttgttggttcgaattttagcggttgtttaatcgcgcgtttttttttagttagatttcgttttttcggtatcgtttttttaacggttgtttgtttttgtatacggtacgcggaggcggggtttttagttttaatagtgacgcgttttttgttttttattaggcgtttaagtttgacgaatagaaaggtaaattaatgagattggacgtttcgtagacgaaagttaataaaaatatcgttcgcgagtaagggaggcgggttattgggaaggatagtaaaattagttaataaggtgaagcgattgtaggcgttgtggttttttcgtttattcgcggcgttggttttttcgtttttgagatttgtttggggaggtaaagagtgttggacgtgttttttttggtgggtttttatagattgtgaggattt

SEQ ID NO: 23290 - DNA, 839 bp, Artificial Sequence
  chemically treated genomic DNA (Homo sapiens) CpG-island No: 23290
aaatcctcacaatctataaaaacccaccaaaaaaaacacgtccaacactctttacctccccaaacaaatctcaaaaacgaaaaaaccaacgccgcgaataaacgaaaaaaccacaacgcctacaatcgcttcaccttattaactaattttactatccttcccaataacccgcctcccttactcgcgaacgatatttttattaactttcgtctacgaaacgtccaatctcattaatttacctttctattcgtcaaacttaaacgcctaataaaaaacaaaaaacgcgtcactattaaaactaaaaaccccgcctccgcgtaccgtatacaaaaacaaacaaccgttaaaaaaacgataccgaaaaaacgaaatctaactaaaaaaaaacgcgcgattaaacaaccgctaaaattcgaaccaacaaaacaaacgaacattaaccacaacaacgcgaaacgaacacgaaatattatccgactccgacgacgacgatcgatactacgaaaacgacgacgacgacgcgaatcgacaacgaaaaaacgcgcgaccgaacgaaaacgaaatcgacgccgaaaacataataaaaacgaccgaataaaccgaaaacacgaaacctaaaaaaacaaaacgcgaaaaccctacgtcgacgccgctacctataaaatcgaaaatttacgaatatctaaacttcgtccgccgaaccccatcgccgcccccgaaaaacgccatatcccaactacgaaacccgacacgaatccccgaataaaaactaaacctaaccgaataaaacgcgaaatctattccgaaccgaataaatctatcccgacgcttataacgct

SEQ ID NO: 23291 - DNA, 839 bp, Artificial Sequence
  chemically treated genomic DNA (Homo sapiens) CpG-island No: 23291
aaatttttatagtttgtgaaaatttattaggagaagtacgtttaatattttttatttttttaaataagttttagaagcgggaaaattaacgtcgcgaatgggcgggaaagttatagcgtttgtaatcgttttattttattagttaattttgttgttttttttagtggttcgttttttttgttcgcgggcgatatttttattggttttcgtttgcgaggcgtttaattttattggtttgtttttttgttcgttaggtttgggcgtttggtgaaaggtagagagcgcgttattattggggttggaggtttcgttttcgcgtgtcgtgtgtaaaaataaatagtcgttaggaaggcggtgtcgggggggcggggtttggttagaaggaggcgcgcgattgaatagtcgttggggttcgaattagtaagataagcgggtattggttatagtagcgcgaggcgggtacggggtattgttcggtttcggcggcggcggtcggtgttgcgagagcggcggcggcggcgcgggtcggtagcgggagggcgcgcggtcgagcggaggcggagtcggcgtcgagaatatggtaagggcggtcgggtgggtcgggggtacggggtttgggagagtagagcgcggaggttttgcgtcggcgtcgttatttgtggagtcgggagtttgcgggtgtttgggtttcgttcgtcgagttttatcgtcgttttcggggggcgttatgttttagttgcggagttcgatacgggttttcgggtgagagttgggtttggtcgggtagagcgcgaagtttgtttcgagtcggatagatttgtttcgacgtttgtgacgtt

SEQ ID NO: 23292 - DNA, 839 bp, Artificial Sequence
  chemically treated genomic DNA (Homo sapiens) CpG-island No: 23292
aacgtcacaaacgtcgaaacaaatctatccgactcgaaacaaacttcgcgctctacccgaccaaacccaactctcacccgaaaacccgtatcgaactccgcaactaaaacataacgccccccgaaaacgacgataaaactcgacgaacgaaacccaaacacccgcaaactcccgactccacaaataacgacgccgacgcaaaacctccgcgctctactctcccaaaccccgtacccccgacccacccgaccgcccttaccatattctcgacgccgactccgcctccgctcgaccgcgcgccctcccgctaccgacccgcgccgccgccgccgctctcgcaacaccgaccgccgccgccgaaaccgaacaataccccgtacccgcctcgcgctactataaccaatacccgcttatcttactaattcgaaccccaacgactattcaatcgcgcgcctccttctaaccaaaccccgcccccccgacaccgccttcctaacgactatttatttttacacacgacacgcgaaaacgaaacctccaaccccaataataacgcgctctctacctttcaccaaacgcccaaacctaacgaacaaaaaaacaaaccaataaaattaaacgcctcgcaaacgaaaaccaataaaaatatcgcccgcgaacaaaaaaaacgaaccactaaaaaaaacaacaaaattaactaataaaataaaacgattacaaacgctataactttcccgcccattcgcgacgttaattttcccgcttctaaaacttatttaaaaaaataaaaaatattaaacgtacttctcctaataaattttcacaaactataaaaattt

SEQ ID NO: 23293 - DNA, 1414 bp, Artificial Sequence
  chemically treated genomic DNA (Homo sapiens) CpG-island No: 23293
agtggacgatatcggagtttaaagtaaaagtgttacgggaagaggcgcgtagatagacgtagcgggcggttgagttacgttaaggttggtaagtttttagggttagaaatcgagtagtaatattagtttatttttagtttgtcgttcgttcggcgcggtttttgacgttatttttttgcgttacgtcgtcgcggcgttttcggtcgcgaggtcgcggagggcgggacggagtgattttacgggaaatcgcgcgtcggaagtggttagggttgtacggaagtcgcgggggcggggcgcggaggcgatgggggggcggcggcggtcggcgatgagcggcgggagcgcgtgagcgagtcgggcgggcgaggttggggggtttcggagcgcgagtcggagggcgggggcgcgagcgcggcgggcggtggcggcgaggcggcggtttagaagatggcggacggcgatagcggtagcgagcgcggcggcggcggtgggtcgtgcgggttttagttcgcgtttcgcggcggcggcgagtaagagacgtaggagttggtttcgaagcggttggatatttagaataagcgtttttatttagatgtgaagtagaacgttaagggtcgtttttttaagatcgtcgaggtgggcgcgggcggttttaaggcgttttacgttgtttagtgcggtggtcgtcgagttacgcgattgttggcgatttatagaatattagcgtagttgggttttagtagtttcgagtagttggcggttggcgtcgaggagggcggcgggttcgggcgcgcgtttaagagcgaatttttggtgcgtgagaatcgtaagtattatttggattttaaggagaattagcgcggtcgttttttgcgtattcgttaaacggttaatcgcggcggtggcggtttcggcgcgggtttcgggtcgggcggtttgtagagcggttagattatcgcgttgtttgcgtagggttttatcgagtttcgcgacgcgttggcgaagtttatagacgattacggaggcgaggacgacgagttggtaggcggttcgggaggcggcgtcgggggtttagggggcggtttgtatggagagttttcggagggtatttttattatcgtggattttaagcgtttttttttcgatgtgggttgtaataaatacggggtgtttttgcgagtgagcgaggtgaagtcgttttatcgtaatgttattatcgtattttttaaagtttggggtaagttcggaggcgttttttgtcggtatgcggatgagatgaaagaaatttaggaacgatagagggataagttttatgagcgacgtggtgggggtagcggcggcggcgaagagttagagggtgaggaggtggatgaggattgaaacgggtagttttttttataggtttttatttaat

SEQ ID NO: 23294 - DNA, 1414 bp, Artificial Sequence
  chemically treated genomic DNA (Homo sapiens) CpG-island No: 23294
attaaataaaaacctataaaaaaaactacccgtttcaatcctcatccacctcctcaccctctaactcttcgccgccgccgctacccccaccacgtcgctcataaaacttatccctctatcgttcctaaatttctttcatctcatccgcataccgacaaaaaacgcctccgaacttaccccaaactttaaaaaatacgataataacattacgataaaacgacttcacctcgctcactcgcaaaaacaccccgtatttattacaacccacatcgaaaaaaaaacgcttaaaatccacgataataaaaataccctccgaaaactctccatacaaaccgccccctaaacccccgacgccgcctcccgaaccgcctaccaactcgtcgtcctcgcctccgtaatcgtctataaacttcgccaacgcgtcgcgaaactcgataaaaccctacgcaaacaacgcgataatctaaccgctctacaaaccgcccgacccgaaacccgcgccgaaaccgccaccgccgcgattaaccgtttaacgaatacgcaaaaaacgaccgcgctaattctccttaaaatccaaataatacttacgattctcacgcaccaaaaattcgctcttaaacgcgcgcccgaacccgccgccctcctcgacgccaaccgccaactactcgaaactactaaaacccaactacgctaatattctataaatcgccaacaatcgcgtaactcgacgaccaccgcactaaacaacgtaaaacgccttaaaaccgcccgcgcccacctcgacgatcttaaaaaaacgacccttaacgttctacttcacatctaaataaaaacgcttattctaaatatccaaccgcttcgaaaccaactcctacgtctcttactcgccgccgccgcgaaacgcgaactaaaacccgcacgacccaccgccgccgccgcgctcgctaccgctatcgccgtccgccatcttctaaaccgccgcctcgccgccaccgcccgccgcgctcgcgcccccgccctccgactcgcgctccgaaaccccccaacctcgcccgcccgactcgctcacgcgctcccgccgctcatcgccgaccgccgccgcccccccatcgcctccgcgccccgcccccgcgacttccgtacaaccctaaccacttccgacgcgcgatttcccgtaaaatcactccgtcccgccctccgcgacctcgcgaccgaaaacgccgcgacgacgtaacgcaaaaaaataacgtcaaaaaccgcgccgaacgaacgacaaactaaaaataaactaatattactactcgatttctaaccctaaaaacttaccaaccttaacgtaactcaaccgcccgctacgtctatctacgcgcctcttcccgtaacacttttactttaaactccgatatcgtccact

SEQ ID NO: 23295 - DNA, 1414 bp, Artificial Sequence
  chemically treated genomic DNA (Homo sapiens) CpG-island No: 23295
gttgggtggaggtttgtaggggaagttgttcgttttaatttttatttatttttttattttttgatttttcgtcgtcgtcgttgtttttattacgtcgtttataaagtttatttttttgtcgtttttggattttttttattttattcgtatatcggtaaaaggcgttttcgaatttgttttaggttttgaagggtacggtgatggtattgcggtaggacggttttatttcgtttattcgtagaaatatttcgtatttgttgtagtttatatcgaagaagaagcgtttggagtttacggtgatggaggtgtttttcgggagttttttatataggtcgttttttgggttttcggcgtcgtttttcgggtcgtttgttagttcgtcgttttcgttttcgtagtcgtttatgagtttcgttagcgcgtcgcggaattcgatgaggttttgcgtaggtagcgcgatggtttggtcgttttgtaagtcgttcggttcggggttcgcgtcgaagtcgttatcgtcgcggttgatcgtttggcggatgcgtaggaagcggtcgcgttggttttttttgaggtttaggtagtatttgcggtttttacgtattaagaattcgtttttgagcgcgcgttcgggttcgtcgtttttttcggcgttagtcgttagttgttcggggttgttagggtttagttgcgttagtgttttatgagtcgttagtagtcgcgtaattcggcggttatcgtattggatagcgtgaggcgttttggaatcgttcgcgtttatttcggcgattttgaggaagcggtttttggcgttttgttttatatttaagtagaagcgtttgttttggatgtttagtcgtttcgaggttagtttttgcgttttttgttcgtcgtcgtcgcgggacgcgggttggaattcgtacggtttatcgtcgtcgtcgcgttcgttgtcgttgtcgtcgttcgttattttttaggtcgtcgtttcgtcgttatcgttcgtcgcgttcgcgttttcgtttttcggttcgcgtttcggggttttttagtttcgttcgttcggttcgtttacgcgttttcgtcgtttatcgtcggtcgtcgtcgtttttttatcgttttcgcgtttcgttttcgcgattttcgtgtagttttagttattttcggcgcgcgatttttcgtgaagttatttcgtttcgtttttcgcggtttcgcggtcggaagcgtcgcggcggcgtggcgtagaggggtgacgttaggggtcgcgtcgggcgggcggtaagttgagagtaggttagtgttattgttcggtttttagttttggggatttgttagttttagcgtgatttagtcgttcgttgcgtttgtttacgcgttttttttcgtgatatttttattttagatttcggtgtcgtttatt

SEQ ID NO: 23296 - DNA, 1414 bp, Artificial Sequence
  chemically treated genomic DNA (Homo sapiens) CpG-island No: 23296
aataaacgacaccgaaatctaaaataaaaatatcacgaaaaaaaacgcgtaaacaaacgcaacgaacgactaaatcacgctaaaactaacaaatccccaaaactaaaaaccgaacaataacactaacctactctcaacttaccgcccgcccgacgcgacccctaacgtcacccctctacgccacgccgccgcgacgcttccgaccgcgaaaccgcgaaaaacgaaacgaaataacttcacgaaaaatcgcgcgccgaaaataactaaaactacacgaaaatcgcgaaaacgaaacgcgaaaacgataaaaaaacgacgacgaccgacgataaacgacgaaaacgcgtaaacgaaccgaacgaacgaaactaaaaaaccccgaaacgcgaaccgaaaaacgaaaacgcgaacgcgacgaacgataacgacgaaacgacgacctaaaaaataacgaacgacgacaacgacaacgaacgcgacgacgacgataaaccgtacgaattccaacccgcgtcccgcgacgacgacgaacaaaaaacgcaaaaactaacctcgaaacgactaaacatccaaaacaaacgcttctacttaaatataaaacaaaacgccaaaaaccgcttcctcaaaatcgccgaaataaacgcgaacgattccaaaacgcctcacgctatccaatacgataaccgccgaattacgcgactactaacgactcataaaacactaacgcaactaaaccctaacaaccccgaacaactaacgactaacgccgaaaaaaacgacgaacccgaacgcgcgctcaaaaacgaattcttaatacgtaaaaaccgcaaatactacctaaacctcaaaaaaaaccaacgcgaccgcttcctacgcatccgccaaacgatcaaccgcgacgataacgacttcgacgcgaaccccgaaccgaacgacttacaaaacgaccaaaccatcgcgctacctacgcaaaacctcatcgaattccgcgacgcgctaacgaaactcataaacgactacgaaaacgaaaacgacgaactaacaaacgacccgaaaaacgacgccgaaaacccaaaaaacgacctatataaaaaactcccgaaaaacacctccatcaccgtaaactccaaacgcttcttcttcgatataaactacaacaaatacgaaatatttctacgaataaacgaaataaaaccgtcctaccgcaataccatcaccgtacccttcaaaacctaaaacaaattcgaaaacgccttttaccgatatacgaataaaataaaaaaaatccaaaaacgacaaaaaaataaactttataaacgacgtaataaaaacaacgacgacgacgaaaaatcaaaaaataaaaaaataaataaaaattaaaacgaacaacttcccctacaaacctccacccaac

SEQ ID NO: 23297 - DNA, 885 bp, Artificial Sequence
  chemically treated genomic DNA (Homo sapiens) CpG-island No: 23297
ggtcgttttttttttgaggaagtcggtagcgcgcgggaggtcgttttttttttgaggaagtcggtagcgcgcgggaggtcgttttttttttgaggaagtcggtagcgcgcgggaggtcgttttttttttgtggaagtcggtagcgcgcgggaggtcgttttttttttgaggaagtcggtagcgcgcgggaggtcgttttttttttgaggaaatcggtagcgcgcgggaggtcgttttttttttgaggaagtaggtagcgcgcgggaggtcgttttttttttgaggaaatcggtagcgcgcgggaggtcgttttttttttgaggaaatcggtagtaggcgggaggtcgttttttttttgaggaagtaggtagcgcgcgggaggtcgttttttttttgaggaagtcggtagcgcgcgggaggtcgttttttttttgagaaagtaggtagcgcgcgggaggtcgttttttttttgaggaaatcggtagcgcgcgggaggtcgttttttttttgaggaagtcggtagcgcgcgggaggtcgttttttttttgaggaagtcggtagcgttcgggaggtcgttttttttttgaggaaatcggtagcgcgcgggaggtcgttttttttttgaggaagtcggtagcgcgcgggaggtcgttttttttttgaggaagtcggtagcgcgcgggaggtcgttttttttttgaggaagtaggtagcgcgcgggaggtcgttttttttttgagaaagtaggtagcgcgcgggaggtcgttttttttttcggtcgtaggtatcggagcgcgggaggtcgtttttttattttaaagtttcgttgtttcgtgggtgatgttaaagtgtatatttttaaatattgtttttgtttattgattg

SEQ ID NO: 23298 - DNA, 885 bp, Artificial Sequence
  chemically treated genomic DNA (Homo sapiens) CpG-island No: 23298
caatcaataaacaaaaacaatatttaaaaatatacactttaacatcacccacgaaacaacgaaactttaaaataaaaaaacgacctcccgcgctccgatacctacgaccgaaaaaaaaaacgacctcccgcgcgctacctactttctcaaaaaaaaaacgacctcccgcgcgctacctacttcctcaaaaaaaaaacgacctcccgcgcgctaccgacttcctcaaaaaaaaaacgacctcccgcgcgctaccgacttcctcaaaaaaaaaacgacctcccgcgcgctaccgatttcctcaaaaaaaaaacgacctcccgaacgctaccgacttcctcaaaaaaaaaacgacctcccgcgcgctaccgacttcctcaaaaaaaaaacgacctcccgcgcgctaccgatttcctcaaaaaaaaaacgacctcccgcgcgctacctactttctcaaaaaaaaaacgacctcccgcgcgctaccgacttcctcaaaaaaaaaacgacctcccgcgcgctacctacttcctcaaaaaaaaaacgacctcccgcctactaccgatttcctcaaaaaaaaaacgacctcccgcgcgctaccgatttcctcaaaaaaaaaacgacctcccgcgcgctacctacttcctcaaaaaaaaaacgacctcccgcgcgctaccgatttcctcaaaaaaaaaacgacctcccgcgcgctaccgacttcctcaaaaaaaaaacgacctcccgcgcgctaccgacttccacaaaaaaaaaacgacctcccgcgcgctaccgacttcctcaaaaaaaaaacgacctcccgcgcgctaccgacttcctcaaaaaaaaaacgacctcccgcgcgctaccgacttcctcaaaaaaaaaacgacc

SEQ ID NO: 23299 - DNA, 885 bp, Artificial Sequence
  chemically treated genomic DNA (Homo sapiens) CpG-island No: 23299
taattaatgaataaaaatagtatttgaaaatgtgtattttgatattatttacgaggtagcggggttttgagataagaggacggtttttcgcgtttcggtgtttgcggtcgaggaagaggacggtttttcgcgcgttgtttgtttttttaggaagaggacggtttttcgcgcgttgtttgtttttttaggaagaggacggtttttcgcgcgttgtcggtttttttaggaagaggacggtttttcgcgcgttgtcggtttttttaggaagaggacggtttttcgcgcgttgtcggtttttttaggaagaggacggtttttcgggcgttgtcggtttttttaggaagaggacggtttttcgcgcgttgtcggtttttttaggaagaggacggtttttcgcgcgttgtcggtttttttaggaagaggacggtttttcgcgcgttgtttgtttttttaggaagaggacggtttttcgcgcgttgtcggtttttttaggaagaggacggtttttcgcgcgttgtttgtttttttaggaagaggacggtttttcgtttgttgtcggtttttttaggaagaggacggtttttcgcgcgttgtcggtttttttaggaagaggacggtttttcgcgcgttgtttgtttttttaggaagaggacggtttttcgcgcgttgtcggtttttttaggaagaggacggtttttcgcgcgttgtcggtttttttaggaagaggacggtttttcgcgcgttgtcggtttttataggaagaggacggtttttcgcgcgttgtcggtttttttaggaagaggacggtttttcgcgcgttgtcggtttttttaggaagaggacggtttttcgcgcgttgtcggtttttttaggaagaggacggtt

SEQ ID NO: 23300 - DNA, 885 bp, Artificial Sequence
  chemically treated genomic DNA (Homo sapiens) CpG-island No: 23300
aaccgtcctcttcctaaaaaaaccgacaacgcgcgaaaaaccgtcctcttcctaaaaaaaccgacaacgcgcgaaaaaccgtcctcttcctaaaaaaaccgacaacgcgcgaaaaaccgtcctcttcctataaaaaccgacaacgcgcgaaaaaccgtcctcttcctaaaaaaaccgacaacgcgcgaaaaaccgtcctcttcctaaaaaaaccgacaacgcgcgaaaaaccgtcctcttcctaaaaaaacaaacaacgcgcgaaaaaccgtcctcttcctaaaaaaaccgacaacgcgcgaaaaaccgtcctcttcctaaaaaaaccgacaacaaacgaaaaaccgtcctcttcctaaaaaaacaaacaacgcgcgaaaaaccgtcctcttcctaaaaaaaccgacaacgcgcgaaaaaccgtcctcttcctaaaaaaacaaacaacgcgcgaaaaaccgtcctcttcctaaaaaaaccgacaacgcgcgaaaaaccgtcctcttcctaaaaaaaccgacaacgcgcgaaaaaccgtcctcttcctaaaaaaaccgacaacgcccgaaaaaccgtcctcttcctaaaaaaaccgacaacgcgcgaaaaaccgtcctcttcctaaaaaaaccgacaacgcgcgaaaaaccgtcctcttcctaaaaaaaccgacaacgcgcgaaaaaccgtcctcttcctaaaaaaacaaacaacgcgcgaaaaaccgtcctcttcctaaaaaaacaaacaacgcgcgaaaaaccgtcctcttcctcgaccgcaaacaccgaaacgcgaaaaaccgtcctcttatctcaaaaccccgctacctcgtaaataatatcaaaatacacattttcaaatactatttttattcattaatta

SEQ ID NO: 23301 - DNA, 501 bp, Artificial Sequence
  chemically treated genomic DNA (Homo sapiens) CpG-island No: 23301
tttagatcgggggtcgtcgttagtttcggaaggtcgagaggtgcgtttgttaggtcgtgcgcgtcgtcggttaggtcgtgtaggagtcggggtacggtagtggtatagttacggcgcgggttaaggtttagggcgcgggcgggcggtgttagtaggtcgggaggtttttcgtgggcgcgggcggttgcgcggggcgcggtttaggcggtttgaggaggttgcggttgcgttaggggcgttaggtcgttatatgggttttttgttaggtggggaaaggttgcggcggcgtcgggcgtttgatcgtagggtagcggtggttgcgggtagggcggcgggaagtagggcggttggaattcggcggtagttgtggcggtcggcgtgtggtagagcgggggcgtcggttcgtaggtcgtttggggtagagacgataggcgggtttcgtcggtagttgtttttagttcgtcggggcgtttttggggaaggagaggggtgttttaggtg

SEQ ID NO: 23302 - DNA, 501 bp, Artificial Sequence
  chemically treated genomic DNA (Homo sapiens) CpG-island No: 23302
cacctaaaacacccctctccttccccaaaaacgccccgacgaactaaaaacaactaccgacgaaacccgcctatcgtctctaccccaaacgacctacgaaccgacgcccccgctctaccacacgccgaccgccacaactaccgccgaattccaaccgccctacttcccgccgccctacccgcaaccaccgctaccctacgatcaaacgcccgacgccgccgcaacctttccccacctaacaaaaaacccatataacgacctaacgcccctaacgcaaccgcaacctcctcaaaccgcctaaaccgcgccccgcgcaaccgcccgcgcccacgaaaaacctcccgacctactaacaccgcccgcccgcgccctaaaccttaacccgcgccgtaactataccactaccgtaccccgactcctacacgacctaaccgacgacgcgcacgacctaacaaacgcacctctcgaccttccgaaactaacgacgacccccgatctaaa

SEQ ID NO: 23303 - DNA, 501 bp, Artificial Sequence
  chemically treated genomic DNA (Homo sapiens) CpG-island No: 23303
tatttaaggtatttttttttttttttaggagcgtttcgacgggttgggagtagttgtcggcggggttcgtttgtcgtttttgttttaggcggtttacgggtcggcgttttcgttttgttatacgtcggtcgttatagttgtcgtcgaattttagtcgttttatttttcgtcgttttattcgtagttatcgttgttttacggttaggcgttcgacgtcgtcgtagtttttttttatttggtaggggatttatatggcggtttggcgtttttggcgtagtcgtagtttttttaggtcgtttgggtcgcgtttcgcgtagtcgttcgcgtttacgaggagtttttcggtttgttggtatcgttcgttcgcgttttgggttttgattcgcgtcgtgattatgttattgtcgtgtttcggtttttgtacggtttggtcgacggcgcgtacggtttggtagacgtatttttcggtttttcggggttggcggcggttttcggtttgga

SEQ ID NO: 23304 - DNA, 501 bp, Artificial Sequence
  chemically treated genomic DNA (Homo sapiens) CpG-island No: 23304
tccaaaccgaaaaccgccgccaaccccgaaaaaccgaaaaatacgtctaccaaaccgtacgcgccgtcgaccaaaccgtacaaaaaccgaaacacgacaataacataatcacgacgcgaatcaaaacccaaaacgcgaacgaacgataccaacaaaccgaaaaactcctcgtaaacgcgaacgactacgcgaaacgcgacccaaacgacctaaaaaaactacgactacgccaaaaacgccaaaccgccatataaatcccctaccaaataaaaaaaaactacgacgacgtcgaacgcctaaccgtaaaacaacgataactacgaataaaacgacgaaaaataaaacgactaaaattcgacgacaactataacgaccgacgtataacaaaacgaaaacgccgacccgtaaaccgcctaaaacaaaaacgacaaacgaaccccgccgacaactactcccaacccgtcgaaacgctcctaaaaaaaaaaaaaaataccttaaata

SEQ ID NO: 23305 - DNA, 621 bp, Artificial Sequence
  chemically treated genomic DNA (Homo sapiens) CpG-island No: 23305
gcgggcgtaggagttttaggttggggatagcggttatttgcgtatcgcgtttttagttggcgaagtttttgcggtttttttttttcgagatttcgttagcgcgggataggagggttggaaagtttagtatttaggcgtttcgatttttcggtcgaatatgtttcgggttcgagattatttattatggcggagtaggtgtgtattagtatggggcggtgagtgtcgggcgcgaggcgtggcggcggcggagttttagttcgacggcgagcgttgcgggtagaggcgtcgggagtcggtatagttcgcggaggttacggtgcggtagttgggtgcgatttagtcgggattttagtgggcgtggggtttttagcggtggtcgttttcgggcgggtttatggaggtaggacggacgggtattgatcgtatttggaaaagtcggttaacgggtgtttagcgttcgtttttttttttttgagcgtagtttgttttatgtattttagttatagtggcgggggcgcgtcgggttttcgggggcgcgtattaaagagataagttatggtagtttttttttttttttttagcggttgttataggggaggtagtggttttggcgggatcggg

SEQ ID NO: 23306 - DNA, 621 bp, Artificial Sequence
  chemically treated genomic DNA (Homo sapiens) CpG-island No: 23306
cccgatcccgccaaaaccactacctcccctataacaaccgctaaaaaaaaaaaaaaaaactaccataacttatctctttaatacgcgcccccgaaaacccgacgcgcccccgccactataactaaaatacataaaacaaactacgctcaaaaaaaaaaaaacgaacgctaaacacccgttaaccgacttttccaaatacgatcaatacccgtccgtcctacctccataaacccgcccgaaaacgaccaccgctaaaaaccccacgcccactaaaatcccgactaaatcgcacccaactaccgcaccgtaacctccgcgaactataccgactcccgacgcctctacccgcaacgctcgccgtcgaactaaaactccgccgccgccacgcctcgcgcccgacactcaccgccccatactaatacacacctactccgccataataaataatctcgaacccgaaacatattcgaccgaaaaatcgaaacgcctaaatactaaactttccaaccctcctatcccgcgctaacgaaatctcgaaaaaaaaaaaccgcaaaaacttcgccaactaaaaacgcgatacgcaaataaccgctatccccaacctaaaactcctacgcccgc

SEQ ID NO: 23307 - DNA, 621 bp, Artificial Sequence
  chemically treated genomic DNA (Homo sapiens) CpG-island No: 23307
ttcgatttcgttaaagttattgttttttttgtggtagtcgttggggaaaagggagagaattgttatagtttgtttttttaatgcgcgttttcggaggttcggcgcgttttcgttattataattggagtgtatggagtaggttacgtttagaggaggaagggcgggcgttgggtattcgttgatcgatttttttaagtgcgattagtgttcgttcgttttgtttttatggattcgttcgggaacggttatcgttgaggattttacgtttattaggatttcggttgggtcgtatttagttatcgtatcgtgattttcgcgggttgtgtcggttttcggcgtttttgttcgtagcgttcgtcgtcgggttagggtttcgtcgtcgttacgtttcgcgttcggtatttatcgttttatgttggtgtatatttatttcgttatggtgagtagtttcgggttcgggatatattcggtcgggggatcggggcgtttgagtgttggattttttaatttttttgtttcgcgttaacgaaatttcggagggagggggtcgtagggatttcgttagttgagaacgcgatgcgtaagtgatcgttgtttttagtttgaggtttttgcgttcgt

SEQ ID NO: 23308 - DNA, 621 bp, Artificial Sequence
  chemically treated genomic DNA (Homo sapiens) CpG-island No: 23308
acgaacgcaaaaacctcaaactaaaaacaacgatcacttacgcatcgcgttctcaactaacgaaatccctacgaccccctccctccgaaatttcgttaacgcgaaacaaaaaaattaaaaaatccaacactcaaacgccccgatcccccgaccgaatatatcccgaacccgaaactactcaccataacgaaataaatatacaccaacataaaacgataaataccgaacgcgaaacgtaacgacgacgaaaccctaacccgacgacgaacgctacgaacaaaaacgccgaaaaccgacacaacccgcgaaaatcacgatacgataactaaatacgacccaaccgaaatcctaataaacgtaaaatcctcaacgataaccgttcccgaacgaatccataaaaacaaaacgaacgaacactaatcgcacttaaaaaaatcgatcaacgaatacccaacgcccgcccttcctcctctaaacgtaacctactccatacactccaattataataacgaaaacgcgccgaacctccgaaaacgcgcattaaaaaaacaaactataacaattctctcccttttccccaacgactaccacaaaaaaaacaataactttaacgaaatcgaa

SEQ ID NO: 23309 - DNA, 592 bp, Artificial Sequence
  chemically treated genomic DNA (Homo sapiens) CpG-island No: 23309
agcggtacgcgtaattatttagttatataatatatcggagggtaggacgcggtattttataagtaagtaatatagtatcgacggttacgggttaattcgtcgtgtattataaattatatatagggttcgtagcgcgtcgacgagtttattgcgagagatcgagagcgatcgtagtcgagcggagttacgttagtcgttattcgagaacgagcgagcgtcggtacgcggagagattacgttaagacgtcgatcgtttatagtcggtagaagagcgtagattgttttttcggacgcgcgcgtcgcgtaggagtaggtacgcgagagagagagaagcgcgcgtcgcgtacgagtttagtttacgtacgtcgcgtcgtattttttttttggttcgtttcgtcgtttcgagataataaaaagatagcgattattattatatgtttcgttatttttcgcgtcgtttcgttgattacgttacggagcgtagtcgcgcggtcgttgcgttcgcgtcgtgtcgcgattcgcgttttggcgcgattttatttacgacgtttcgaggagagatacgaggagcgagagagagagggcggggggg

SEQ ID NO: 23310 - DNA, 592 bp, Artificial Sequence
  chemically treated genomic DNA (Homo sapiens) CpG-island No: 23310
cccccccgccctctctctctcgctcctcgtatctctcctcgaaacgtcgtaaataaaatcgcgccaaaacgcgaatcgcgacacgacgcgaacgcaacgaccgcgcgactacgctccgtaacgtaatcaacgaaacgacgcgaaaaataacgaaacatataataataatcgctatctttttattatctcgaaacgacgaaacgaaccaaaaaaaaaatacgacgcgacgtacgtaaactaaactcgtacgcgacgcgcgcttctctctctctcgcgtacctactcctacgcgacgcgcgcgtccgaaaaaacaatctacgctcttctaccgactataaacgatcgacgtcttaacgtaatctctccgcgtaccgacgctcgctcgttctcgaataacgactaacgtaactccgctcgactacgatcgctctcgatctctcgcaataaactcgtcgacgcgctacgaaccctatatataatttataatacacgacgaattaacccgtaaccgtcgatactatattacttacttataaaataccgcgtcctaccctccgatatattatataactaaataattacgcgtaccgct

SEQ ID NO: 23311 - DNA, 592 bp, Artificial Sequence
  chemically treated genomic DNA (Homo sapiens) CpG-island No: 23311
ttttttcgttttttttttttcgtttttcgtgttttttttcgaggcgtcgtaggtgaggtcgcgttagggcgcggatcgcggtacggcgcggacgtagcggtcgcgcggttgcgtttcgtgacgtagttagcgaggcggcgcgaggagtggcgaggtatgtgatagtgatcgttgtttttttgttgtttcgaggcggcggggcgggttagggggggggtgcggcgcggcgtgcgtaggttgggttcgtgcgcgacgcgcgtttttttttttttcgcgtgtttgtttttgcgcggcgcgcgcgttcgagagggtagtttgcgtttttttgtcggttgtgggcggtcggcgttttgacgtggttttttcgcgtgtcggcgttcgttcgttttcgggtggcggttgacgtggtttcgttcggttgcgatcgttttcggtttttcgtagtgggttcgtcggcgcgttgcgggttttgtgtgtggtttgtggtgtacggcgggttggttcgtggtcgtcggtgttgtgttgtttgtttgtagggtgtcgcgttttgtttttcggtgtgttgtgtggttgggtagttgcgcgtgtcgtt

SEQ ID NO: 23312 - DNA, 592 bp, Artificial Sequence
  chemically treated genomic DNA (Homo sapiens) CpG-island No: 23312
aacgacacgcgcaactacccaaccacacaacacaccgaaaaacaaaacgcgacaccctacaaacaaacaacacaacaccgacgaccacgaaccaacccgccgtacaccacaaaccacacacaaaacccgcaacgcgccgacgaacccactacgaaaaaccgaaaacgatcgcaaccgaacgaaaccacgtcaaccgccacccgaaaacgaacgaacgccgacacgcgaaaaaaccacgtcaaaacgccgaccgcccacaaccgacaaaaaaacgcaaactaccctctcgaacgcgcgcgccgcgcaaaaacaaacacgcgaaaaaaaaaaaaacgcgcgtcgcgcacgaacccaacctacgcacgccgcgccgcaccccccccctaacccgccccgccgcctcgaaacaacaaaaaaacaacgatcactatcacatacctcgccactcctcgcgccgcctcgctaactacgtcacgaaacgcaaccgcgcgaccgctacgtccgcgccgtaccgcgatccgcgccctaacgcgacctcacctacgacgcctcgaaaaaaaacacgaaaaacgaaaaaaaaaaaacgaaaaaa

SEQ ID NO: 23313 - DNA, 863 bp, Artificial Sequence
  chemically treated genomic DNA (Homo sapiens) CpG-island No: 23313
ttttcgtgtatcgggttgtcggtagtttcggtcgtttagttttcgcggtagtaatagtagtaatagtatcgggggagttttttttaggcggattataagtttcggtaggtcgcgcgcgggtcgcgtatgcgtagcggggatcggcgtttgagtggtaagttgtttgttatagcgaatattagttgtttttcgcgtcgggcgtcgcgcgtcgttgtttcgtcgttcggtttttcggttgttgttttgtcggcgttgtttttttcgtttcgcggtttttttttgtaatttggcgggtttttttttttttgttcggttcggttcggtcgtcgtcgtttttcgcgttcggcgtcgagttttcgggttttcgggtcggttgtcggtgtcggtagggcgcggagggggcgggggtcgcggttcgttttttcgcggatgagtcgtcgcggacggggcgcgggcggacgatggaattttatattttggagtatcggttgtaagttgttagcgtcgttaaggagagtatttcgttgtttattacggtttgattaaatttgtttttttgttttttaagattaggtaagcgcgcggggacgcggcgtcggtcggggatagataaagggggcgtatttcgggtcgttgttttcgtcgtcgcgtttcggaaaataatttcgggtttcgggaggttttcgtttcgttttcgtcgtcgcgttcgttagcgtttgataaagtcggagtcgtagggttttggttttcggattttttgaaaaattttatttttcggtgcgttattttttatttttgtcgttttttttattttttatttttttttttatcgtagtttttttttcgaaattcggggggttggg

SEQ ID NO: 23314 - DNA, 863 bp, Artificial Sequence
  chemically treated genomic DNA (Homo sapiens) CpG-island No: 23314
cccaaccccccgaatttcgaaaaaaaaactacgataaaaaaaaaaataaaaaataaaaaaaacgacaaaaataaaaaataacgcaccgaaaaataaaatttttcaaaaaatccgaaaaccaaaaccctacgactccgactttatcaaacgctaacgaacgcgacgacgaaaacgaaacgaaaacctcccgaaacccgaaattattttccgaaacgcgacgacgaaaacaacgacccgaaatacgccccctttatctatccccgaccgacgccgcgtccccgcgcgcttacctaatcttaaaaaacaaaaaaacaaatttaatcaaaccgtaataaacaacgaaatactctccttaacgacgctaacaacttacaaccgatactccaaaatataaaattccatcgtccgcccgcgccccgtccgcgacgactcatccgcgaaaaaacgaaccgcgacccccgccccctccgcgccctaccgacaccgacaaccgacccgaaaacccgaaaactcgacgccgaacgcgaaaaacgacgacgaccgaaccgaaccgaacaaaaaaaaaaaaacccgccaaattacaaaaaaaaaccgcgaaacgaaaaaaacaacgccgacaaaacaacaaccgaaaaaccgaacgacgaaacaacgacgcgcgacgcccgacgcgaaaaacaactaatattcgctataacaaacaacttaccactcaaacgccgatccccgctacgcatacgcgacccgcgcgcgacctaccgaaacttataatccgcctaaaaaaaactcccccgatactattactactattactaccgcgaaaactaaacgaccgaaactaccgacaacccgatacacgaaaa

SEQ ID NO: 23315 - DNA, 863 bp, Artificial Sequence
  chemically treated genomic DNA (Homo sapiens) CpG-island No: 23315
tttagtttttcggatttcggggagggggttgcgatgggggagggggtgggagatgggggggacgatagaggtggggggtggcgtatcggggggtgaaattttttaaggggttcgggagttaagattttgcggtttcggttttgttagacgttagcgaacgcggcggcgggggcggggcgggggtttttcggggttcgaagttgtttttcgaggcgcggcggcgaggatagcggttcggggtgcgttttttttgtttgttttcggtcggcgtcgcgttttcgcgcgtttatttggttttggaggataggaaggtaagtttgattaggtcgtagtgaatagcgggatattttttttggcgacgttggtaatttgtagtcggtgttttaggatgtggagttttatcgttcgttcgcgtttcgttcgcggcggtttattcgcggggggacgagtcgcggttttcgtttttttcgcgttttgtcggtatcgatagtcggttcggagattcgggagttcggcgtcgggcgcggggggcggcggcggtcgggtcgggtcggataaaagggaggaggttcgttaagttgtaagggggagtcgcggggcgagggaggtagcgtcggtagagtagtagtcgaggggtcgagcggcggagtagcggcgcgcggcgttcggcgcggggagtagttggtgttcgttgtaataaataatttgttatttaaacgtcggttttcgttgcgtatgcgcggttcgcgcgcggtttgtcgggatttgtagttcgtttggggggggttttttcggtgttgttgttgttgttgttgtcgcgggggttgggcggtcggagttatcggtagttcggtgtacgggaa

SEQ ID NO: 23316 - DNA, 863 bp, Artificial Sequence
  chemically treated genomic DNA (Homo sapiens) CpG-island No: 23316
ttcccgtacaccgaactaccgataactccgaccgcccaacccccgcgacaacaacaacaacaacaacaccgaaaaaaccccccccaaacgaactacaaatcccgacaaaccgcgcgcgaaccgcgcatacgcaacgaaaaccgacgtttaaataacaaattatttattacaacgaacaccaactactccccgcgccgaacgccgcgcgccgctactccgccgctcgacccctcgactactactctaccgacgctacctccctcgccccgcgactcccccttacaacttaacgaacctcctcccttttatccgacccgacccgaccgccgccgccccccgcgcccgacgccgaactcccgaatctccgaaccgactatcgataccgacaaaacgcgaaaaaaacgaaaaccgcgactcgtccccccgcgaataaaccgccgcgaacgaaacgcgaacgaacgataaaactccacatcctaaaacaccgactacaaattaccaacgtcgccaaaaaaaatatcccgctattcactacgacctaatcaaacttaccttcctatcctccaaaaccaaataaacgcgcgaaaacgcgacgccgaccgaaaacaaacaaaaaaaacgcaccccgaaccgctatcctcgccgccgcgcctcgaaaaacaacttcgaaccccgaaaaacccccgccccgcccccgccgccgcgttcgctaacgtctaacaaaaccgaaaccgcaaaatcttaactcccgaaccccttaaaaaatttcaccccccgatacgccaccccccacctctatcgtcccccccatctcccaccccctcccccatcgcaaccccctccccgaaatccgaaaaactaaa

SEQ ID NO: 23317 - DNA, 822 bp, Artificial Sequence
  chemically treated genomic DNA (Homo sapiens) CpG-island No: 23317
ttcgtattttttgttatcgattttcgtcgtttatttttacgaagttcgaagttttatattatattttttattttcgaattatatttttaggattcgatttttcgtttagttattttttacgttttattacgtcgttagaattttttattttagtttttttttagttttgtgtacgtttgattattcgatttggtttagtagtaattcgttcgattatatatttattacggttttatcgttatttttattatttacgtttatcgatttataatttttttttttttttatatatatagtttatacgttttatcggtttattaataacgttagatcgttcgggtttcgcggtatacgaggcgtattatattacggttttttttttcgttttacgtttttttttattttttttcgcgtttttttgttcgcgcgattttttaggtcgttttatcgtattattaaggtacggttacgtattatttatttttttttttatatatttagaattcgttgcgtcgttttttatttcgtcgttcgtcgtcgcgtttcgacgatttttttttttttttttttttttttttgtagttcgaggatagcgtacgcgcgttagttacgcgcgtatcgttataacgttttttttttagacgagaagtatttatagtttatattttttgcgttttatgtttatttttttttttttcgtttacgtttttatatattatattagcgattagtcgttatttaattttttcgttcgtttacgtattttagagttacgttttacgtatacgttatttattacgataagtgtagttacgattgttt

SEQ ID NO: 23318 - DNA, 822 bp, Artificial Sequence
  chemically treated genomic DNA (Homo sapiens) CpG-island No: 23318
aaacaatcgtaactacacttatcgtaataaataacgtatacgtaaaacgtaactctaaaatacgtaaacgaacgaaaaaattaaataacgactaatcgctaatataatatataaaaacgtaaacgaaaaaaaaaaaaataaacataaaacgcaaaaaatataaactataaatacttctcgtctaaaaaaaaaacgttataacgatacgcgcgtaactaacgcgcgtacgctatcctcgaactacaaaaaaaaaaaaaaaaaaaaaaaaaaatcgtcgaaacgcgacgacgaacgacgaaataaaaaacgacgcaacgaattctaaatatataaaaaaaaaaataaataatacgtaaccgtaccttaataatacgataaaacgacctaaaaaatcgcgcgaacaaaaaaacgcgaaaaaaaataaaaaaaaacgtaaaacgaaaaaaaaaaccgtaatataatacgcctcgtataccgcgaaacccgaacgatctaacgttattaataaaccgataaaacgtataaactatatatataaaaaaaaaaaaaaattataaatcgataaacgtaaataataaaaataacgataaaaccgtaataaatatataatcgaacgaattactactaaaccaaatcgaataatcaaacgtacacaaaactaaaaaaaaactaaaataaaaaattctaacgacgtaataaaacgtaaaaaataactaaacgaaaaatcgaatcctaaaaatataattcgaaaataaaaaatataatataaaacttcgaacttcgtaaaaataaacgacgaaaatcgataacaaaaaatacgaa

SEQ ID NO: 23319 - DNA, 822 bp, Artificial Sequence
  chemically treated genomic DNA (Homo sapiens) CpG-island No: 23319
gggtagtcgtggttgtatttgtcgtggtgggtggcgtgtgcgtgaggcgtggttttggagtacgtgggcgggcgggagggttgggtggcggttggtcgttggtgtggtgtgtagggacgtggacggagaggggggggatgggtatggagcgtagggagtatgagttgtggatgtttttcgtttggaggggggacgttgtggcggtgcgcgcgtgattgacgcgcgtgcgttgttttcgagttgtagaggaggggaggggggggggggggggtcgtcgggacgcggcgacgagcggcggggtggagggcggcgtagcgggttttgagtgtgtggaggaaagagtaggtggtgcgtggtcgtgttttggtggtgcggtggagcggtttgggaggtcgcgcgggtaggagggcgcgggggggggtggagagaggcgtgagacgagggaggaggtcgtggtgtggtgcgtttcgtgtgtcgcgaggttcgggcggtttggcgttgttggtgggtcggtggggcgtgtgagttatatatgtgggagagagagagagttgtgagtcgatgggcgtgggtagtgagagtggcggtggggtcgtgatggatgtgtgatcgagcgggttattgttggattaggtcgagtggttaggcgtgtatagggttgagagagggttgaggtgggaggttttggcggcgtgatggggcgtgggaggtggttgagcgaagggtcgggttttggggatgtggttcggaggtgaggagtgtggtgtggagtttcgagtttcgtagaagtgggcggcggggatcggtggtaagaagtgcgag

SEQ ID NO: 23320 - DNA, 822 bp, Artificial Sequence
  chemically treated genomic DNA (Homo sapiens) CpG-island No: 23320
ctcgcacttcttaccaccgatccccgccgcccacttctacgaaactcgaaactccacaccacactcctcacctccgaaccacatccccaaaacccgacccttcgctcaaccacctcccacgccccatcacgccgccaaaacctcccacctcaaccctctctcaaccctatacacgcctaaccactcgacctaatccaacaataacccgctcgatcacacatccatcacgaccccaccgccactctcactacccacgcccatcgactcacaactctctctctctcccacatatataactcacacgccccaccgacccaccaacaacgccaaaccgcccgaacctcgcgacacacgaaacgcaccacaccacgacctcctccctcgtctcacgcctctctccacccccccccgcgccctcctacccgcgcgacctcccaaaccgctccaccgcaccaccaaaacacgaccacgcaccacctactctttcctccacacactcaaaacccgctacgccgccctccaccccgccgctcgtcgccgcgtcccgacgacccccccccccccccctcccctcctctacaactcgaaaacaacgcacgcgcgtcaatcacgcgcgcaccgccacaacgtcccccctccaaacgaaaaacatccacaactcatactccctacgctccatacccatcccccccctctccgtccacgtccctacacaccacaccaacgaccaaccgccacccaaccctcccgcccgcccacgtactccaaaaccacgcctcacgcacacgccacccaccacgacaaatacaaccacgactaccc

SEQ ID NO: 23321 - DNA, 940 bp, Artificial Sequence
  chemically treated genomic DNA (Homo sapiens) CpG-island No: 23321
gggaagaattttagggcgtcgttttaaattaaattcgttcggcgagaaaataatttttatatttcgtttttacggtcgttatttattcgttttataattttatttttttaagttcggacgcgttttcgcgttattattagtattttttttttttagatttattcgagttcgtcgttttcgtttagttatattataatagtcgtatttttacgattttatattattatttattttttcgcgattcgtcgtacgtatttatatttttttttacgcgcgtcgttttagtcggacgatttcgcgtttcgacgtatacgcgtagatatcgtattatacgattcgatttcgaatatatataattatatcgtttcgattattagttcgttagcgatattttcgattatattttatatcgcgtcgatatttttagacggcgtattcgcgtttataagatatttcgcgtttcgcgttcgcgtcgcgttcgtagtagtatattttattcgttcggtttagcgcgcggtagagttcgacgcgttatagttcgtttattcgttatttataatatagttttttcgcgaagacgcgatcgaagtatatcgagcgatcgatatatagttcgcgttatcgagttagacgagtcgtatattcgttcgtacgacgcgtagcgacgcgcgcgcgtcgtttttcgttttcgcgcgtatttttttcgcgtatattcgtaacgatagttcgtttattcgatttatttagcgtacgtcgtttttcggcgtacgttcgtatattatcgtttttaagtttcggtcgtatagtagttcgtatagtttttatatatatcgtatattcgcgttttttacgtattttacgtatttttttttttattattatcgacgtttttttattagtttatttatttttatagtttaggagaagtcgttaatatatt

SEQ ID NO: 23322 - DNA, 940 bp, Artificial Sequence
  chemically treated genomic DNA (Homo sapiens) CpG-island No: 23322
aatatattaacgacttctcctaaactataaaaataaataaactaataaaaaaacgtcgataataataaaaaaaaaaatacgtaaaatacgtaaaaaacgcgaatatacgatatatataaaaactatacgaactactatacgaccgaaacttaaaaacgataatatacgaacgtacgccgaaaaacgacgtacgctaaataaatcgaataaacgaactatcgttacgaatatacgcgaaaaaaatacgcgcgaaaacgaaaaacgacgcgcgcgcgtcgctacgcgtcgtacgaacgaatatacgactcgtctaactcgataacgcgaactatatatcgatcgctcgatatacttcgatcgcgtcttcgcgaaaaaactatattataaataacgaataaacgaactataacgcgtcgaactctaccgcgcgctaaaccgaacgaataaaatatactactacgaacgcgacgcgaacgcgaaacgcgaaatatcttataaacgcgaatacgccgtctaaaaatatcgacgcgatataaaatataatcgaaaatatcgctaacgaactaataatcgaaacgatataattatatatattcgaaatcgaatcgtataatacgatatctacgcgtatacgtcgaaacgcgaaatcgtccgactaaaacgacgcgcgtaaaaaaaaatataaatacgtacgacgaatcgcgaaaaaataaataataatataaaatcgtaaaaatacgactattataatataactaaacgaaaacgacgaactcgaataaatctaaaaaaaaaaaatactaataataacgcgaaaacgcgtccgaacttaaaaaaataaaattataaaacgaataaataacgaccgtaaaaacgaaatataaaaattattttctcgccgaacgaatttaatttaaaacgacgccctaaaattcttccc

SEQ ID NO: 23323 - DNA, 940 bp, Artificial Sequence
  chemically treated genomic DNA (Homo sapiens) CpG-island No: 23323
ggtgtgttggcggttttttttgggttgtggaggtgagtgggttggtgggggggcgtcggtggtggtgggggggggggtgcgtgggatgcgtagggggcgcgggtgtgcggtgtgtgtgggggttgtgcgggttgttgtgcggtcggggtttggaggcggtggtgtgcggacgtgcgtcggggggcggcgtgcgttgggtgggtcgggtgggcgggttgtcgttgcgggtgtgcgcggggggggtgcgcgcgggggcggggggcggcgcgcgcgcgtcgttgcgcgtcgtgcgggcgggtgtgcggttcgtttggttcggtggcgcgagttatgtgtcggtcgttcggtgtgtttcggtcgcgttttcgcgaggggattgtgttgtgagtggcgagtgggcgggttgtggcgcgtcgagttttgtcgcgcgttgagtcgggcgggtggggtgtgttgttgcgggcgcggcgcgagcgcggggcgcgaggtgttttgtgggcgcgggtacgtcgtttgggggtgtcggcgcggtgtggggtgtggtcggaggtgtcgttggcgggttggtggtcggagcggtgtggttgtgtgtgttcggggtcgggtcgtgtggtgcggtgtttgcgcgtgtgcgtcggggcgcggggtcgttcggttggggcggcgcgcgtggggaggagtgtgggtgcgtgcggcgggtcgcgggggggtgggtggtggtgtggggtcgtgggggtgcggttgttgtggtgtggttgggcgggggcggcgggttcgggtgggtttgggggaggggggtgttggtggtggcgcggggacgcgttcgggtttgggggggtggggttgtggggcgggtaggtggcggtcgtgggggcggagtgtgggggttgttttttcgtcgggcgggtttaatttggggcgacgttttggggtttttttt

SEQ ID NO: 23324 - DNA, 940 bp, Artificial Sequence
  chemically treated genomic DNA (Homo sapiens) CpG-island No: 23324
aaaaaaaaccccaaaacgtcgccccaaattaaacccgcccgacgaaaaaacaacccccacactccgcccccacgaccgccacctacccgccccacaaccccacccccccaaacccgaacgcgtccccgcgccaccaccaacacccccctcccccaaacccacccgaacccgccgcccccgcccaaccacaccacaacaaccgcacccccacgaccccacaccaccacccacccccccgcgacccgccgcacgcacccacactcctccccacgcgcgccgccccaaccgaacgaccccgcgccccgacgcacacgcgcaaacaccgcaccacacgacccgaccccgaacacacacaaccacaccgctccgaccaccaacccgccaacgacacctccgaccacaccccacaccgcgccgacacccccaaacgacgtacccgcgcccacaaaacacctcgcgccccgcgctcgcgccgcgcccgcaacaacacaccccacccgcccgactcaacgcgcgacaaaactcgacgcgccacaacccgcccactcgccactcacaacacaatcccctcgcgaaaacgcgaccgaaacacaccgaacgaccgacacataactcgcgccaccgaaccaaacgaaccgcacacccgcccgcacgacgcgcaacgacgcgcgcgcgccgccccccgcccccgcgcgcaccccccccgcgcacacccgcaacgacaacccgcccacccgacccacccaacgcacgccgccccccgacgcacgtccgcacaccaccgcctccaaaccccgaccgcacaacaacccgcacaacccccacacacaccgcacacccgcgccccctacgcatcccacgcacccccccccccaccaccaccgacgcccccccaccaacccactcacctccacaacccaaaaaaaaccgccaacacacc

SEQ ID NO: 23325 - DNA, 595 bp, Artificial Sequence
  chemically treated genomic DNA (Homo sapiens) CpG-island No: 23325
ttgtttgcgtcggggcgggcgggttggtcgtggtcgcgcggtttatttgttggcggtcgaggcgtcgggtttgaggacgttgggtagtttgttagaattcggtattttttagggtttcggcgcgacggcggttttgcgcgtcggggcgtttttcgggggtcgcgggttcggtcggggattcgcgcgcgtattcgttttgttttcggtttttagcgcgtcgttgtcgtcgtcgttcgggtcggtaaacgtcggcgtagttttcgggttttcgcgtcggtagagttcggagttcgtcgtcgtacggggcgtttttttttcgttcgttcgcgtcgcgttcgtcgcgtttgtcgtcgcgagttcgggcgttttggttttcgaggcgggtttgtcggtttcgggtcgtttttggtcgtcgggcgttttttcgagtttcggtcgcgcggttttttgcggattcgtcgagcgttttttttgtttttcgaggcgttgttttttttggtcgtaggttgaaagtttttttggttttttaacgtcgtgttttcgtttgatattttaagttgggtttgggtttatttggtgggaagggtcggagggt

SEQ ID NO: 23326 - DNA, 595 bp, Artificial Sequence
  chemically treated genomic DNA (Homo sapiens) CpG-island No: 23326
accctccgacccttcccaccaaataaacccaaacccaacttaaaatatcaaacgaaaacacgacgttaaaaaaccaaaaaaactttcaacctacgaccaaaaaaaacaacgcctcgaaaaacaaaaaaaacgctcgacgaatccgcaaaaaaccgcgcgaccgaaactcgaaaaaacgcccgacgaccaaaaacgacccgaaaccgacaaacccgcctcgaaaaccaaaacgcccgaactcgcgacgacaaacgcgacgaacgcgacgcgaacgaacgaaaaaaaaacgccccgtacgacgacgaactccgaactctaccgacgcgaaaacccgaaaactacgccgacgtttaccgacccgaacgacgacgacaacgacgcgctaaaaaccgaaaacaaaacgaatacgcgcgcgaatccccgaccgaacccgcgacccccgaaaaacgccccgacgcgcaaaaccgccgtcgcgccgaaaccctaaaaaataccgaattctaacaaactacccaacgtcctcaaacccgacgcctcgaccgccaacaaataaaccgcgcgaccacgaccaacccgcccgccccgacgcaaacaa

SEQ ID NO: 23327 - DNA, 595 bp, Artificial Sequence
  chemically treated genomic DNA (Homo sapiens) CpG-island No: 23327
atttttcgattttttttattagataagtttaggtttaatttgggatattaaacgggaatacgacgttaggaaattaaaggagtttttagtttgcggttagaagaagtagcgtttcggggagtagagggagcgttcggcgagttcgtagagggtcgcgcggtcgaggttcgaggaggcgttcggcggttaggggcggttcgaggtcggtaggttcgtttcggaggttagggcgttcgggttcgcggcggtagacgcggcggacgcggcgcgggcgggcgggaaggaggcgtttcgtgcggcggcgggtttcgagttttgtcggcgcgaaggttcgggggttgcgtcggcgtttgtcggttcgggcggcggcggtagcggcgcgttggaggtcgagggtagggcgggtgcgcgcgcgggttttcggtcgggttcgcgattttcggggggcgtttcggcgcgtaaggtcgtcgtcgcgtcggggttttggaaggtgtcgggttttgataagttgtttagcgtttttaaattcggcgtttcggtcgttagtagatgagtcgcgcggttacggttaattcgttcgtttcggcgtaggtag

SEQ ID NO: 23328 - DNA, 595 bp, Artificial Sequence
  chemically treated genomic DNA (Homo sapiens) CpG-island No: 23328
ctacctacgccgaaacgaacgaattaaccgtaaccgcgcgactcatctactaacgaccgaaacgccgaatttaaaaacgctaaacaacttatcaaaacccgacaccttccaaaaccccgacgcgacgacgaccttacgcgccgaaacgccccccgaaaatcgcgaacccgaccgaaaacccgcgcgcgcacccgccctaccctcgacctccaacgcgccgctaccgccgccgcccgaaccgacaaacgccgacgcaacccccgaaccttcgcgccgacaaaactcgaaacccgccgccgcacgaaacgcctccttcccgcccgcccgcgccgcgtccgccgcgtctaccgccgcgaacccgaacgccctaacctccgaaacgaacctaccgacctcgaaccgcccctaaccgccgaacgcctcctcgaacctcgaccgcgcgaccctctacgaactcgccgaacgctccctctactccccgaaacgctacttcttctaaccgcaaactaaaaactcctttaatttcctaacgtcgtattcccgtttaatatcccaaattaaacctaaacttatctaataaaaaaaatcgaaaaat

SEQ ID NO: 23329 - DNA, 521 bp, Artificial Sequence
  chemically treated genomic DNA (Homo sapiens) CpG-island No: 23329
tgggaggcgtagcgttcgcgggcgcgggaattggcgttcggcgttcgtcgtagttcggtttgggacgcggttacggagcgttcgggacggcgattaaaggagggaatcggagggtcgtttgtgagttgagaggtcgggtgggacgttgggggtttgttttttcggaggcgtttttcggttaatttggtattttcgggtttttacgtcggtattggattcgttaggttcggcgcggggagcgaaggtagcggcgattatagcgttttttttggttcggcggcgtcgttttaggtcgggtttggcggggtttgggggcggcggggtagtttgtttttaggagtaggagtaggttcggcgttagttcggtttgggttttcggcgttcggggtggtgaagttgtttttttttagatacgtagaatgggggcgttttttttcggttagggttttttaggtttcgcgggatttcgggaaatggaagagttgacgattttcgtgggaagggggaagtttggataggat

SEQ ID NO: 23330 - DNA, 521 bp, Artificial Sequence
  chemically treated genomic DNA (Homo sapiens) CpG-island No: 23330
atcctatccaaacttcccccttcccacgaaaatcgtcaactcttccatttcccgaaatcccgcgaaacctaaaaaaccctaaccgaaaaaaaacgcccccattctacgtatctaaaaaaaaacaacttcaccaccccgaacgccgaaaacccaaaccgaactaacgccgaacctactcctactcctaaaaacaaactaccccgccgcccccaaaccccgccaaacccgacctaaaacgacgccgccgaaccaaaaaaaacgctataatcgccgctaccttcgctccccgcgccgaacctaacgaatccaataccgacgtaaaaacccgaaaataccaaattaaccgaaaaacgcctccgaaaaaacaaacccccaacgtcccacccgacctctcaactcacaaacgaccctccgattccctcctttaatcgccgtcccgaacgctccgtaaccgcgtcccaaaccgaactacgacgaacgccgaacgccaattcccgcgcccgcgaacgctacgcctccca

SEQ ID NO: 23331 - DNA, 521 bp, Artificial Sequence
  chemically treated genomic DNA (Homo sapiens) CpG-island No: 23331
gttttgtttaaatttttttttttttacggaagtcgttaatttttttatttttcggggtttcgcggagtttggggggttttggtcggggggaaacgtttttattttgcgtgtttgaggaaaagtaattttattatttcggacgtcgaaggtttaggtcgggttggcgtcgggtttgtttttatttttggggataaattgtttcgtcgtttttagatttcgttaagttcggtttgaggcggcgtcgtcgggttagagggggcgttgtggtcgtcgttattttcgtttttcgcgtcgggtttaacgagtttagtgtcggcgtagaggttcggaggtgttaggttggtcggggggcgttttcggagggataggtttttaacgttttattcgattttttagtttataaacggtttttcggtttttttttttggtcgtcgtttcgggcgtttcgtgatcgcgttttaggtcgagttacggcgagcgtcgagcgttaattttcgcgttcgcgagcgttgcgtttttta

SEQ ID NO: 23332 - DNA, 521 bp, Artificial Sequence
  chemically treated genomic DNA (Homo sapiens) CpG-island No: 23332
taaaaaacgcaacgctcgcgaacgcgaaaattaacgctcgacgctcgccgtaactcgacctaaaacgcgatcacgaaacgcccgaaacgacgaccaaaaaaaaaaaccgaaaaaccgtttataaactaaaaaatcgaataaaacgttaaaaacctatccctccgaaaacgccccccgaccaacctaacacctccgaacctctacgccgacactaaactcgttaaacccgacgcgaaaaacgaaaataacgacgaccacaacgccccctctaacccgacgacgccgcctcaaaccgaacttaacgaaatctaaaaacgacgaaacaatttatccccaaaaataaaaacaaacccgacgccaacccgacctaaaccttcgacgtccgaaataataaaattacttttcctcaaacacgcaaaataaaaacgtttccccccgaccaaaaccccccaaactccgcgaaaccccgaaaaataaaaaaattaacgacttccgtaaaaaaaaaaaaatttaaacaaaac

SEQ ID NO: 23333 - DNA, 1080 bp, Artificial Sequence
  chemically treated genomic DNA (Homo sapiens) CpG-island No: 23333
ttgtcgtcgcgttttttatattagtcggattttcgttcgtagtttcgtcgtcgtttaattgggcgttgaatatcgatttaaagtattcgttgtaggcggttagtacggcgcggtgcgttgggaagttttcgtcgtttattcgtaagagtacgtcgtagaagcgttcgtcgtttttgcgttgttggtttaggttgtgtagtattttcgtgttgtgtttgtttatttggtatgtgtagtagttagacgggtcgtacgaagcgtcgtttattcgttttatggtcgtcgtttttttttattagttcggtcgttgtatttgttcgtttttttttttttttttagtagcgagaagcggggcgtagtagacgtgtttatattttttatacgtgtcggttcgaggttttgtagtttcgtaggtgcgtcgagtgtatacgtttttagttcggattagattgtttagattgcggggtgtattattttttatatagttaattttcgttttcgttggattgcgcgttattttttttttttcgttcgttcgtttttttttttcggtttatttttcgggggggtgcgcgagcgaagaggtgcgttttttttgtaaacgcgtttgttattttttttttcgttcgttaggcggcgtcggcgcgtagttaagaagggtacgcgtacgcggggaggagaaggaggggttcgtcgcgtaggcgcgcgcgcgcgtcgcggtttttttcgggttcgttgggggcgcgcgttgcgttttttgtaaagcgcgagtcggggcgggggcgtcggagcggaggaaataaaaggcgaaggcgaaggcggcggcggcggggcgcgtacgggggcggtggcgcgggtcgggtttcggagtttggagggcggtggcggcggcggcggcggttggagcgggcgggcggcggcggcggtagagtaggtttttttttaggtcgggagaaggcggcggcggagcggcggttgtgcggtttcgggtttcgtgtgttcggagcggaggaaaattgtgtagcggttgtatttttttttgtatttttatttttggggggaggagaaggagggggcgat

SEQ ID NO: 23334 - DNA, 1080 bp, Artificial Sequence
  chemically treated genomic DNA (Homo sapiens) CpG-island No: 23334
atcgccccctccttctcctccccccaaaaataaaaatacaaaaaaaaatacaaccgctacacaattttcctccgctccgaacacacgaaacccgaaaccgcacaaccgccgctccgccgccgccttctcccgacctaaaaaaaaacctactctaccgccgccgccgcccgcccgctccaaccgccgccgccgccgccaccgccctccaaactccgaaacccgacccgcgccaccgcccccgtacgcgccccgccgccgccgccttcgccttcgccttttatttcctccgctccgacgcccccgccccgactcgcgctttacaaaaaacgcaacgcgcgcccccaacgaacccgaaaaaaaccgcgacgcgcgcgcgcgcctacgcgacgaacccctccttctcctccccgcgtacgcgtacccttcttaactacgcgccgacgccgcctaacgaacgaaaaaaaaaataacaaacgcgtttacaaaaaaaacgcacctcttcgctcgcgcacccccccgaaaaataaaccgaaaaaaaaaaacgaacgaacgaaaaaaaaaaaataacgcgcaatccaacgaaaacgaaaattaactatataaaaaataatacaccccgcaatctaaacaatctaatccgaactaaaaacgtatacactcgacgcacctacgaaactacaaaacctcgaaccgacacgtataaaaaatataaacacgtctactacgccccgcttctcgctactaaaaaaaaaaaaaaaaacgaacaaatacaacgaccgaactaataaaaaaaaacgacgaccataaaacgaataaacgacgcttcgtacgacccgtctaactactacacataccaaataaacaaacacaacacgaaaatactacacaacctaaaccaacaacgcaaaaacgacgaacgcttctacgacgtactcttacgaataaacgacgaaaacttcccaacgcaccgcgccgtactaaccgcctacaacgaatactttaaatcgatattcaacgcccaattaaacgacgacgaaactacgaacgaaaatccgactaatataaaaaacgcgacgacaa

SEQ ID NO: 23335 - DNA, 1080 bp, Artificial Sequence
  chemically treated genomic DNA (Homo sapiens) CpG-island No: 23335
atcgtttttttttttttttttttttaggggtgaaagtgtaagaggaagtgtagtcgttgtatagttttttttcgtttcgaatatacggagttcggggtcgtatagtcgtcgtttcgtcgtcgttttttttcggtttgaggaagggtttattttgtcgtcgtcgtcgttcgttcgttttagtcgtcgtcgtcgtcgttatcgttttttaggtttcgggattcggttcgcgttatcgttttcgtgcgcgtttcgtcgtcgtcgttttcgttttcgttttttgtttttttcgtttcggcgttttcgtttcggttcgcgttttgtaggggacgtagcgcgcgtttttagcgggttcgggaaaagtcgcggcgcgcgcgcgcgtttgcgcggcggatttttttttttttttttcgcgtgcgcgtgttttttttggttgcgcgtcggcgtcgtttggcgggcgggaggggaggtggtaggcgcgtttgtaggaggggcgtattttttcgttcgcgtattttttcggaaggtagatcgggaaggggaggcgggcgggcggagaggagagagtggcgcgtagtttagcgagggcgggggttggttatgtggggggtggtgtatttcgtagtttagatagtttgattcgggttgggggcgtgtatattcggcgtatttgcgagattatagagtttcgggtcggtacgtgtggggagtgtggatacgtttgttgcgtttcgtttttcgttgttgaggggaagggagggggcgggtaggtgtagcggtcgggttagtgggagggggcggcggttatggagcgggtgaacgacgtttcgtgcggttcgtttggttgttatatatattaggtgagtagatatagtacggagatgttgtataatttgaattagtagcgtaaaaacggcgggcgtttttgcgacgtgtttttgcgggtaggcgacgagagttttttagcgtatcgcgtcgtgttggtcgtttgtagcgagtattttgagtcggtgtttagcgtttagttgggcgacggcggagttgcggacgggggttcggttgatgtagggggcgcgacggtag

SEQ ID NO: 23336 - DNA, 1080 bp, Artificial Sequence
  chemically treated genomic DNA (Homo sapiens) CpG-island No: 23336
ctaccgtcgcgccccctacatcaaccgaacccccgtccgcaactccgccgtcgcccaactaaacgctaaacaccgactcaaaatactcgctacaaacgaccaacacgacgcgatacgctaaaaaactctcgtcgcctacccgcaaaaacacgtcgcaaaaacgcccgccgtttttacgctactaattcaaattatacaacatctccgtactatatctactcacctaatatatataacaaccaaacgaaccgcacgaaacgtcgttcacccgctccataaccgccgccccctcccactaacccgaccgctacacctacccgccccctcccttcccctcaacaacgaaaaacgaaacgcaacaaacgtatccacactccccacacgtaccgacccgaaactctataatctcgcaaatacgccgaatatacacgcccccaacccgaatcaaactatctaaactacgaaatacaccaccccccacataaccaacccccgccctcgctaaactacgcgccactctctcctctccgcccgcccgcctccccttcccgatctaccttccgaaaaaatacgcgaacgaaaaaatacgcccctcctacaaacgcgcctaccacctcccctcccgcccgccaaacgacgccgacgcgcaaccaaaaaaaacacgcgcacgcgaaaaaaaaaaaaaaaaatccgccgcgcaaacgcgcgcgcgcgccgcgacttttcccgaacccgctaaaaacgcgcgctacgtcccctacaaaacgcgaaccgaaacgaaaacgccgaaacgaaaaaaacaaaaaacgaaaacgaaaacgacgacgacgaaacgcgcacgaaaacgataacgcgaaccgaatcccgaaacctaaaaaacgataacgacgacgacgacgactaaaacgaacgaacgacgacgacgacaaaataaacccttcctcaaaccgaaaaaaaacgacgacgaaacgacgactatacgaccccgaactccgtatattcgaaacgaaaaaaaactatacaacgactacacttcctcttacactttcacccctaaaaaaaaaaaaaaaaaaaaacgat

SEQ ID NO: 23337 - DNA, 643 bp, Artificial Sequence
  chemically treated genomic DNA (Homo sapiens) CpG-island No: 23337
attttttgtcggcgtgaggtggcgttgtttggtcgtattttgggggagcgtttatattttcggtcgataaaaggagcgtcgatattttcggatttgggaaagtgacggtttaaacgttagggaggagttaggatttcgttttgagttagcgggaggtaacggcggggagttttggggcggagatcgagcgttgggggcgtggtttttagcgggattgggtttttagcgggagtgggggcgggggcgggggcggggttagtttgggggtttagacgtggcgtagcgattcggaggttcgtttttagtttgcgtattatttgcggtcgggtttcgatgagttttttgttgttttcgttggcgttgttgttgtttttcgcggcgtttgtggttttagttatagtcgttattgtttatcggtcggattggaatcgtttgagcggtttaattcgcgttcgggtagaggtgagtacgtcggtttttagtttcggtattatcgttttttaattttgcggttttatgggagtatcgttcgtttcggttttaagattatttcgaatcgcgagtttttttgttttttttttggcgtcgggattattttttttgttttttagttttagatggttttagtatttatcgtggaagt

SEQ ID NO: 23338 - DNA, 643 bp, Artificial Sequence
  chemically treated genomic DNA (Homo sapiens) CpG-island No: 23338
acttccacgataaatactaaaaccatctaaaactaaaaaacaaaaaaaataatcccgacgccaaaaaaaaaacaaaaaaactcgcgattcgaaataatcttaaaaccgaaacgaacgatactcccataaaaccgcaaaattaaaaaacgataataccgaaactaaaaaccgacgtactcacctctacccgaacgcgaattaaaccgctcaaacgattccaatccgaccgataaacaataacgactataactaaaaccacaaacgccgcgaaaaacaacaacaacgccaacgaaaacaacaaaaaactcatcgaaacccgaccgcaaataatacgcaaactaaaaacgaacctccgaatcgctacgccacgtctaaacccccaaactaaccccgcccccgcccccgcccccactcccgctaaaaacccaatcccgctaaaaaccacgcccccaacgctcgatctccgccccaaaactccccgccgttacctcccgctaactcaaaacgaaatcctaactcctccctaacgtttaaaccgtcactttcccaaatccgaaaatatcgacgctccttttatcgaccgaaaatataaacgctcccccaaaatacgaccaaacaacgccacctcacgccgacaaaaaat

SEQ ID NO: 23339 - DNA, 643 bp, Artificial Sequence
  chemically treated genomic DNA (Homo sapiens) CpG-island No: 23339
gtttttacggtggatgttggggttatttggggttagggaataggagggatggtttcggcgttagggggaaagtagggagattcgcggttcgaggtggttttggggtcgggacggacggtgtttttatggggtcgtagggttggggaacgatagtgtcggggttggaggtcggcgtatttatttttattcgggcgcgggttaggtcgtttagacggttttagttcggtcggtaggtagtggcggttgtggttggggttataagcgtcgcgagaagtagtagtagcgttagcggaggtaataggaggtttatcgggattcggtcgtagatgatgcgtaagttggaggcgaattttcgagtcgttgcgttacgtttgggtttttaggttggtttcgttttcgttttcgtttttattttcgttagaggtttagtttcgttggagattacgtttttagcgttcggttttcgttttaggatttttcgtcgttatttttcgttagtttagggcgaggttttggtttttttttggcgtttgggtcgttatttttttaggttcgagagtgtcgacgttttttttgtcgatcgaggatgtggacgtttttttaggatgcggttaggtagcgttattttacgtcggtagagggt

SEQ ID NO: 23340 - DNA, 643 bp, Artificial Sequence
  chemically treated genomic DNA (Homo sapiens) CpG-island No: 23340
accctctaccgacgtaaaataacgctacctaaccgcatcctaaaaaaacgtccacatcctcgatcgacaaaaaaaacgtcgacactctcgaacctaaaaaaataacgacccaaacgccaaaaaaaaaccaaaacctcgccctaaactaacgaaaaataacgacgaaaaatcctaaaacgaaaaccgaacgctaaaaacgtaatctccaacgaaactaaacctctaacgaaaataaaaacgaaaacgaaaacgaaaccaacctaaaaacccaaacgtaacgcaacgactcgaaaattcgcctccaacttacgcatcatctacgaccgaatcccgataaacctcctattacctccgctaacgctactactacttctcgcgacgcttataaccccaaccacaaccgccactacctaccgaccgaactaaaaccgtctaaacgacctaacccgcgcccgaataaaaataaatacgccgacctccaaccccgacactatcgttccccaaccctacgaccccataaaaacaccgtccgtcccgaccccaaaaccacctcgaaccgcgaatctccctactttccccctaacgccgaaaccatccctcctattccctaaccccaaataaccccaacatccaccgtaaaaac

SEQ ID NO: 23341 - DNA, 537 bp, Artificial Sequence
  chemically treated genomic DNA (Homo sapiens) CpG-island No: 23341
gttattttttcgttttttagagtcgtgtattgagtgtttattgagcgttattttttcgttttttagagtcgtgtattgagtgtttattgagtgttattttttcgttttttagagtcgtgtattgagtgtttattgagcgtttttttttcgtttttttgagtcgtgtattgagtgtttattgagcgttttttttttgttttttagagtcgtgtattgagtgtttattgagcgtttttttatcgtttttcggagtcgtgtattgagtgtttattgagcgtttttttttcgttttttagagtcgtgtattgagtgtttattgagcgttttttttttgtttttttgagtcgtgtattgagtgtttattgagcgttattttttcgttttttagagtcgtgtattgagtgtttattgagcgttattttttcgttttttagagtcgtgtattgagtgtttattgagtgttattttttcgttttttagagtcgtgtattgagtgtttattgagcgttttttttttatttttttgagtcgtgtatt

SEQ ID NO: 23342 - DNA, 537 bp, Artificial Sequence
  chemically treated genomic DNA (Homo sapiens) CpG-island No: 23342
aatacacgactcaaaaaaataaaaaaaaaacgctcaataaacactcaatacacgactctaaaaaacgaaaaaataacactcaataaacactcaatacacgactctaaaaaacgaaaaaataacgctcaataaacactcaatacacgactctaaaaaacgaaaaaataacgctcaataaacactcaatacacgactcaaaaaaacaaaaaaaaaacgctcaataaacactcaatacacgactctaaaaaacgaaaaaaaaacgctcaataaacactcaatacacgactccgaaaaacgataaaaaaacgctcaataaacactcaatacacgactctaaaaaacaaaaaaaaaacgctcaataaacactcaatacacgactcaaaaaaacgaaaaaaaaacgctcaataaacactcaatacacgactctaaaaaacgaaaaaataacactcaataaacactcaatacacgactctaaaaaacgaaaaaataacgctcaataaacactcaatacacgactctaaaaaacgaaaaaataac

SEQ ID NO: 23343 - DNA, 537 bp, Artificial Sequence
  chemically treated genomic DNA (Homo sapiens) CpG-island No: 23343
aatatacgatttaggaggatgaggagggagcgtttagtaagtatttaatatacgattttggaggacgaggaggtggtatttagtaagtatttaatatacgattttggaggacgaggaggtggcgtttagtaagtatttaatgtacgattttggaggacgaggaggtggcgtttagtaagtatttaatatacgatttaggaggataaggagggagcgtttagtaagtatttaatatacgattttggaggacgaggagggggcgtttagtaagtatttaatatacgatttcggaggacgatgagggagcgtttagtaagtatttaatatacgattttggaggataaggagggagcgtttagtaagtatttaatatacgatttaggaggacgaggagggagcgtttagtaagtatttaatatacgattttggaggacgaggaggtggtatttagtaagtatttaatatacgattttggaggacgaggaggtggcgtttagtaagtatttaatgtacgattttggaggacgaggaggtggt

SEQ ID NO: 23344 - DNA, 537 bp, Artificial Sequence
  chemically treated genomic DNA (Homo sapiens) CpG-island No: 23344
accacctcctcgtcctccaaaatcgtacattaaatacttactaaacgccacctcctcgtcctccaaaatcgtatattaaatacttactaaataccacctcctcgtcctccaaaatcgtatattaaatacttactaaacgctccctcctcgtcctcctaaatcgtatattaaatacttactaaacgctccctccttatcctccaaaatcgtatattaaatacttactaaacgctccctcatcgtcctccgaaatcgtatattaaatacttactaaacgccccctcctcgtcctccaaaatcgtatattaaatacttactaaacgctccctccttatcctcctaaatcgtatattaaatacttactaaacgccacctcctcgtcctccaaaatcgtacattaaatacttactaaacgccacctcctcgtcctccaaaatcgtatattaaatacttactaaataccacctcctcgtcctccaaaatcgtatattaaatacttactaaacgctccctcctcatcctcctaaatcgtatatt

SEQ ID NO: 23345 - DNA, 544 bp, Artificial Sequence
  chemically treated genomic DNA (Homo sapiens) CpG-island No: 23345
tattgagcgtttttttttcgtttttttgagtcgtgtattgagtgtttattgagcgttatttttttgtttttcggagtcgtgtattgagtgtttattgagcgtttttttttcgtttttttgagtcgtgtattgagtgtttattgagcgtttttttttcgtttttttgagtcgtgtattgagtgtttattgagcgtttttttttcgttttttagagtcgtgtattgagtgtttattgagcgtttttttttcgtttttttgagtcgtgtattgagtgtttattgagcgtttttttttcgttttttagagtcgtgtattgagtgtttattgagcgttattttttcgttttttagagtcgtgtattgagtgtttattgagcgttttttttttatttttttgagtcgtgtattgagtgtttattgagcgtttttttttcgtttttttgagtcgtgtattgagtgtttattgagcgttttttttttgttttttagagtcgtgtattgagtgtttattgagcgttttttttttgttttttggagtcgtgtat

SEQ ID NO: 23346 - DNA, 544 bp, Artificial Sequence
  chemically treated genomic DNA (Homo sapiens) CpG-island No: 23346
atacacgactccaaaaaacaaaaaaaaaacgctcaataaacactcaatacacgactctaaaaaacaaaaaaaaaacgctcaataaacactcaatacacgactcaaaaaaacgaaaaaaaaacgctcaataaacactcaatacacgactcaaaaaaataaaaaaaaaacgctcaataaacactcaatacacgactctaaaaaacgaaaaaataacgctcaataaacactcaatacacgactctaaaaaacgaaaaaaaaacgctcaataaacactcaatacacgactcaaaaaaacgaaaaaaaaacgctcaataaacactcaatacacgactctaaaaaacgaaaaaaaaacgctcaataaacactcaatacacgactcaaaaaaacgaaaaaaaaacgctcaataaacactcaatacacgactcaaaaaaacgaaaaaaaaacgctcaataaacactcaatacacgactccgaaaaacaaaaaaataacgctcaataaacactcaatacacgactcaaaaaaacgaaaaaaaaacgctcaata

SEQ ID NO: 23347 - DNA, 544 bp, Artificial Sequence
  chemically treated genomic DNA (Homo sapiens) CpG-island No: 23347
atatacgattttagaggataaggagggagcgtttagtaagtatttaatatacgattttggaggataaggagggagcgtttagtaagtatttaatatacgatttaggaggacgaggagggagcgtttagtaagtatttaatatacgatttaggaggatgaggagggagcgtttagtaagtatttaatatacgattttggaggacgaggaggtggcgtttagtaagtatttaatatacgattttggaggacgaggagggggcgtttagtaagtatttaatatacgatttaggaggacgaggagggagcgtttagtaagtatttaatatacgattttggaggacgaggagggggcgtttagtaagtatttaatatacgatttaggaggacgaggagggagcgtttagtaagtatttaatatacgatttaggaggacgaggagggagcgtttagtaagtatttaatatacgatttcggaagataaggaggtggcgtttagtaagtatttaatatacgatttaggaggacgaggagggagcgtttagta

SEQ ID NO: 23348 - DNA, 544 bp, Artificial Sequence
  chemically treated genomic DNA (Homo sapiens) CpG-island No: 23348
tactaaacgctccctcctcgtcctcctaaatcgtatattaaatacttactaaacgccacctccttatcttccgaaatcgtatattaaatacttactaaacgctccctcctcgtcctcctaaatcgtatattaaatacttactaaacgctccctcctcgtcctcctaaatcgtatattaaatacttactaaacgccccctcctcgtcctccaaaatcgtatattaaatacttactaaacgctccctcctcgtcctcctaaatcgtatattaaatacttactaaacgccccctcctcgtcctccaaaatcgtatattaaatacttactaaacgccacctcctcgtcctccaaaatcgtatattaaatacttactaaacgctccctcctcatcctcctaaatcgtatattaaatacttactaaacgctccctcctcgtcctcctaaatcgtatattaaatacttactaaacgctccctccttatcctccaaaatcgtatattaaatacttactaaacgctccctccttatcctctaaaatcgtatat

SEQ ID NO: 23349 - DNA, 636 bp, Artificial Sequence
  chemically treated genomic DNA (Homo sapiens) CpG-island No: 23349
attgagcgtttttttttcgttttttagagtcgtgtattgagtgtttattgagcgttatttttttattttttagagtcgtgtattgagtgtttattgagcgtttttttttcgttttttagagtcgtgtattgagtgtttattgagcgtttttttttcgttttttagagtcgtgtattgagtgtttattgagcgtttttttttcgttttttagagtcgtgtattgagtgtttattgagcgttattttttcgttttttagagtcgtgtattgagtgtttattgagcgtttttttttcgttttttagagtcgtgtattgagtgtttattgagcgttattttttcgttttttagagtcgtgtattgagtgtttattgagcgttattttttcgttttttagagtcgtgtattgagtgtttattgagcgttattttttcgttttttagagtcgtgtattgagtgtttattgagcgtttttttttcgttttttagagtcgtgtattgagtgtttattgagcgttattttttcgttttttaaagtcgtgtattgagtgtttattgagcgttttttttttgttttttagagtcgtgtattgagtgtttattgagcgttatttttttattttttagagtcgtgtatt

SEQ ID NO: 23350 - DNA, 636 bp, Artificial Sequence
  chemically treated genomic DNA (Homo sapiens) CpG-island No: 23350
aatacacgactctaaaaaataaaaaaataacgctcaataaacactcaatacacgactctaaaaaacaaaaaaaaaacgctcaataaacactcaatacacgactttaaaaaacgaaaaaataacgctcaataaacactcaatacacgactctaaaaaacgaaaaaaaaacgctcaataaacactcaatacacgactctaaaaaacgaaaaaataacgctcaataaacactcaatacacgactctaaaaaacgaaaaaataacgctcaataaacactcaatacacgactctaaaaaacgaaaaaataacgctcaataaacactcaatacacgactctaaaaaacgaaaaaaaaacgctcaataaacactcaatacacgactctaaaaaacgaaaaaataacgctcaataaacactcaatacacgactctaaaaaacgaaaaaaaaacgctcaataaacactcaatacacgactctaaaaaacgaaaaaaaaacgctcaataaacactcaatacacgactctaaaaaacgaaaaaaaaacgctcaataaacactcaatacacgactctaaaaaataaaaaaataacgctcaataaacactcaatacacgactctaaaaaacgaaaaaaaaacgctcaat

SEQ ID NO: 23351 - DNA, 636 bp, Artificial Sequence
  chemically treated genomic DNA (Homo sapiens) CpG-island No: 23351
aatatacgattttggaggatgaggaggtggcgtttagtaagtatttaatatacgattttggaggataaggagggagcgtttagtaagtatttaatatacgattttggaggacgaggaggtggcgtttagtaagtatttaatatacgattttggaggacgaggagggagcgtttagtaagtatttaatatacgattttggaggacgaggaggtggcgtttagtaagtatttaatatacgattttggaggacgaggaggtggcgtttagtaagtatttaatatacgattttggaggacgaggaggtggcgtttagtaagtatttaatatacgattttggaggacgaggagggagcgtttagtaagtatttaatatacgattttggaggacgaggaggtggcgtttagtaagtatttaatatacgattttggaggacgaggagggagcgtttagtaagtatttaatatacgattttggaggacgaggagggagcgtttagtaagtatttaatatacgattttggaggacgaggagggagcgtttagtaagtatttaatatacgattttggaggatgaggaggtggcgtttagtaagtatttaatatacgattttggaggacgaggagggggcgtttagt

SEQ ID NO: 23352 - DNA, 636 bp, Artificial Sequence
  chemically treated genomic DNA (Homo sapiens) CpG-island No: 23352
actaaacgccccctcctcgtcctccaaaatcgtatattaaatacttactaaacgccacctcctcatcctccaaaatcgtatattaaatacttactaaacgctccctcctcgtcctccaaaatcgtatattaaatacttactaaacgctccctcctcgtcctccaaaatcgtatattaaatacttactaaacgctccctcctcgtcctccaaaatcgtatattaaatacttactaaacgccacctcctcgtcctccaaaatcgtatattaaatacttactaaacgctccctcctcgtcctccaaaatcgtatattaaatacttactaaacgccacctcctcgtcctccaaaatcgtatattaaatacttactaaacgccacctcctcgtcctccaaaatcgtatattaaatacttactaaacgccacctcctcgtcctccaaaatcgtatattaaatacttactaaacgctccctcctcgtcctccaaaatcgtatattaaatacttactaaacgccacctcctcgtcctccaaaatcgtatattaaatacttactaaacgctccctccttatcctccaaaatcgtatattaaatacttactaaacgccacctcctcatcctccaaaatcgtatatt

SEQ ID NO: 23353 - DNA, 584 bp, Artificial Sequence
  chemically treated genomic DNA (Homo sapiens) CpG-island No: 23353
tgagcgttattttttcgttttttagagtcgtgtattgagtgtttattgagcgttattttttcgttttttagagtcgtgtattgagtgtttattgagcgttttttttttatttttttgagtcgtgtattgagtgtttattgagcgtttttttttcgtttttttgagtcgtgtattgagtgtttattgagcgttttttttttgttttttagagtcgtgtattgagtgtttattgagcgtttttttatcgtttttcggagtcgtgtattgagtgtttattgagcgtttttttttcgttttttagagtcgtgtattgagtgtttattgagcgttattttttcgtttttttgagtcgtgtattgagtgtttattgagcgttatttttttgtttttttgagtcgtgtattgagtgtttattgagcgtttttttttcgttttttagagtcgtattaattgagcgtttttattttgttttttagagtcgcgtaatttagcgtttattgagcgttatttttttgttttttagagtcgtgtattgagtgcgtattgagcgttatttttttattttttagggtagtgtattgagt

SEQ ID NO: 23354 - DNA, 584 bp, Artificial Sequence
  chemically treated genomic DNA (Homo sapiens) CpG-island No: 23354
actcaatacactaccctaaaaaataaaaaaataacgctcaatacgcactcaatacacgactctaaaaaacaaaaaaataacgctcaataaacgctaaattacgcgactctaaaaaacaaaataaaaacgctcaattaatacgactctaaaaaacgaaaaaaaaacgctcaataaacactcaatacacgactcaaaaaaacaaaaaaataacgctcaataaacactcaatacacgactcaaaaaaacgaaaaaataacgctcaataaacactcaatacacgactctaaaaaacgaaaaaaaaacgctcaataaacactcaatacacgactccgaaaaacgataaaaaaacgctcaataaacactcaatacacgactctaaaaaacaaaaaaaaaacgctcaataaacactcaatacacgactcaaaaaaacgaaaaaaaaacgctcaataaacactcaatacacgactcaaaaaaataaaaaaaaaacgctcaataaacactcaatacacgactctaaaaaacgaaaaaataacgctcaataaacactcaatacacgactctaaaaaacgaaaaaataacgctca

SEQ ID NO: 23355 - DNA, 584 bp, Artificial Sequence
  chemically treated genomic DNA (Homo sapiens) CpG-island No: 23355
atttaatatattattttggaggatgaggaggtggcgtttagtgcgtatttaatatacgattttggagggtaaggaggtggcgtttagtaagcgttgagttacgcgattttggaggataaggtgggagcgtttagttagtacgattttggaggacgaggagggagcgtttagtaagtatttaatatacgatttaggaggataaggaggtggcgtttagtaagtatttaatatacgatttaggaggacgaggaggtggcgtttagtaagtatttaatatacgattttggaggacgaggagggggcgtttagtaagtatttaatatacgatttcggaggacgatgagggagcgtttagtaagtatttaatatacgattttggaggataaggagggagcgtttagtaagtatttaatatacgatttaggaggacgaggagggagcgtttagtaagtatttaatatacgatttaggaggatgaggagggagcgtttagtaagtatttaatatacgattttggaggacgaggaggtggcgtttagtaagtatttaatatacgattttggaggacgaggaggtggcgttta

SEQ ID NO: 23356 - DNA, 584 bp, Artificial Sequence
  chemically treated genomic DNA (Homo sapiens) CpG-island No: 23356
taaacgccacctcctcgtcctccaaaatcgtatattaaatacttactaaacgccacctcctcgtcctccaaaatcgtatattaaatacttactaaacgctccctcctcatcctcctaaatcgtatattaaatacttactaaacgctccctcctcgtcctcctaaatcgtatattaaatacttactaaacgctccctccttatcctccaaaatcgtatattaaatacttactaaacgctccctcatcgtcctccgaaatcgtatattaaatacttactaaacgccccctcctcgtcctccaaaatcgtatattaaatacttactaaacgccacctcctcgtcctcctaaatcgtatattaaatacttactaaacgccacctccttatcctcctaaatcgtatattaaatacttactaaacgctccctcctcgtcctccaaaatcgtactaactaaacgctcccaccttatcctccaaaatcgcgtaactcaacgcttactaaacgccacctccttaccctccaaaatcgtatattaaatacgcactaaacgccacctcctcatcctccaaaataatatattaaat

SEQ ID NO: 23357 - DNA, 676 bp, Artificial Sequence
  chemically treated genomic DNA (Homo sapiens) CpG-island No: 23357
ttttttcgatttttttttcgatttttttagtttttttcgatttttttagtttttttcgatttttttagtttttttcgatttttttagtttttttcgatttttttaggttttttcgatttttttagtttttttcgatttttttattttttttcgatttttttagtttttttcgatttttttagtttttttcgatttttttagtttttttcgatttttttagtttttttcgatttttttaggttttttcgatttttttagtttttttcgatttttttagtttttttcgatttttttaggttttttcgatttttttagtttttttcgatttttttagtttttttcgatttttttagtttttttcgatttttttagtttttttcgatttttttaggttttttcgatttttttagtttttttcgatttttttagtttttttcgatttttttaggttttttcgatttttttagtttttttcgatttttttagtttttttcgatttttttagtttttttcgatttttttaggttttttcgatttttttagtttttttcgatttttttagtttttttcgatttttttagtttttttcgatttttttagtttttttcgatttttttagtttttttcgatttttttagtttttttcgttagttgttgatttttatattttgttttt

SEQ ID NO: 23358 - DNA, 676 bp, Artificial Sequence
  chemically treated genomic DNA (Homo sapiens) CpG-island No: 23358
aaaaacaaaatataaaaatcaacaactaacgaaaaaaactaaaaaaatcgaaaaaaactaaaaaaatcgaaaaaaactaaaaaaatcgaaaaaaactaaaaaaatcgaaaaaaactaaaaaaatcgaaaaaaactaaaaaaatcgaaaaaacctaaaaaaatcgaaaaaaactaaaaaaatcgaaaaaaactaaaaaaatcgaaaaaaactaaaaaaatcgaaaaaacctaaaaaaatcgaaaaaaactaaaaaaatcgaaaaaaactaaaaaaatcgaaaaaacctaaaaaaatcgaaaaaaactaaaaaaatcgaaaaaaactaaaaaaatcgaaaaaaactaaaaaaatcgaaaaaaactaaaaaaatcgaaaaaacctaaaaaaatcgaaaaaaactaaaaaaatcgaaaaaaactaaaaaaatcgaaaaaacctaaaaaaatcgaaaaaaactaaaaaaatcgaaaaaaactaaaaaaatcgaaaaaaactaaaaaaatcgaaaaaaactaaaaaaatcgaaaaaaaataaaaaaatcgaaaaaaactaaaaaaatcgaaaaaacctaaaaaaatcgaaaaaaactaaaaaaatcgaaaaaaactaaaaaaatcgaaaaaaactaaaaaaatcgaaaaaaactaaaaaaatcgaaaaaaaaatcgaaaaaa

SEQ ID NO: 23359 - DNA, 676 bp, Artificial Sequence
  chemically treated genomic DNA (Homo sapiens) CpG-island No: 23359
ggggatagagtgtggaggttagtagttggcgggaaaggttggaggggtcgggaaaagttggaggggtcgggaaaggttggaggggtcgggaaaggttggaggggtcgggaaaagttggaggggtcgggaaaggttggaggggtcgggaaagtttggaggggtcgggaaaggttggaggggtcgggaaaggttggaggggtcgggaaaggttggaggggtcgggaaagtttggaggggtcgggaaaggttggaggggtcgggaaaggttggaggggtcgggaaagtttggaggggtcgggaaaggttggaggggtcgggaaaggttggaggggtcgggaaaggttggaggggtcgggaaaggttggaggggtcgggaaagtttggaggggtcgggaaaggttggaggggtcgggaaaggttggaggggtcgggaaagtttggaggggtcgggaaaggttggaggggtcgggaaaggttggaggggtcgggaaaggttggaggggtcgggaaaggttggaggggtcgggaaaggatggaggggtcgggaaaggttggaggggtcgggaaagtttggaggggtcgggaaaggttggaggggtcgggaaaggttggaggggtcgggaaaggttgggggagtcgggaaaggttggaggagtcggggaaggagtcggggaag

SEQ ID NO: 23360 - DNA, 676 bp, Artificial Sequence
  chemically treated genomic DNA (Homo sapiens) CpG-island No: 23360
cttccccgactccttccccgactcctccaacctttcccgactcccccaacctttcccgacccctccaacctttcccgacccctccaacctttcccgacccctccaaactttcccgacccctccaacctttcccgacccctccatcctttcccgacccctccaacctttcccgacccctccaacctttcccgacccctccaacctttcccgacccctccaacctttcccgacccctccaaactttcccgacccctccaacctttcccgacccctccaacctttcccgacccctccaaactttcccgacccctccaacctttcccgacccctccaacctttcccgacccctccaacctttcccgacccctccaacctttcccgacccctccaaactttcccgacccctccaacctttcccgacccctccaacctttcccgacccctccaaactttcccgacccctccaacctttcccgacccctccaacctttcccgacccctccaacctttcccgacccctccaaactttcccgacccctccaacctttcccgacccctccaacttttcccgacccctccaacctttcccgacccctccaacctttcccgacccctccaacttttcccgacccctccaacctttcccgccaactactaacctccacactctatcccc

SEQ ID NO: 23361 - DNA, 906 bp, Artificial Sequence
  chemically treated genomic DNA (Homo sapiens) CpG-island No: 23361
cggcgtttcgttattgggggattgtgtggtgttggggtgttcgcgtttcgttattgggggattgtgtggtgttggggtgttcgcgtttcgttgttgggggattgtgtggtgttcgggtgttcgcgtttcgttattgggggattgtgtggagttcgggtgttcgcgtttcgttgttgcgggattgtgtgttgttggggtgtcggcgtttcgttattgggggattgtgtggtgttggggtgttcgcgtttcgttattgggggattgtgtggtgttgggtgttcgtgtttcgttgttggtggattgtgtggtgttgggtgttcgcgtttcgttgttcggggattgtgtggtgttggggtgttcgcgtttcgttgttgggggattgtgtggtgttggggtgttcgcgttttattattggggggttgtgtggtgttggggtgttcgcgtttcgttattgggggattgtgtggtgttggggtgtttgcgtttcgttattgggggattgtgtggtgttgggtgttcgcgtttcgttattggggggttgtgtggtgttggggtgttcgcgtttcgttattggggggttgtgtggtgttggggtgttcgcgtttcgttattgggggattgtgtggtgttggggtgttcgtgtttcgttattgcggggattgtgtagtgttcgggtgttcgcgtttcgttattgggggattgtgtggtgttggggtgttcgcgtttcgttgttggggggttgtgtggttttggggtgttcgcgtttcgttattgggggattgtgtggtgttgggtgttcgcgtttcgttgttgggggattgtgtggtgttggggtgttcgcgttttattgttgggggattgtgtggtgttggggtgttcgcgtttcgttattggggggttgtgtgg

SEQ ID NO: 23362 - DNA, 906 bp, Artificial Sequence
  chemically treated genomic DNA (Homo sapiens) CpG-island No: 23362
ccacacaaccccccaataacgaaacgcgaacaccccaacaccacacaatcccccaacaataaaacgcgaacaccccaacaccacacaatcccccaacaacgaaacgcgaacacccaacaccacacaatcccccaataacgaaacgcgaacaccccaaaaccacacaaccccccaacaacgaaacgcgaacaccccaacaccacacaatcccccaataacgaaacgcgaacacccgaacactacacaatccccgcaataacgaaacacgaacaccccaacaccacacaatcccccaataacgaaacgcgaacaccccaacaccacacaaccccccaataacgaaacgcgaacaccccaacaccacacaaccccccaataacgaaacgcgaacacccaacaccacacaatcccccaataacgaaacgcaaacaccccaacaccacacaatcccccaataacgaaacgcgaacaccccaacaccacacaaccccccaataataaaacgcgaacaccccaacaccacacaatcccccaacaacgaaacgcgaacaccccaacaccacacaatccccgaacaacgaaacgcgaacacccaacaccacacaatccaccaacaacgaaacacgaacacccaacaccacacaatcccccaataacgaaacgcgaacaccccaacaccacacaatcccccaataacgaaacgccgacaccccaacaacacacaatcccgcaacaacgaaacgcgaacacccgaactccacacaatcccccaataacgaaacgcgaacacccgaacaccacacaatcccccaacaacgaaacgcgaacaccccaacaccacacaatcccccaataacgaaacgcgaacaccccaacaccacacaatcccccaataacgaaacgccg

SEQ ID NO: 23363 - DNA, 906 bp, Artificial Sequence
  chemically treated genomic DNA (Homo sapiens) CpG-island No: 23363
ttatatagttttttagtaacgaggcgcggatattttaatattatatagttttttagtaatgaggcgcggatattttaatattatatagttttttagtaacgaggcgcggatatttaatattatatagttttttagtaacgaggcgcggatattttaaaattatatagttttttagtaacgaggcgcggatattttaatattatatagttttttagtaacgaggcgcggatattcggatattgtatagttttcgtagtaacgaggtacggatattttaatattatatagttttttagtaacgaggcgcggatattttaatattatatagttttttagtaacgaggcgcggatattttaatattatatagttttttagtaacgaggcgcggatatttaatattatatagttttttagtaacgaggcgtagatattttaatattatatagttttttagtaacgaggcgcggatattttaatattatatagttttttagtaatgaggcgcggatattttaatattatatagttttttagtaacgaggcgcggatattttaatattatatagttttcgagtaacgaggcgcggatatttaatattatatagtttattagtaacgaggtacggatatttaatattatatagttttttagtaacgaggcgcggatattttaatattatatagttttttagtaacgaggcgtcgatattttaataatatatagtttcgtagtaacgaggcgcggatattcgaattttatatagttttttagtaacgaggcgcggatattcgaatattatatagttttttagtaacgaggcgcggatattttaatattatatagttttttagtaacgaggcgcggatattttaatattatatagttttttagtaacgaggcgtcg

SEQ ID NO: 23364 - DNA, 906 bp, Artificial Sequence
  chemically treated genomic DNA (Homo sapiens) CpG-island No: 23364
cgacgcctcgttactaaaaaactatataatattaaaatatccgcgcctcgttactaaaaaactatataatattaaaatatccgcgcctcgttactaaaaaactatataatattcgaatatccgcgcctcgttactaaaaaactatataaaattcgaatatccgcgcctcgttactacgaaactatatattattaaaatatcgacgcctcgttactaaaaaactatataatattaaaatatccgcgcctcgttactaaaaaactatataatattaaatatccgtacctcgttactaataaactatataatattaaatatccgcgcctcgttactcgaaaactatataatattaaaatatccgcgcctcgttactaaaaaactatataatattaaaatatccgcgcctcattactaaaaaactatataatattaaaatatccgcgcctcgttactaaaaaactatataatattaaaatatctacgcctcgttactaaaaaactatataatattaaatatccgcgcctcgttactaaaaaactatataatattaaaatatccgcgcctcgttactaaaaaactatataatattaaaatatccgcgcctcgttactaaaaaactatataatattaaaatatccgtacctcgttactacgaaaactatacaatatccgaatatccgcgcctcgttactaaaaaactatataatattaaaatatccgcgcctcgttactaaaaaactatataattttaaaatatccgcgcctcgttactaaaaaactatataatattaaatatccgcgcctcgttactaaaaaactatataatattaaaatatccgcgcctcattactaaaaaactatataatattaaaatatccgcgcctcgttactaaaaaactatataa

SEQ ID NO: 23365 - DNA, 549 bp, Artificial Sequence
  chemically treated genomic DNA (Homo sapiens) CpG-island No: 23365
gtagttcgcgtagcgtggtcgagtcgttgtttttaggtaggtagacgaagcggtggaatttgggttgttggttaaagcggttaaagagtaggcggaagcgcgcgtcgtttagcggtcggggattgcggtgttcgcgtacggtttagcgtatcgaggcgttgtttgcgtttatcgtttttatcgttaggttgtatagaatgaatttgttgaagtcgtatgggtcggatattagcggcggtagttcggttttatcgtcggattgggcggtacgtttttggtgtttcgtgtttagacgatgtttcgtcgcgcgttgttaggggtcgtcggcgggcgatggcgtagagttaggagaggtcgttggggtgggtttcgcgagggcgggatttgttcgagtcggacggtttcgttggggttttttgtgtaggtttagggattgtggagtcgggttcgcggcggtagcgacggaggggttgggttgttggaggttcgggtttcgtcgatttagttttagggcgttgcggttgtttattagttttttggcggttttat

SEQ ID NO: 23366 - DNA, 549 bp, Artificial Sequence
  chemically treated genomic DNA (Homo sapiens) CpG-island No: 23366
ataaaaccgccaaaaaactaataaacaaccgcaacgccctaaaactaaatcgacgaaacccgaacctccaacaacccaacccctccgtcgctaccgccgcgaacccgactccacaatccctaaacctacacaaaaaaccccaacgaaaccgtccgactcgaacaaatcccgccctcgcgaaacccaccccaacgacctctcctaactctacgccatcgcccgccgacgacccctaacaacgcgcgacgaaacatcgtctaaacacgaaacaccaaaaacgtaccgcccaatccgacgataaaaccgaactaccgccgctaatatccgacccatacgacttcaacaaattcattctatacaacctaacgataaaaacgataaacgcaaacaacgcctcgatacgctaaaccgtacgcgaacaccgcaatccccgaccgctaaacgacgcgcgcttccgcctactctttaaccgctttaaccaacaacccaaattccaccgcttcgtctacctacctaaaaacaacgactcgaccacgctacgcgaactac

SEQ ID NO: 23367 - DNA, 549 bp, Artificial Sequence
  chemically treated genomic DNA (Homo sapiens) CpG-island No: 23367
atggggtcgttagggagttggtaggtaatcgtagcgttttaaggttgagtcggcggggttcgggtttttagtagtttagttttttcgtcgttgtcgtcgcgggttcggttttatagtttttagatttgtataagaagttttagcggggtcgttcgattcgggtagatttcgttttcgcggagtttattttaacggttttttttggttttgcgttatcgttcgtcggcgatttttggtagcgcgcgacgaagtatcgtttgggtacggagtattaggagcgtgtcgtttagttcgacggtggggtcgggttgtcgtcgttggtgttcgatttatgcgattttaataagtttattttgtgtaatttgacggtggaggcggtgggcgtagatagcgtttcggtgcgttgggtcgtgcgcgagtatcgtagttttcggtcgttgggcggcgcgcgttttcgtttgttttttgatcgttttggttagtagtttaagttttatcgtttcgtttatttgtttgagagtagcgattcggttacgttgcgcgagttgt

SEQ ID NO: 23368 - DNA, 549 bp, Artificial Sequence
  chemically treated genomic DNA (Homo sapiens) CpG-island No: 23368
acaactcgcgcaacgtaaccgaatcgctactctcaaacaaataaacgaaacgataaaacttaaactactaaccaaaacgatcaaaaaacaaacgaaaacgcgcgccgcccaacgaccgaaaactacgatactcgcgcacgacccaacgcaccgaaacgctatctacgcccaccgcctccaccgtcaaattacacaaaataaacttattaaaatcgcataaatcgaacaccaacgacgacaacccgaccccaccgtcgaactaaacgacacgctcctaatactccgtacccaaacgatacttcgtcgcgcgctaccaaaaatcgccgacgaacgataacgcaaaaccaaaaaaaaccgttaaaataaactccgcgaaaacgaaatctacccgaatcgaacgaccccgctaaaacttcttatacaaatctaaaaactataaaaccgaacccgcgacgacaacgacgaaaaaactaaactactaaaaacccgaaccccgccgactcaaccttaaaacgctacgattacctaccaactccctaacgaccccat

SEQ ID NO: 23369 - DNA, 535 bp, Artificial Sequence
  chemically treated genomic DNA (Homo sapiens) CpG-island No: 23369
cgaggtgcgtgagttggttgtttttgagcgagagtaggtcgagacgtggtaggtgttggaagatgcgcggttcgaggtgttgtaggttgttggtcgagaggatgagggaggagagggagcgtagcggtgcgaaggtggtcgcgtggcgtagggagggttgtagttcgttggtagagaggttgaggaagcgtagtttgtttagttgggcgaaggcgtttttgtttagaaagcggattcggttggattttagatgtaggtagagtaggttgtttaagggagcgaagatcgcgttcggtagcgtttttagggcgttttcgtttagtcgtagtttgattagattttttaggttttcgaaggagtcgcggtttaggcggttgatttcgttttcgttggcgtagaggatgcgtagtttgcgtagcggggttagcgtgttcggggcgagcgtttgtaagaggttgttttttaggtatagtttttttagtcgcgagagtttttcgaaggttttggggtgtagagagcggatttggttgtattg

SEQ ID NO: 23370 - DNA, 535 bp, Artificial Sequence
  chemically treated genomic DNA (Homo sapiens) CpG-island No: 23370
caatacaaccaaatccgctctctacaccccaaaaccttcgaaaaactctcgcgactaaaaaaactatacctaaaaaacaacctcttacaaacgctcgccccgaacacgctaaccccgctacgcaaactacgcatcctctacgccaacgaaaacgaaatcaaccgcctaaaccgcgactccttcgaaaacctaaaaaatctaatcaaactacgactaaacgaaaacgccctaaaaacgctaccgaacgcgatcttcgctcccttaaacaacctactctacctacatctaaaatccaaccgaatccgctttctaaacaaaaacgccttcgcccaactaaacaaactacgcttcctcaacctctctaccaacgaactacaaccctccctacgccacgcgaccaccttcgcaccgctacgctccctctcctccctcatcctctcgaccaacaacctacaacacctcgaaccgcgcatcttccaacacctaccacgtctcgacctactctcgctcaaaaacaaccaactcacgcacctcg

SEQ ID NO: 23371 - DNA, 535 bp, Artificial Sequence
  chemically treated genomic DNA (Homo sapiens) CpG-island No: 23371
tagtataattagattcgttttttgtattttaagattttcgagaagttttcgcggttggaagagttgtatttggggaataattttttgtaggcgttcgtttcgggtacgttggtttcgttgcgtaagttgcgtattttttacgttaacgggaacgagattagtcgtttaagtcgcggttttttcgagggtttggagagtttagttaagttgcggttggacgggaacgttttgggggcgttgtcggacgcggttttcgtttttttgggtaatttgttttatttatatttggagtttaatcggattcgttttttgggtaagaacgttttcgtttagttaggtaagttgcgtttttttaatttttttgttaacgagttatagttttttttgcgttacgcggttattttcgtatcgttgcgttttttttttttttttattttttcggttaataatttgtagtatttcgggtcgcgtattttttagtatttgttacgtttcggtttgttttcgtttaggggtaattagtttacgtatttcg

SEQ ID NO: 23372 - DNA, 535 bp, Artificial Sequence
  chemically treated genomic DNA (Homo sapiens) CpG-island No: 23372
cgaaatacgtaaactaattacccctaaacgaaaacaaaccgaaacgtaacaaatactaaaaaatacgcgacccgaaatactacaaattattaaccgaaaaaataaaaaaaaaaaaaaaacgcaacgatacgaaaataaccgcgtaacgcaaaaaaaactataactcgttaacaaaaaaattaaaaaaacgcaacttacctaactaaacgaaaacgttcttacccaaaaaacgaatccgattaaactccaaatataaataaaacaaattacccaaaaaaacgaaaaccgcgtccgacaacgcccccaaaacgttcccgtccaaccgcaacttaactaaactctccaaaccctcgaaaaaaccgcgacttaaacgactaatctcgttcccgttaacgtaaaaaatacgcaacttacgcaacgaaaccaacgtacccgaaacgaacgcctacaaaaaattattccccaaatacaactcttccaaccgcgaaaacttctcgaaaatcttaaaatacaaaaaacgaatctaattatacta

SEQ ID NO: 23373 - DNA, 957 bp, Artificial Sequence
  chemically treated genomic DNA (Homo sapiens) CpG-island No: 23373
gacggtggaagtcgaaggtcgtgatgttggttatgaagttgtcgtcgaggttgtaggtgagtacgtcgtgggggttcggtagcgagttggttttgggtattacgcggagttttttgttggtgtataggagatgttggggatgttggtagtcgtagcgtttcgggtatacgggttcggtagcggcgggagcgcgaggtagtcgtatattacgagtaggaggcgtaaggcgcgggtagtttttatcgtttttcgttttgcgtgtagcggtcggatcgtttttttggttcgtcggttttgtgttttttttgtattttttttagtttggttagagtcgttaaatggtttttttcggatttcgtagcgtcgtttagtttttttttcgttttttgttcggaggtcggttcgggtttttgtaggcgggtttcgttcggttaagttaggcggcgcggggcgttttgtagatttcgggtattatttgttgtatttttgtataaaattgttttttcgggtgcgcgtcggcgggcgggaggagggagtaagattcggcgttttttgtttgtagttgagttcggagagttggattttttggcgcggatttttttagtcgagtggattttttagttgtaggcgggagtcgttttaagagtttcgcggggcgcggtttggtagtagagtttcggttgttcggttttcgtagacggtattttttcgttcgcggtttcggacggggagggcggttttagtgtaatagttcggggagtacgcgggttgcgttcggaagggatttaagtttgcgagcggagagtaaacggggcggaaattcgttttttttatattttgttcgcggggacgtaggcggagaaagaggagacggtagagggaggatagatttcggtagggggaggaggaaatattaagtggtttcgcgtttggttagttcgggttcgggatgttaag

SEQ ID NO: 23374 - DNA, 957 bp, Artificial Sequence
  chemically treated genomic DNA (Homo sapiens) CpG-island No: 23374
cttaacatcccgaacccgaactaaccaaacgcgaaaccacttaatatttcctcctccccctaccgaaatctatcctccctctaccgtctcctctttctccgcctacgtccccgcgaacaaaatataaaaaaaacgaatttccgccccgtttactctccgctcgcaaacttaaatcccttccgaacgcaacccgcgtactccccgaactattacactaaaaccgccctccccgtccgaaaccgcgaacgaaaaaataccgtctacgaaaaccgaacaaccgaaactctactaccaaaccgcgccccgcgaaactcttaaaacgactcccgcctacaactaaaaaatccactcgactaaaaaaatccgcgccaaaaaatccaactctccgaactcaactacaaacaaaaaacgccgaatcttactccctcctcccgcccgccgacgcgcacccgaaaaaacaattttatacaaaaatacaacaaataatacccgaaatctacaaaacgccccgcgccgcctaacttaaccgaacgaaacccgcctacaaaaacccgaaccgacctccgaacaaaaaacgaaaaaaaaactaaacgacgctacgaaatccgaaaaaaaccatttaacgactctaaccaaactaaaaaaaatacaaaaaaaacacaaaaccgacgaaccaaaaaaacgatccgaccgctacacgcaaaacgaaaaacgataaaaactacccgcgccttacgcctcctactcgtaatatacgactacctcgcgctcccgccgctaccgaacccgtatacccgaaacgctacgactaccaacatccccaacatctcctatacaccaacaaaaaactccgcgtaatacccaaaaccaactcgctaccgaacccccacgacgtactcacctacaacctcgacgacaacttcataaccaacatcacgaccttcgacttccaccgtc

SEQ ID NO: 23375 - DNA, 957 bp, Artificial Sequence
  chemically treated genomic DNA (Homo sapiens) CpG-island No: 23375
tttggtatttcgggttcgggttgattagacgcggagttatttagtgtttttttttttttttgtcggggtttgttttttttttgtcgtttttttttttttcgtttgcgttttcgcgggtagagtgtgggaagaacgaattttcgtttcgtttgtttttcgttcgtagatttgggtttttttcggacgtagttcgcgtgtttttcgagttattgtattggagtcgtttttttcgttcgggatcgcgagcgagaaggtgtcgtttgcgggggtcgagtagtcggggttttgttgttaagtcgcgtttcgcgaagtttttggaacggttttcgtttgtagttggggaatttattcggttgggagaattcgcgttagggaatttagtttttcggatttagttgtaaataaaaagcgtcgggttttgtttttttttttcgttcgtcgacgcgtattcggagaaatagttttatatagaaatgtaataagtagtattcggggtttgtagagcgtttcgcgtcgtttgatttggtcgggcgaagttcgtttgtagagattcgggtcggttttcggataaaggacggaggaggggttggacggcgttgcgaagttcgaaagaggttatttagcgattttggttaggttaaggggaatgtagaggagatatagagtcggcgggttaagaggacgattcggtcgttgtacgtagggcgggaggcgatggaggttgttcgcgttttgcgttttttgttcgtggtgtgcggttgtttcgcgttttcgtcgttgtcgagttcgtgtgttcggagcgttgcgattgttagtatttttagtattttttgtgtattaatagggggtttcgcgtagtgtttaagattagttcgttgtcgagtttttacgacgtgtttatttatagtttcggcggtaattttataattaatattacggttttcgatttttatcgtt

SEQ ID NO: 23376 - DNA, 957 bp, Artificial Sequence
  chemically treated genomic DNA (Homo sapiens) CpG-island No: 23376
aacgataaaaatcgaaaaccgtaatattaattataaaattaccgccgaaactataaataaacacgtcgtaaaaactcgacaacgaactaatcttaaacactacgcgaaaccccctattaatacacaaaaaatactaaaaatactaacaatcgcaacgctccgaacacacgaactcgacaacgacgaaaacgcgaaacaaccgcacaccacgaacaaaaaacgcaaaacgcgaacaacctccatcgcctcccgccctacgtacaacgaccgaatcgtcctcttaacccgccgactctatatctcctctacattccccttaacctaaccaaaatcgctaaataacctctttcgaacttcgcaacgccgtccaacccctcctccgtcctttatccgaaaaccgacccgaatctctacaaacgaacttcgcccgaccaaatcaaacgacgcgaaacgctctacaaaccccgaatactacttattacatttctatataaaactatttctccgaatacgcgtcgacgaacgaaaaaaaaaaacaaaacccgacgctttttatttacaactaaatccgaaaaactaaattccctaacgcgaattctcccaaccgaataaattccccaactacaaacgaaaaccgttccaaaaacttcgcgaaacgcgacttaacaacaaaaccccgactactcgacccccgcaaacgacaccttctcgctcgcgatcccgaacgaaaaaaacgactccaatacaataactcgaaaaacacgcgaactacgtccgaaaaaaacccaaatctacgaacgaaaaacaaacgaaacgaaaattcgttcttcccacactctacccgcgaaaacgcaaacgaaaaaaaaaaaaacgacaaaaaaaaaacaaaccccgacaaaaaaaaaaaaaaacactaaataactccgcgtctaatcaacccgaacccgaaataccaaa

SEQ ID NO: 23377 - DNA, 555 bp, Artificial Sequence
  chemically treated genomic DNA (Homo sapiens) CpG-island No: 23377
ttatcgtatagcgacggtcggcgttaggtcgtcgaggatatatacgggttaggtttaggtttcgtcgttttttcgttttcgttattatttttcgtttggtttttttggttttagcgtcgttggtttcggggtttacgttcgggggtttcggttcgagtttttattcggttcgcgcgaattttgggtcgtatagttttcgttcgtttaggtgttggttcgggcggttagcgtttagtttcgtagattcggtgatttttatttattagaggttaaagtttgggaattagagtaagcggtgatttgaagaggcgtaggaagcgagggtagtgcggaggtggcgcgtatgtgtagtacgtacgcgcgaatacgtacgtagggagaggtgtatacgcgtaggagtgtatcggaagttcgttttttgggatatttatcgtcgtttttaggataagtaacggattttattttttatgagtttacgcgttttttaagtttaggggtcgttttaaatgtttttatttcgtttaaaggttaagaagttttaggttatgagttttg

SEQ ID NO: 23378 - DNA, 555 bp, Artificial Sequence
  chemically treated genomic DNA (Homo sapiens) CpG-island No: 23378
caaaactcataacctaaaacttcttaacctttaaacgaaataaaaacatttaaaacgacccctaaacttaaaaaacgcgtaaactcataaaaaataaaatccgttacttatcctaaaaacgacgataaatatcccaaaaaacgaacttccgatacactcctacgcgtatacacctctccctacgtacgtattcgcgcgtacgtactacacatacgcgccacctccgcactaccctcgcttcctacgcctcttcaaatcaccgcttactctaattcccaaactttaacctctaataaataaaaatcaccgaatctacgaaactaaacgctaaccgcccgaaccaacacctaaacgaacgaaaactatacgacccaaaattcgcgcgaaccgaataaaaactcgaaccgaaacccccgaacgtaaaccccgaaaccaacgacgctaaaaccaaaaaaaccaaacgaaaaataataacgaaaacgaaaaaacgacgaaacctaaacctaacccgtatatatcctcgacgacctaacgccgaccgtcgctatacgataa

SEQ ID NO: 23379 - DNA, 555 bp, Artificial Sequence
  chemically treated genomic DNA (Homo sapiens) CpG-island No: 23379
taaagtttatagtttggagttttttaatttttaggcggggtagagatatttaagacggtttttaaatttggggagcgcgtaggtttataggaaatagagttcgttatttgttttgggaacggcggtgggtgttttaggaggcggattttcggtgtatttttgcgcgtgtgtatttttttttgcgtgcgtgttcgcgcgtgcgtgttgtatatgcgcgttattttcgtattgttttcgttttttgcgtttttttaggttatcgtttgttttagtttttaggttttggtttttagtggatgagaattatcgagtttgcggggttggacgttgatcgttcgggttagtatttaggcgggcgggagttgtgcggtttagggttcgcgcgggtcgggtagaggttcgagtcgggattttcgagcgtgaatttcggagttagcggcgttggggttagaggggttaggcgggaggtggtggcggaggcgaaggggcgacgggatttgggtttggttcgtgtgtgttttcggcggtttggcgtcggtcgtcgttgtacggtga

SEQ ID NO: 23380 - DNA, 555 bp, Artificial Sequence
  chemically treated genomic DNA (Homo sapiens) CpG-island No: 23380
tcaccgtacaacgacgaccgacgccaaaccgccgaaaacacacacgaaccaaacccaaatcccgtcgccccttcgcctccgccaccacctcccgcctaacccctctaaccccaacgccgctaactccgaaattcacgctcgaaaatcccgactcgaacctctacccgacccgcgcgaaccctaaaccgcacaactcccgcccgcctaaatactaacccgaacgatcaacgtccaaccccgcaaactcgataattctcatccactaaaaaccaaaacctaaaaactaaaacaaacgataacctaaaaaaacgcaaaaaacgaaaacaatacgaaaataacgcgcatatacaacacgcacgcgcgaacacgcacgcaaaaaaaaatacacacgcgcaaaaatacaccgaaaatccgcctcctaaaacacccaccgccgttcccaaaacaaataacgaactctatttcctataaacctacgcgctccccaaatttaaaaaccgtcttaaatatctctaccccgcctaaaaattaaaaaactccaaactataaacttta

SEQ ID NO: 23381 - DNA, 633 bp, Artificial Sequence
  chemically treated genomic DNA (Homo sapiens) CpG-island No: 23381
agcgattcgtagagggtaggacggacgggcgttgtataggttcggggttaaatcgtattttgtaatttgagtttcgagggtcgtcgtattcgtttttgtttgggattacgttttttagcgggtattgcgtcgaggttacgttcggtttcggcggcgttgtttgcgtattggaagtgggaagcgtcgggtttttttaggttgaggggcggggcggggcggggcggggcggggcggggcggggcggggcggggcggggcggggcggggtagcggggaggggtggggaggggcggggcgcggtcgggggcggggcggtttcgcggcgcggtttagtggatgtcgggttatgggggagcgcgcgcggggttgttcgttgggcgtggcgggcgggtgtggttaggggtgtgggtttgtgagggatcggtcggaagggcgtcgcgcggtttcgggtgatatgcggggggcggcgagcgcgagtgttcgcgagtcgacgtcgttttcgggtagaggcgtttttcgtataaagtttcgggcgggtcgaggttcgattgtagggattttagttattttggttttttttgttcggggaaggtcgcgtttaaggaatggtttcgtatttaaaggttagcgagga

SEQ ID NO: 23382 - DNA, 633 bp, Artificial Sequence
  chemically treated genomic DNA (Homo sapiens) CpG-island No: 23382
tcctcgctaacctttaaatacgaaaccattccttaaacgcgaccttccccgaacaaaaaaaaccaaaataactaaaatccctacaatcgaacctcgacccgcccgaaactttatacgaaaaacgcctctacccgaaaacgacgtcgactcgcgaacactcgcgctcgccgccccccgcatatcacccgaaaccgcgcgacgcccttccgaccgatccctcacaaacccacacccctaaccacacccgcccgccacgcccaacgaacaaccccgcgcgcgctcccccataacccgacatccactaaaccgcgccgcgaaaccgccccgcccccgaccgcgccccgcccctccccacccctccccgctaccccgccccgccccgccccgccccgccccgccccgccccgccccgccccgccccgccccgcccctcaacctaaaaaaacccgacgcttcccacttccaatacgcaaacaacgccgccgaaaccgaacgtaacctcgacgcaatacccgctaaaaaacgtaatcccaaacaaaaacgaatacgacgaccctcgaaactcaaattacaaaatacgatttaaccccgaacctatacaacgcccgtccgtcctaccctctacgaatcgct

SEQ ID NO: 23383 - DNA, 633 bp, Artificial Sequence
  chemically treated genomic DNA (Homo sapiens) CpG-island No: 23383
ttttcgttggtttttggatgcgaggttattttttgagcgcggtttttttcgggtagggagggttaaggtggttggagtttttatagtcgggtttcggttcgttcggggttttgtgcggggggcgtttttattcgggagcggcgtcggttcgcggatattcgcgttcgtcgtttttcgtatgttattcgaggtcgcgcgacgttttttcgatcggttttttatagatttatatttttggttatattcgttcgttacgtttagcgaatagtttcgcgcgcgtttttttatggttcggtatttattgggtcgcgtcgcggagtcgtttcgttttcggtcgcgtttcgtttttttttattttttttcgttgtttcgtttcgtttcgtttcgtttcgtttcgtttcgtttcgtttcgtttcgtttcgtttcgttttttagtttagagaagttcggcgttttttatttttagtgcgtaggtagcgtcgtcggaatcgggcgtggtttcggcgtaatgttcgttgggaagcgtagttttaagtagggacggatgcggcggttttcggagtttaggttgtaagatacggtttggtttcgggtttatgtaacgttcgttcgttttgttttttgcgggtcgtt

SEQ ID NO: 23384 - DNA, 633 bp, Artificial Sequence
  chemically treated genomic DNA (Homo sapiens) CpG-island No: 23384
aacgacccgcaaaaaacaaaacgaacgaacgttacataaacccgaaaccaaaccgtatcttacaacctaaactccgaaaaccgccgcatccgtccctacttaaaactacgcttcccaacgaacattacgccgaaaccacgcccgattccgacgacgctacctacgcactaaaaataaaaaacgccgaacttctctaaactaaaaaacgaaacgaaacgaaacgaaacgaaacgaaacgaaacgaaacgaaacgaaacgaaacgaaacaacgaaaaaaaataaaaaaaaacgaaacgcgaccgaaaacgaaacgactccgcgacgcgacccaataaataccgaaccataaaaaaacgcgcgcgaaactattcgctaaacgtaacgaacgaatataaccaaaaatataaatctataaaaaaccgatcgaaaaaacgtcgcgcgacctcgaataacatacgaaaaacgacgaacgcgaatatccgcgaaccgacgccgctcccgaataaaaacgccccccgcacaaaaccccgaacgaaccgaaacccgactataaaaactccaaccaccttaaccctccctacccgaaaaaaaccgcgctcaaaaaataacctcgcatccaaaaaccaacgaaaa

SEQ ID NO: 23385 - DNA, 500 bp, Artificial Sequence
  chemically treated genomic DNA (Homo sapiens) CpG-island No: 23385
gtttcgcggagcgtcgggtgggcgattcggaggggatatgtgcggcgggaggtggcggcgaaagtggtgtgggggatttcgaggttttggagttttattttattttattcgggttgttgtagtaacgacgcggtttaaaaacggtcgcgattaggtcgtttcgttcggttttcgtaggtattcgtttttttcgcgtttatgttcgtattcgtatttttttcgcgattttaagtcggtgttgttttttggtgttcgtagttttgtacgtaggtcgtcgcgggcgcgtagtcgattttcgttttttttttaatgttttgttgaaagtgagaagtcgcgggacgtaaacgcgtcgtttttttaggagtatgagaggcgttttagtttaaagcgatttttagtaaacgcgttgtttacgagtttttatttaggttggaaaacgggtttttttgtttttgtcgggttttcggatttgttcgtaggtttgaggtagggaagttaga

SEQ ID NO: 23386 - DNA, 500 bp, Artificial Sequence
  chemically treated genomic DNA (Homo sapiens) CpG-island No: 23386
tctaacttccctacctcaaacctacgaacaaatccgaaaacccgacaaaaacaaaaaaacccgttttccaacctaaataaaaactcgtaaacaacgcgtttactaaaaatcgctttaaactaaaacgcctctcatactcctaaaaaaacgacgcgtttacgtcccgcgacttctcactttcaacaaaacattaaaaaaaaaacgaaaatcgactacgcgcccgcgacgacctacgtacaaaactacgaacaccaaaaaacaacaccgacttaaaatcgcgaaaaaaatacgaatacgaacataaacgcgaaaaaaacgaatacctacgaaaaccgaacgaaacgacctaatcgcgaccgtttttaaaccgcgtcgttactacaacaacccgaataaaataaaataaaactccaaaacctcgaaatcccccacaccactttcgccgccacctcccgccgcacatatcccctccgaatcgcccacccgacgctccgcgaaac

SEQ ID NO: 23387 - DNA, 500 bp, Artificial Sequence
  chemically treated genomic DNA (Homo sapiens) CpG-island No: 23387
tttggtttttttgttttagatttgcgggtaggttcgggaattcgatagggatagagaagttcgttttttagtttaaatagaagttcgtgggtagcgcgtttgttggaggtcgttttgggttgaaacgttttttatatttttagaggagcggcgcgtttgcgtttcgcggttttttatttttagtaggatattaggagggagacgagagtcggttgcgcgttcgcggcggtttacgtatagggttgcggatattagggggtagtatcgatttagggtcgcgggaggggtgcgggtgcgggtatgggcgcgggggaggcgggtgtttgcgaaggtcgggcggggcggtttagtcgcggtcgtttttaggtcgcgtcgttgttgtagtaattcgggtggggtggggtgggattttagggtttcgagattttttatattattttcgtcgttatttttcgtcgtatatgtttttttcgagtcgtttattcggcgtttcgcggggt

SEQ ID NO: 23388 - DNA, 500 bp, Artificial Sequence
  chemically treated genomic DNA (Homo sapiens) CpG-island No: 23388
accccgcgaaacgccgaataaacgactcgaaaaaaacatatacgacgaaaaataacgacgaaaataatataaaaaatctcgaaaccctaaaatcccaccccaccccacccgaattactacaacaacgacgcgacctaaaaacgaccgcgactaaaccgccccgcccgaccttcgcaaacacccgcctcccccgcgcccatacccgcacccgcacccctcccgcgaccctaaatcgatactaccccctaatatccgcaaccctatacgtaaaccgccgcgaacgcgcaaccgactctcgtctccctcctaatatcctactaaaaataaaaaaccgcgaaacgcaaacgcgccgctcctctaaaaatataaaaaacgtttcaacccaaaacgacctccaacaaacgcgctacccacgaacttctatttaaactaaaaaacgaacttctctatccctatcgaattcccgaacctacccgcaaatctaaaacaaaaaaaccaaa

SEQ ID NO: 23389 - DNA, 612 bp, Artificial Sequence
  chemically treated genomic DNA (Homo sapiens) CpG-island No: 23389
gcgcggcgggcgggtgcgggtttagtgtcgagacgtgtagtttcgtttcggtcgttgttgtcgtcgtcgtcgtcgcggtcgtcgttttcgttaggttcgggtcgggtagcggtttggttagcgcgtcgggcggtagcgcgagtgtcgggaagaaggagggttgcgtcgtcgttagaaaggcggatatggggaagtcggcgggtcgtggcgcgtggaacgggtggtaagttatggcgttggtcgttagcgtcggtttttttatcgggatattcggtttaggcgttcgggggtcggggtcggggtcgggggcgcgcggttcggattttcggttcgggcggcggcgcgcgcggtggacggacgattcgggtggcgggcgtagtagttgtttttcggggtttttcgttcggcgtatcgtaaggggtattcggttttgtgcgcgggggcggcgggggttttgcgcggggtcgggttgggtcgggttgagttggttcgtttcggcgtcggggattacgcgcgattggttagattttgtcgtgatttttggaaaattgtgattattttatatgttttgtttagttcggattttttgcgttaacgagttaggtttttttt

SEQ ID NO: 23390 - DNA, 612 bp, Artificial Sequence
  chemically treated genomic DNA (Homo sapiens) CpG-island No: 23390
aaaaaaaacctaactcgttaacgcaaaaaatccgaactaaacaaaacatataaaataatcacaattttccaaaaatcacgacaaaatctaaccaatcgcgcgtaatccccgacgccgaaacgaaccaactcaacccgacccaacccgaccccgcgcaaaacccccgccgcccccgcgcacaaaaccgaataccccttacgatacgccgaacgaaaaaccccgaaaaacaactactacgcccgccacccgaatcgtccgtccaccgcgcgcgccgccgcccgaaccgaaaatccgaaccgcgcgcccccgaccccgaccccgacccccgaacgcctaaaccgaatatcccgataaaaaaaccgacgctaacgaccaacgccataacttaccacccgttccacgcgccacgacccgccgacttccccatatccgcctttctaacgacgacgcaaccctccttcttcccgacactcgcgctaccgcccgacgcgctaaccaaaccgctacccgacccgaacctaacgaaaacgacgaccgcgacgacgacgacgacaacaacgaccgaaacgaaactacacgtctcgacactaaacccgcacccgcccgccgcgc

SEQ ID NO: 23391 - DNA, 612 bp, Artificial Sequence
  chemically treated genomic DNA (Homo sapiens) CpG-island No: 23391
aaggggggtttggttcgttagcgtaggggattcgagttgggtaggatatgtgagatagttatagttttttagagattacgataagatttaattagtcgcgcgtggttttcggcgtcggagcgggttagtttagttcggtttagttcggtttcgcgtagagttttcgtcgttttcgcgtatagagtcgggtgttttttgcggtgcgtcggacgggaagtttcgaggagtagttgttgcgttcgttattcgggtcgttcgtttatcgcgcgcgtcgtcgttcgggtcgggggttcgagtcgcgcgttttcggtttcggtttcggttttcgggcgtttgggtcggatgtttcgatgagagagtcggcgttggcggttagcgttatggtttattattcgttttacgcgttacggttcgtcgatttttttatgttcgtttttttggcggcggcgtagtttttttttttttcggtattcgcgttgtcgttcggcgcgttggttaagtcgttgttcgattcgggtttggcgggggcggcggtcgcggcggcggcggcggtagtagcggtcgaggcggggttgtacgtttcggtattgggttcgtattcgttcgtcgcgt

SEQ ID NO: 23392 - DNA, 612 bp, Artificial Sequence
  chemically treated genomic DNA (Homo sapiens) CpG-island No: 23392
acgcgacgaacgaatacgaacccaataccgaaacgtacaaccccgcctcgaccgctactaccgccgccgccgccgcgaccgccgcccccgccaaacccgaatcgaacaacgacttaaccaacgcgccgaacgacaacgcgaataccgaaaaaaaaaaaaactacgccgccgccaaaaaaacgaacataaaaaaatcgacgaaccgtaacgcgtaaaacgaataataaaccataacgctaaccgccaacgccgactctctcatcgaaacatccgacccaaacgcccgaaaaccgaaaccgaaaccgaaaacgcgcgactcgaacccccgacccgaacgacgacgcgcgcgataaacgaacgacccgaataacgaacgcaacaactactcctcgaaacttcccgtccgacgcaccgcaaaaaacacccgactctatacgcgaaaacgacgaaaactctacgcgaaaccgaactaaaccgaactaaactaacccgctccgacgccgaaaaccacgcgcgactaattaaatcttatcgtaatctctaaaaaactataactatctcacatatcctacccaactcgaatcccctacgctaacgaaccaaacccccctt

SEQ ID NO: 23393 - DNA, 795 bp, Artificial Sequence
  chemically treated genomic DNA (Homo sapiens) CpG-island No: 23393
cgggtcgtcgggtttcgagatttttttttttgtttcggtttttatcgttcgttcgcgtttgcggttgtttgcgtcggattggagagcgcggagggtcgatttgattcgtcgaaagggtttgaggcgaggggagttcgggtttcggggttttggggaaggattcgtagtcgtacgtcggttttaagtgtaaagtattgatacgatttcgagcggagagggggcgttttttttttttcgcgtttagaggttcggtcgttttggttcgagttttagtttggttttcgatttagtttcgggtcgtggcgtcgtttgggggtttttgcgtttcggaaagagatagtaggtattggaaagcgaggtcggtgggcgggcgagtcgggaggttcgggcggtcgaggttcgggagcggattttaggtggcgggagttggtgagtggagttatggtcgagttttgttggggtcggcgcgggcgggagcgggacgcggttttgcgttggggaaacgcggggattttttattcgcgttcgtttttatcggaagattcggaaggaatttggagtttttcgtaggttcgggtttcgttttgagttttttagcggtcgggaggagcggattttcggggttaggaaggtgagcgtatttttcgttgagtatagggcggtatcgcgcgggcggatttcggattttttattcgcgatttaacgaattttcgttttattcggtatcggagacgaaagtttttttttttcgaaatatcggtttttttttttcgttttgttaattatttttttagt

SEQ ID NO: 23394 - DNA, 795 bp, Artificial Sequence
  chemically treated genomic DNA (Homo sapiens) CpG-island No: 23394
actaaaaaaataattaacaaaacgaaaaaaaaaaaccgatatttcgaaaaaaaaaaactttcgtctccgataccgaataaaacgaaaattcgttaaatcgcgaataaaaaatccgaaatccgcccgcgcgataccgccctatactcaacgaaaaatacgctcaccttcctaaccccgaaaatccgctcctcccgaccgctaaaaaactcaaaacgaaacccgaacctacgaaaaactccaaattccttccgaatcttccgataaaaacgaacgcgaataaaaaatccccgcgtttccccaacgcaaaaccgcgtcccgctcccgcccgcgccgaccccaacaaaactcgaccataactccactcaccaactcccgccacctaaaatccgctcccgaacctcgaccgcccgaacctcccgactcgcccgcccaccgacctcgctttccaatacctactatctctttccgaaacgcaaaaacccccaaacgacgccacgacccgaaactaaatcgaaaaccaaactaaaactcgaaccaaaacgaccgaacctctaaacgcgaaaaaaaaaaaacgccccctctccgctcgaaatcgtatcaatactttacacttaaaaccgacgtacgactacgaatccttccccaaaaccccgaaacccgaactcccctcgcctcaaaccctttcgacgaatcaaatcgaccctccgcgctctccaatccgacgcaaacaaccgcaaacgcgaacgaacgataaaaaccgaaacaaaaaaaaaaatctcgaaacccgacgacccg

SEQ ID NO: 23395 - DNA, 795 bp, Artificial Sequence
  chemically treated genomic DNA (Homo sapiens) CpG-island No: 23395
attaaaaaagtggttggtagggcgaagagaggaagtcggtatttcggaagaaggagattttcgttttcggtatcggatagggcgaaaattcgttgggtcgcgggtggagaattcggggttcgttcgcgcggtgtcgttttgtgtttagcgaaaggtgcgtttatttttttggtttcgaggattcgtttttttcggtcgttggaaagtttagggcggggttcgggtttgcggagaattttaggtttttttcgagtttttcggtgaaggcgggcgcgggtagggggttttcgcgtttttttagcgtaaggtcgcgtttcgttttcgttcgcgtcggttttagtagggttcggttatggttttatttattagttttcgttatttgggattcgttttcggatttcggtcgttcgagtttttcgattcgttcgtttatcggtttcgttttttagtgtttgttgttttttttcggggcgtagggatttttaggcggcgttacgattcggagttgggtcggaggttaggttggggttcgggttagagcggtcgggtttttgggcgcgggagaaggagggcgtttttttttcgttcggggtcgtgttaatgttttgtatttggggtcggcgtgcggttgcgggtttttttttaaggtttcgggattcgggtttttttcgttttaggttttttcggcgggttaggtcggtttttcgcgttttttagttcggcgtaggtagtcgtaggcgcgggcgggcggtgggggtcggggtaggaggaggggtttcggggttcggcggttcg

SEQ ID NO: 23396 - DNA, 795 bp, Artificial Sequence
  chemically treated genomic DNA (Homo sapiens) CpG-island No: 23396
cgaaccgccgaaccccgaaacccctcctcctaccccgacccccaccgcccgcccgcgcctacgactacctacgccgaactaaaaaacgcgaaaaaccgacctaacccgccgaaaaaacctaaaacgaaaaaaacccgaatcccgaaaccttaaaaaaaaacccgcaaccgcacgccgaccccaaatacaaaacattaacacgaccccgaacgaaaaaaaaacgccctccttctcccgcgcccaaaaacccgaccgctctaacccgaaccccaacctaacctccgacccaactccgaatcgtaacgccgcctaaaaatccctacgccccgaaaaaaaacaacaaacactaaaaaacgaaaccgataaacgaacgaatcgaaaaactcgaacgaccgaaatccgaaaacgaatcccaaataacgaaaactaataaataaaaccataaccgaaccctactaaaaccgacgcgaacgaaaacgaaacgcgaccttacgctaaaaaaacgcgaaaaccccctacccgcgcccgccttcaccgaaaaactcgaaaaaaacctaaaattctccgcaaacccgaaccccgccctaaactttccaacgaccgaaaaaaacgaatcctcgaaaccaaaaaaataaacgcacctttcgctaaacacaaaacgacaccgcgcgaacgaaccccgaattctccacccgcgacccaacgaattttcgccctatccgataccgaaaacgaaaatctccttcttccgaaataccgacttcctctcttcgccctaccaaccacttttttaat

SEQ ID NO: 23397 - DNA, 577 bp, Artificial Sequence
  chemically treated genomic DNA (Homo sapiens) CpG-island No: 23397
tataatttaaggtgtgtacggggagagtgaagcgattacgtatttgtttttaatcgggttcgggcgcgaatatttaggttgatttttgaaggtcgttttttgaaggaaaagatagagtatgtattagttacgggtgatatttttattcgtataatcgcgtggtgggcgcgtatatttaatattgatttatgtaggcgttcgtttattgcgtatatcggtcgtagggtatttcgttgttgaacgttgggagtagcgtttgaaggtcggattttttttggtagtgcggattcgggatcggcggaagtagtatggtttttgcgatcgttatttttatttttcggggtcgattttagggtttttataattttttattatcgtatatgtgagcgtcgtttttatagggttttttttacgatttcgtttttggttaggtcgtattttttttagtattttttttttggttagaacgaatttttgatttcgagttgcgtagtttacgtagacggggtaggatttattgtagttttttataggtaaatatttgttggttttattttaggcgagatgtggtttttcg

SEQ ID NO: 23398 - DNA, 577 bp, Artificial Sequence
  chemically treated genomic DNA (Homo sapiens) CpG-island No: 23398
cgaaaaaccacatctcgcctaaaataaaaccaacaaatatttacctataaaaaactacaataaatcctaccccgtctacgtaaactacgcaactcgaaatcaaaaattcgttctaaccaaaaaaaaaatactaaaaaaaatacgacctaaccaaaaacgaaatcgtaaaaaaaaccctataaaaacgacgctcacatatacgataataaaaaattataaaaaccctaaaatcgaccccgaaaaataaaaataacgatcgcaaaaaccatactacttccgccgatcccgaatccgcactaccaaaaaaaatccgaccttcaaacgctactcccaacgttcaacaacgaaataccctacgaccgatatacgcaataaacgaacgcctacataaatcaatattaaatatacgcgcccaccacgcgattatacgaataaaaatatcacccgtaactaatacatactctatcttttccttcaaaaaacgaccttcaaaaatcaacctaaatattcgcgcccgaacccgattaaaaacaaatacgtaatcgcttcactctccccgtacacaccttaaattata

SEQ ID NO: 23399 - DNA, 577 bp, Artificial Sequence
  chemically treated genomic DNA (Homo sapiens) CpG-island No: 23399
cgagaggttatatttcgtttaaggtggagttagtaggtatttgtttgtggaaaattgtagtggattttgtttcgtttgcgtagattgcgtagttcggagttaaagattcgttttggttagagaggaggtattaagagaggtgcgatttagttaagaacgaggtcgtggagaaaattttgtgggggcggcgtttatatatgcggtgatgaggagttgtgagggttttggggtcggtttcgaaaagtagggataacggtcgtagaggttatattgttttcgtcggtttcgaattcgtattgttaggagagattcggtttttaaacgttgtttttaacgtttaataacgaagtgttttgcgatcggtgtgcgtagtgggcgggcgtttgtatgggttaatgttggatgtacgcgtttattacgcggttgtacgggtgggaatgttattcgtggttagtgtatgttttgtttttttttttagaaaacgatttttaggaattagtttgagtgttcgcgttcgagttcgattggaagtaggtgcgtggtcgttttatttttttcgtgtatattttgagttata

SEQ ID NO: 23400 - DNA, 577 bp, Artificial Sequence
  chemically treated genomic DNA (Homo sapiens) CpG-island No: 23400
tataactcaaaatatacacgaaaaaaataaaacgaccacgcacctacttccaatcgaactcgaacgcgaacactcaaactaattcctaaaaatcgttttctaaaaaaaaaaacaaaacatacactaaccacgaataacattcccacccgtacaaccgcgtaataaacgcgtacatccaacattaacccatacaaacgcccgcccactacgcacaccgatcgcaaaacacttcgttattaaacgttaaaaacaacgtttaaaaaccgaatctctcctaacaatacgaattcgaaaccgacgaaaacaatataacctctacgaccgttatccctacttttcgaaaccgaccccaaaaccctcacaactcctcatcaccgcatatataaacgccgcccccacaaaattttctccacgacctcgttcttaactaaatcgcacctctcttaatacctcctctctaaccaaaacgaatctttaactccgaactacgcaatctacgcaaacgaaacaaaatccactacaattttccacaaacaaatacctactaactccaccttaaacgaaatataacctctcg

SEQ ID NO: 23401 - DNA, 505 bp, Artificial Sequence
  chemically treated genomic DNA (Homo sapiens) CpG-island No: 23401
acgcggtcgagaattaaggtcgtatttcggatggatttcgggtgattttttcggagttttggggaattttttaattcggggagttgtagacgatttattggtttcgggtcgcggtttcgcgggtggtcgttgtacgtttgagatatttggttcgtagaagttaggtgtacgtttgtgtatcgtcgtgcgttggatgtgtatggaggcgagatcgtggttatggatgtttgggattacgggagcgtgaacggggcgatcgattgagtgatttgagagacggggtagagcgtaggaaggatttttaggacgggtttatttgcgacgggcggcggtgggggagtggggggtttgtcggcgcgtttataggttttgggttcgcgttcggaaacgttttcgtagggagcgggtcgggatttttcggagtagtacggtgacggcgtgttataattcgggttttagttgtgtcgttttcgttttttttatttttgttaaggggtatttggtt

SEQ ID NO: 23402 - DNA, 505 bp, Artificial Sequence
  chemically treated genomic DNA (Homo sapiens) CpG-island No: 23402
aaccaaataccccttaacaaaaataaaaaaaacgaaaacgacacaactaaaacccgaattataacacgccgtcaccgtactactccgaaaaatcccgacccgctccctacgaaaacgtttccgaacgcgaacccaaaacctataaacgcgccgacaaaccccccactcccccaccgccgcccgtcgcaaataaacccgtcctaaaaatccttcctacgctctaccccgtctctcaaatcactcaatcgatcgccccgttcacgctcccgtaatcccaaacatccataaccacgatctcgcctccatacacatccaacgcacgacgatacacaaacgtacacctaacttctacgaaccaaatatctcaaacgtacaacgaccacccgcgaaaccgcgacccgaaaccaataaatcgtctacaactccccgaattaaaaaattccccaaaactccgaaaaaatcacccgaaatccatccgaaatacgaccttaattctcgaccgcgt

SEQ ID NO: 23403 - DNA, 505 bp, Artificial Sequence
  chemically treated genomic DNA (Homo sapiens) CpG-island No: 23403
ggttaggtgttttttagtagggatggggagggcggaggcggtatagttggagttcggattgtggtacgtcgttatcgtgttgtttcggggaatttcgattcgttttttgcgaaagcgttttcgaacgcgaatttagagtttgtgaacgcgtcggtaagttttttatttttttatcgtcgttcgtcgtaggtgggttcgttttaggggttttttttgcgttttatttcgttttttaagttatttagtcgatcgtttcgtttacgttttcgtgattttagatatttataattacgatttcgtttttatgtatatttaacgtacgacggtgtatagacgtgtatttgatttttgcggattaggtgttttaagcgtatagcggttattcgcggaatcgcggttcggggttagtgagtcgtttgtagtttttcgggttaggggattttttagaatttcgggaaagttattcgaagtttattcgggatgcggttttggttttcggtcgcgt

SEQ ID NO: 23404 - DNA, 505 bp, Artificial Sequence
  chemically treated genomic DNA (Homo sapiens) CpG-island No: 23404
acgcgaccgaaaaccaaaaccgcatcccgaataaacttcgaataactttcccgaaattctaaaaaatcccctaacccgaaaaactacaaacgactcactaaccccgaaccgcgattccgcgaataaccgctatacgcttaaaacacctaatccgcaaaaatcaaatacacgtctatacaccgtcgtacgttaaatatacataaaaacgaaatcgtaattataaatatctaaaatcacgaaaacgtaaacgaaacgatcgactaaataacttaaaaaacgaaataaaacgcaaaaaaaacccctaaaacgaacccacctacgacgaacgacgataaaaaaataaaaaacttaccgacgcgttcacaaactctaaattcgcgttcgaaaacgctttcgcaaaaaacgaatcgaaattccccgaaacaacacgataacgacgtaccacaatccgaactccaactataccgcctccgccctccccatccctactaaaaaacacctaacc

SEQ ID NO: 23405 - DNA, 854 bp, Artificial Sequence
  chemically treated genomic DNA (Homo sapiens) CpG-island No: 23405
ggcggttcggcggtcgcggagtcgttgttcgtcgcggagaaggcggaggagttcggggatcggtcggcggaggagtggttgggtcgcgcgggtttgcgttggacgtgggcgcggagttttgcggagtcggtagcggtcggtttgacgtgtttttcgagcgtgacgcgcgggtagcggttggcggcgggcggcgggtgtttgttgttggttgtattgtgtttcggtttagtcgcgttttacgtatcggtgttgttgttgcgcgcgcgtaagttcgcgttgttttggttattgggttcggcgttggcgttggcgggaagcgcgttgttgcggggcggcgcggcgtgcggacgtttgttgcgttgcgaagaagcgtcgtttcggttcgcgttgttttatatggtagcgttgggcgttacgttgttcgtcgcgttgggttttcgtagtacgttgtttacggtgttgggcgcgggcgcgtaggtggtcgcgttgttggtcgcgttggttgggttgttgttttggggcggcggtatcgcgttgcgtttcgtattgggtcgtttgggtcgcggcgtcggtttcgttaaggtgttgttcgtgtgaggatttcgcgttttcgtcgttggggaagtacgcggagttagcgtcgtcggagatcgcgtcggtcgagttgaggattgtacgtcgttgtgcggaagttcgtggcgaaggttttgttttaatagtttgcgagtttaattcgggagcggttgttgttagcggaggcgatagtagcgttgggagtttttcgatgttagttttttgtgttggatttggtatacgttttgaaaattgagattttgttattgaattggtgatag

SEQ ID NO: 23406 - DNA, 854 bp, Artificial Sequence
  chemically treated genomic DNA (Homo sapiens) CpG-island No: 23406
ctatcaccaattcaataacaaaatctcaattttcaaaacgtataccaaatccaacacaaaaaactaacatcgaaaaactcccaacgctactatcgcctccgctaacaacaaccgctcccgaattaaactcgcaaactattaaaacaaaaccttcgccacgaacttccgcacaacgacgtacaatcctcaactcgaccgacgcgatctccgacgacgctaactccgcgtacttccccaacgacgaaaacgcgaaatcctcacacgaacaacaccttaacgaaaccgacgccgcgacccaaacgacccaatacgaaacgcaacgcgataccgccgccccaaaacaacaacccaaccaacgcgaccaacaacgcgaccacctacgcgcccgcgcccaacaccgtaaacaacgtactacgaaaacccaacgcgacgaacaacgtaacgcccaacgctaccatataaaacaacgcgaaccgaaacgacgcttcttcgcaacgcaacaaacgtccgcacgccgcgccgccccgcaacaacgcgcttcccgccaacgccaacgccgaacccaataaccaaaacaacgcgaacttacgcgcgcgcaacaacaacaccgatacgtaaaacgcgactaaaccgaaacacaatacaaccaacaacaaacacccgccgcccgccgccaaccgctacccgcgcgtcacgctcgaaaaacacgtcaaaccgaccgctaccgactccgcaaaactccgcgcccacgtccaacgcaaacccgcgcgacccaaccactcctccgccgaccgatccccgaactcctccgccttctccgcgacgaacaacgactccgcgaccgccgaaccgcc

SEQ ID NO: 23407 - DNA, 854 bp, Artificial Sequence
  chemically treated genomic DNA (Homo sapiens) CpG-island No: 23407
ttgttattagtttaatgataaaattttagtttttagagcgtgtgttaagtttagtataaaaagttgatatcgaggagtttttaacgttgttgtcgttttcgttggtagtagtcgttttcggattagattcgtaggttgttagggtagggttttcgttacgggttttcgtatagcggcgtgtagtttttagttcggtcggcgcggttttcgacggcgttggtttcgcgtatttttttagcggcgagggcgcgaggtttttatacgggtagtattttggcgaggtcggcgtcgcggtttaggcgatttagtgcgaggcgtagcgcggtgtcgtcgttttagggtagtagtttaattagcgcggttagtagcgcggttatttgcgcgttcgcgtttagtatcgtgagtagcgtgttgcgaaggtttagcgcggcgaatagcgtggcgtttagcgttgttatgtagagtagcgcgggtcgggacggcgttttttcgtagcgtagtaggcgttcgtacgtcgcgtcgtttcgtagtagcgcgtttttcgttaacgttagcgtcgagtttagtgattagagtagcgcgaatttgcgcgcgcgtagtagtaatatcggtgcgtagagcgcggttaggtcgaaatatagtgtagttagtagtaggtattcgtcgttcgtcgttagtcgttgttcgcgcgttacgttcgggaggtacgttaggtcggtcgttgtcgatttcgtagggtttcgcgtttacgtttagcgtaagttcgcgcggtttagttattttttcgtcggtcggttttcgggttttttcgtttttttcgcggcgagtagcggtttcgcggtcgtcgggtcgtt

SEQ ID NO: 23408 - DNA, 854 bp, Artificial Sequence
  chemically treated genomic DNA (Homo sapiens) CpG-island No: 23408
aacgacccgacgaccgcgaaaccgctactcgccgcgaaaaaaacgaaaaaacccgaaaaccgaccgacgaaaaaataactaaaccgcgcgaacttacgctaaacgtaaacgcgaaaccctacgaaatcgacaacgaccgacctaacgtacctcccgaacgtaacgcgcgaacaacgactaacgacgaacgacgaatacctactactaactacactatatttcgacctaaccgcgctctacgcaccgatattactactacgcgcgcgcaaattcgcgctactctaatcactaaactcgacgctaacgttaacgaaaaacgcgctactacgaaacgacgcgacgtacgaacgcctactacgctacgaaaaaacgccgtcccgacccgcgctactctacataacaacgctaaacgccacgctattcgccgcgctaaaccttcgcaacacgctactcacgatactaaacgcgaacgcgcaaataaccgcgctactaaccgcgctaattaaactactaccctaaaacgacgacaccgcgctacgcctcgcactaaatcgcctaaaccgcgacgccgacctcgccaaaatactacccgtataaaaacctcgcgccctcgccgctaaaaaaatacgcgaaaccaacgccgtcgaaaaccgcgccgaccgaactaaaaactacacgccgctatacgaaaacccgtaacgaaaaccctaccctaacaacctacgaatctaatccgaaaacgactactaccaacgaaaacgacaacaacgttaaaaactcctcgatatcaactttttatactaaacttaacacacgctctaaaaactaaaattttatcattaaactaataacaa

SEQ ID NO: 23409 - DNA, 1518 bp, Artificial Sequence
  chemically treated genomic DNA (Homo sapiens) CpG-island No: 23409
tatatatcgacggaataggatttagtttacgcgtcgacggaagaggatttagtttatacgttaacgggaatagaatttcgtttatatatcgacggaatagaatttagtttatgtatcgacggaataggatttagtttacgtatcgacgggaatagaatttagtttatatatcgatagaatagaatttagtttatatacggacgggaatagaatttagtttatatatcgacggaataggatttagtttatatatcgacggaataggatttagtttacgcgtcgacggaagaggatttagtttatacgttaacgggaatagaatttcgtttatatatcgacggaatagaatttagtttatgtatcgacggaataggatttagtttacgtatcgacgggaatagaatttagtttatatatcgatagaatagaatttagtttatatacggacgggaatagaatttagtttatatatcgacggaataggatttagtttatatatcgacggaataggatttagtttatacgtcgacggaagaggatttagtttatatatcgacggaataggatttagtttacgcgtcgacggaagaggatttagtttatacgtcgatagaatagaatttagtttatatacggacgggaatagaatttagtttatatacggacgggaatagaatttagtttatatatcgacggaataggatttagtttacgcgtcgacggaagaggatttagtttatatattaacgggaatagaatttcgtttatatatcgacggaatagaatttagtttatgtatcgacggaataggatttagtttacgtatcgacggaagaggatttagtttatatatcgacgggaatagaatttagtttatatatcgacgggataggatttagtttatatatcgacgggaatagaatttagtttatatatcgacggaataggatttagtttatatatcgacggaataggatttagtttatacgtcgacggaagaggatttagtttatatatcgacggaataggatttagtttacgcgtcgacggaagaggatttagtttatacgtcgatagaatagaatttagtttatatacggacgggaatagaatttagtttatatacggacgggaatagaatttagtttatatatcgacggaataggatttagtttacgcgtcgacggaagaggatttagtttatatattaacgggaatagaatttcgtttatatatcgacggaatagaatttagtttatgtatcgacggaataggatttagtttacgtatcgacggaagaggatttagtttatatatcgacgggaatagaatttagtttatatatcgacgggataggatttagtttatatatcgacgggaatagaatttagtttatatatcgacggaataggatttagtttacgcgtcgacggaagaggatttagtttacgcgtcgacggaataggatttagtttatatacggatggaatagaatttagtttatgtattaacggaata

SEQ ID NO: 23410 - DNA, 1518 bp, Artificial Sequence
  chemically treated genomic DNA (Homo sapiens) CpG-island No: 23410
tattccgttaatacataaactaaattctattccatccgtatataaactaaatcctattccgtcgacgcgtaaactaaatcctcttccgtcgacgcgtaaactaaatcctattccgtcgatatataaactaaattctattcccgtcgatatataaactaaatcctatcccgtcgatatataaactaaattctattcccgtcgatatataaactaaatcctcttccgtcgatacgtaaactaaatcctattccgtcgatacataaactaaattctattccgtcgatatataaacgaaattctattcccgttaatatataaactaaatcctcttccgtcgacgcgtaaactaaatcctattccgtcgatatataaactaaattctattcccgtccgtatataaactaaattctattcccgtccgtatataaactaaattctattctatcgacgtataaactaaatcctcttccgtcgacgcgtaaactaaatcctattccgtcgatatataaactaaatcctcttccgtcgacgtataaactaaatcctattccgtcgatatataaactaaatcctattccgtcgatatataaactaaattctattcccgtcgatatataaactaaatcctatcccgtcgatatataaactaaattctattcccgtcgatatataaactaaatcctcttccgtcgatacgtaaactaaatcctattccgtcgatacataaactaaattctattccgtcgatatataaacgaaattctattcccgttaatatataaactaaatcctcttccgtcgacgcgtaaactaaatcctattccgtcgatatataaactaaattctattcccgtccgtatataaactaaattctattcccgtccgtatataaactaaattctattctatcgacgtataaactaaatcctcttccgtcgacgcgtaaactaaatcctattccgtcgatatataaactaaatcctcttccgtcgacgtataaactaaatcctattccgtcgatatataaactaaatcctattccgtcgatatataaactaaattctattcccgtccgtatataaactaaattctattctatcgatatataaactaaattctattcccgtcgatacgtaaactaaatcctattccgtcgatacataaactaaattctattccgtcgatatataaacgaaattctattcccgttaacgtataaactaaatcctcttccgtcgacgcgtaaactaaatcctattccgtcgatatataaactaaatcctattccgtcgatatataaactaaattctattcccgtccgtatataaactaaattctattctatcgatatataaactaaattctattcccgtcgatacgtaaactaaatcctattccgtcgatacataaactaaattctattccgtcgatatataaacgaaattctattcccgttaacgtataaactaaatcctcttccgtcgacgcgtaaactaaatcctattccgtcgatatata

SEQ ID NO: 23411 - DNA, 1518 bp, Artificial Sequence
  chemically treated genomic DNA (Homo sapiens) CpG-island No: 23411
tgtttcgttggtgtatggattggattttattttattcgtgtgtggattggattttgtttcgtcggcgcgtggattggattttttttcgtcggcgcgtggattggattttgtttcgtcggtgtgtggattggattttattttcgtcggtgtgtggattggattttgtttcgtcggtgtgtggattggattttattttcgtcggtgtgtggattggattttttttcgtcggtgcgtgggttggattttgtttcgtcggtgtatggattggattttgtttcgtcggtgtgtggacgggattttattttcgttggtgtgtggattagattttttttcgtcggcgcgtggattggattttgtttcgtcggtgtgtggattggattttattttcgttcgtgtgtggattggattttattttcgttcgtgtgtggattggattttgttttgtcggcgtgtggattggattttttttcgtcggcgcgtggattggattttgtttcgtcggtgtgtggattggattttttttcgtcggcgtgtggattggattttgtttcgtcggtgtgtggattggattttgtttcgtcggtgtgtggattggattttattttcgtcggtgtgtggattggattttgtttcgtcggtgtgtggattggattttattttcgtcggtgtgtggattggattttttttcgtcggtgcgtgggttggattttgtttcgtcggtgtatggattggattttgtttcgtcggtgtgtggacgggattttattttcgttggtgtgtggattagattttttttcgtcggcgcgtggattggattttgtttcgtcggtgtgtggattggattttattttcgttcgtgtgtggattggattttattttcgttcgtgtgtggattggattttgttttgtcggcgtgtggattggattttttttcgtcggcgcgtggattggattttgtttcgtcggtgtgtggattggattttttttcgtcggcgtgtggattggattttgtttcgtcggtgtgtggattggattttgtttcgtcggtgtgtggattggattttattttcgttcgtgtgtggattggattttgttttgtcggtgtgtggattggattttattttcgtcggtgcgtggattggattttgtttcgtcggtgtatggattggattttgtttcgtcggtgtgtggacgggattttattttcgttggcgtgtggattagattttttttcgtcggcgcgtggattggattttgtttcgtcggtgtgtggattggattttgtttcgtcggtgtgtggattggattttattttcgttcgtgtgtggattggattttgttttgtcggtgtgtggattggattttattttcgtcggtgcgtggattgaattttgtttcgtcggtgtatggattggattttgtttcgtcggtgtgtggacgggattttattttcgttggcgtgtggattagattttttttcgtcggcgcgtggattggattttgtttcgtcggtgtgtg

SEQ ID NO: 23412 - DNA, 1518 bp, Artificial Sequence
  chemically treated genomic DNA (Homo sapiens) CpG-island No: 23412
cacacaccgacgaaacaaaatccaatccacgcgccgacgaaaaaaaatctaatccacacgccaacgaaaataaaatcccgtccacacaccgacgaaacaaaatccaatccatacaccgacgaaacaaaattcaatccacgcaccgacgaaaataaaatccaatccacacaccgacaaaacaaaatccaatccacacacgaacgaaaataaaatccaatccacacaccgacgaaacaaaatccaatccacacaccgacgaaacaaaatccaatccacgcgccgacgaaaaaaaatctaatccacacgccaacgaaaataaaatcccgtccacacaccgacgaaacaaaatccaatccatacaccgacgaaacaaaatccaatccacgcaccgacgaaaataaaatccaatccacacaccgacaaaacaaaatccaatccacacacgaacgaaaataaaatccaatccacacaccgacgaaacaaaatccaatccacacaccgacgaaacaaaatccaatccacacgccgacgaaaaaaaatccaatccacacaccgacgaaacaaaatccaatccacgcgccgacgaaaaaaaatccaatccacacgccgacaaaacaaaatccaatccacacacgaacgaaaataaaatccaatccacacacgaacgaaaataaaatccaatccacacaccgacgaaacaaaatccaatccacgcgccgacgaaaaaaaatctaatccacacaccaacgaaaataaaatcccgtccacacaccgacgaaacaaaatccaatccatacaccgacgaaacaaaatccaacccacgcaccgacgaaaaaaaatccaatccacacaccgacgaaaataaaatccaatccacacaccgacgaaacaaaatccaatccacacaccgacgaaaataaaatccaatccacacaccgacgaaacaaaatccaatccacacaccgacgaaacaaaatccaatccacacgccgacgaaaaaaaatccaatccacacaccgacgaaacaaaatccaatccacgcgccgacgaaaaaaaatccaatccacacgccgacaaaacaaaatccaatccacacacgaacgaaaataaaatccaatccacacacgaacgaaaataaaatccaatccacacaccgacgaaacaaaatccaatccacgcgccgacgaaaaaaaatctaatccacacaccaacgaaaataaaatcccgtccacacaccgacgaaacaaaatccaatccatacaccgacgaaacaaaatccaacccacgcaccgacgaaaaaaaatccaatccacacaccgacgaaaataaaatccaatccacacaccgacgaaacaaaatccaatccacacaccgacgaaaataaaatccaatccacacaccgacgaaacaaaatccaatccacgcgccgacgaaaaaaaatccaatccacgcgccgacgaaacaaaatccaatccacacacgaataaaataaaatccaatccatacaccaacgaaaca

SEQ ID NO: 23413 - DNA, 560 bp, Artificial Sequence
  chemically treated genomic DNA (Homo sapiens) CpG-island No: 23413
cggcgtttcgaggagggcgcggacggggcggggcggggtatttcggttgcgttttcgcgcgtggtcgcgagggggcgcggtaggacggggttgttagggcggtcgcgggtgagttagggcggcgttaggatgagttagtttttcgtgggtttatcgcgtttttttcgtttttggttttttcgttcggtcgcgttttggtcgtcggttcgttttgattttcggggattttaggttttgcgtcgttttgcgttttttcgggatttttttgtcgttaggagatcgcgtttttcgggaatatagggtagggcgcgcgggtttgggttaggtcgttttcgcgggttttttcgtcgttttttttttggggtcgggcgtggttttttttttagagcgggtttcggggtcggtttcggttcggttcggattcgagggatagttttgttaaggttcggttatgggcggtcgtcgcgggggaaatgtgttttttggttaatacgtggggagaaagtttttttcgtttttgggtgtatttcggtgtttcggtttttttttagagtaaatta

SEQ ID NO: 23414 - DNA, 560 bp, Artificial Sequence
  chemically treated genomic DNA (Homo sapiens) CpG-island No: 23414
taatttactctaaaaaaaaaccgaaacaccgaaatacacccaaaaacgaaaaaaactttctccccacgtattaaccaaaaaacacatttcccccgcgacgaccgcccataaccgaaccttaacaaaactatccctcgaatccgaaccgaaccgaaaccgaccccgaaacccgctctaaaaaaaaaaccacgcccgaccccaaaaaaaaaacgacgaaaaaacccgcgaaaacgacctaacccaaacccgcgcgccctaccctatattcccgaaaaacgcgatctcctaacgacaaaaaaatcccgaaaaaacgcaaaacgacgcaaaacctaaaatccccgaaaatcaaaacgaaccgacgaccaaaacgcgaccgaacgaaaaaaccaaaaacgaaaaaaacgcgataaacccacgaaaaactaactcatcctaacgccgccctaactcacccgcgaccgccctaacaaccccgtcctaccgcgccccctcgcgaccacgcgcgaaaacgcaaccgaaataccccgccccgccccgtccgcgccctcctcgaaacgccg

SEQ ID NO: 23415 - DNA, 560 bp, Artificial Sequence
  chemically treated genomic DNA (Homo sapiens) CpG-island No: 23415
tgatttgttttgagaagaggtcgaaatatcggggtatatttaagaacggagagggttttttttttacgtgttagttagggggtatatttttttcgcggcggtcgtttatggtcgggttttggtagagttgtttttcgaattcgggtcgagtcggggtcggtttcgaaattcgttttgggagggaagttacgttcggttttaggaaaggagcgacgggagggttcgcgggaacggtttggtttaggttcgcgcgttttgttttgtgttttcgggaggcgcggttttttggcggtaggggagtttcgggagggcgtagggcggcgtagagtttgggattttcgagggttagggcgagtcggcggttagggcgcggtcgggcggggaagttaggggcggagggggcgcggtaagtttacggagggttgatttattttggcgtcgttttgatttattcgcggtcgttttggtagtttcgttttgtcgcgttttttcgcggttacgcgcggaagcgtagtcggggtgtttcgtttcgtttcgttcgcgtttttttcggagcgtcg

SEQ ID NO: 23416 - DNA, 560 bp, Artificial Sequence
  chemically treated genomic DNA (Homo sapiens) CpG-island No: 23416
cgacgctccgaaaaaaacgcgaacgaaacgaaacgaaacaccccgactacgcttccgcgcgtaaccgcgaaaaaacgcgacaaaacgaaactaccaaaacgaccgcgaataaatcaaaacgacgccaaaataaatcaaccctccgtaaacttaccgcgccccctccgcccctaacttccccgcccgaccgcgccctaaccgccgactcgccctaaccctcgaaaatcccaaactctacgccgccctacgccctcccgaaactcccctaccgccaaaaaaccgcgcctcccgaaaacacaaaacaaaacgcgcgaacctaaaccaaaccgttcccgcgaaccctcccgtcgctcctttcctaaaaccgaacgtaacttccctcccaaaacgaatttcgaaaccgaccccgactcgacccgaattcgaaaaacaactctaccaaaacccgaccataaacgaccgccgcgaaaaaaatataccccctaactaacacgtaaaaaaaaaaccctctccgttcttaaatataccccgatatttcgacctcttctcaaaacaaatca

SEQ ID NO: 23417 - DNA, 525 bp, Artificial Sequence
  chemically treated genomic DNA (Homo sapiens) CpG-island No: 23417
agcgagttgttcgtgttttcggtttttgtttcgtaaatttcggacgatgttatcggaggacgttgaaggtaaaggttggtggggttaggcgtcggcgagattgtcgcgttagtatagttttcgcgggagtcgagtgttgacgggtttcgcgattttttttcgagggtaaacggttcggttttttagggatatttggttagtgttattttttttttatcgggtgtcgcgtatttttttaatagaacgtgatttcgtagacggatgaattcggaatcggtaaaattcgtttgtttttgtttagtttttttgttttattatattattgttttttattgcggattgcgtcgtgtgcgtttcgggatcgtttttgtatttttgtttatagttttttattattaaggtagtcggaggaagattttttcgagttatttgttttacgttagtagttatatcgaggcggtttttttcgtattattttttaagtgtagagtttttgaaagttcgaggtttttgtgttacgtattt

SEQ ID NO: 23418 - DNA, 525 bp, Artificial Sequence
  chemically treated genomic DNA (Homo sapiens) CpG-island No: 23418
aaatacgtaacacaaaaacctcgaactttcaaaaactctacacttaaaaaataatacgaaaaaaaccgcctcgatataactactaacgtaaaacaaataactcgaaaaaatcttcctccgactaccttaataataaaaaactataaacaaaaatacaaaaacgatcccgaaacgcacacgacgcaatccgcaataaaaaacaataatataataaaacaaaaaaactaaacaaaaacaaacgaattttaccgattccgaattcatccgtctacgaaatcacgttctattaaaaaaatacgcgacacccgataaaaaaaaaataacactaaccaaatatccctaaaaaaccgaaccgtttaccctcgaaaaaaaatcgcgaaacccgtcaacactcgactcccgcgaaaactatactaacgcgacaatctcgccgacgcctaaccccaccaacctttaccttcaacgtcctccgataacatcgtccgaaatttacgaaacaaaaaccgaaaacacgaacaactcgct

SEQ ID NO: 23419 - DNA, 525 bp, Artificial Sequence
  chemically treated genomic DNA (Homo sapiens) CpG-island No: 23419
gggtgcgtggtataggagtttcggatttttaggggttttgtatttggggagtggtgcgagggggatcgtttcggtgtggttgttgacgtgagataggtaattcggaaaggttttttttcggttgttttggtaatgggaagttgtgggtaaaggtgtaggggcggtttcggagcgtatacggcgtagttcgtagtgaagggtagtggtgtggtggggtagagagattagataagggtaggcgggttttgtcgatttcgagtttattcgtttacggggttacgttttgttgagaaaatgcgcgatattcggtagggagagagtgatattgattaagtgtttttggagggtcgagtcgtttgttttcgggagggggtcgcgaggttcgttagtattcggttttcgcggaagttgtgttagcgcggtagtttcgtcggcgtttggttttattagtttttgtttttagcgtttttcggtggtatcgttcgagatttgcggagtagaagtcgaggatacgagtaattcgtt

SEQ ID NO: 23420 - DNA, 525 bp, Artificial Sequence
  chemically treated genomic DNA (Homo sapiens) CpG-island No: 23420
aacgaattactcgtatcctcgacttctactccgcaaatctcgaacgataccaccgaaaaacgctaaaaacaaaaactaataaaaccaaacgccgacgaaactaccgcgctaacacaacttccgcgaaaaccgaatactaacgaacctcgcgaccccctcccgaaaacaaacgactcgaccctccaaaaacacttaatcaatatcactctctccctaccgaatatcgcgcattttctcaacaaaacgtaaccccgtaaacgaataaactcgaaatcgacaaaacccgcctacccttatctaatctctctaccccaccacaccactacccttcactacgaactacgccgtatacgctccgaaaccgcccctacacctttacccacaacttcccattaccaaaacaaccgaaaaaaaacctttccgaattacctatctcacgtcaacaaccacaccgaaacgatccccctcgcaccactccccaaatacaaaacccctaaaaatccgaaactcctataccacgcaccc

SEQ ID NO: 23421 - DNA, 596 bp, Artificial Sequence
  chemically treated genomic DNA (Homo sapiens) CpG-island No: 23421
atggggcgcgtcgggtcgtttggtcgggcggttacgtgttttttttttttcgttattgcggcgggagttttaattagagcgcgttagggggtttttttcgggtaggaattattcggttcggcggcggagggtgggtcgtcgttatttgatcgttcgttttcgtttttcgcgagtaaggggcggtggtagcgtttgttcggttataaatggtttttttcgttcggttcgttcgttcgttcgggttcggcgcggattcgtttgggcgtgtttttttcgtcggttttaggcgttttatcgttttgttcggcgttagttcgcggttttagttatttttgagggcgcgtcgggtatttagcgcgtaggttcgtttacggaggtcgatacggaagtttggatcgtcgaggcgtgtggttcgtttatcggtaggtgagcgtgtatcgcgggcgtgggatgttgtggggatagtgcgggggacgtgtggggttttcggatgcgaacgcgagttcgtgcgatgtttaggttaagtttgtagagagagtttgcggtgtttgtttttttggtttttttttgatgtttttgcgggttgggggttcgga

SEQ ID NO: 23422 - DNA, 596 bp, Artificial Sequence
  chemically treated genomic DNA (Homo sapiens) CpG-island No: 23422
tccgaacccccaacccgcaaaaacatcaaaaaaaaaccaaaaaaacaaacaccgcaaactctctctacaaacttaacctaaacatcgcacgaactcgcgttcgcatccgaaaaccccacacgtcccccgcactatccccacaacatcccacgcccgcgatacacgctcacctaccgataaacgaaccacacgcctcgacgatccaaacttccgtatcgacctccgtaaacgaacctacgcgctaaatacccgacgcgccctcaaaaataactaaaaccgcgaactaacgccgaacaaaacgataaaacgcctaaaaccgacgaaaaaaacacgcccaaacgaatccgcgccgaacccgaacgaacgaacgaaccgaacgaaaaaaaccatttataaccgaacaaacgctaccaccgccccttactcgcgaaaaacgaaaacgaacgatcaaataacgacgacccaccctccgccgccgaaccgaataattcctacccgaaaaaaaccccctaacgcgctctaattaaaactcccgccgcaataacgaaaaaaaaaaaacacgtaaccgcccgaccaaacgacccgacgcgccccat

SEQ ID NO: 23423 - DNA, 596 bp, Artificial Sequence
  chemically treated genomic DNA (Homo sapiens) CpG-island No: 23423
ttcgagtttttaattcgtaggagtattaagaggaggttaaggagatagatatcgtagattttttttgtaaatttgatttgggtatcgtacggattcgcgttcgtattcgaagattttatacgtttttcgtattgtttttatagtattttacgttcgcggtgtacgtttatttgtcggtagacgagttatacgtttcggcggtttagattttcgtgtcgattttcgtgggcgagtttacgcgttgggtgttcggcgcgtttttaggagtggttgggatcgcgggttggcgtcgggtagggcggtgggacgtttggagtcggcgggaggagtacgtttaggcgggttcgcgtcgagttcgagcgagcgggcgagtcgggcgggaggggttatttgtaatcgagtagacgttattatcgttttttattcgcggggggcgggggcgggcggttaggtgacggcggtttatttttcgtcgtcgagtcgggtggtttttgttcgggaggagttttttggcgcgttttgattggaattttcgtcgtagtggcgggggaggggggatacgtgatcgttcggttaggcggttcggcgcgttttat

SEQ ID NO: 23424 - DNA, 596 bp, Artificial Sequence
  chemically treated genomic DNA (Homo sapiens) CpG-island No: 23424
ataaaacgcgccgaaccgcctaaccgaacgatcacgtatcccccctcccccgccactacgacgaaaattccaatcaaaacgcgccaaaaaactcctcccgaacaaaaaccacccgactcgacgacgaaaaataaaccgccgtcacctaaccgcccgcccccgccccccgcgaataaaaaacgataataacgtctactcgattacaaataacccctcccgcccgactcgcccgctcgctcgaactcgacgcgaacccgcctaaacgtactcctcccgccgactccaaacgtcccaccgccctacccgacgccaacccgcgatcccaaccactcctaaaaacgcgccgaacacccaacgcgtaaactcgcccacgaaaatcgacacgaaaatctaaaccgccgaaacgtataactcgtctaccgacaaataaacgtacaccgcgaacgtaaaatactataaaaacaatacgaaaaacgtataaaatcttcgaatacgaacgcgaatccgtacgatacccaaatcaaatttacaaaaaaaatctacgatatctatctccttaacctcctcttaatactcctacgaattaaaaactcgaa

SEQ ID NO: 23425 - DNA, 744 bp, Artificial Sequence
  chemically treated genomic DNA (Homo sapiens) CpG-island No: 23425
tgtcgaagtggtattgcggtcggttttgcgtttttatcgcgatcgaggtggcggtaagagttgggagagagggggagaaaagcggttagggtaggggcgagggcgggggcgagggtaggggcgagggcggggttgagacgaagttcgcgttacggtgttttacgtcggttcgtcgcgatagcgtaggaggttaagacgaggttttttttcgtttcgggtttcgcggtttttacgtagcgcgtacgtatgcgggcgagttttttatttggttggtttttagtttgagcgggttttcgtgagtagaagagaaagtattgttattgtagttaaattttaacgtcgttaacggaacgtcgtttttttttttaggtcgggttttttaatgttacgttaaatttcgcgagagtcgggataaatatcgcgagagtatagtttagatgggggtggttaatcgaaggtggcggtagcgggggcgtacgtacgggggcgtacgtacgggggcgtgtttggggagttttcgaggagtttttagttagcgtttttatatttgcgcgttttttgtttgtttttttttttgaagttagtcgtttaatttgaaagtcgtggatgcgtttgcgttttttatttcgttaggtgtggttgtgagcgtcgcgtatttttcgatatcgcgagatttttttgttttcgagcgttgtgaaggaattgagtgaattgaggttttgagttttcgttagttaagacgtt

SEQ ID NO: 23426 - DNA, 744 bp, Artificial Sequence
  chemically treated genomic DNA (Homo sapiens) CpG-island No: 23426
aacgtcttaactaacgaaaactcaaaacctcaattcactcaattccttcacaacgctcgaaaacaaaaaaatctcgcgatatcgaaaaatacgcgacgctcacaaccacacctaacgaaataaaaaacgcaaacgcatccacgactttcaaattaaacgactaacttcaaaaaaaaaaacaaacaaaaaacgcgcaaatataaaaacgctaactaaaaactcctcgaaaactccccaaacacgcccccgtacgtacgcccccgtacgtacgcccccgctaccgccaccttcgattaaccacccccatctaaactatactctcgcgatatttatcccgactctcgcgaaatttaacgtaacattaaaaaacccgacctaaaaaaaaaaacgacgttccgttaacgacgttaaaatttaactacaataacaatactttctcttctactcacgaaaacccgctcaaactaaaaaccaaccaaataaaaaactcgcccgcatacgtacgcgctacgtaaaaaccgcgaaacccgaaacgaaaaaaaacctcgtcttaacctcctacgctatcgcgacgaaccgacgtaaaacaccgtaacgcgaacttcgtctcaaccccgccctcgcccctaccctcgcccccgccctcgcccctaccctaaccgcttttctccccctctctcccaactcttaccgccacctcgatcgcgataaaaacgcaaaaccgaccgcaataccacttcgaca

SEQ ID NO: 23427 - DNA, 744 bp, Artificial Sequence
  chemically treated genomic DNA (Homo sapiens) CpG-island No: 23427
aacgttttggttaacgaaaatttaaagttttaatttatttagtttttttatagcgttcggaaatagagaagtttcgcggtatcggaaaatgcgcggcgtttatagttatatttgacgagatggagggcgtaggcgtatttacggtttttagattgggcgattgattttaaaggggggggtaaatagggaacgcgtaggtataggagcgttggttggaggtttttcgagagttttttagatacgttttcgtgcgtacgttttcgtgcgtacgttttcgttgtcgttattttcggttgattatttttatttagattgtattttcgcggtatttgtttcgattttcgcggggtttagcgtggtattgggaggttcggtttgggggaggagacggcgtttcgttagcggcgttggggtttggttgtagtggtagtgtttttttttttgtttacggggattcgtttaggttggaggttagttaggtgaagagttcgttcgtatgcgtgcgcgttgcgtgggagtcgcgaggttcggggcgggagggggtttcgttttggttttttgcgttgtcgcgacgggtcggcgtgaggtatcgtggcgcggatttcgttttagtttcgttttcgtttttgttttcgttttcgttttcgtttttgttttgatcgttttttttttttttttttttagtttttgtcgttatttcggtcgcgatgggggcgtaggatcggtcgtagtgttatttcgata

SEQ ID NO: 23428 - DNA, 744 bp, Artificial Sequence
  chemically treated genomic DNA (Homo sapiens) CpG-island No: 23428
tatcgaaataacactacgaccgatcctacgcccccatcgcgaccgaaataacgacaaaaactaaaaaaaaaaaaaaaaaaaacgatcaaaacaaaaacgaaaacgaaaacgaaaacaaaaacgaaaacgaaactaaaacgaaatccgcgccacgatacctcacgccgacccgtcgcgacaacgcaaaaaaccaaaacgaaaccccctcccgccccgaacctcgcgactcccacgcaacgcgcacgcatacgaacgaactcttcacctaactaacctccaacctaaacgaatccccgtaaacaaaaaaaaaaacactaccactacaaccaaaccccaacgccgctaacgaaacgccgtctcctcccccaaaccgaacctcccaataccacgctaaaccccgcgaaaatcgaaacaaataccgcgaaaatacaatctaaataaaaataatcaaccgaaaataacgacaacgaaaacgtacgcacgaaaacgtacgcacgaaaacgtatctaaaaaactctcgaaaaacctccaaccaacgctcctatacctacgcgttccctatttacccccccctttaaaatcaatcgcccaatctaaaaaccgtaaatacgcctacgccctccatctcgtcaaatataactataaacgccgcgcattttccgataccgcgaaacttctctatttccgaacgctataaaaaaactaaataaattaaaactttaaattttcgttaaccaaaacgtt

SEQ ID NO: 23429 - DNA, 677 bp, Artificial Sequence
  chemically treated genomic DNA (Homo sapiens) CpG-island No: 23429
atgcggtaggtcgtttttgtagtgttttggcgggagtcgcggcggtcgtcgtagtagtattcgagacgcgtcgggtaaattcgtcgttttggtttattcgttcgacgttttttttagttggataatcgttttacggagtagttacggcgaaaatgttttttttttatttttatttttatcggttgttagtaatttggagacgtcgtttttttttcggtgtagggagtttcggaggatgcggggcggaaaagtaaaatattattttttttcgaagtttcgaggtaaatgacgataaatagtattttcgtttttttttaatattatgggagtttttgattcgatttcgaaggaggcgggcgggcgagagtttggatttatatggttttttagtttttttcgtttttcgtattttagcgcggatttcgttaaggttacgcggcgcgttaggagtttttaggagtttggagtggagtagggtgcgtgcggcggcgggttcgttcggtttatttttgggcgttgtaagattagtagaaatttgagaaagcgtttggaatatcgagtagcgattggtttattcgggcgtgggttggggagggcgggggagggtaggagcgaggaggtggatggaaaatatgagggggtggtttggaagagagcggggttgttatttagttttt

SEQ ID NO: 23430 - DNA, 677 bp, Artificial Sequence
  chemically treated genomic DNA (Homo sapiens) CpG-island No: 23430
aaaaactaaataacaaccccgctctcttccaaaccaccccctcatattttccatccacctcctcgctcctaccctcccccgccctccccaacccacgcccgaataaaccaatcgctactcgatattccaaacgctttctcaaatttctactaatcttacaacgcccaaaaataaaccgaacgaacccgccgccgcacgcaccctactccactccaaactcctaaaaactcctaacgcgccgcgtaaccttaacgaaatccgcgctaaaatacgaaaaacgaaaaaaactaaaaaaccatataaatccaaactctcgcccgcccgcctccttcgaaatcgaatcaaaaactcccataatattaaaaaaaaacgaaaatactatttatcgtcatttacctcgaaacttcgaaaaaaaataatattttacttttccgccccgcatcctccgaaactccctacaccgaaaaaaaaacgacgtctccaaattactaacaaccgataaaaataaaaataaaaaaaaaacattttcgccgtaactactccgtaaaacgattatccaactaaaaaaaacgtcgaacgaataaaccaaaacgacgaatttacccgacgcgtctcgaatactactacgacgaccgccgcgactcccgccaaaacactacaaaaacgacctaccgcat

SEQ ID NO: 23431 - DNA, 677 bp, Artificial Sequence
  chemically treated genomic DNA (Homo sapiens) CpG-island No: 23431
gggaattgaatgataatttcgtttttttttaaattatttttttatattttttatttattttttcgtttttgttttttttcgttttttttaatttacgttcgggtgggttaatcgttgttcggtattttaggcgtttttttaggtttttgttgattttgtagcgtttagaaatggatcgagcggattcgtcgtcgtacgtattttgttttattttaagtttttaagggtttttggcgcgtcgcgtagttttggcgaggttcgcgttggggtgcggagagcgaagggaattggagagttatgtagatttaggttttcgttcgttcgtttttttcgggatcgaattaagggtttttatagtgttaggagggggcgagagtgttgtttatcgttatttgtttcggagtttcgagagagggtggtattttgttttttcgtttcgtatttttcggaattttttgtatcggagagaggacggcgtttttaggttgttggtaatcggtgagaatgggggtagggaaggaatattttcgtcgtagttgtttcgtaaagcgattgtttaattgagaggggcgtcggacgagtggattagggcggcgagtttgttcggcgcgtttcggatgttgttgcggcggtcgtcgcggttttcgttagggtattgtaaagacgatttgtcgtat

SEQ ID NO: 23432 - DNA, 677 bp, Artificial Sequence
  chemically treated genomic DNA (Homo sapiens) CpG-island No: 23432
atacgacaaatcgtctttacaataccctaacgaaaaccgcgacgaccgccgcaacaacatccgaaacgcgccgaacaaactcgccgccctaatccactcgtccgacgcccctctcaattaaacaatcgctttacgaaacaactacgacgaaaatattccttccctacccccattctcaccgattaccaacaacctaaaaacgccgtcctctctccgatacaaaaaattccgaaaaatacgaaacgaaaaaacaaaataccaccctctctcgaaactccgaaacaaataacgataaacaacactctcgccccctcctaacactataaaaacccttaattcgatcccgaaaaaaacgaacgaacgaaaacctaaatctacataactctccaattcccttcgctctccgcaccccaacgcgaacctcgccaaaactacgcgacgcgccaaaaacccttaaaaacttaaaataaaacaaaatacgtacgacgacgaatccgctcgatccatttctaaacgctacaaaatcaacaaaaacctaaaaaaacgcctaaaataccgaacaacgattaacccacccgaacgtaaattaaaaaaaacgaaaaaaaacaaaaacgaaaaaataaataaaaaatataaaaaaataatttaaaaaaaaacgaaattatcattcaattccc

SEQ ID NO: 23433 - DNA, 511 bp, Artificial Sequence
  chemically treated genomic DNA (Homo sapiens) CpG-island No: 23433
gttcggtgcgtgtttagttgaattaggcggttgcggaaaaaaaaaagcggggagaaagtagggttcggttattagcggttttacgggcgtacgtagtttaggttttaagattttgggttgggattggttgagtttggcgggaggcggggttcgagttatcgtttgtcgtcgcgttttcggtttttataaattgagttcgtagtttttcgtttcgttttttgttttttttgttcgatagttagtcgtatttttttttgcgtcgttaggtgaagacgggcggagagaaattcgggaggttagggacggtttgaaggcggtaggggcgggcgtaggtcggatgtgttcgcgtcgttgcggggtgggttcgggcggttttcgtattgtaggggcgggcggaggacgtgatgcggcgcgggttgggtatggaggtttggtgggggaggggaggggaggcgtgtgtgtcggtcggggttattaggcgtttattgtttttttttttcgcgtagtcgag

SEQ ID NO: 23434 - DNA, 511 bp, Artificial Sequence
  chemically treated genomic DNA (Homo sapiens) CpG-island No: 23434
ctcgactacgcgaaaaaaaaaaacaataaacgcctaataaccccgaccgacacacacgcctcccctcccctcccccaccaaacctccatacccaacccgcgccgcatcacgtcctccgcccgcccctacaatacgaaaaccgcccgaacccaccccgcaacgacgcgaacacatccgacctacgcccgcccctaccgccttcaaaccgtccctaacctcccgaatttctctccgcccgtcttcacctaacgacgcaaaaaaaaatacgactaactatcgaacaaaaaaaacaaaaaacgaaacgaaaaactacgaactcaatttataaaaaccgaaaacgcgacgacaaacgataactcgaaccccgcctcccgccaaactcaaccaatcccaacccaaaatcttaaaacctaaactacgtacgcccgtaaaaccgctaataaccgaaccctactttctccccgcttttttttttccgcaaccgcctaattcaactaaacacgcaccgaac

SEQ ID NO: 23435 - DNA, 511 bp, Artificial Sequence
  chemically treated genomic DNA (Homo sapiens) CpG-island No: 23435
ttcggttgcgcggagggagagaatagtgagcgtttagtggtttcggtcgatatatacgttttttttttttttttttattaggtttttatgtttagttcgcgtcgtattacgtttttcgttcgtttttgtaatgcggaggtcgttcgggtttatttcgtagcggcgcgaatatattcggtttgcgttcgtttttgtcgtttttaggtcgtttttagtttttcgggttttttttcgttcgtttttatttggcgacgtaaaagaagatgcggttgattgtcgaataggaggagtagagagcgaagcgggaggttgcgggtttaatttatagaaatcgggggcgcggcggtaggcggtgattcggatttcgtttttcgttaggtttagttagttttagtttaaggttttgaggtttgagttacgtgcgttcgtaaaatcgttagtagtcgggttttatttttttttcgttttttttttttcgtagtcgtttggtttaattgggtacgtatcgagt

SEQ ID NO: 23436 - DNA, 511 bp, Artificial Sequence
  chemically treated genomic DNA (Homo sapiens) CpG-island No: 23436
actcgatacgtacccaattaaaccaaacgactacgaaaaaaaaaaaacgaaaaaaaaataaaacccgactactaacgattttacgaacgcacgtaactcaaacctcaaaaccttaaactaaaactaactaaacctaacgaaaaacgaaatccgaatcaccgcctaccgccgcgcccccgatttctataaattaaacccgcaacctcccgcttcgctctctactcctcctattcgacaatcaaccgcatcttcttttacgtcgccaaataaaaacgaacgaaaaaaaacccgaaaaactaaaaacgacctaaaaacgacaaaaacgaacgcaaaccgaatatattcgcgccgctacgaaataaacccgaacgacctccgcattacaaaaacgaacgaaaaacgtaatacgacgcgaactaaacataaaaacctaataaaaaaaaaaaaaaaaaacgtatatatcgaccgaaaccactaaacgctcactattctctccctccgcgcaaccgaa

SEQ ID NO: 23437 - DNA, 535 bp, Artificial Sequence
  chemically treated genomic DNA (Homo sapiens) CpG-island No: 23437
tttgttttttttttttaatttttattttcgtttgtattcgtttcgttttcgttttattttggttagtacgttgtagagagcgcggatttcgggcgtgatggtgtcgatttggacgtttattttattcgggtgtatttacgataagttaggtttttgtattagagtgggttttagtttcggttcgagtcggcgggcgtgcgagaacgattagatggtgtcgggtatgaagcgggtcgacgaggaataggtggtggaggtggaggtggaggacgacgagaggttggtcgcggagggcgcgagggggtcggtcggggagcgcgcgggcgagtttagtacgcgcgtcgaagggttgtagatagcggtcggtcgggcgtttagttgtagttttaggggtcggatggggttgacgaagtcggtttgtattgtttggtcgcgacgatttaggtttcgtcggttttgtttatttttttttagcgtttgttgtagttgtttttttaatagtcggtttcggcgttttagtttatgtattttggtt

SEQ ID NO: 23438 - DNA, 535 bp, Artificial Sequence
  chemically treated genomic DNA (Homo sapiens) CpG-island No: 23438
aaccaaaatacataaactaaaacgccgaaaccgactattaaaaaaacaactacaacaaacgctaaaaaaaaataaacaaaaccgacgaaacctaaatcgtcgcgaccaaacaatacaaaccgacttcgtcaaccccatccgacccctaaaactacaactaaacgcccgaccgaccgctatctacaacccttcgacgcgcgtactaaactcgcccgcgcgctccccgaccgaccccctcgcgccctccgcgaccaacctctcgtcgtcctccacctccacctccaccacctattcctcgtcgacccgcttcatacccgacaccatctaatcgttctcgcacgcccgccgactcgaaccgaaactaaaacccactctaatacaaaaacctaacttatcgtaaatacacccgaataaaataaacgtccaaatcgacaccatcacgcccgaaatccgcgctctctacaacgtactaaccaaaataaaacgaaaacgaaacgaatacaaacgaaaataaaaattaaaaaaaaaaaacaaa

SEQ ID NO: 23439 - DNA, 535 bp, Artificial Sequence
  chemically treated genomic DNA (Homo sapiens) CpG-island No: 23439
ggttaaggtgtatgagttggagcgtcggaatcggttgttggagaagtaattgtagtaagcgttggaggagggtaagtagggtcggcggggtttgggtcgtcgcgattaggtagtgtagatcggtttcgttagttttattcggtttttggggttgtagttgggcgttcggtcggtcgttgtttgtagtttttcggcgcgcgtgttgggttcgttcgcgcgtttttcggtcggttttttcgcgtttttcgcggttagtttttcgtcgttttttatttttatttttattatttatttttcgtcggttcgttttatgttcggtattatttggtcgttttcgtacgttcgtcggttcgggtcgggattggagtttattttggtgtaagggtttggtttgtcgtgggtgtattcggatggggtgggcgtttagatcgatattattacgttcgagattcgcgttttttataacgtgttggttaaagtgaagcgggagcgggacgagtataagcggaggtagggattgggaaagggggatagg

SEQ ID NO: 23440 - DNA, 535 bp, Artificial Sequence
  chemically treated genomic DNA (Homo sapiens) CpG-island No: 23440
cctatccccctttcccaatccctacctccgcttatactcgtcccgctcccgcttcactttaaccaacacgttataaaaaacgcgaatctcgaacgtaataatatcgatctaaacgcccaccccatccgaatacacccacgacaaaccaaacccttacaccaaaataaactccaatcccgacccgaaccgacgaacgtacgaaaacgaccaaataataccgaacataaaacgaaccgacgaaaaataaataataaaaataaaaataaaaaacgacgaaaaactaaccgcgaaaaacgcgaaaaaaccgaccgaaaaacgcgcgaacgaacccaacacgcgcgccgaaaaactacaaacaacgaccgaccgaacgcccaactacaaccccaaaaaccgaataaaactaacgaaaccgatctacactacctaatcgcgacgacccaaaccccgccgaccctacttaccctcctccaacgcttactacaattacttctccaacaaccgattccgacgctccaactcatacaccttaacc

SEQ ID NO: 23441 - DNA, 507 bp, Artificial Sequence
  chemically treated genomic DNA (Homo sapiens) CpG-island No: 23441
  misc_feature (396)..(396): n is either a, c, g or t
cgcgggttcggagacgtttgaggaaggggcgggtgacgggatgattttcggggttggtagggtcgtgaggggcgtttttttgggaatttcgcgttttttttatttcggagtcgtcgtaggtcgcgttgggttcggttcggtgttattttcgtttcggttttttttcgtcgcggtcgaaggggggaaaatggtttcggttttagcgtcgttttttaaagggtttgaaatatcggtcgggaaattttatcgtataggtttcgtttttttacggatagtttataataattttaattaattttaattttttttttttattatcgttatttttttttttaggtttttcgggtaattttcgttttttcgtcgtttaggtaattattggttacgttttttttngagcgggcgcgcgcgcgttatttgggtaatcgtttattttttggttattttataatatatacggatatttttttttttaatatatatatatatatatatatatatatatat

SEQ ID NO: 23442 - DNA, 507 bp, Artificial Sequence
  chemically treated genomic DNA (Homo sapiens) CpG-island No: 23442
  misc_feature (112)..(112): n is either a, c, g or t
atatatatatatatatatatatatatatatattaaaaaaaaaaatatccgtatatattataaaataaccaaaaaataaacgattacccaaataacgcgcgcgcgcccgctcnaaaaaaaacgtaaccaataattacctaaacgacgaaaaaacgaaaattacccgaaaaacctaaaaaaaaaaataacgataataaaaaaaaaaaattaaaattaattaaaattattataaactatccgtaaaaaaacgaaacctatacgataaaatttcccgaccgatatttcaaaccctttaaaaaacgacgctaaaaccgaaaccattttccccccttcgaccgcgacgaaaaaaaaccgaaacgaaaataacaccgaaccgaacccaacgcgacctacgacgactccgaaataaaaaaaacgcgaaattcccaaaaaaacgcccctcacgaccctaccaaccccgaaaatcatcccgtcacccgccccttcctcaaacgtctccgaacccgcg

SEQ ID NO: 23443 - DNA, 507 bp, Artificial Sequence
  chemically treated genomic DNA (Homo sapiens) CpG-island No: 23443
  misc_feature (112)..(112): n is either a, c, g or t
gtgtgtgtgtgtgtgtgtgtgtgtgtgtgtgttgggggggggggtgttcgtgtgtattatgggatggttaggaggtgggcggttgtttaggtgacgcgcgcgcgttcgtttngaagggggcgtggttagtggttgtttgagcgacgagggggcgggggttgttcgggagatttggggaggagggtggcggtagtggaaggggggggttggagttggttgaggttattatgggttgttcgtgggggggcggggtttgtgcggtgggatttttcggtcggtgttttaggttttttaagaggcgacgttggagtcggagttattttttttttttcggtcgcggcgaggaggagtcggagcgggagtgatatcgagtcggatttagcgcgatttgcggcggtttcggggtgaggagagcgcggggtttttaaagagacgttttttacggttttattagtttcgagggttatttcgttattcgttttttttttaggcgttttcggattcgcg

SEQ ID NO: 23444 - DNA, 507 bp, Artificial Sequence
  chemically treated genomic DNA (Homo sapiens) CpG-island No: 23444
  misc_feature (396)..(396): n is either a, c, g or t
cgcgaatccgaaaacgcctaaaaaaaaaacgaataacgaaataaccctcgaaactaataaaaccgtaaaaaacgtctctttaaaaaccccgcgctctcctcaccccgaaaccgccgcaaatcgcgctaaatccgactcgatatcactcccgctccgactcctcctcgccgcgaccgaaaaaaaaaaaataactccgactccaacgtcgcctcttaaaaaacctaaaacaccgaccgaaaaatcccaccgcacaaaccccgcccccccacgaacaacccataataacctcaaccaactccaaccccccccttccactaccgccaccctcctccccaaatctcccgaacaacccccgccccctcgtcgctcaaacaaccactaaccacgcccccttcnaaacgaacgcgcgcgcgtcacctaaacaaccgcccacctcctaaccatcccataatacacacgaacacccccccccccaacacacacacacacacacacacacacacacac

SEQ ID NO: 23445 - DNA, 586 bp, Artificial Sequence
  chemically treated genomic DNA (Homo sapiens) CpG-island No: 23445
attttcggggtatgggttcgatggtttatgggaaggatgtaattagtattttcggggtatgggttcgatggtttatgggaaggatgtaattagtattttcggggtatgggttcgatggtttatgggaaggatgtaattagtattttcggggtatgggttcgatggtttatgggaaggatgtaattagtattttcggggtatgggttcgatggtttatgggaaggatgtaattagtattttcggggtatgggttcgatggtttatgggaaggatgtaattagtattttcggggtatgggttcgatggtttatgggaaggatgtaattagtattttcggggtatgggttcgatggtttatgggaaggatgtaattagtattttcggggtatgggttcgatggtttatgggaaggatgtaattagtattttcggggtatgggttcgatggtttatgggaaggatgtaattagtattttcggggtatgggttcgatggtttatgggaaggatgtaattagtattttcggggtatgggttcgatggtttatgggaaggatgtaattagtattttcggggtatgggtttgat

SEQ ID NO: 23446 - DNA, 586 bp, Artificial Sequence
  chemically treated genomic DNA (Homo sapiens) CpG-island No: 23446
atcaaacccataccccgaaaatactaattacatccttcccataaaccatcgaacccataccccgaaaatactaattacatccttcccataaaccatcgaacccataccccgaaaatactaattacatccttcccataaaccatcgaacccataccccgaaaatactaattacatccttcccataaaccatcgaacccataccccgaaaatactaattacatccttcccataaaccatcgaacccataccccgaaaatactaattacatccttcccataaaccatcgaacccataccccgaaaatactaattacatccttcccataaaccatcgaacccataccccgaaaatactaattacatccttcccataaaccatcgaacccataccccgaaaatactaattacatccttcccataaaccatcgaacccataccccgaaaatactaattacatccttcccataaaccatcgaacccataccccgaaaatactaattacatccttcccataaaccatcgaacccataccccgaaaatactaattacatccttcccataaaccatcgaacccataccccgaaaat

SEQ ID NO: 23447 - DNA, 586 bp, Artificial Sequence
  chemically treated genomic DNA (Homo sapiens) CpG-island No: 23447
attaagtttatatttcgaaaatgttggttatattttttttataagttatcgagtttatatttcgaaaatgttggttatattttttttataagttatcgagtttatatttcgaaaatgttggttatattttttttataagttatcgagtttatatttcgaaaatgttggttatattttttttataagttatcgagtttatatttcgaaaatgttggttatattttttttataagttatcgagtttatatttcgaaaatgttggttatattttttttataagttatcgagtttatatttcgaaaatgttggttatattttttttataagttatcgagtttatatttcgaaaatgttggttatattttttttataagttatcgagtttatatttcgaaaatgttggttatattttttttataagttatcgagtttatatttcgaaaatgttggttatattttttttataagttatcgagtttatatttcgaaaatgttggttatattttttttataagttatcgagtttatatttcgaaaatgttggttatattttttttataagttatcgagtttatatttcgaaaat

SEQ ID NO: 23448 - DNA, 586 bp, Artificial Sequence
  chemically treated genomic DNA (Homo sapiens) CpG-island No: 23448
attttcgaaatataaactcgataacttataaaaaaaatataaccaacattttcgaaatataaactcgataacttataaaaaaaatataaccaacattttcgaaatataaactcgataacttataaaaaaaatataaccaacattttcgaaatataaactcgataacttataaaaaaaatataaccaacattttcgaaatataaactcgataacttataaaaaaaatataaccaacattttcgaaatataaactcgataacttataaaaaaaatataaccaacattttcgaaatataaactcgataacttataaaaaaaatataaccaacattttcgaaatataaactcgataacttataaaaaaaatataaccaacattttcgaaatataaactcgataacttataaaaaaaatataaccaacattttcgaaatataaactcgataacttataaaaaaaatataaccaacattttcgaaatataaactcgataacttataaaaaaaatataaccaacattttcgaaatataaactcgataacttataaaaaaaatataaccaacattttcgaaatataaacttaat

SEQ ID NO: 23449 - DNA, 705 bp, Artificial Sequence
  chemically treated genomic DNA (Homo sapiens) CpG-island No: 23449
atagcgcgggagcgcggattttttggaggcgcgcggcgtttatcgttgttcgttttcgaagtttcgtttcggggtttcgttttcgtcggcgcgtgtttttttagggatcgcgcgcgtcgcggtttcgttttggggtcggtatttgcgcgttcgtatttcgcgtttttcgtttcgtttttcgtttcgcgttttacgcgcgttttagcgttgggggtttttttttcgcggcgggaatgtttggtcggtttcggtagtacggcgcggtttaggttttcgcgtttacgacgggttagcgcgttgggttatgattcggttgggcggttggtgtgcgcggcggttttgtagcgcggcggttttcgcggggcggcgcggggcggcgggcgggttgggtttggcgggaggtcgcgttttacgggtgttggtggatatggacggcgtgttggttgatttcgagggcggattttttaggaagtttcgcgcgcgttttttcgattagttttttatcgcgttggaggatcggcgcggtttttgggtgtcggagtagtacggtcgtttgcggttagggttgagcgtgagcgttttcgtttcgtttcgcgtcgggtttttttttcgtttcgagttttagatatcgtttttgcgtcggtgattttggacggttagcgttttagtttcggggtggttttttgatagaatagggtttggggg

SEQ ID NO: 23450 - DNA, 705 bp, Artificial Sequence
  chemically treated genomic DNA (Homo sapiens) CpG-island No: 23450
cccccaaaccctattctatcaaaaaaccaccccgaaactaaaacgctaaccgtccaaaatcaccgacgcaaaaacgatatctaaaactcgaaacgaaaaaaaaacccgacgcgaaacgaaacgaaaacgctcacgctcaaccctaaccgcaaacgaccgtactactccgacacccaaaaaccgcgccgatcctccaacgcgataaaaaactaatcgaaaaaacgcgcgcgaaacttcctaaaaaatccgccctcgaaatcaaccaacacgccgtccatatccaccaacacccgtaaaacgcgacctcccgccaaacccaacccgcccgccgccccgcgccgccccgcgaaaaccgccgcgctacaaaaccgccgcgcacaccaaccgcccaaccgaatcataacccaacgcgctaacccgtcgtaaacgcgaaaacctaaaccgcgccgtactaccgaaaccgaccaaacattcccgccgcgaaaaaaaaacccccaacgctaaaacgcgcgtaaaacgcgaaacgaaaaacgaaacgaaaaacgcgaaatacgaacgcgcaaataccgaccccaaaacgaaaccgcgacgcgcgcgatccctaaaaaaacacgcgccgacgaaaacgaaaccccgaaacgaaacttcgaaaacgaacaacgataaacgccgcgcgcctccaaaaaatccgcgctcccgcgctat

SEQ ID NO: 23451 - DNA, 705 bp, Artificial Sequence
  chemically treated genomic DNA (Homo sapiens) CpG-island No: 23451
tttttagattttattttattagagggttatttcgaggttggggcgttgatcgtttaaggttatcggcgtaggggcggtgtttggggttcggggcgagaaggaggttcggcgcggggcggggcggggacgtttacgtttagttttggtcgtaggcggtcgtattgtttcgatatttagaagtcgcgtcggttttttagcgcgatgaagggttggtcgggaaagcgcgcgcggaattttttgaggaattcgttttcgaagttagttagtacgtcgtttatgtttattagtattcgtagggcgcggtttttcgttaggtttagttcgttcgtcgtttcgcgtcgtttcgcgggaatcgtcgcgttgtagagtcgtcgcgtatattagtcgtttagtcggattatggtttagcgcgttggttcgtcgtgggcgcggggatttgggtcgcgtcgtgttgtcggagtcggttagatattttcgtcgcggaggagaagtttttaacgttggggcgcgcgtggagcgcgggacggggagcggggcggggagcgcggggtgcgggcgcgtaagtatcggttttagagcgaggtcgcggcgcgcgcggtttttaaaggaatacgcgtcggcggaggcggagtttcggggcggggtttcgaggacggatagcggtaagcgtcgcgcgtttttagaaggttcgcgttttcgcgttgt

SEQ ID NO: 23452 - DNA, 705 bp, Artificial Sequence
  chemically treated genomic DNA (Homo sapiens) CpG-island No: 23452
acaacgcgaaaacgcgaaccttctaaaaacgcgcgacgcttaccgctatccgtcctcgaaaccccgccccgaaactccgcctccgccgacgcgtattcctttaaaaaccgcgcgcgccgcgacctcgctctaaaaccgatacttacgcgcccgcaccccgcgctccccgccccgctccccgtcccgcgctccacgcgcgccccaacgttaaaaacttctcctccgcgacgaaaatatctaaccgactccgacaacacgacgcgacccaaatccccgcgcccacgacgaaccaacgcgctaaaccataatccgactaaacgactaatatacgcgacgactctacaacgcgacgattcccgcgaaacgacgcgaaacgacgaacgaactaaacctaacgaaaaaccgcgccctacgaatactaataaacataaacgacgtactaactaacttcgaaaacgaattcctcaaaaaattccgcgcgcgctttcccgaccaacccttcatcgcgctaaaaaaccgacgcgacttctaaatatcgaaacaatacgaccgcctacgaccaaaactaaacgtaaacgtccccgccccgccccgcgccgaacctccttctcgccccgaaccccaaacaccgcccctacgccgataaccttaaacgatcaacgccccaacctcgaaataaccctctaataaaataaaatctaaaaa

SEQ ID NO: 23453 - DNA, 533 bp, Artificial Sequence
  chemically treated genomic DNA (Homo sapiens) CpG-island No: 23453
gacgcgtaagcgtagtttgttagtttggtttttttttaaagtttgcgtgtaggttggcggcgggagatcgggtttcgcgatgcgagtgagcgtgtgcgtgcgcggttttcgcgagttcgcgtacgtcgtttttaatattatagggtggtagcggttttttcgtattgcgttcggggtaggatcgtgcgcggcggtcgcggcgggtgttgggagttagcgtttgtttcgtcgtcgttttcgttgtttgttatttcgttttggttcgtttttcgtatcgtgtagaggcggcgggttggggagggagcggcgttagtacgaggtttttagtcgttgggaagtttttagacgcgtcgaggggtcgggttacgagcggttgaggtaggtaggggtgcgcgggttggttagtcggtcgggagcggggtagggcggcggcgagaacgggcgtttcgttgatcggggagaagaggttttttgttaaggggttttagtgtagtcggagtgagaggaggggtttcggacgtagtttgtttttt

SEQ ID NO: 23454 - DNA, 533 bp, Artificial Sequence
  chemically treated genomic DNA (Homo sapiens) CpG-island No: 23454
aaaaaacaaactacgtccgaaacccctcctctcactccgactacactaaaaccccttaacaaaaaacctcttctccccgatcaacgaaacgcccgttctcgccgccgccctaccccgctcccgaccgactaaccaacccgcgcacccctacctacctcaaccgctcgtaacccgacccctcgacgcgtctaaaaacttcccaacgactaaaaacctcgtactaacgccgctccctccccaacccgccgcctctacacgatacgaaaaacgaaccaaaacgaaataacaaacaacgaaaacgacgacgaaacaaacgctaactcccaacacccgccgcgaccgccgcgcacgatcctaccccgaacgcaatacgaaaaaaccgctaccaccctataatattaaaaacgacgtacgcgaactcgcgaaaaccgcgcacgcacacgctcactcgcatcgcgaaacccgatctcccgccgccaacctacacgcaaactttaaaaaaaaaccaaactaacaaactacgcttacgcgtc

SEQ ID NO: 23455 - DNA, 533 bp, Artificial Sequence
  chemically treated genomic DNA (Homo sapiens) CpG-island No: 23455
gaagagtaggttacgttcggggtttttttttttatttcggttatattagggttttttggtaggaggtttttttttttcggttagcgaggcgttcgttttcgtcgtcgttttatttcgttttcggtcggttgattagttcgcgtatttttatttattttagtcgttcgtagttcggtttttcggcgcgtttaggggttttttagcggttgggaatttcgtgttggcgtcgttttttttttagttcgtcgtttttgtacggtgcggagaacgggttaagacggagtggtaggtagcgagggcggcggcgaggtaggcgttggtttttagtattcgtcgcggtcgtcgcgtacggttttgtttcggacgtagtacgaagaggtcgttattattttgtagtgttagaggcggcgtgcgcgagttcgcgagggtcgcgtacgtatacgtttattcgtatcgcgagattcgatttttcgtcgttaatttgtacgtaagttttgggagggagttaggttggtaggttgcgtttgcgcgtt

SEQ ID NO: 23456 - DNA, 533 bp, Artificial Sequence
  chemically treated genomic DNA (Homo sapiens) CpG-island No: 23456
aacgcgcaaacgcaacctaccaacctaactccctcccaaaacttacgtacaaattaacgacgaaaaatcgaatctcgcgatacgaataaacgtatacgtacgcgaccctcgcgaactcgcgcacgccgcctctaacactacaaaataataacgacctcttcgtactacgtccgaaacaaaaccgtacgcgacgaccgcgacgaatactaaaaaccaacgcctacctcgccgccgccctcgctacctaccactccgtcttaacccgttctccgcaccgtacaaaaacgacgaactaaaaaaaaaacgacgccaacacgaaattcccaaccgctaaaaaacccctaaacgcgccgaaaaaccgaactacgaacgactaaaataaataaaaatacgcgaactaatcaaccgaccgaaaacgaaataaaacgacgacgaaaacgaacgcctcgctaaccgaaaaaaaaaaacctcctaccaaaaaaccctaatataaccgaaataaaaaaaaaaaccccgaacgtaacctactcttc

SEQ ID NO: 23457 - DNA, 884 bp, Artificial Sequence
  chemically treated genomic DNA (Homo sapiens) CpG-island No: 23457
agtttcgtcgtttaattgtttcgttttggtttacgatatttttttgttcgtatggattgcgcgtagcgtcgttaagcggggagtttagttcggtgttagcgttcgcgaagcggaggaggtcggcgttcgaggttgggcgaagttttttttagcgtagcgaggatcggagggtaaggttagcgcgcgtcgggcgatttgcgtttcgggtatagacgcgacgggttcgtacggggcggggatcgcgcgcgtttgttgggtttacggttgtggggcgcgtagagtttatttggcggttaagggcgttggcgatcgttgaagtttttgggggtgttcggggttcgggttgcgtttgtgttcgcgggaaggttgggcgttttttatatatagatttcgtttcgggttagtttcgtagggagattattagggttggcggtagttgggcgtggtcgggtcgggggcggttgtgggcggtcggtaggtagcgcgcggggtagttttcggtagacggttaatggcggcggtgttcggggcgttcggggcgacgcggcgtttgttggcggcgttgcgaggttagagtttagggttagcggttatggtgagtgtatagcggtcgcgtgggtgggggttcggggtcggggggcggtgcgaggttcggcggcgtcggttgagggattagcgggattggggcgaattcggcgtgggtcgagttttggagttcgggcgtcgggttatcgcgtttcgggattgattatttgttcggtgcgtcgtttagagatcggggtggtcgtagttttcgttatttgtttttgattttatattttcgtcgaagtttacgaatttgttaatcggaaataaatgggaacgaattttgtttagtaattata

SEQ ID NO: 23458 - DNA, 884 bp, Artificial Sequence
  chemically treated genomic DNA (Homo sapiens) CpG-island No: 23458
tataattactaaacaaaattcgttcccatttatttccgattaacaaattcgtaaacttcgacgaaaatataaaatcaaaaacaaataacgaaaactacgaccaccccgatctctaaacgacgcaccgaacaaataatcaatcccgaaacgcgataacccgacgcccgaactccaaaactcgacccacgccgaattcgccccaatcccgctaatccctcaaccgacgccgccgaacctcgcaccgccccccgaccccgaacccccacccacgcgaccgctatacactcaccataaccgctaaccctaaactctaacctcgcaacgccgccaacaaacgccgcgtcgccccgaacgccccgaacaccgccgccattaaccgtctaccgaaaactaccccgcgcgctacctaccgaccgcccacaaccgcccccgacccgaccacgcccaactaccgccaaccctaataatctccctacgaaactaacccgaaacgaaatctatatataaaaaacgcccaaccttcccgcgaacacaaacgcaacccgaaccccgaacacccccaaaaacttcaacgatcgccaacgcccttaaccgccaaataaactctacgcgccccacaaccgtaaacccaacaaacgcgcgcgatccccgccccgtacgaacccgtcgcgtctatacccgaaacgcaaatcgcccgacgcgcgctaaccttaccctccgatcctcgctacgctaaaaaaaacttcgcccaacctcgaacgccgacctcctccgcttcgcgaacgctaacaccgaactaaactccccgcttaacgacgctacgcgcaatccatacgaacaaaaaaatatcgtaaaccaaaacgaaacaattaaacgacgaaact

SEQ ID NO: 23459 - DNA, 884 bp, Artificial Sequence
  chemically treated genomic DNA (Homo sapiens) CpG-island No: 23459
tgtagttgttgaataaaattcgtttttatttgttttcggttggtaagttcgtaggtttcggcggaagtgtaaagttaagggtaagtggcggaggttgcggttatttcggtttttgagcggcgtatcggataggtggttagtttcgggacgcggtgattcgacgttcgagttttaaggttcggtttacgtcgggttcgttttagtttcgttggttttttagtcgacgtcgtcgggtttcgtatcgtttttcgatttcggatttttatttacgcggtcgttgtgtatttattatggtcgttagttttaggttttggtttcgtagcgtcgttaataagcgtcgcgtcgtttcgagcgtttcgagtatcgtcgttattggtcgtttgtcgagggttgtttcgcgcgttgtttgtcggtcgtttatagtcgttttcgattcgattacgtttagttatcgttagttttggtagtttttttgcggggttggttcggagcggggtttgtgtgtgggaagcgtttagttttttcgcgggtataggcgtagttcggatttcgaatatttttaggagttttagcggtcgttagcgtttttggtcgttaggtggattttgcgcgttttatagtcgtaggtttagtaggcgcgcgcggttttcgtttcgtgcgggttcgtcgcgtttgtgttcgggacgtaggtcgttcggcgcgcgttggttttgtttttcggttttcgttgcgttaggaggaatttcgtttagtttcgggcgtcggtttttttcgtttcgcgggcgttagtatcgagttgggtttttcgtttggcggcgttgcgcgtagtttatgcgggtaggaggatgtcgtaggttagggcggggtagttgagcggcggggtt

SEQ ID NO: 23460 - DNA, 884 bp, Artificial Sequence
  chemically treated genomic DNA (Homo sapiens) CpG-island No: 23460
aaccccgccgctcaactaccccgccctaacctacgacatcctcctacccgcataaactacgcgcaacgccgccaaacgaaaaacccaactcgatactaacgcccgcgaaacgaaaaaaaccgacgcccgaaactaaacgaaattcctcctaacgcaacgaaaaccgaaaaacaaaaccaacgcgcgccgaacgacctacgtcccgaacacaaacgcgacgaacccgcacgaaacgaaaaccgcgcgcgcctactaaacctacgactataaaacgcgcaaaatccacctaacgaccaaaaacgctaacgaccgctaaaactcctaaaaatattcgaaatccgaactacgcctatacccgcgaaaaaactaaacgcttcccacacacaaaccccgctccgaaccaaccccgcaaaaaaactaccaaaactaacgataactaaacgtaatcgaatcgaaaacgactataaacgaccgacaaacaacgcgcgaaacaaccctcgacaaacgaccaataacgacgatactcgaaacgctcgaaacgacgcgacgcttattaacgacgctacgaaaccaaaacctaaaactaacgaccataataaatacacaacgaccgcgtaaataaaaatccgaaatcgaaaaacgatacgaaacccgacgacgtcgactaaaaaaccaacgaaactaaaacgaacccgacgtaaaccgaaccttaaaactcgaacgtcgaatcaccgcgtcccgaaactaaccacctatccgatacgccgctcaaaaaccgaaataaccgcaacctccgccacttacccttaactttacacttccgccgaaacctacgaacttaccaaccgaaaacaaataaaaacgaattttattcaacaactaca

SEQ ID NO: 23461 - DNA, 557 bp, Artificial Sequence
  chemically treated genomic DNA (Homo sapiens) CpG-island No: 23461
gggattggttggtgtcgcgagaagaggggggcgttgtcgtagagaggcgaggcggggtagagttgcggggtgggggcggggcgttgtcgttggggcggagtcgagttagtggagggcggtgggggcggggtaagcgcggaggattagggatcggtttcggatcgcgtagttagcgtcgtttggtttgggtcggattcggttagggtttttaagttgtcgtttttatggggttgtgttttttttgtttcggggagttcgcgttttttacgtcggatttggtgagtagagtaggtttttgcgttcgtcgggtcgcgttttgagtatttgttttcgggttgcggggcgggtcgagttattgtatttggtggcgtaggtcgagagttcgttgggggattttgttagcgaggacgggtggacgcgttaggagggtcgttgggttttgttagagcgatttaggtcgtcgttttcgtgtagatttttatttttgtaataaaaagttgtcgaaaggcggttgtggcgtttttttattttttattgattttagttgcgtcggattt

SEQ ID NO: 23462 - DNA, 557 bp, Artificial Sequence
  chemically treated genomic DNA (Homo sapiens) CpG-island No: 23462
aaatccgacgcaactaaaatcaataaaaaataaaaaaacgccacaaccgcctttcgacaactttttattacaaaaataaaaatctacacgaaaacgacgacctaaatcgctctaacaaaacccaacgaccctcctaacgcgtccacccgtcctcgctaacaaaatcccccaacgaactctcgacctacgccaccaaatacaataactcgacccgccccgcaacccgaaaacaaatactcaaaacgcgacccgacgaacgcaaaaacctactctactcaccaaatccgacgtaaaaaacgcgaactccccgaaacaaaaaaaacacaaccccataaaaacgacaacttaaaaaccctaaccgaatccgacccaaaccaaacgacgctaactacgcgatccgaaaccgatccctaatcctccgcgcttaccccgcccccaccgccctccactaactcgactccgccccaacgacaacgccccgcccccaccccgcaactctaccccgcctcgcctctctacgacaacgcccccctcttctcgcgacaccaaccaatccc

SEQ ID NO: 23463 - DNA, 557 bp, Artificial Sequence
  chemically treated genomic DNA (Homo sapiens) CpG-island No: 23463
agattcggcgtagttaaagttagtggaaggtagaaagacgttatagtcgtttttcgataattttttgttataaaagtggagatttatacggaggcgacggtttaggtcgttttgataggatttaacgatttttttgacgcgtttattcgttttcgttagtagggttttttagcgggttttcgatttgcgttattaggtataatggttcggttcgtttcgtaattcgaggataggtgtttaaggcgcggttcggcggacgtagggatttgttttatttattaggttcggcgtgggaggcgcggatttttcgggataaggaaaatatagttttatagggacgatagtttgagaattttgatcgggttcggtttaggttaggcggcgttaattgcgcggttcggagtcggtttttggtttttcgcgtttgtttcgtttttatcgttttttattggttcggtttcgttttagcggtaacgtttcgtttttatttcgtagttttgtttcgtttcgtttttttgcggtaacgttttttttttttcgcgatattaattagtttt

SEQ ID NO: 23464 - DNA, 557 bp, Artificial Sequence
  chemically treated genomic DNA (Homo sapiens) CpG-island No: 23464
aaaactaattaatatcgcgaaaaaaaaaaaacgttaccgcaaaaaaacgaaacgaaacaaaactacgaaataaaaacgaaacgttaccgctaaaacgaaaccgaaccaataaaaaacgataaaaacgaaacaaacgcgaaaaaccaaaaaccgactccgaaccgcgcaattaacgccgcctaacctaaaccgaacccgatcaaaattctcaaactatcgtccctataaaactatattttccttatcccgaaaaatccgcgcctcccacgccgaacctaataaataaaacaaatccctacgtccgccgaaccgcgccttaaacacctatcctcgaattacgaaacgaaccgaaccattatacctaataacgcaaatcgaaaacccgctaaaaaaccctactaacgaaaacgaataaacgcgtcaaaaaaatcgttaaatcctatcaaaacgacctaaaccgtcgcctccgtataaatctccacttttataacaaaaaattatcgaaaaacgactataacgtctttctaccttccactaactttaactacgccgaatct

SEQ ID NO: 23465 - DNA, 655 bp, Artificial Sequence
  chemically treated genomic DNA (Homo sapiens) CpG-island No: 23465
agtgcgtttgtcggggaaatagcgtcgtagggcgcgttttttatttggggttcgtatcgttatttcgttcgattcggtttggtatatgtttttattcgggaatttattagttcggtttatgtttattcggcgtcggtttcgtcgcgcggcgtttcgtttagatgcggttcggttgtagtagcgtagatagcgtgaggggtattagtcgtttttggacgtacggagtcgggttttagtagggtttagtcggttttgcgttttgtatggttcggtcgtttcgttagtttcgttcgtcgttcggtttcgttcgtcgcgtttttatttcgttcgtttttcgtattttaaatttgttgtgttaggtcgtagtatcgtttgtcgtatttttttcgaagtcggtaagttatagagtcggcggcgtagcgtagttttagcgcgtttgacgtcgttcggttttagttcgttttgttcgcgtaacggtttcgggcggcgtcgtcgcgcggtacgttgggagttgtagtttacgtcgcgcggttttatttagtcgaggagattttcgagttcgcgaggagataggcgggttttatttcggttttttttttttgtcgatttcggtttttgttttttgttgtttttagcgttcggatgtaggaagagt

SEQ ID NO: 23466 - DNA, 655 bp, Artificial Sequence
  chemically treated genomic DNA (Homo sapiens) CpG-island No: 23466
actcttcctacatccgaacgctaaaaacaacaaaaaacaaaaaccgaaatcgacaaaaaaaaaaaaccgaaataaaacccgcctatctcctcgcgaactcgaaaatctcctcgactaaataaaaccgcgcgacgtaaactacaactcccaacgtaccgcgcgacgacgccgcccgaaaccgttacgcgaacaaaacgaactaaaaccgaacgacgtcaaacgcgctaaaactacgctacgccgccgactctataacttaccgacttcgaaaaaaatacgacaaacgatactacgacctaacacaacaaatttaaaatacgaaaaacgaacgaaataaaaacgcgacgaacgaaaccgaacgacgaacgaaactaacgaaacgaccgaaccatacaaaacgcaaaaccgactaaaccctactaaaacccgactccgtacgtccaaaaacgactaatacccctcacgctatctacgctactacaaccgaaccgcatctaaacgaaacgccgcgcgacgaaaccgacgccgaataaacataaaccgaactaataaattcccgaataaaaacatataccaaaccgaatcgaacgaaataacgatacgaaccccaaataaaaaacgcgccctacgacgctatttccccgacaaacgcact

SEQ ID NO: 23467 - DNA, 655 bp, Artificial Sequence
  chemically treated genomic DNA (Homo sapiens) CpG-island No: 23467
gttttttttatattcgggcgttggggatagtagggggtaagggtcggggtcggtagggaggaagggtcggggtgaagttcgtttgttttttcgcggattcgggggttttttcggttgggtggggtcgcgcggcgtggattataatttttagcgtgtcgcgcggcggcgtcgttcgaagtcgttgcgcgagtagggcgggttggggtcgagcggcgttaggcgcgttggggttgcgttgcgtcgtcggttttgtggtttgtcggtttcggggaaggtgcggtaggcggtgttgcggtttggtatagtaggtttggggtgcgggaggcgggcggggtaggagcgcggcgggcggggtcgggcggcgggcggggttggcggggcggtcgggttatgtagggcgtagagtcggttaaattttgttgagattcggtttcgtgcgtttaggggcggttaatgttttttacgttgtttacgttgttgtaatcgggtcgtatttggacggggcgtcgcgcggcggagtcgacgtcgggtgagtatagatcgggttggtgggttttcgggtggggatatgtgttaggtcgagtcgggcgaggtggcggtgcggattttaggtggggggcgcgttttgcggcgttattttttcgatagacgtatt

SEQ ID NO: 23468 - DNA, 655 bp, Artificial Sequence
  chemically treated genomic DNA (Homo sapiens) CpG-island No: 23468
aatacgtctatcgaaaaaataacgccgcaaaacgcgccccccacctaaaatccgcaccgccacctcgcccgactcgacctaacacatatccccacccgaaaacccaccaacccgatctatactcacccgacgtcgactccgccgcgcgacgccccgtccaaatacgacccgattacaacaacgtaaacaacgtaaaaaacattaaccgcccctaaacgcacgaaaccgaatctcaacaaaatttaaccgactctacgccctacataacccgaccgccccgccaaccccgcccgccgcccgaccccgcccgccgcgctcctaccccgcccgcctcccgcaccccaaacctactataccaaaccgcaacaccgcctaccgcaccttccccgaaaccgacaaaccacaaaaccgacgacgcaacgcaaccccaacgcgcctaacgccgctcgaccccaacccgccctactcgcgcaacgacttcgaacgacgccgccgcgcgacacgctaaaaattataatccacgccgcgcgaccccacccaaccgaaaaaacccccgaatccgcgaaaaaacaaacgaacttcaccccgacccttcctccctaccgaccccgacccttaccccctactatccccaacgcccgaatataaaaaaaac

SEQ ID NO: 23469 - DNA, 1012 bp, Artificial Sequence
  chemically treated genomic DNA (Homo sapiens) CpG-island No: 23469
gggcggttttatcgtggcggtaggggttatagagcgttatcgtcgcggagtcggcggttaatagcgttttttgtagcggggaggtggggaggtggtgcgagtatagcgggtcggcgtcgtcgtttttagttcggaggggtatttttgcggggtaagaaaaaggtcgaggttagaggagtcgggcgtttttaggttttttttcgtttgcgtttagaattcggcgttatttgtttgtcgtaggtcgttgtaggttcgggagttcgtagagtcgacggaggatagggcgtagtagagtcgttatggtagcgggcgttcgcggaggatgggcgggtacgaagaacgtcgcgattttgttaggcgacggagcgtcggaggggttaaaatttattgaaaaatcgattttgacggcgtagtttacggtttttcgaggggaaatatcgttttacgggtagaaggtatgtaggttaagtaggcgaaggaaacgtacgcgaattgtttatcgtttacgtttatcgatttaagattttcgttatgttatttcgttttagaaagtgtttgtaaaggatacgtaattacgtttatttagcgtcgggttttatttttttttttatagtcggtttttttcgaagattataaaatgcgaatttttttcggttgtggaatatggcggcgttcgtggaaaggattatatttgggggcggggtttggcggtattttcgtttaggtttagcgggtgttgtgatttttaagtatggggtttgttggtttgtcgcggttgtatgggtttttcgcggtttataagttttcggggttaaaatggaagtatttgcgggatatagtggagttataatttttgaagggtgagtgtttcgaattagatttacgttttcgttttcgtttttttggaagtttattttcgtttttggtttttattttaaaataaaattacgtgatttatttatttgggtagagcgtttttttaaacgtttgttttttgtgtttttttattttt

SEQ ID NO: 23470 - DNA, 1012 bp, Artificial Sequence
  chemically treated genomic DNA (Homo sapiens) CpG-island No: 23470
aaaaataaaaaaacacaaaaaacaaacgtttaaaaaaacgctctacccaaataaataaatcacgtaattttattttaaaataaaaaccaaaaacgaaaataaacttccaaaaaaacgaaaacgaaaacgtaaatctaattcgaaacactcacccttcaaaaattataactccactatatcccgcaaatacttccattttaaccccgaaaacttataaaccgcgaaaaacccatacaaccgcgacaaaccaacaaaccccatacttaaaaatcacaacacccgctaaacctaaacgaaaataccgccaaaccccgcccccaaatataatcctttccacgaacgccgccatattccacaaccgaaaaaaattcgcattttataatcttcgaaaaaaaccgactataaaaaaaaaaataaaacccgacgctaaataaacgtaattacgtatcctttacaaacactttctaaaacgaaataacataacgaaaatcttaaatcgataaacgtaaacgataaacaattcgcgtacgtttccttcgcctacttaacctacataccttctacccgtaaaacgatatttcccctcgaaaaaccgtaaactacgccgtcaaaatcgatttttcaataaattttaacccctccgacgctccgtcgcctaacaaaatcgcgacgttcttcgtacccgcccatcctccgcgaacgcccgctaccataacgactctactacgccctatcctccgtcgactctacgaactcccgaacctacaacgacctacgacaaacaaataacgccgaattctaaacgcaaacgaaaaaaaacctaaaaacgcccgactcctctaacctcgacctttttcttaccccgcaaaaatacccctccgaactaaaaacgacgacgccgacccgctatactcgcaccacctccccacctccccgctacaaaaaacgctattaaccgccgactccgcgacgataacgctctataacccctaccgccacgataaaaccgccc

SEQ ID NO: 23471 - DNA, 1012 bp, Artificial Sequence
  chemically treated genomic DNA (Homo sapiens) CpG-island No: 23471
aggagtaagaaagtatagagaataggcgtttgggaaagcgttttgtttaggtgaataggttacgtgattttgttttggggtaaggattagaagcggagatggatttttaagagaacgagagcgggaacgtgggtttggttcgaggtatttattttttagaagttgtagttttattgtatttcgtaggtgtttttattttagtttcgggggtttatagatcgcgaaaagtttatgtagtcgcgataagttagtagattttatatttgaagattatagtattcgttggatttggacggaagtatcgttaggtttcgtttttaaatgtggttttttttacgggcgtcgttatgttttatagtcggaagaggttcgtattttatagttttcggggaaaatcggttgtggagaaggaaatagggttcggcgttgagtgagcgtggttgcgtgttttttgtagatattttttggggcgaggtgatatggcgagagttttggatcggtggacgtagacggtagatagttcgcgtgcgtttttttcgtttatttggtttatatgttttttgttcgtgaagcgatgttttttttcgaaaggtcgtaggttacgtcgttagaatcggttttttagtgagttttgattttttcgacgtttcgtcgtttgatagaatcgcggcgtttttcgtattcgtttatttttcgcggacgttcgttgttatggcgattttgttgcgttttgtttttcgtcggttttgcgggttttcgggtttatagcggtttgcggtaggtaagtggcgtcgggttttgggcgtaggcgggaaggagtttgagggcgttcggtttttttgatttcggttttttttttgtttcgtagaaatgttttttcgggttaggagcgacggcgtcggttcgttatattcgtattatttttttattttttcgttgtagaaagcgttgttggtcgtcggtttcgcggcgatggcgttttataatttttatcgttacggtaaggtcgttt

SEQ ID NO: 23472 - DNA, 1012 bp, Artificial Sequence
  chemically treated genomic DNA (Homo sapiens) CpG-island No: 23472
aaacgaccttaccgtaacgataaaaattataaaacgccatcgccgcgaaaccgacgaccaacaacgctttctacaacgaaaaaataaaaaaataatacgaatataacgaaccgacgccgtcgctcctaacccgaaaaaacatttctacgaaacaaaaaaaaaaccgaaatcaaaaaaaccgaacgccctcaaactccttcccgcctacgcccaaaacccgacgccacttacctaccgcaaaccgctataaacccgaaaacccgcaaaaccgacgaaaaacaaaacgcaacaaaatcgccataacaacgaacgtccgcgaaaaataaacgaatacgaaaaacgccgcgattctatcaaacgacgaaacgtcgaaaaaatcaaaactcactaaaaaaccgattctaacgacgtaacctacgacctttcgaaaaaaaacatcgcttcacgaacaaaaaacatataaaccaaataaacgaaaaaaacgcacgcgaactatctaccgtctacgtccaccgatccaaaactctcgccatatcacctcgccccaaaaaatatctacaaaaaacacgcaaccacgctcactcaacgccgaaccctatttccttctccacaaccgattttccccgaaaactataaaatacgaacctcttccgactataaaacataacgacgcccgtaaaaaaaaccacatttaaaaacgaaacctaacgatacttccgtccaaatccaacgaatactataatcttcaaatataaaatctactaacttatcgcgactacataaacttttcgcgatctataaacccccgaaactaaaataaaaacacctacgaaatacaataaaactacaacttctaaaaaataaatacctcgaaccaaacccacgttcccgctctcgttctcttaaaaatccatctccgcttctaatccttaccccaaaacaaaatcacgtaacctattcacctaaacaaaacgctttcccaaacgcctattctctatactttcttactcct

SEQ ID NO: 23473 - DNA, 529 bp, Artificial Sequence
  chemically treated genomic DNA (Homo sapiens) CpG-island No: 23473
cgcgggagtcggagagcgattttttaggtgtatcgggttaggaattttgattcggagtgtgaattggcgtatagaaagttgcgcgcgtatttaaggaaagtcggtttcgtttttttttcgaggtgggcggggatagcggttgcgtgcgtagtttttgttgtgacgttataggtttttttggttacgtcgttgtatagttacgttttttttcgttttatattttttattgattaatgggttttgatttttgaggttacgtttttattttgcgttttagtatcgttttggttacgttttttttggtttcgtcgtatagttgcgcggtggttgattgattttcgtagtggttgtcgggatcgcgttgatgtggttttaatttcgttttttttttcgtttcgcgatgtcggaagaaattcgatagagtaaattggtcgtagcgaagaaaaaggtaaagtgtatcgggtcgcggtttttcgatttagttttagttttatttcgatggtaggattatggttagagtttttgttat

SEQ ID NO: 23474 - DNA, 529 bp, Artificial Sequence
  chemically treated genomic DNA (Homo sapiens) CpG-island No: 23474
ataacaaaaactctaaccataatcctaccatcgaaataaaactaaaactaaatcgaaaaaccgcgacccgatacactttacctttttcttcgctacgaccaatttactctatcgaatttcttccgacatcgcgaaacgaaaaaaaaaacgaaattaaaaccacatcaacgcgatcccgacaaccactacgaaaatcaatcaaccaccgcgcaactatacgacgaaaccaaaaaaaacgtaaccaaaacgatactaaaacgcaaaataaaaacgtaacctcaaaaatcaaaacccattaatcaataaaaaatataaaacgaaaaaaaacgtaactatacaacgacgtaaccaaaaaaacctataacgtcacaacaaaaactacgcacgcaaccgctatccccgcccacctcgaaaaaaaaacgaaaccgactttccttaaatacgcgcgcaactttctatacgccaattcacactccgaatcaaaattcctaacccgatacacctaaaaaatcgctctccgactcccgcg

SEQ ID NO: 23475 - DNA, 529 bp, Artificial Sequence
  chemically treated genomic DNA (Homo sapiens) CpG-island No: 23475
gtggtagagattttggttatggttttgttatcggagtggggttggggttgggtcggggggtcgcgattcggtgtattttattttttttttcgttgcggttaatttgttttgtcgggtttttttcgatatcgcggggcggggagggaggcggggttggggttatattagcgcgatttcggtaattattgcggaagttagttagttatcgcgtagttgtgcgacggagttagaggaggcgtaattagggcgatattggagcgtagaatgggggcgtggttttaaagattaaagtttattggttaatgagaaatatgaagcggaagggggcgtggttatgtagcggcgtggttagagggatttgtggcgttataataaaagttgcgtacgtaatcgttgttttcgtttatttcgggagaggggcggggtcggttttttttgggtgcgcgcgtagttttttgtgcgttagtttatatttcgggttagagtttttggttcggtgtatttgagaggtcgtttttcgattttcgcg

SEQ ID NO: 23476 - DNA, 529 bp, Artificial Sequence
  chemically treated genomic DNA (Homo sapiens) CpG-island No: 23476
cgcgaaaatcgaaaaacgacctctcaaatacaccgaaccaaaaactctaacccgaaatataaactaacgcacaaaaaactacgcgcgcacccaaaaaaaaccgaccccgcccctctcccgaaataaacgaaaacaacgattacgtacgcaacttttattataacgccacaaatccctctaaccacgccgctacataaccacgcccccttccgcttcatatttctcattaaccaataaactttaatctttaaaaccacgcccccattctacgctccaatatcgccctaattacgcctcctctaactccgtcgcacaactacgcgataactaactaacttccgcaataattaccgaaatcgcgctaatataaccccaaccccgcctccctccccgccccgcgatatcgaaaaaaacccgacaaaacaaattaaccgcaacgaaaaaaaaaataaaatacaccgaatcgcgaccccccgacccaaccccaaccccactccgataacaaaaccataaccaaaatctctaccac

SEQ ID NO: 23477 - DNA, 793 bp, Artificial Sequence
  chemically treated genomic DNA (Homo sapiens) CpG-island No: 23477
tcgcgtatttagatttttaattttcgggatacgttttgcgcggttattttgttattttattttaggtcgttttttttaatttcggtcgagtttgggcggcgagaggcgttgggtggggttttttttatcgcggttttagttaaggcgggaggtttcgggggtttttttcgtcgtttcggatttcgagggggcgcgaattaggggttttttcgttcgtagttcgtcgttttatcgggacggttttttcgggttcgagttgtcggtagtcgttttgtattattcggttcggtcgaggtttttaggaaaatcgcgtttcgtttgtaattagtttagtttttaatttttcgcgtcgtttattttcgtatttatagttatagtgcggtcgggttacgtttagttcgttaatttcgtttgcggcggatatggcggacgagttcgagtttttgttgaggaagtcgtgaaattttggaggcgcggacggcggtagttatagtttttgttaagtgcgcgggtttgtcggggttttcgatgtttcgtttcgtgtcgttagttttatttcgtaggtttcgttttagcggtatcgttttagcgatatcgttttgagcggtcggaaagaggcggggttagagttatcgtgtttcgtttttaatttcgtttttttagttcggtttcgttttgtatttcgttatggttttcgtaggcggaaggaagaaggtagagtttattttttaatcgggtttacgttgagtttgttttgtcgggaatgttcgtttaggtttatagtttcgttttt

SEQ ID NO: 23478 - DNA, 793 bp, Artificial Sequence
  chemically treated genomic DNA (Homo sapiens) CpG-island No: 23478
aaaaacgaaactataaacctaaacgaacattcccgacaaaacaaactcaacgtaaacccgattaaaaaataaactctaccttcttccttccgcctacgaaaaccataacgaaatacaaaacgaaaccgaactaaaaaaacgaaattaaaaacgaaacacgataactctaaccccgcctctttccgaccgctcaaaacgatatcgctaaaacgataccgctaaaacgaaacctacgaaataaaactaacgacacgaaacgaaacatcgaaaaccccgacaaacccgcgcacttaacaaaaactataactaccgccgtccgcgcctccaaaatttcacgacttcctcaacaaaaactcgaactcgtccgccatatccgccgcaaacgaaattaacgaactaaacgtaacccgaccgcactataactataaatacgaaaataaacgacgcgaaaaattaaaaactaaactaattacaaacgaaacgcgattttcctaaaaacctcgaccgaaccgaataatacaaaacgactaccgacaactcgaacccgaaaaaaccgtcccgataaaacgacgaactacgaacgaaaaaacccctaattcgcgccccctcgaaatccgaaacgacgaaaaaaacccccgaaacctcccgccttaactaaaaccgcgataaaaaaaaccccacccaacgcctctcgccgcccaaactcgaccgaaattaaaaaaaacgacctaaaataaaataacaaaataaccgcgcaaaacgtatcccgaaaattaaaaatctaaatacgcga

SEQ ID NO: 23479 - DNA, 793 bp, Artificial Sequence
  chemically treated genomic DNA (Homo sapiens) CpG-island No: 23479
gggggcggggttataaatttgggcgggtattttcggtagggtaagtttagcgtgagttcgattggaggatgggttttattttttttttttcgtttacggagattatagcgggatgtagggcggggtcgggttgagggggcggagttaggggcggggtacggtgattttggtttcgttttttttcggtcgtttagggcggtgtcgttggggcggtgtcgttggggcggggtttgcggggtggggttgacggtacggggcggggtatcggggatttcggtaagttcgcgtatttggtaggagttgtagttatcgtcgttcgcgtttttaaggttttacggtttttttagtagagattcgggttcgttcgttatgttcgtcgtagacgaggttgacgggttgggcgtggttcggtcgtattatggttgtgagtgcgggggtgggcggcgcggggggttgggggttgggttaattgtagacgaggcgcgatttttttgggggtttcggtcgggtcgggtggtgtagggcggttgtcggtagttcggattcggaagagtcgtttcggtggggcggcgggttgcgggcggggaggtttttggttcgcgttttttcggggttcgaggcggcggagaggattttcgaggtttttcgttttagttggggtcgcggtagggggagttttatttagcgtttttcgtcgtttaggttcggtcgagattggggaagacggtttagagtgaggtggtaggatgatcgcgtagggcgtgtttcggggattgggggtttgggtacgcgg

SEQ ID NO: 23480 - DNA, 793 bp, Artificial Sequence
  chemically treated genomic DNA (Homo sapiens) CpG-island No: 23480
ccgcgtacccaaacccccaatccccgaaacacgccctacgcgatcatcctaccacctcactctaaaccgtcttccccaatctcgaccgaacctaaacgacgaaaaacgctaaataaaactccccctaccgcgaccccaactaaaacgaaaaacctcgaaaatcctctccgccgcctcgaaccccgaaaaaacgcgaaccaaaaacctccccgcccgcaacccgccgccccaccgaaacgactcttccgaatccgaactaccgacaaccgccctacaccacccgacccgaccgaaacccccaaaaaaatcgcgcctcgtctacaattaacccaacccccaaccccccgcgccgcccacccccgcactcacaaccataatacgaccgaaccacgcccaacccgtcaacctcgtctacgacgaacataacgaacgaacccgaatctctactaaaaaaaccgtaaaaccttaaaaacgcgaacgacgataactacaactcctaccaaatacgcgaacttaccgaaatccccgataccccgccccgtaccgtcaaccccaccccgcaaaccccgccccaacgacaccgccccaacgacaccgccctaaacgaccgaaaaaaaacgaaaccaaaatcaccgtaccccgcccctaactccgccccctcaacccgaccccgccctacatcccgctataatctccgtaaacgaaaaaaaaaaaataaaacccatcctccaatcgaactcacgctaaacttaccctaccgaaaatacccgcccaaatttataaccccgccccc

SEQ ID NO: 23481 - DNA, 503 bp, Artificial Sequence
  chemically treated genomic DNA (Homo sapiens) CpG-island No: 23481
ttgttacgatgtcgtttgagacggaaagggtattgggtcggcgtttggaattggtttatacgttttaggttatttgttacgatgtcgtttgagacggaaagggtattgggtcggcgtttggaattggtttttacgttttaggttatttgttacgatgtcgtttgagacggaaagggtattgggtcggcgtttggaattggtttatacgttttaggttatttgttacgatgtcgtttgagacggaaagggtattgggtcggcgtttggaattggtttatacgttttaggttatttgttacgatgtcgtttgagacggaaagggtattgggtcggcgtttggaattggtttttacgttttaggttatttgttacgatgtcgtttgagacggaaagggtattgggtcggcgtttggaattggtttttacgttttaggttatttgttacgatgtcgtttgagagggaaagggtattgggtcggcgtttggaattggtttttacgttt

SEQ ID NO: 23482 - DNA, 503 bp, Artificial Sequence
  chemically treated genomic DNA (Homo sapiens) CpG-island No: 23482
aaacgtaaaaaccaattccaaacgccgacccaataccctttccctctcaaacgacatcgtaacaaataacctaaaacgtaaaaaccaattccaaacgccgacccaataccctttccgtctcaaacgacatcgtaacaaataacctaaaacgtaaaaaccaattccaaacgccgacccaataccctttccgtctcaaacgacatcgtaacaaataacctaaaacgtataaaccaattccaaacgccgacccaataccctttccgtctcaaacgacatcgtaacaaataacctaaaacgtataaaccaattccaaacgccgacccaataccctttccgtctcaaacgacatcgtaacaaataacctaaaacgtaaaaaccaattccaaacgccgacccaataccctttccgtctcaaacgacatcgtaacaaataacctaaaacgtataaaccaattccaaacgccgacccaataccctttccgtctcaaacgacatcgtaacaa

SEQ ID NO: 23483 - DNA, 503 bp, Artificial Sequence
  chemically treated genomic DNA (Homo sapiens) CpG-island No: 23483
aggcgtgggggttagttttagacgtcggtttagtgtttttttttttttaaacggtatcgtgatagatgatttgaggcgtgggggttagttttagacgtcggtttagtgtttttttcgttttaaacggtatcgtgatagatgatttgaggcgtgggggttagttttagacgtcggtttagtgtttttttcgttttaaacggtatcgtgatagatgatttgaggcgtgtgggttagttttagacgtcggtttagtgtttttttcgttttaaacggtatcgtgatagatgatttgaggcgtgtgggttagttttagacgtcggtttagtgtttttttcgttttaaacggtatcgtgatagatgatttgaggcgtgggggttagttttagacgtcggtttagtgtttttttcgttttaaacggtatcgtgatagatgatttgaggcgtgtgggttagttttagacgtcggtttagtgtttttttcgttttaaacggtatcgtgatag

SEQ ID NO: 23484 - DNA, 503 bp, Artificial Sequence
  chemically treated genomic DNA (Homo sapiens) CpG-island No: 23484
ctatcacgataccgtttaaaacgaaaaaaacactaaaccgacgtctaaaactaacccacacgcctcaaatcatctatcacgataccgtttaaaacgaaaaaaacactaaaccgacgtctaaaactaacccccacgcctcaaatcatctatcacgataccgtttaaaacgaaaaaaacactaaaccgacgtctaaaactaacccacacgcctcaaatcatctatcacgataccgtttaaaacgaaaaaaacactaaaccgacgtctaaaactaacccacacgcctcaaatcatctatcacgataccgtttaaaacgaaaaaaacactaaaccgacgtctaaaactaacccccacgcctcaaatcatctatcacgataccgtttaaaacgaaaaaaacactaaaccgacgtctaaaactaacccccacgcctcaaatcatctatcacgataccgtttaaaaaaaaaaaaacactaaaccgacgtctaaaactaacccccacgcct

SEQ ID NO: 23485 - DNA, 1451 bp, Artificial Sequence
  chemically treated genomic DNA (Homo sapiens) CpG-island No: 23485
tttcgttcgtttttgtttttagcgaggtttggggtcggggtgttcgaggtgggggatattcgggggggttaggtggttggcgcggggagtcggggttgtgaggggtgatgtttttaggcggcggcgttgcggggtgcggcgaggatatcggtggggtgagagtatcggcggggtagtagcgggggtcgtagcgtcgggtttttcggttcggggtttttttcgcgcggattaggggcgtgataggggggcgtggttggtggcgttgacgttatttcgtttataaaatgttcggggcgtcgttagttgggttttgtggagcgttgcgtagggtgcgtgcgggttcggtatcgaataaaggagtaggggcgtcgcgtatggattcgttatttatttttcggggtcgcgtagttttcgtttattgttattatgatcgttaacgtatagcgaggcggtgtagatttagttcggttttattaattgcggtaataagtatttgacggtcgaggcgttcgggtttaaggtgaacgcgttcgttagtagtttgaagaagaagtagatttggacgttggagtagttttttgacgaggcgggtagcgcggtcgtgtgtttgcgtagttatttgggtcgttatttggcggcggataaggacggtaacgtgatttgcgagcgcgaggtgttcggtttcgattgtcgtttttttatcgtggcgtacgacgacggtcgttggtcgttgtagttcgaggcgtatcggcgttatttcggcggtatcgaggatcgtttgttttgtttcgcgtagacggtgtttttcgtcgagaagtggagcgtgtatatcgttatgtatttttaggttaatatttatagcgttattcgtaagcgttacgtatttgagcgcgcggtcggtcgacgagatcgtcgtggatcgcgacgtgttttggggcgtcgattcgtttattattttcgttttttaggattagcgttatagcgtgtagatcgtcgattatcgttttttgcgttacgacggcgttggtggcgcgtttcgagtcggttattggttatacgttggagtttcgtttcggtaaggtggtttttcgcgattgcgagggtcgttatttggcgtcgtcggggtttagcggtacgtttaaggcggtaaggtattaaggtgggtaaggacgagttttttgttttggagtagattgcgtttaggtcgtgttgtaggcggttaacgagaggaacgtgttaacggcgttagggtgagtggaacgttgttttcgttttttttggttcgtgtataaagcgtattttattcgcgtttttttagttttcgtattttttttcgttcgcgggtcgttgcggttcggagtattgtttattgcgttttcgttaggtaaacgggttatttcgtttggagggggcgaggagtgagttttgtttattttcgggtgtcgttgttt

SEQ ID NO: 23486 - DNA, 1451 bp, Artificial Sequence
  chemically treated genomic DNA (Homo sapiens) CpG-island No: 23486
aaacaacgacacccgaaaataaacaaaactcactcctcgccccctccaaacgaaataacccgtttacctaacgaaaacgcaataaacaatactccgaaccgcaacgacccgcgaacgaaaaaaaatacgaaaactaaaaaaacgcgaataaaatacgctttatacacgaaccaaaaaaaacgaaaacaacgttccactcaccctaacgccgttaacacgttcctctcgttaaccgcctacaacacgacctaaacgcaatctactccaaaacaaaaaactcgtccttacccaccttaataccttaccgccttaaacgtaccgctaaaccccgacgacgccaaataacgaccctcgcaatcgcgaaaaaccaccttaccgaaacgaaactccaacgtataaccaataaccgactcgaaacgcgccaccaacgccgtcgtaacgcaaaaaacgataatcgacgatctacacgctataacgctaatcctaaaaaacgaaaataataaacgaatcgacgccccaaaacacgtcgcgatccacgacgatctcgtcgaccgaccgcgcgctcaaatacgtaacgcttacgaataacgctataaatattaacctaaaaatacataacgatatacacgctccacttctcgacgaaaaacaccgtctacgcgaaacaaaacaaacgatcctcgataccgccgaaataacgccgatacgcctcgaactacaacgaccaacgaccgtcgtcgtacgccacgataaaaaaacgacaatcgaaaccgaacacctcgcgctcgcaaatcacgttaccgtccttatccgccgccaaataacgacccaaataactacgcaaacacacgaccgcgctacccgcctcgtcaaaaaactactccaacgtccaaatctacttcttcttcaaactactaacgaacgcgttcaccttaaacccgaacgcctcgaccgtcaaatacttattaccgcaattaataaaaccgaactaaatctacaccgcctcgctatacgttaacgatcataataacaataaacgaaaactacgcgaccccgaaaaataaataacgaatccatacgcgacgcccctactcctttattcgataccgaacccgcacgcaccctacgcaacgctccacaaaacccaactaacgacgccccgaacattttataaacgaaataacgtcaacgccaccaaccacgcccccctatcacgcccctaatccgcgcgaaaaaaaccccgaaccgaaaaacccgacgctacgacccccgctactaccccgccgatactctcaccccaccgatatcctcgccgcaccccgcaacgccgccgcctaaaaacatcacccctcacaaccccgactccccgcgccaaccacctaacccccccgaatatcccccacctcgaacaccccgaccccaaacctcgctaaaaacaaaaacgaacgaaa

SEQ ID NO: 23487 - DNA, 1451 bp, Artificial Sequence
  chemically treated genomic DNA (Homo sapiens) CpG-island No: 23487
gggtagcggtattcgaggatgggtaaagtttatttttcgttttttttaggcggggtagttcgtttgtttagcgggggcgtaatgggtagtgtttcggatcgtagcggttcgcgagcgaagaaaggtgcggaggttggaggggcgcgggtggggtgcgttttgtgtacggattaggagaggcgggggtagcgttttatttattttggcgtcgttgatacgtttttttcgttggtcgtttgtagtacgatttgggcgtagtttgttttagagtaaagagttcgtttttgtttattttggtgttttgtcgttttgagcgtgtcgttgggtttcgacggcgttaggtaacggttttcgtagtcgcggaaggttattttgtcggagcggaattttagcgtgtagttagtggtcggttcggggcgcgttattagcgtcgtcgtggcgtaggaagcggtggtcggcggtttgtacgttgtagcgttggttttggaaggcgagggtgatgagcgagtcgacgttttagggtacgtcgcggtttacggcgatttcgtcggtcggtcgcgcgtttaggtgcgtagcgtttacgggtgacgttgtagatgttgatttgagggtgtatggcgatgtgtacgttttatttttcggcgggggatatcgtttgcgcgaagtaggataggcggttttcggtgtcgtcgaagtagcgtcggtgcgtttcggattgtagcgattagcgatcgtcgtcgtgcgttacgatgaggaaacggtagtcgggatcgggtatttcgcgttcgtaggttacgttgtcgtttttgttcgtcgttaggtagcggtttaggtggttgcgtaggtatacggtcgcgttgttcgtttcgttagggggttgttttagcgtttagatttgttttttttttaggttgttggcggacgcgtttattttgaattcgaacgtttcggtcgttaggtatttgttgtcgtagttgatgaggtcgaattggatttgtatcgtttcgttgtgcgttggcgattatggtggtagtagacgagagttgcgcggtttcgggaggtgggtggcgggtttatgcgcggcgtttttgtttttttgttcggtgtcgggttcgtacgtattttacgtagcgttttataaagtttagttagcggcgtttcggatattttataggcgaggtgacgttagcgttattagttacgtttttttgttacgtttttggttcgcgcgggaggagtttcgggtcgagggattcggcgttgcggttttcgttgttgtttcgtcggtgtttttattttatcggtgttttcgtcgtatttcgtagcgtcgtcgtttgaggatattattttttataatttcggtttttcgcgttagttatttaattttttcggatgttttttatttcggatatttcgattttaagtttcgttaggagtaaggacgagcgagg

SEQ ID NO: 23488 - DNA, 1451 bp, Artificial Sequence
  chemically treated genomic DNA (Homo sapiens) CpG-island No: 23488
cctcgctcgtccttactcctaacgaaacttaaaatcgaaatatccgaaataaaaaacatccgaaaaaattaaataactaacgcgaaaaaccgaaattataaaaaataatatcctcaaacgacgacgctacgaaatacgacgaaaacaccgataaaataaaaacaccgacgaaacaacaacgaaaaccgcaacgccgaatccctcgacccgaaactcctcccgcgcgaaccaaaaacgtaacaaaaaaacgtaactaataacgctaacgtcacctcgcctataaaatatccgaaacgccgctaactaaactttataaaacgctacgtaaaatacgtacgaacccgacaccgaacaaaaaaacaaaaacgccgcgcataaacccgccacccacctcccgaaaccgcgcaactctcgtctactaccaccataatcgccaacgcacaacgaaacgatacaaatccaattcgacctcatcaactacgacaacaaatacctaacgaccgaaacgttcgaattcaaaataaacgcgtccgccaacaacctaaaaaaaaaacaaatctaaacgctaaaacaaccccctaacgaaacgaacaacgcgaccgtatacctacgcaaccacctaaaccgctacctaacgacgaacaaaaacgacaacgtaacctacgaacgcgaaatacccgatcccgactaccgtttcctcatcgtaacgcacgacgacgatcgctaatcgctacaatccgaaacgcaccgacgctacttcgacgacaccgaaaaccgcctatcctacttcgcgcaaacgatatcccccgccgaaaaataaaacgtacacatcgccatacaccctcaaatcaacatctacaacgtcacccgtaaacgctacgcacctaaacgcgcgaccgaccgacgaaatcgccgtaaaccgcgacgtaccctaaaacgtcgactcgctcatcaccctcgccttccaaaaccaacgctacaacgtacaaaccgccgaccaccgcttcctacgccacgacgacgctaataacgcgccccgaaccgaccactaactacacgctaaaattccgctccgacaaaataaccttccgcgactacgaaaaccgttacctaacgccgtcgaaacccaacgacacgctcaaaacgacaaaacaccaaaataaacaaaaacgaactctttactctaaaacaaactacgcccaaatcgtactacaaacgaccaacgaaaaaaacgtatcaacgacgccaaaataaataaaacgctacccccgcctctcctaatccgtacacaaaacgcaccccacccgcgcccctccaacctccgcacctttcttcgctcgcgaaccgctacgatccgaaacactacccattacgcccccgctaaacaaacgaactaccccgcctaaaaaaaacgaaaaataaactttacccatcctcgaataccgctaccc

SEQ ID NO: 23489 - DNA, 1207 bp, Artificial Sequence
  chemically treated genomic DNA (Homo sapiens) CpG-island No: 23489
tcgttcgcgaagtcggttttgtatatgtcggagtcgttgtcgacgacgagcgcggcgatattattatttatggtgagttgcgagaatagtcgggcgcgttgtgagtcgaggtcgttttcgttttggttattttcggcgcgtcgagtttttaggtcgttaggggcgtcggcgcgcgtttagattggggataaaggaagtcgggtcggtcgcgttattattataaaaggtaaatattggtcggaggcgttttcgcggcgcgcggtaggaagttaggttttaatttttttttaatcgggcgttagtttcgtttcgttcggtttaaatagcgtcgggttagggcgcgcgtacgtagcggttatattttcgggcggttagcggttcgggtaggaagtgcgtaagcgtacgggagtcgcggcgattttatttttttcggtcgagtcgttttcgttttagtttaggtcgcggtatttcgggttttagaacgtacgcgtagttagcgttttgagttttaagcggtacgcggtaattagcgttaatttttagcgcgtacgtagttagcgtttaaaggattagcggtacgcgtaatggcgttttagttttatcgggtttggcggggttcgtcgcgtttattttgcgatttttattggtaagagttcggtttagataaagatttcgtcggttgttttcgtttcgagagcggtattttcggagcgcgtttttcgacgcggtttcgcgttttcgaattggcgtggggtgttttttattttcggaggtttagggtttttttcgcgttttttacggcggttcggttttttttttatgcgtttttcgttgcggtttagacggcggttttgtacgggcgaaggggtcggttcgtgcgtcgggtcgtgagtcgtttgtttcggtcggttggtcgggttttattggcggcgggtgtggacgggcggcggatcggtaaaagcgaggttttgtgttcgcggggcgaatcggtttcggcgggtgtggcgcgttcgttagtgtgttattatagtggcgtcgcgcggtcgcgtcgagttataaaaggtaattttcggaaggcgtacgttgattggtttcgcgtcgtttatttatcggtttcggtatagtgtagtatttttttatttttttttttttttttttgcgaaaaaaaaaaagagcgagagcgagattgaggaagaggaggagggag

SEQ ID NO: 23490 - DNA, 1207 bp, Artificial Sequence
  chemically treated genomic DNA (Homo sapiens) CpG-island No: 23490
ctccctcctcctcttcctcaatctcgctctcgctctttttttttttcgcaaaaaaaaaaaaaaaaaaataaaaaaatactacactataccgaaaccgataaataaacgacgcgaaaccaatcaacgtacgccttccgaaaattaccttttataactcgacgcgaccgcgcgacgccactataataacacactaacgaacgcgccacacccgccgaaaccgattcgccccgcgaacacaaaacctcgcttttaccgatccgccgcccgtccacacccgccgccaataaaacccgaccaaccgaccgaaacaaacgactcacgacccgacgcacgaaccgaccccttcgcccgtacaaaaccgccgtctaaaccgcaacgaaaaacgcataaaaaaaaaaccgaaccgccgtaaaaaacgcgaaaaaaaccctaaacctccgaaaataaaaaacaccccacgccaattcgaaaacgcgaaaccgcgtcgaaaaacgcgctccgaaaataccgctctcgaaacgaaaacaaccgacgaaatctttatctaaaccgaactcttaccaataaaaatcgcaaaataaacgcgacgaaccccgccaaacccgataaaactaaaacgccattacgcgtaccgctaatcctttaaacgctaactacgtacgcgctaaaaattaacgctaattaccgcgtaccgcttaaaactcaaaacgctaactacgcgtacgttctaaaacccgaaataccgcgacctaaactaaaacgaaaacgactcgaccgaaaaaaataaaatcgccgcgactcccgtacgcttacgcacttcctacccgaaccgctaaccgcccgaaaatataaccgctacgtacgcgcgccctaacccgacgctatttaaaccgaacgaaacgaaactaacgcccgattaaaaaaaaattaaaacctaacttcctaccgcgcgccgcgaaaacgcctccgaccaatatttaccttttataataataacgcgaccgacccgacttcctttatccccaatctaaacgcgcgccgacgcccctaacgacctaaaaactcgacgcgccgaaaataaccaaaacgaaaacgacctcgactcacaacgcgcccgactattctcgcaactcaccataaataataatatcgccgcgctcgtcgtcgacaacgactccgacatatacaaaaccgacttcgcgaacga

SEQ ID NO: 23491 - DNA, 1207 bp, Artificial Sequence
  chemically treated genomic DNA (Homo sapiens) CpG-island No: 23491
tttttttttttttttttttaatttcgttttcgttttttttttttttcgtaaaaggaggggagagggggtaaaaaaatgttgtattgtgtcgaagtcggtgagtgagcggcgcggggttaattagcgtgcgtttttcgaaagttgttttttatggttcgacgcggtcgcgcggcgttattataataatatattagcggacgcgttatattcgtcgagatcggttcgtttcgcgagtatagagtttcgtttttgtcgattcgtcgttcgtttatattcgtcgttagtaaagttcggttagtcgatcggggtaggcggtttacggttcggcgtacgggtcggttttttcgttcgtgtagagtcgtcgtttgggtcgtagcggggggcgtatggggggggaatcggatcgtcgtggggggcgcgggagaagttttgggttttcggagatgggggatattttacgttagttcggaggcgcgaggtcgcgtcgggaggcgcgtttcgggggtgtcgttttcggggcgggggtaatcggcggggtttttgtttgagtcgggtttttgttaatggggatcgtagggtgggcgcggcggatttcgttaggttcggtggggttggggcgttattgcgcgtgtcgttggttttttgggcgttaattgcgtgcgcgttgggaattggcgttaattgtcgcgtgtcgtttgggatttaaggcgttaattgcgcgtgcgttttggggttcggggtgtcgcggtttgggttggggcgaaggcggttcggtcggaaggggtggggtcgtcgcggttttcgtgcgtttgcgtattttttgttcgagtcgttggtcgttcgagggtgtggtcgttgcgtgcgcgcgttttgattcggcgttgtttgaatcgggcggagcggggttggcgttcggttgggagggggttggggtttggttttttgtcgcgcgtcgcggggacgttttcgattagtgtttgttttttatggtaataacgcggtcggttcggttttttttgtttttaatttgggcgcgcgtcggcgtttttggcggtttaaggattcggcgcgtcggaagtggttagggcgggggcgatttcggtttatagcgcgttcggttattttcgtagtttattatggatgatgatatcgtcgcgttcgtcgtcgataacggtttcggtatgtgtaaggtcggtttcgcgggcga

SEQ ID NO: 23492 - DNA, 1207 bp, Artificial Sequence
  chemically treated genomic DNA (Homo sapiens) CpG-island No: 23492
tcgcccgcgaaaccgaccttacacataccgaaaccgttatcgacgacgaacgcgacgatatcatcatccataataaactacgaaaataaccgaacgcgctataaaccgaaatcgcccccgccctaaccacttccgacgcgccgaatccttaaaccgccaaaaacgccgacgcgcgcccaaattaaaaacaaaaaaaaccgaaccgaccgcgttattaccataaaaaacaaacactaatcgaaaacgtccccgcgacgcgcgacaaaaaaccaaaccccaaccccctcccaaccgaacgccaaccccgctccgcccgattcaaacaacgccgaatcaaaacgcgcgcacgcaacgaccacaccctcgaacgaccaacgactcgaacaaaaaatacgcaaacgcacgaaaaccgcgacgaccccaccccttccgaccgaaccgccttcgccccaacccaaaccgcgacaccccgaaccccaaaacgcacgcgcaattaacgccttaaatcccaaacgacacgcgacaattaacgccaattcccaacgcgcacgcaattaacgcccaaaaaaccaacgacacgcgcaataacgccccaaccccaccgaacctaacgaaatccgccgcgcccaccctacgatccccattaacaaaaacccgactcaaacaaaaaccccgccgattacccccgccccgaaaacgacacccccgaaacgcgcctcccgacgcgacctcgcgcctccgaactaacgtaaaatatcccccatctccgaaaacccaaaacttctcccgcgccccccacgacgatccgattccccccccatacgccccccgctacgacccaaacgacgactctacacgaacgaaaaaaccgacccgtacgccgaaccgtaaaccgcctaccccgatcgactaaccgaactttactaacgacgaatataaacgaacgacgaatcgacaaaaacgaaactctatactcgcgaaacgaaccgatctcgacgaatataacgcgtccgctaatatattattataataacgccgcgcgaccgcgtcgaaccataaaaaacaactttcgaaaaacgcacgctaattaaccccgcgccgctcactcaccgacttcgacacaatacaacatttttttaccccctctcccctccttttacgaaaaaaaaaaaaaacgaaaacgaaattaaaaaaaaaaaaaaaaaaa

SEQ ID NO: 23493 - DNA, 590 bp, Artificial Sequence
  chemically treated genomic DNA (Homo sapiens) CpG-island No: 23493
ttttcggtcgtttagtttttaatttcgtggttttagtcgggttacgtacgttgcgggttttaatttttttaatcgtaaaatggggatagagcgcgggattcgcggggatcggcggggggtgttatgagttcgattcggagtggggattggggttagggtcgtggtttacgggttcggcgtgggggtcgcggtaggggggttgggttgtattttcgggtcggcgagggttcgtagtgagggaggggaatacggtgggcgggggcggttcgtggatttaacgtttttttttcgggcgtttttaaatttcgttttttatggagaggaattcgggttaagtggtcgggtcggtcgaggggcggggtgggggtcggtgaggggcgggttgggggtcggtcgggttcgcgttggattcgtacggggtttggtttatttttcggtagcgtcgcggttttgggacgcgggaggttcgcgagttgggtttacgtgagtcgcgcgggtttgggagttttcgataataattatttatttagttcgggtagagtcggttttcgtattttaagttgagattttagttttggtttcgggttcga

SEQ ID NO: 23494 - DNA, 590 bp, Artificial Sequence
  chemically treated genomic DNA (Homo sapiens) CpG-island No: 23494
tcgaacccgaaaccaaaactaaaatctcaacttaaaatacgaaaaccgactctacccgaactaaataaataattattatcgaaaactcccaaacccgcgcgactcacgtaaacccaactcgcgaacctcccgcgtcccaaaaccgcgacgctaccgaaaaataaaccaaaccccgtacgaatccaacgcgaacccgaccgacccccaacccgcccctcaccgacccccaccccgcccctcgaccgacccgaccacttaacccgaattcctctccataaaaaacgaaatttaaaaacgcccgaaaaaaaaacgttaaatccacgaaccgcccccgcccaccgtattcccctccctcactacgaaccctcgccgacccgaaaatacaacccaacccccctaccgcgacccccacgccgaacccgtaaaccacgaccctaaccccaatccccactccgaatcgaactcataacaccccccgccgatccccgcgaatcccgcgctctatccccattttacgattaaaaaaattaaaacccgcaacgtacgtaacccgactaaaaccacgaaattaaaaactaaacgaccgaaaa

SEQ ID NO: 23495 - DNA, 590 bp, Artificial Sequence
  chemically treated genomic DNA (Homo sapiens) CpG-island No: 23495
tcgaattcggggttagggttagagttttagtttggggtgcgggggtcgattttgttcgggttgggtggatagttgttatcgggagtttttaggttcgcgcggtttacgtgggtttagttcgcggatttttcgcgttttaggatcgcgacgttatcgggagataagttaggtttcgtgcgagtttagcgcggattcggtcggtttttagttcgttttttatcggtttttatttcgtttttcggtcggttcggttatttggttcgagtttttttttataaaaggcgaggtttgggagcgttcggggagggggcgttgggtttacgggtcgttttcgtttatcgtgttttttttttttattgcgagttttcgtcggttcgggggtgtagtttagtttttttgtcgcgatttttacgtcgggttcgtagattacgattttgattttagtttttatttcggatcgggtttatagtatttttcgtcggttttcgcgagtttcgcgttttgtttttattttgcgattgaagaaattgaggttcgtagcgtgcgtagttcggttggggttacggggttggggattgaacggtcggaaa

SEQ ID NO: 23496 - DNA, 590 bp, Artificial Sequence
  chemically treated genomic DNA (Homo sapiens) CpG-island No: 23496
tttccgaccgttcaatccccaaccccgtaaccccaaccgaactacgcacgctacgaacctcaatttcttcaatcgcaaaataaaaacaaaacgcgaaactcgcgaaaaccgacgaaaaatactataaacccgatccgaaataaaaactaaaatcaaaatcgtaatctacgaacccgacgtaaaaatcgcgacaaaaaaactaaactacacccccgaaccgacgaaaactcgcaataaaaaaaaaaaacacgataaacgaaaacgacccgtaaacccaacgccccctccccgaacgctcccaaacctcgccttttataaaaaaaaactcgaaccaaataaccgaaccgaccgaaaaacgaaataaaaaccgataaaaaacgaactaaaaaccgaccgaatccgcgctaaactcgcacgaaacctaacttatctcccgataacgtcgcgatcctaaaacgcgaaaaatccgcgaactaaacccacgtaaaccgcgcgaacctaaaaactcccgataacaactatccacccaacccgaacaaaatcgacccccgcaccccaaactaaaactctaaccctaaccccgaattcga

SEQ ID NO: 23497 - DNA, 961 bp, Artificial Sequence
  chemically treated genomic DNA (Homo sapiens) CpG-island No: 23497
acgaattttaaaaattttcgaagaaaataggatttgcgaatataggtcgtagatatcgggaattaggggtttttagaatcgcgtcggtaggtcgggtattttggtcggcgtgttaggcggttggagttagggaacgtagagttttagtacgttgttttttgttttttcggagtaggcggtaaatatagtttttagtcgtttcggggcgcgcggtaggaatgaaacggcgtcgcggtagaaaggggcgagtacgggatgtacgaaagtaaaaagtttgtaatttagcggttgttttttatacgttttgtttaagttgtttttgtcgttattatttttaggttcgcgggagttcggttttataatagttttacgtcgcgtatttttagcgtaaaagtttaattcggaggcggggaaacgtcgtagttttcgattggtttttacgggtggcgtcgcgagtagaggcggtagcgggtcggtttttagttttgggtataaagagcgtttgcggttggaaggtagtagtcgtagagtagagaaagggttttttaattttgtttttagcgcggcggagaatttgtaggtaggttttttcgggcgtcggttatatatacgtaatttttaataaaaggaagttgcggtcgcgtttcgtacggtaagagaaggcgttcggtgtaaatttttgagtttttcgttttcgtttttcgcgtaacgtcggtataaaagttattttaaattcgtacggagtttgtagtttcgtttacgtttaatttttttttgttgtttttattttcgaagaatttcggattcgcgttttttattattagtagttggggttttttcgcgtaggtgagcgaggtagggcgtcggagagttcgagggttatttggagttttttcggaggttggaacgtacgggtattgagggttcgtagtttttttttcggatgtattttggcgggtat

SEQ ID NO: 23498 - DNA, 961 bp, Artificial Sequence
  chemically treated genomic DNA (Homo sapiens) CpG-island No: 23498
atacccgccaaaatacatccgaaaaaaaaactacgaaccctcaatacccgtacgttccaacctccgaaaaaactccaaataaccctcgaactctccgacgccctacctcgctcacctacgcgaaaaaaccccaactactaataataaaaaacgcgaatccgaaattcttcgaaaataaaaacaacaaaaaaaaattaaacgtaaacgaaactacaaactccgtacgaatttaaaataacttttataccgacgttacgcgaaaaacgaaaacgaaaaactcaaaaatttacaccgaacgccttctcttaccgtacgaaacgcgaccgcaacttccttttattaaaaattacgtatatataaccgacgcccgaaaaaacctacctacaaattctccgccgcgctaaaaacaaaattaaaaaaccctttctctactctacgactactaccttccaaccgcaaacgctctttatacccaaaactaaaaaccgacccgctaccgcctctactcgcgacgccacccgtaaaaaccaatcgaaaactacgacgtttccccgcctccgaattaaacttttacgctaaaaatacgcgacgtaaaactattataaaaccgaactcccgcgaacctaaaaataataacgacaaaaacaacttaaacaaaacgtataaaaaacaaccgctaaattacaaactttttactttcgtacatcccgtactcgcccctttctaccgcgacgccgtttcattcctaccgcgcgccccgaaacgactaaaaactatatttaccgcctactccgaaaaaacaaaaaacaacgtactaaaactctacgttccctaactccaaccgcctaacacgccgaccaaaatacccgacctaccgacgcgattctaaaaacccctaattcccgatatctacgacctatattcgcaaatcctattttcttcgaaaatttttaaaattcgt

SEQ ID NO: 23499 - DNA, 961 bp, Artificial Sequence
  chemically treated genomic DNA (Homo sapiens) CpG-island No: 23499
gtattcgttagggtgtattcggagagaggattgcgggtttttagtgttcgtgcgttttagttttcggggagattttaggtggttttcggatttttcggcgttttgtttcgtttatttgcgcgaggagattttagttgttggtggtgggggacgcgaattcggggtttttcgggaatggggatagtaagagggggttaggcgtgagcgaggttgtaggtttcgtgcgagtttggggtggtttttgtgtcgacgttgcgcggggggcggaggcggggggtttaggggtttgtatcgagcgtttttttttgtcgtgcgaggcgcggtcgtagtttttttttgttaaaagttgcgtgtgtgtgatcggcgttcgggaggatttgtttgtaggtttttcgtcgcgttgagggtaaagttagagagttttttttttgttttgcggttattgttttttaatcgtaggcgttttttgtgtttagagttggggatcgattcgttgtcgtttttgttcgcggcgttattcgtggagattaatcgaaggttgcggcgttttttcgttttcgggttaggtttttgcgttgggagtgcgcggcgtggggttgttgtggggtcggattttcgcgagtttggaggtggtggcgatagggataatttgggtagggcgtgtggaaagtagtcgttaggttgtagattttttgttttcgtatatttcgtgttcgtttttttttgtcgcggcgtcgttttatttttgtcgcgcgtttcggggcggttggaggttgtgtttgtcgtttgtttcgggaaggtaagggatagcgtgttgggattttgcgttttttgattttaatcgtttagtacgtcggttagagtgttcggtttgtcggcgcggttttgaaagtttttagttttcggtgtttgcgatttgtattcgtaggttttgtttttttcggaaatttttgagattcgt

SEQ ID NO: 23500 - DNA, 961 bp, Artificial Sequence
  chemically treated genomic DNA (Homo sapiens) CpG-island No: 23500
acgaatctcaaaaatttccgaaaaaaacaaaacctacgaatacaaatcgcaaacaccgaaaactaaaaactttcaaaaccgcgccgacaaaccgaacactctaaccgacgtactaaacgattaaaatcaaaaaacgcaaaatcccaacacgctatcccttaccttcccgaaacaaacgacaaacacaacctccaaccgccccgaaacgcgcgacaaaaataaaacgacgccgcgacaaaaaaaaacgaacacgaaatatacgaaaacaaaaaatctacaacctaacgactactttccacacgccctacccaaattatccctatcgccaccacctccaaactcgcgaaaatccgaccccacaacaaccccacgccgcgcactcccaacgcaaaaacctaacccgaaaacgaaaaaacgccgcaaccttcgattaatctccacgaataacgccgcgaacaaaaacgacaacgaatcgatccccaactctaaacacaaaaaacgcctacgattaaaaaacaataaccgcaaaacaaaaaaaaaactctctaactttaccctcaacgcgacgaaaaacctacaaacaaatcctcccgaacgccgatcacacacacgcaacttttaacaaaaaaaaactacgaccgcgcctcgcacgacaaaaaaaaacgctcgatacaaacccctaaaccccccgcctccgccccccgcgcaacgtcgacacaaaaaccaccccaaactcgcacgaaacctacaacctcgctcacgcctaaccccctcttactatccccattcccgaaaaaccccgaattcgcgtcccccaccaccaacaactaaaatctcctcgcgcaaataaacgaaacaaaacgccgaaaaatccgaaaaccacctaaaatctccccgaaaactaaaacgcacgaacactaaaaacccgcaatcctctctccgaatacaccctaacgaatac

SEQ ID NO: 23501 - DNA, 826 bp, Artificial Sequence
  chemically treated genomic DNA (Homo sapiens) CpG-island No: 23501
  misc_feature (38)..(38): n is either a, c, g or t
  misc_feature (40)..(40): n is either a, c, g or t
  misc_feature (51)..(51): n is either a, c, g or t
  misc_feature (410)..(410): n is either a, c, g or t
tcggtttcggttcggttcggttgtagggtcgggttttntntatatcgatanaggatatcggagttgtttcgagacgttaagagggttgcgaagagttgtttttgtatttagagttagacgcggtttacgggacgggatcgttacgtttggggtttgcgggttgtagggcggcgcggtacgcgtgggtatattttgcgggggcgggttgcggtcgcggggaatagcggcgagaggggggttcgcgggagatgcggttttgtttagtcgcgtcgagaaggcggggaaggcgaggtcggaatatatttttttttgtacgtttcggagcgtttcgtcggttggggagggtaggaggtttaggtcggagtcgcgtaggggatattttcgttttcgtttaggagttttgttaggtncggcgtcgcggcgtttatcgtcgatttacgggttagttacggtttgacggggtttggtttcggggcgtcgttcgtttgcggtttagtttttatcgtttttatatacgtttttttgaagaattcggcgcgaggaggtattagtcggtcggatattacggaaggttcgggttatttggggggttgttggtggttgggtagtttttcgggcgggaggggggcgttaggattaggaataggagtgcggacgtagcgggagagggggcgggggcggtcgatcgaggcgtcggtaggtatattggtaggtcgagaggtgtagacgcgtcggtagtagtagcggtagtagtagtggtagcggtgattgtttttgtgtttttttagtatttttttcgggttggtttaagatggcggcgtttttt

SEQ ID NO: 23502 - DNA, 826 bp, Artificial Sequence
  chemically treated genomic DNA (Homo sapiens) CpG-island No: 23502
  misc_feature (417)..(417): n is either a, c, g or t
  misc_feature (776)..(776): n is either a, c, g or t
  misc_feature (787)..(787): n is either a, c, g or t
  misc_feature (789)..(789): n is either a, c, g or t
aaaaaacgccgccatcttaaaccaacccgaaaaaaatactaaaaaaacacaaaaacaatcaccgctaccactactactaccgctactactaccgacgcgtctacacctctcgacctaccaatatacctaccgacgcctcgatcgaccgcccccgccccctctcccgctacgtccgcactcctattcctaatcctaacgcccccctcccgcccgaaaaactacccaaccaccaacaaccccccaaataacccgaaccttccgtaatatccgaccgactaatacctcctcgcgccgaattcttcaaaaaaacgtatataaaaacgataaaaactaaaccgcaaacgaacgacgccccgaaaccaaaccccgtcaaaccgtaactaacccgtaaatcgacgataaacgccgcgacgccgnacctaacaaaactcctaaacgaaaacgaaaatatcccctacgcgactccgacctaaacctcctaccctccccaaccgacgaaacgctccgaaacgtacaaaaaaaaatatattccgacctcgccttccccgccttctcgacgcgactaaacaaaaccgcatctcccgcgaacccccctctcgccgctattccccgcgaccgcaacccgcccccgcaaaatatacccacgcgtaccgcgccgccctacaacccgcaaaccccaaacgtaacgatcccgtcccgtaaaccgcgtctaactctaaatacaaaaacaactcttcgcaaccctcttaacgtctcgaaacaactccgatatcctntatcgatatananaaaacccgaccctacaaccgaaccgaaccgaaaccga

SEQ ID NO: 23503 - DNA, 826 bp, Artificial Sequence
  chemically treated genomic DNA (Homo sapiens) CpG-island No: 23503
  misc_feature (417)..(417): n is either a, c, g or t
  misc_feature (776)..(776): n is either a, c, g or t
  misc_feature (787)..(787): n is either a, c, g or t
  misc_feature (789)..(789): n is either a, c, g or t
agggagcgtcgttattttggattagttcgaggaagatattgagggagtataggagtagttatcgttgttattgttattgtcgttattgttgtcggcgcgtttgtatttttcggtttgttagtgtatttgtcggcgtttcggtcgatcgttttcgttttttttttcgttgcgttcgtatttttgtttttggttttgacgtttttttttcgttcggaaagttgtttagttattagtaattttttaggtaattcgggtttttcgtagtgttcggtcggttgatattttttcgcgtcgggttttttagaggggcgtgtgtggggacggtggagattgggtcgtaggcgggcggcgtttcggggttaggtttcgttaggtcgtggttagttcgtgggtcggcggtgagcgtcgcggcgtcgngtttgataggatttttgggcgggggcggaggtgttttttgcgcggtttcggtttgagttttttgttttttttaatcggcggggcgtttcgaggcgtgtagggaagggtgtgtttcggtttcgtttttttcgttttttcggcgcggttgggtaggatcgtatttttcgcgggtttttttttcgtcgttgtttttcgcggtcgtagttcgttttcgtagggtgtatttacgcgtgtcgcgtcgttttgtagttcgtaagttttagacgtggcggtttcgtttcgtaggtcgcgtttggttttgagtataaaggtagtttttcgtagtttttttggcgtttcggggtagtttcggtgttttntgtcgatgtgngnggagttcggttttgtagtcgggtcgggtcggggtcgg

SEQ ID NO: 23504 - DNA, 826 bp, Artificial Sequence
  chemically treated genomic DNA (Homo sapiens) CpG-island No: 23504
  misc_feature (38)..(38): n is either a, c, g or t
  misc_feature (40)..(40): n is either a, c, g or t
  misc_feature (51)..(51): n is either a, c, g or t
  misc_feature (410)..(410): n is either a, c, g or t
ccgaccccgacccgacccgactacaaaaccgaactccncncacatcgacanaaaacaccgaaactaccccgaaacgccaaaaaaactacgaaaaactacctttatactcaaaaccaaacgcgacctacgaaacgaaaccgccacgtctaaaacttacgaactacaaaacgacgcgacacgcgtaaatacaccctacgaaaacgaactacgaccgcgaaaaacaacgacgaaaaaaaaacccgcgaaaaatacgatcctacccaaccgcgccgaaaaaacgaaaaaaacgaaaccgaaacacacccttccctacacgcctcgaaacgccccgccgattaaaaaaaacaaaaaactcaaaccgaaaccgcgcaaaaaacacctccgcccccgcccaaaaatcctatcaaacncgacgccgcgacgctcaccgccgacccacgaactaaccacgacctaacgaaacctaaccccgaaacgccgcccgcctacgacccaatctccaccgtccccacacacgcccctctaaaaaacccgacgcgaaaaaatatcaaccgaccgaacactacgaaaaacccgaattacctaaaaaattactaataactaaacaactttccgaacgaaaaaaaaacgtcaaaaccaaaaacaaaaatacgaacgcaacgaaaaaaaaaacgaaaacgatcgaccgaaacgccgacaaatacactaacaaaccgaaaaatacaaacgcgccgacaacaataacgacaataacaataacaacgataactactcctatactccctcaatatcttcctcgaactaatccaaaataacgacgctccct

SEQ ID NO: 23505 - DNA, 809 bp, Artificial Sequence
  chemically treated genomic DNA (Homo sapiens) CpG-island No: 23505
  misc_feature (777)..(777): n is either a, c, g or t
  misc_feature (801)..(801): n is either a, c, g or t
tagcgttgttagtgattagtagttgcggtaattgttgatcgggagaaaatttaattagcggaaaatgttaggttattgtttttagtgtgcgtagacggtttattaatttttttttagcgggagcggggcgggtgataaggatatttatgtcggggcgttttcgttatagattttagcgaggatttcgcgcgcgtcgttatttagtagtttttttgttagcgaaatttttatttgttcggtattttgcggcgtatcgcggcgtttatcgcgaataatttgcgaatcgttcggcgcgtcgattagcgtacgtagttagatttcgttattaataagttcggcgtagttattaattggtatttgatattcgttttcgagacgggtatttatggcgcgttttgcggtaacgcgtagtgtagtttcgtggtgatttagcgcggtaagtagttcgcgagtgcgtgaattattaaggcggtatttaatatttatcgtattttgttttatcgtcggaagagaaatttcgggtggtaacgcggcgcgaatacgtgattttagatttaaacgttttagttcggttacggtaagaatgatggtatcgtattcgtcgttatttagtttgtttaggcgagtgtcgacgttgtcgcgtagggagcggataattagattcggacggcgtttagatagttggtattggcgacgtaaattggacgtttcgacgatattgtttgtcggtaacgtatttagattgttatagttattggtaatagaggtttagggttnttgtaagcgtttttatgttttttnttttttcg

SEQ ID NO: 23506 - DNA, 809 bp, Artificial Sequence
  chemically treated genomic DNA (Homo sapiens) CpG-island No: 23506
  misc_feature (9)..(9): n is either a, c, g or t
  misc_feature (33)..(33): n is either a, c, g or t
cgaaaaaanaaaaaacataaaaacgcttacaanaaccctaaacctctattaccaataactataacaatctaaatacgttaccgacaaacaatatcgtcgaaacgtccaatttacgtcgccaataccaactatctaaacgccgtccgaatctaattatccgctccctacgcgacaacgtcgacactcgcctaaacaaactaaataacgacgaatacgataccatcattcttaccgtaaccgaactaaaacgtttaaatctaaaatcacgtattcgcgccgcgttaccacccgaaatttctcttccgacgataaaacaaaatacgataaatattaaataccgccttaataattcacgcactcgcgaactacttaccgcgctaaatcaccacgaaactacactacgcgttaccgcaaaacgcgccataaatacccgtctcgaaaacgaatatcaaataccaattaataactacgccgaacttattaataacgaaatctaactacgtacgctaatcgacgcgccgaacgattcgcaaattattcgcgataaacgccgcgatacgccgcaaaataccgaacaaataaaaatttcgctaacaaaaaaactactaaataacgacgcgcgcgaaatcctcgctaaaatctataacgaaaacgccccgacataaatatccttatcacccgccccgctcccgctaaaaaaaaattaataaaccgtctacgcacactaaaaacaataacctaacattttccgctaattaaattttctcccgatcaacaattaccgcaactactaatcactaacaacgcta

SEQ ID NO: 23507 - DNA, 809 bp, Artificial Sequence
  chemically treated genomic DNA (Homo sapiens) CpG-island No: 23507
  misc_feature (9)..(9): n is either a, c, g or t
  misc_feature (33)..(33): n is either a, c, g or t
cggaggggnaagaaatatgagaacgtttgtagnagttttgaatttttgttgttaataattatgatagtttggatgcgttatcggtaggtagtatcgtcgggacgtttagtttacgtcgttagtgttaattgtttgaacgtcgttcggatttgattattcgttttttgcgcggtaacgtcggtattcgtttgagtaaattggataacggcgaatacgatgttattatttttgtcgtagtcggattaaaacgtttaggtttggagttacgtattcgcgtcgcgttgttattcgagatttttttttcggcggtaggataaggtgcggtgggtattgaatgtcgttttgatgatttacgtattcgcgagttgtttgtcgcgttgaattattacgaaattgtattgcgcgttatcgtagaacgcgttatgaatattcgtttcgaaggcggatgttaggtgttaattggtagttacgtcgagtttattgatggcgaaatttggttgcgtgcgttggtcggcgcgtcggacggttcgtagattattcgcggtgaacgtcgcggtgcgtcgtaagatgtcgaataaatggggatttcgttggtagaagagttattgaataacggcgcgcgcgagattttcgttgaagtttataacggagacgtttcggtatgagtatttttgttattcgtttcgttttcgttggagaagagttagtgagtcgtttgcgtatattgggggtagtggtttggtatttttcgttgattgagttttttttcggttaataattatcgtaattgttgattattggtaacgttg

SEQ ID NO: 23508 - DNA, 809 bp, Artificial Sequence
  chemically treated genomic DNA (Homo sapiens) CpG-island No: 23508
  misc_feature (777)..(777): n is either a, c, g or t
  misc_feature (801)..(801): n is either a, c, g or t
caacgttaccaataatcaacaattacgataattattaaccgaaaaaaaactcaatcaacgaaaaataccaaaccactacccccaatatacgcaaacgactcactaactcttctccaacgaaaacgaaacgaataacaaaaatactcataccgaaacgtctccgttataaacttcaacgaaaatctcgcgcgcgccgttattcaataactcttctaccaacgaaatccccatttattcgacatcttacgacgcaccgcgacgttcaccgcgaataatctacgaaccgtccgacgcgccgaccaacgcacgcaaccaaatttcgccatcaataaactcgacgtaactaccaattaacacctaacatccgccttcgaaacgaatattcataacgcgttctacgataacgcgcaatacaatttcgtaataattcaacgcgacaaacaactcgcgaatacgtaaatcatcaaaacgacattcaatacccaccgcaccttatcctaccgccgaaaaaaaaatctcgaataacaacgcgacgcgaatacgtaactccaaacctaaacgttttaatccgactacgacaaaaataataacatcgtattcgccgttatccaatttactcaaacgaataccgacgttaccgcgcaaaaaacgaataatcaaatccgaacgacgttcaaacaattaacactaacgacgtaaactaaacgtcccgacgatactacctaccgataacgcatccaaactatcataattattaacaacaaaaattcaaaactnctacaaacgttctcatatttcttncccctccg

SEQ ID NO: 23509 - DNA, 719 bp, Artificial Sequence
  chemically treated genomic DNA (Homo sapiens) CpG-island No: 23509
aagatatcgaaggtgaagcgcgttcgtagttagatattaagattggttatttgtcgtagaatcgtagttgaattcggaatatatcgtgcgtgagtttattgaagaagcggttttagaagtggttaacgttttgaaacgtttggatgaagtgtatgcgttgtacgtcgattcggatgtcgattttgataagttggtcgttgaataaggtcgtttggaagagattatttaggtttacgacggttataatttgaacgtatagttggagcgtgcggcggatgcgttacgtttgtcggatttggacgcgagaatcgttaattttttcggtggtgaacgtcgtcgcgtagcgttgtgtcgtttgttgttggaaaaattagatatgttgttgttcgacgaatcgattaattatttggatgtcgaattcgtggtttggttggaacgttttttgtacgatttcgaaggtatcgttgtggcgattatttacgatcgttattttttcgataacgttgtaggttggattttcgaatttgatcgcggtgaaggtatttcgtgggaaggtaattattttttttggttggagtagaaagattagcgtttggcgtaggaagttttataagaagcggcgcgtcgtaagtcgattgagaaagagttggaatgggtacgttaaggtattaaaggtcgttagtcgaaaggtaaagtacgtttggcgcgttttgaagaat

SEQ ID NO: 23510 - DNA, 719 bp, Artificial Sequence
  chemically treated genomic DNA (Homo sapiens) CpG-island No: 23510
attcttcaaaacgcgccaaacgtactttacctttcgactaacgacctttaataccttaacgtacccattccaactctttctcaatcgacttacgacgcgccgcttcttataaaacttcctacgccaaacgctaatctttctactccaaccaaaaaaaataattaccttcccacgaaataccttcaccgcgatcaaattcgaaaatccaacctacaacgttatcgaaaaaataacgatcgtaaataatcgccacaacgataccttcgaaatcgtacaaaaaacgttccaaccaaaccacgaattcgacatccaaataattaatcgattcgtcgaacaacaacatatctaatttttccaacaacaaacgacacaacgctacgcgacgacgttcaccaccgaaaaaattaacgattctcgcgtccaaatccgacaaacgtaacgcatccgccgcacgctccaactatacgttcaaattataaccgtcgtaaacctaaataatctcttccaaacgaccttattcaacgaccaacttatcaaaatcgacatccgaatcgacgtacaacgcatacacttcatccaaacgtttcaaaacgttaaccacttctaaaaccgcttcttcaataaactcacgcacgatatattccgaattcaactacgattctacgacaaataaccaatcttaatatctaactacgaacgcgcttcaccttcgatatctt

SEQ ID NO: 23511 - DNA, 719 bp, Artificial Sequence
  chemically treated genomic DNA (Homo sapiens) CpG-island No: 23511
gttttttaaagcgcgttagacgtgttttatttttcgattgacggtttttagtattttgacgtatttattttagtttttttttaatcgatttacgacgcgtcgttttttgtgaagttttttgcgttaggcgttgatttttttgttttagttaggaggagtagttatttttttacggaatatttttatcgcggttaagttcgaggatttagtttgtaacgttatcgaggaagtaacggtcgtgggtaatcgttataacggtgttttcgaagtcgtgtaggaagcgttttagttaggttacggattcggtatttaggtggttggtcggttcgtcgagtagtagtatgtttggtttttttagtagtaggcggtataacgttacgcgacgacgtttattatcggagaggttagcgattttcgcgtttaagttcggtagacgtagcgtattcgtcgtacgttttagttgtacgtttagattatgatcgtcgtgagtttgaatgattttttttagacggttttgtttagcggttagtttgttaaaatcggtattcggatcggcgtatagcgtatatattttatttaggcgttttagggcgttaattatttttgaaatcgtttttttaatggatttacgtacggtgtgtttcgggtttagttgcggttttgcggtagataattaattttgatgtttggttgcggacgcgttttattttcgatgtttt

SEQ ID NO: 23512 - DNA, 719 bp, Artificial Sequence
  chemically treated genomic DNA (Homo sapiens) CpG-island No: 23512
aaaacatcgaaaataaaacgcgtccgcaaccaaacatcaaaattaattatctaccgcaaaaccgcaactaaacccgaaacacaccgtacgtaaatccattaaaaaaacgatttcaaaaataattaacgccctaaaacgcctaaataaaatatatacgctatacgccgatccgaataccgattttaacaaactaaccgctaaacaaaaccgtctaaaaaaaatcattcaaactcacgacgatcataatctaaacgtacaactaaaacgtacgacgaatacgctacgtctaccgaacttaaacgcgaaaatcgctaacctctccgataataaacgtcgtcgcgtaacgttataccgcctactactaaaaaaaccaaacatactactactcgacgaaccgaccaaccacctaaataccgaatccgtaacctaactaaaacgcttcctacacgacttcgaaaacaccgttataacgattacccacgaccgttacttcctcgataacgttacaaactaaatcctcgaacttaaccgcgataaaaatattccgtaaaaaaataactactcctcctaactaaaacaaaaaaatcaacgcctaacgcaaaaaacttcacaaaaaacgacgcgtcgtaaatcgattaaaaaaaaactaaaataaatacgtcaaaatactaaaaaccgtcaatcgaaaaataaaacacgtctaacgcgctttaaaaaac

SEQ ID NO: 23513 - DNA, 541 bp, Artificial Sequence
  chemically treated genomic DNA (Homo sapiens) CpG-island No: 23513
tttgtttagttgcgttttttaatgattgtaatgttcgttcgtttaatttcgttataagcgataatcgttcgttgtatgtgattgttagcgacggtggtttgttatttgaattagtgaaggtgagcgaattgtcggtgttgatgggcgagcgttttgaagtgttgatggaggttaacgataataaattttttgatatggtgacgttgtcgattagttagatggggatggcgattgcgtcgtttgataagttttattcggtaatgcggatttagtcgattgttattagtgttttcggtgttttgttagatatattaagtagtttgtttgcgttattttcgttggaagggttgacggtacgtaagttgtaattttttatggattcgatgttcgatatgatggggatgtagatgttaatggagaaatatggcgattaggcgatggtcgggatggattatagttagatgatgggttatatggggtacggtaatatgaattatatgaattacggcgggaagttcgatttttattatgttaataaaat

SEQ ID NO: 23514 - DNA, 541 bp, Artificial Sequence
  chemically treated genomic DNA (Homo sapiens) CpG-island No: 23514
attttattaacataataaaaatcgaacttcccgccgtaattcatataattcatattaccgtaccccatataacccatcatctaactataatccatcccgaccatcgcctaatcgccatatttctccattaacatctacatccccatcatatcgaacatcgaatccataaaaaattacaacttacgtaccgtcaacccttccaacgaaaataacgcaaacaaactacttaatatatctaacaaaacaccgaaaacactaataacaatcgactaaatccgcattaccgaataaaacttatcaaacgacgcaatcgccatccccatctaactaatcgacaacgtcaccatatcaaaaaatttattatcgttaacctccatcaacacttcaaaacgctcgcccatcaacaccgacaattcgctcaccttcactaattcaaataacaaaccaccgtcgctaacaatcacatacaacgaacgattatcgcttataacgaaattaaacgaacgaacattacaatcattaaaaaacgcaactaaacaaa

SEQ ID NO: 23515 - DNA, 541 bp, Artificial Sequence
  chemically treated genomic DNA (Homo sapiens) CpG-island No: 23515
attttgttggtatggtggaaatcgaatttttcgtcgtggtttatatgatttatattgtcgtgttttatatggtttattatttggttgtgatttatttcggttatcgtttgatcgttatatttttttattagtatttgtatttttattatatcgagtatcgggtttatagagagttgtagtttgcgtatcgttagtttttttagcgaaggtaacgtaggtaggttatttaatgtgtttggtaaagtatcggaggtattaatagtaatcggttgaattcgtattatcggatgaggtttattaaacggcgtaatcgttatttttatttggttgatcggtagcgttattatgttaaagggtttgttatcgttaatttttattagtattttaaaacgttcgtttattagtatcggtagttcgtttatttttattggtttaggtagtagattatcgtcgttggtaattatatatagcgggcgattgtcgtttgtggcgaaattgagcgaacgggtattatagttattgagaaacgtagttgagtaag

SEQ ID NO: 23516 - DNA, 541 bp, Artificial Sequence
  chemically treated genomic DNA (Homo sapiens) CpG-island No: 23516
cttactcaactacgtttctcaataactataatacccgttcgctcaatttcgccacaaacgacaatcgcccgctatatataattaccaacgacgataatctactacctaaaccaataaaaataaacgaactaccgatactaataaacgaacgttttaaaatactaataaaaattaacgataacaaaccctttaacataataacgctaccgatcaaccaaataaaaataacgattacgccgtttaataaacctcatccgataatacgaattcaaccgattactattaatacctccgatactttaccaaacacattaaataacctacctacgttaccttcgctaaaaaaactaacgatacgcaaactacaactctctataaacccgatactcgatataataaaaatacaaatactaataaaaaaatataacgatcaaacgataaccgaaataaatcacaaccaaataataaaccatataaaacacgacaatataaatcatataaaccacgacgaaaaattcgatttccaccataccaacaaaat

SEQ ID NO: 23517 - DNA, 548 bp, Artificial Sequence
  chemically treated genomic DNA (Homo sapiens) CpG-island No: 23517
aggataaggttcgcggatgaattataggaattttcgggttttaaagattttggcgttaagtttagggcgttgatcgcgaaggacgaggcgttttcgtgacgttttgtttttttaatgaattttaggtttgcggagacgacggagaacggaagttttttgtttgtgtgttggttggttgcgcgttgaggttagtttcgttttttatttttcggtttttttagaagtcgtttagtttttcggtggttgttttacgttcggaggtttagtcgtcgtttatttaggatgtcgcgtggaagtcgaagtcgtatttttcgtatggttttttcggttaggtgagattatcgtagggtttgagattaaagcgcggtcgttcggattttattggggtaatgacgtagagggaggtcgcgggcgggggtgaattaaggtcggttgcggcgtgggttcgtttttgttaggcgggggtagattgaacgtaaagtttatgttaggggagtgtggggagggaatttatttacggaaaaagttttttatttaaataacgggaa

SEQ ID NO: 23518 - DNA, 548 bp, Artificial Sequence
  chemically treated genomic DNA (Homo sapiens) CpG-island No: 23518
ttcccgttatttaaataaaaaactttttccgtaaataaattccctccccacactcccctaacataaactttacgttcaatctacccccgcctaacaaaaacgaacccacgccgcaaccgaccttaattcacccccgcccgcgacctccctctacgtcattaccccaataaaatccgaacgaccgcgctttaatctcaaaccctacgataatctcacctaaccgaaaaaaccatacgaaaaatacgacttcgacttccacgcgacatcctaaataaacgacgactaaacctccgaacgtaaaacaaccaccgaaaaactaaacgacttctaaaaaaaccgaaaaataaaaaacgaaactaacctcaacgcgcaaccaaccaacacacaaacaaaaaacttccgttctccgtcgtctccgcaaacctaaaattcattaaaaaaacaaaacgtcacgaaaacgcctcgtccttcgcgatcaacgccctaaacttaacgccaaaatctttaaaacccgaaaattcctataattcatccgcgaaccttatcct

SEQ ID NO: 23519 - DNA, 548 bp, Artificial Sequence
  chemically treated genomic DNA (Homo sapiens) CpG-island No: 23519
ttttcgttgtttggataggaagtttttttcgtaagtgaattttttttttatatttttttaatataggttttacgtttaatttattttcgtttggtagaggcgagtttacgtcgtagtcgattttagtttattttcgttcgcggtttttttttgcgttattgttttagtagagttcggacggtcgcgttttggttttaaattttgcgatggttttatttggtcggaggggttatgcgggaggtgcggtttcggtttttacgcggtattttaggtaagcgacggttaggttttcggacgtgggataattatcgaagagttaagcgatttttgaggagatcggaagatgggaggcggggttggttttaacgcgtaattaattagtatataggtagagaattttcgtttttcgtcgttttcgtaggtttgaagtttattggaagagtaggacgttacggggacgtttcgtttttcgcggttaacgttttgaatttggcgttaggatttttaaaattcggaagtttttgtggtttattcgcgaattttgtttt

SEQ ID NO: 23520 - DNA, 548 bp, Artificial Sequence
  chemically treated genomic DNA (Homo sapiens) CpG-island No: 23520
aaaacaaaattcgcgaataaaccacaaaaacttccgaattttaaaaatcctaacgccaaattcaaaacgttaaccgcgaaaaacgaaacgtccccgtaacgtcctactcttccaataaacttcaaacctacgaaaacgacgaaaaacgaaaattctctacctatatactaattaattacgcgttaaaaccaaccccgcctcccatcttccgatctcctcaaaaatcgcttaactcttcgataattatcccacgtccgaaaacctaaccgtcgcttacctaaaataccgcgtaaaaaccgaaaccgcacctcccgcataacccctccgaccaaataaaaccatcgcaaaatttaaaaccaaaacgcgaccgtccgaactctactaaaacaataacgcaaaaaaaaaccgcgaacgaaaataaactaaaatcgactacgacgtaaactcgcctctaccaaacgaaaataaattaaacgtaaaacctatattaaaaaaatataaaaaaaaaattcacttacgaaaaaaacttcctatccaaacaacgaaaa

SEQ ID NO: 23521 - DNA, 544 bp, Artificial Sequence
  chemically treated genomic DNA (Homo sapiens) CpG-island No: 23521
taggaaaaatcggcggaaacgtatttatatttcgagtttgtcgggtagcgggtcgagcgtttcgcggcgtgaatatttattaggggtggggttcgaataatggcgcgtcggcgggtagcgcgggtagcggtttcgatacgacgttcggcgtttagggtgcggttttcgcgttcgatttcgtacggcgttttcgaaaattgtaggagcggggaggaagcgggttgggattttttcggggaggagttggggtggggaaacgtttttatttcgcgttaataataaatgatacgaaattgagttggatcgatattaagaggttatggattttcgcgttttttagggtaagggtgtgtttcgtcggtcgcgtttcggttttagagggattcgaattcggtgttgtcgagcggaggaggggtttttttcgattttcgtttttttttcgttttattcgttttattttttatttttttatattttagagaggagatttttaagtttttcgttttcggtttttttgtacggttttttttttttttttttgttt

SEQ ID NO: 23522 - DNA, 544 bp, Artificial Sequence
  chemically treated genomic DNA (Homo sapiens) CpG-island No: 23522
aaacaaaaaaaaaaaaaaaaaaccgtacaaaaaaaccgaaaacgaaaaacttaaaaatctcctctctaaaatataaaaaaataaaaaataaaacgaataaaacgaaaaaaaaacgaaaatcgaaaaaaacccctcctccgctcgacaacaccgaattcgaatccctctaaaaccgaaacgcgaccgacgaaacacacccttaccctaaaaaacgcgaaaatccataacctcttaatatcgatccaactcaatttcgtatcatttattattaacgcgaaataaaaacgtttccccaccccaactcctccccgaaaaaatcccaacccgcttcctccccgctcctacaattttcgaaaacgccgtacgaaatcgaacgcgaaaaccgcaccctaaacgccgaacgtcgtatcgaaaccgctacccgcgctacccgccgacgcgccattattcgaaccccacccctaataaatattcacgccgcgaaacgctcgacccgctacccgacaaactcgaaatataaatacgtttccgccgatttttccta

SEQ ID NO: 23523 - DNA, 544 bp, Artificial Sequence
  chemically treated genomic DNA (Homo sapiens) CpG-island No: 23523
aagtagagaaaggaaaagaaaatcgtgtagggaagtcggaaacgagggatttaagggttttttttttagggtgtgggagagtgggggatggggcgaatggggcgaggagggggcgaggatcgagggaggtttttttttcgttcggtaatatcgggttcgggtttttttagagtcgggacgcggtcggcgggatatatttttgttttgggagacgcgagggtttatggttttttagtgtcggtttagtttagtttcgtgttatttgttgttagcgcgaggtaggggcgtttttttattttagttttttttcggggaaattttagttcgtttttttttcgtttttgtagttttcgggagcgtcgtgcggggtcgagcgcggaggtcgtattttgggcgtcgggcgtcgtgtcgggatcgttgttcgcgttgttcgtcggcgcgttattgttcgagttttatttttgatgaatatttacgtcgcggggcgttcggttcgttattcggtaggttcggggtgtgagtgcgttttcgtcggttttttttg

SEQ ID NO: 23524 - DNA, 544 bp, Artificial Sequence
  chemically treated genomic DNA (Homo sapiens) CpG-island No: 23524
caaaaaaaaccgacgaaaacgcactcacaccccgaacctaccgaataacgaaccgaacgccccgcgacgtaaatattcatcaaaaataaaactcgaacaataacgcgccgacgaacaacgcgaacaacgatcccgacacgacgcccgacgcccaaaatacgacctccgcgctcgaccccgcacgacgctcccgaaaactacaaaaacgaaaaaaaaacgaactaaaatttccccgaaaaaaaactaaaataaaaaaacgcccctacctcgcgctaacaacaaataacacgaaactaaactaaaccgacactaaaaaaccataaaccctcgcgtctcccaaaacaaaaatatatcccgccgaccgcgtcccgactctaaaaaaacccgaacccgatattaccgaacgaaaaaaaaacctccctcgatcctcgccccctcctcgccccattcgccccatcccccactctcccacaccctaaaaaaaaaacccttaaatccctcgtttccgacttccctacacgattttcttttcctttctctactt

SEQ ID NO: 23525 - DNA, 718 bp, Artificial Sequence
  chemically treated genomic DNA (Homo sapiens) CpG-island No: 23525
gagtcgtcgggaaggcgaggcgcgcggtgggtgggtggggtgggttggtatgggtgtcggtgtttttagcgttggggtcggagcgcggaacgtttttttatcgttttttcggggttgacgtacgtttttacggcgcgcgtattttttagatttttttaggtcggagggaggaggggaggggaaggggttgatgcggtttcgtatcgggattcgggattcgaggaggcgattcgtttattacgcgtcgttcgcggagggtagagaaggtagtttttattaggcgttttcgatcgtttcggttgtcgggcgttttttgttgttttttgtagttcgttcgcgcgttttcgtttcgatttcggagggtaggtatttcggagtttcggtttttaggagtttttcggtcgcggtcggagcgttttttcggattatttattcgacgttagcgttagtcgaaggcgagggaaaggggcggggggagcgtaggaatcggttttttttgcggcggtcgttattagtcggaatagtaatcggcggagttcgtgcgtatcgtagcgtagcgtagcggtcggggggtgcgggcgttttcgcgttcggttatttatcgtcgtttgggcgtcgtcgttgtttttttttttcgtttttattttttagtagacgttcgtcggagcgattttttttagggtgatcgggggaaggtgggtggcgttgattttatttt

SEQ ID NO: 23526 - DNA, 718 bp, Artificial Sequence
  chemically treated genomic DNA (Homo sapiens) CpG-island No: 23526
aaaataaaatcaacgccacccaccttcccccgatcaccctaaaaaaaatcgctccgacgaacgtctactaaaaaataaaaacgaaaaaaaaaaacaacgacgacgcccaaacgacgataaataaccgaacgcgaaaacgcccgcaccccccgaccgctacgctacgctacgatacgcacgaactccgccgattactattccgactaataacgaccgccgcaaaaaaaaccgattcctacgctccccccgcccctttccctcgccttcgactaacgctaacgtcgaataaataatccgaaaaaacgctccgaccgcgaccgaaaaactcctaaaaaccgaaactccgaaatacctaccctccgaaatcgaaacgaaaacgcgcgaacgaactacaaaaaacaacaaaaaacgcccgacaaccgaaacgatcgaaaacgcctaataaaaactaccttctctaccctccgcgaacgacgcgtaataaacgaatcgcctcctcgaatcccgaatcccgatacgaaaccgcatcaaccccttcccctcccctcctccctccgacctaaaaaaatctaaaaaatacgcgcgccgtaaaaacgtacgtcaaccccgaaaaaacgataaaaaaacgttccgcgctccgaccccaacgctaaaaacaccgacacccataccaacccaccccacccacccaccgcgcgcctcgccttcccgacgactc

SEQ ID NO: 23527 - DNA, 718 bp, Artificial Sequence
  chemically treated genomic DNA (Homo sapiens) CpG-island No: 23527
aaggtgaggttaacgttatttattttttttcggttattttgggaggggtcgtttcggcgggcgtttgttggagggtagaagcggggaagggaggtagcggcggcgtttaggcggcggtaggtagtcgggcgcgagggcgttcgtatttttcggtcgttgcgttgcgttgcggtgcgtacgggtttcgtcggttgttatttcggttggtggcggtcgtcgtaggaagggtcggtttttgcgtttttttcgtttttttttttcgttttcggttgacgttgacgtcggatgagtgattcggagggacgtttcgatcgcggtcgggaggtttttgggggtcggggtttcgaggtatttgtttttcggggtcggggcgggggcgcgcgggcgggttgtaggaagtagtaggagacgttcggtagtcgggacggtcggggacgtttggtaggagttgttttttttgtttttcgcgggcggcgcgtgataggcgagtcgttttttcgggtttcggatttcggtgcggaatcgtattagttttttttttttttttttttttttcggtttgggaaggtttggaggatgcgcgcgtcgtgagagcgtgcgttagtttcgggggagcggtagggaagcgtttcgcgtttcggttttagcgttgggagtatcggtatttatgttagtttattttatttatttatcgcgcgtttcgttttttcggcggttt

SEQ ID NO: 23528 - DNA, 718 bp, Artificial Sequence
  chemically treated genomic DNA (Homo sapiens) CpG-island No: 23528
aaaccgccgaaaaaacgaaacgcgcgataaataaataaaataaactaacataaataccgatactcccaacgctaaaaccgaaacgcgaaacgcttccctaccgctcccccgaaactaacgcacgctctcacgacgcgcgcatcctccaaaccttcccaaaccgaaaaaaaaaaaaaaaaaaaaaaaactaatacgattccgcaccgaaatccgaaacccgaaaaaacgactcgcctatcacgcgccgcccgcgaaaaacaaaaaaaacaactcctaccaaacgtccccgaccgtcccgactaccgaacgtctcctactacttcctacaacccgcccgcgcgcccccgccccgaccccgaaaaacaaatacctcgaaaccccgacccccaaaaacctcccgaccgcgatcgaaacgtccctccgaatcactcatccgacgtcaacgtcaaccgaaaacgaaaaaaaaaaacgaaaaaaacgcaaaaaccgacccttcctacgacgaccgccaccaaccgaaataacaaccgacgaaacccgtacgcaccgcaacgcaacgcaacgaccgaaaaatacgaacgccctcgcgcccgactacctaccgccgcctaaacgccgccgctacctcccttccccgcttctaccctccaacaaacgcccgccgaaacgacccctcccaaaataaccgaaaaaaaataaataacgttaacctcacctt

SEQ ID NO: 23529 - DNA, 529 bp, Artificial Sequence
  chemically treated genomic DNA (Homo sapiens) CpG-island No: 23529
tcgcgacgacgatttgttattgttttatttacgcgcgcgcgcgcgtttttttcgggattgtatacgggtgcgcgtcggtaatcgcgagtacgagagttggttttcgtttttcgcgattttcggcgtcggcggtttggtcgtgcgtattttcgtgtcgtattttagggatcgcgcggtggtcggttatttgacgcgggtcgttgagtttttgcgtattttttcggtgttggagttcggtggattcggcggttgcgcggcgagacgacgcgttatcgtggaggagacggcgcgggcggtcgattgtcgtgtcgtttagaacggcggtttttttcgtatgaattcgggcgagtgtttggggaacgtggtgagcgacgagcggcgggtgagtagtttcggggggttgtagaacgcgtagttcgggattcgtcgcgacgggattttggttatcgggtgaggaggtagggagtttcgtgttgtcgagggtagagggtttgagatttgggttgtagtcgtgttttcgtgtttaagt

SEQ ID NO: 23530 - DNA, 529 bp, Artificial Sequence
  chemically treated genomic DNA (Homo sapiens) CpG-island No: 23530
acttaaacacgaaaacacgactacaacccaaatctcaaaccctctaccctcgacaacacgaaactccctacctcctcacccgataaccaaaatcccgtcgcgacgaatcccgaactacgcgttctacaaccccccgaaactactcacccgccgctcgtcgctcaccacgttccccaaacactcgcccgaattcatacgaaaaaaaccgccgttctaaacgacacgacaatcgaccgcccgcgccgtctcctccacgataacgcgtcgtctcgccgcgcaaccgccgaatccaccgaactccaacaccgaaaaaatacgcaaaaactcaacgacccgcgtcaaataaccgaccaccgcgcgatccctaaaatacgacacgaaaatacgcacgaccaaaccgccgacgccgaaaatcgcgaaaaacgaaaaccaactctcgtactcgcgattaccgacgcgcacccgtatacaatcccgaaaaaaacgcgcgcgcgcgcgtaaataaaacaataacaaatcgtcgtcgcga

SEQ ID NO: 23531 - DNA, 529 bp, Artificial Sequence
  chemically treated genomic DNA (Homo sapiens) CpG-island No: 23531
atttgaatacggaggtacggttataatttaaattttaggttttttgttttcgatagtacggggttttttgtttttttattcggtgattagggtttcgtcgcggcggatttcgaattgcgcgttttgtagtttttcggagttgtttattcgtcgttcgtcgtttattacgttttttaggtattcgttcgagtttatgcggaagaagtcgtcgttttgggcgatacggtagtcggtcgttcgcgtcgttttttttacggtggcgcgtcgtttcgtcgcgtagtcgtcgggtttatcgggttttagtatcgagaaggtgcgtaggggtttaacggttcgcgttaggtggtcggttatcgcgcggtttttgaagtgcgatacgaaggtgcgtacggttagatcgtcggcgtcgggagtcgcgggaggcggaggttaattttcgtgttcgcggttgtcggcgcgtattcgtgtgtagtttcgggggaggcgcgcgcgcgcgcgtggatagggtagtagtaagtcgtcgtcgcgg

SEQ ID NO: 23532 - DNA, 529 bp, Artificial Sequence
  chemically treated genomic DNA (Homo sapiens) CpG-island No: 23532
ccgcgacgacgacttactactaccctatccacgcgcgcgcgcgcgcctcccccgaaactacacacgaatacgcgccgacaaccgcgaacacgaaaattaacctccgcctcccgcgactcccgacgccgacgatctaaccgtacgcaccttcgtatcgcacttcaaaaaccgcgcgataaccgaccacctaacgcgaaccgttaaacccctacgcaccttctcgatactaaaacccgataaacccgacgactacgcgacgaaacgacgcgccaccgtaaaaaaaacgacgcgaacgaccgactaccgtatcgcccaaaacgacgacttcttccgcataaactcgaacgaatacctaaaaaacgtaataaacgacgaacgacgaataaacaactccgaaaaactacaaaacgcgcaattcgaaatccgccgcgacgaaaccctaatcaccgaataaaaaaacaaaaaaccccgtactatcgaaaacaaaaaacctaaaatttaaattataaccgtacctccgtattcaaat

SEQ ID NO: 23533 - DNA, 547 bp, Artificial Sequence
  chemically treated genomic DNA (Homo sapiens) CpG-island No: 23533
gtgttcgttaaagtattaggagcgtcgagtttcgcggtagcgtagaattaggtgaaggtttcggttagaggcgcgtcgggttcgaggagggtggggttgcgagcgttcgtttcggcggtttttgcgttttagtgtttgttcggttttcggagtttttcggttgggggtgggcggcgttcggttaagatttagtgtttttattttcgcgtttaagtttcgttcgcgcggtggttttttttcgggaaggtaagtattattttttcggggagcggttcgtagagttagtggtcggcgggcgtttcgtttttagcgagtagggattcggagttattgtcgcgtcgtagttcgggtttttcgcgtcgtcgttcgtttatttgcgttttcgttcgtttttcggtgcgcgttcggttcgttagtcgtcgtcgttcgtatttcgagcgttattatgaattcgttttttaggaagagaaataaaggtaaatatagttttattgtgtagattcggaggtgaggaggcgtttatagtttcgtttcgggacgtttttgt

SEQ ID NO: 23534 - DNA, 547 bp, Artificial Sequence
  chemically treated genomic DNA (Homo sapiens) CpG-island No: 23534
acaaaaacgtcccgaaacgaaactataaacgcctcctcacctccgaatctacacaataaaactatatttacctttatttctcttcctaaaaaacgaattcataataacgctcgaaatacgaacgacgacgactaacgaaccgaacgcgcaccgaaaaacgaacgaaaacgcaaataaacgaacgacgacgcgaaaaacccgaactacgacgcgacaataactccgaatccctactcgctaaaaacgaaacgcccgccgaccactaactctacgaaccgctccccgaaaaaataatacttaccttcccgaaaaaaaaccaccgcgcgaacgaaacttaaacgcgaaaataaaaacactaaatcttaaccgaacgccgcccacccccaaccgaaaaactccgaaaaccgaacaaacactaaaacgcaaaaaccgccgaaacgaacgctcgcaaccccaccctcctcgaacccgacgcgcctctaaccgaaaccttcacctaattctacgctaccgcgaaactcgacgctcctaatactttaacgaacac

SEQ ID NO: 23535 - DNA, 547 bp, Artificial Sequence
  chemically treated genomic DNA (Homo sapiens) CpG-island No: 23535
gtaagagcgtttcggagcggagttgtgggcgtttttttattttcgggtttgtatagtggggttgtatttgtttttgtttttttttttgaagagcgagtttatggtggcgttcggggtgcgggcggcggcggttggcgggtcgggcgcgtatcgaggggcgggcgggagcgtaggtgagcgagcggcggcgcggggagttcggattgcggcgcggtagtggtttcgggtttttattcgttgggggcggggcgttcgtcggttattggttttgcgggtcgtttttcgagaaggtggtgtttattttttcgaggaggggttatcgcgcgggcggggtttggacgcgggggtggggatattgggttttggtcggacgtcgtttatttttagtcgggggatttcggaggtcgggtaggtattggggcgtaaaggtcgtcggggcgagcgttcgtagttttatttttttcgggttcggcgcgtttttggtcgaggtttttatttggttttgcgttatcgcggaattcggcgtttttggtgttttggcggatat

SEQ ID NO: 23536 - DNA, 547 bp, Artificial Sequence
  chemically treated genomic DNA (Homo sapiens) CpG-island No: 23536
atatccgccaaaacaccaaaaacgccgaattccgcgataacgcaaaaccaaataaaaacctcgaccaaaaacgcgccgaacccgaaaaaaataaaactacgaacgctcgccccgacgacctttacgccccaatacctacccgacctccgaaatcccccgactaaaaataaacgacgtccgaccaaaacccaatatccccacccccgcgtccaaaccccgcccgcgcgataacccctcctcgaaaaaataaacaccaccttctcgaaaaacgacccgcaaaaccaataaccgacgaacgccccgcccccaacgaataaaaacccgaaaccactaccgcgccgcaatccgaactccccgcgccgccgctcgctcacctacgctcccgcccgcccctcgatacgcgcccgacccgccaaccgccgccgcccgcaccccgaacgccaccataaactcgctcttcaaaaaaaaaaacaaaaacaaatacaaccccactatacaaacccgaaaataaaaaaacgcccacaactccgctccgaaacgctcttac

SEQ ID NO: 23537 - DNA, 546 bp, Artificial Sequence
  chemically treated genomic DNA (Homo sapiens) CpG-island No: 23537
cggggtcggcgttggttttttttttcgcggggcgggtttcgttatgtattatttattggttagagtcgggttgcgggcgcgagtgttgatgttaggtaggcgcgagtgcggcgggcgtagcggcggcggtcgtttagtagttcgggttcgggtgggggggcgtcgagtgggggtggcggttagtatgttgttcggttgcggttcggttttttatattcgcggttttttagttttcgttagtagcggcggcggtagagtagcgagcggcgttcgcgtttgtagcggcgtcgggttcgagcgcgcggcgcggcggtgggggtcggggttcgggcggggagcggggatcgggtatggcgttgcggagaggcggttgcggagcgttcgggttgttgttgttgttgttgggcgtcgcgtgtttgatatcgcggagcgcgtaggtgaggcggttggcgcgttgtttcgttatttgtagttgtattaaggagtttattatttgcgtgggttttttttgggtgtttaggatcgtgtcgggcgatattagttttt

SEQ ID NO: 23538 - DNA, 546 bp, Artificial Sequence
  chemically treated genomic DNA (Homo sapiens) CpG-island No: 23538
aaaaactaatatcgcccgacacgatcctaaacacccaaaaaaaacccacgcaaataataaactccttaatacaactacaaataacgaaacaacgcgccaaccgcctcacctacgcgctccgcgatatcaaacacgcgacgcccaacaacaacaacaacaacccgaacgctccgcaaccgcctctccgcaacgccatacccgatccccgctccccgcccgaaccccgacccccaccgccgcgccgcgcgctcgaacccgacgccgctacaaacgcgaacgccgctcgctactctaccgccgccgctactaacgaaaactaaaaaaccgcgaatataaaaaaccgaaccgcaaccgaacaacatactaaccgccacccccactcgacgcccccccacccgaacccgaactactaaacgaccgccgccgctacgcccgccgcactcgcgcctacctaacatcaacactcgcgcccgcaacccgactctaaccaataaataatacataacgaaacccgccccgcgaaaaaaaaaaccaacgccgaccccg

SEQ ID NO: 23539 - DNA, 546 bp, Artificial Sequence
  chemically treated genomic DNA (Homo sapiens) CpG-island No: 23539
gggagttgatgtcgttcggtacgattttgggtatttaggaagagtttacgtagatgatagattttttggtatagttgtaagtggcggggtagcgcgttagtcgttttatttgcgcgtttcgcggtattaggtacgcggcgtttagtagtagtagtagtagttcgagcgtttcgtagtcgttttttcgtagcgttatgttcggttttcgtttttcgttcgggtttcgatttttatcgtcgcgtcgcgcgttcggattcggcgtcgttgtagacgcgggcgtcgttcgttgttttgtcgtcgtcgttgttggcgaggattagggagtcgcgggtgtgggaggtcgagtcgtagtcgagtagtatgttggtcgttatttttattcggcgtttttttattcgagttcgggttgttgggcggtcgtcgtcgttgcgttcgtcgtattcgcgtttgtttgatattagtattcgcgttcgtagttcggttttggttaatgaataatgtatggcggggttcgtttcgcgggggagggggttagcgtcggtttcg

SEQ ID NO: 23540 - DNA, 546 bp, Artificial Sequence
  chemically treated genomic DNA (Homo sapiens) CpG-island No: 23540
cgaaaccgacgctaaccccctcccccgcgaaacgaaccccgccatacattattcattaaccaaaaccgaactacgaacgcgaatactaatatcaaacaaacgcgaatacgacgaacgcaacgacgacgaccgcccaacaacccgaactcgaataaaaaaacgccgaataaaaataacgaccaacatactactcgactacgactcgacctcccacacccgcgactccctaatcctcgccaacaacgacgacgacaaaacaacgaacgacgcccgcgtctacaacgacgccgaatccgaacgcgcgacgcgacgataaaaatcgaaacccgaacgaaaaacgaaaaccgaacataacgctacgaaaaaacgactacgaaacgctcgaactactactactactactaaacgccgcgtacctaataccgcgaaacgcgcaaataaaacgactaacgcgctaccccgccacttacaactataccaaaaaatctatcatctacgtaaactcttcctaaatacccaaaatcgtaccgaacgacatcaactccc

SEQ ID NO: 23541 - DNA, 806 bp, Artificial Sequence
  chemically treated genomic DNA (Homo sapiens) CpG-island No: 23541
ggtatagcgcggtcgtaggcgttcggcgtagcgtagtgggaagtttattgttagttattggtttgcgtttagcgtcgttacgtttagcgtcgcgttggacgttaggaaggtgtttaggaagttaatgatttggtatgcgtcgggcgtcgacggtgttcgttcgcgtattatatcgagtagcgtgaagggtatgtttagcgtcgttagtagtaggtggtttagagatagatttattaggaggacgtttgaggttcgagtgcggagtttagcgttgtaggcgtaataaagtagtattagtgcgttggatagtagcgttacggttagtattattattaggagattcgttagtagcgtttcgtcggggtttatggcgttagcggttcgttaggtattttggggtttttatggttttgtttcgggcgcgagtttgggaaagtgaggcgatggagtagttgagcggcgcgtttacggtttttgggaggtgtagagtcggttagtaaggtttagagtagcgcgaggaaagcggcggtaagtgtagggttcggggtattcggggggagggcgtagttttgcggagtaggagtagttcggggtcgttttggaggtagcgtaatcgcggtgttgtttagggtgttgaatgcgtttatcgtttcggtaggattgttttgaggttgaagcgaggcgtaggggcgcggggcgtaggggcgagggaggttttttttttaatattgtatttttttttttttttttttcgtggcgtggtaggatgggattttgcgcgtttttgtttcgggttaggttagttt

SEQ ID NO: 23542 - DNA, 806 bp, Artificial Sequence
  chemically treated genomic DNA (Homo sapiens) CpG-island No: 23542
aaactaacctaacccgaaacaaaaacgcgcaaaatcccatcctaccacgccacgaaaaaaaaaaaaaaaaaaatacaatattaaaaaaaaaacctccctcgcccctacgccccgcgcccctacgcctcgcttcaacctcaaaacaatcctaccgaaacgataaacgcattcaacaccctaaacaacaccgcgattacgctacctccaaaacgaccccgaactactcctactccgcaaaactacgccctccccccgaataccccgaaccctacacttaccgccgctttcctcgcgctactctaaaccttactaaccgactctacacctcccaaaaaccgtaaacgcgccgctcaactactccatcgcctcactttcccaaactcgcgcccgaaacaaaaccataaaaaccccaaaatacctaacgaaccgctaacgccataaaccccgacgaaacgctactaacgaatctcctaataataatactaaccgtaacgctactatccaacgcactaatactactttattacgcctacaacgctaaactccgcactcgaacctcaaacgtcctcctaataaatctatctctaaaccacctactactaacgacgctaaacatacccttcacgctactcgatataatacgcgaacgaacaccgtcgacgcccgacgcataccaaatcattaacttcctaaacaccttcctaacgtccaacgcgacgctaaacgtaacgacgctaaacgcaaaccaataactaacaataaacttcccactacgctacgccgaacgcctacgaccgcgctatacc

SEQ ID NO: 23543 - DNA, 806 bp, Artificial Sequence
  chemically treated genomic DNA (Homo sapiens) CpG-island No: 23543
ggattgatttggttcggaatagaagcgcgtagagttttattttgttacgttacgaggagagaagaaggaaagatatagtgttaggaaagagatttttttcgtttttacgtttcgcgtttttgcgtttcgttttagttttaggatagttttgtcgggacggtgagcgtatttagtattttggatagtatcgcggttgcgttgtttttagggcggtttcgggttgtttttgtttcgtagagttacgtttttttttcgggtgtttcggattttgtatttgtcgtcgtttttttcgcgttgttttggattttgttagtcggttttgtattttttagaagtcgtgggcgcgtcgtttagttgttttatcgttttatttttttaggttcgcgttcgaagtagagttatgagaattttagggtgtttggcgagtcgttagcgttatgggtttcggcgaggcgttgttggcgggttttttggtgatggtattggtcgtggcgttgttatttaacgtattggtgttgttttgttgcgtttatagcgttgagtttcgtattcgagttttaggcgtttttttggtgaatttgtttttgggttatttgttgttggcggcgttggatatgttttttacgttgttcggtgtgatgcgcgggcggatatcgtcggcgttcggcgtatgttaagttattggttttttggatatttttttggcgtttaacgcggcgttgagcgtggcggcgttgagcgtagattagtggttggtagtgggttttttattgcgttacgtcggacgtttgcgatcgcgttatgtt

SEQ ID NO: 23544 - DNA, 806 bp, Artificial Sequence
  chemically treated genomic DNA (Homo sapiens) CpG-island No: 23544
aacataacgcgatcgcaaacgtccgacgtaacgcaataaaaaacccactaccaaccactaatctacgctcaacgccgccacgctcaacgccgcgttaaacgccaaaaaaatatccaaaaaaccaataacttaacatacgccgaacgccgacgatatccgcccgcgcatcacaccgaacaacgtaaaaaacatatccaacgccgccaacaacaaataacccaaaaacaaattcaccaaaaaaacgcctaaaactcgaatacgaaactcaacgctataaacgcaacaaaacaacaccaatacgttaaataacaacgccacgaccaataccatcaccaaaaaacccgccaacaacgcctcgccgaaacccataacgctaacgactcgccaaacaccctaaaattctcataactctacttcgaacgcgaacctaaaaaaataaaacgataaaacaactaaacgacgcgcccacgacttctaaaaaatacaaaaccgactaacaaaatccaaaacaacgcgaaaaaaacgacgacaaatacaaaatccgaaacacccgaaaaaaaaacgtaactctacgaaacaaaaacaacccgaaaccgccctaaaaacaacgcaaccgcgatactatccaaaatactaaatacgctcaccgtcccgacaaaactatcctaaaactaaaacgaaacgcaaaaacgcgaaacgtaaaaacgaaaaaaatctctttcctaacactatatctttccttcttctctcctcgtaacgtaacaaaataaaactctacgcgcttctattccgaaccaaatcaatcc

SEQ ID NO: 23545 - DNA, 705 bp, Artificial Sequence
  chemically treated genomic DNA (Homo sapiens) CpG-island No: 23545
  misc_feature (240)..(240): n is either a, c, g or t
gcgagcgtgcgagcgtgtgagcgtgcgagtgtgcgagcgtgtgagcgtgcgagcgtgcgagtgtgcgtgcgagcgtgcgagtgtgcgagcgtgcgagtgcgagcgtgcgagcgtgcgagtgtgcgtgcgtgtgagtgtgcgagtgtgcgagcgagcggagtcgtgagagtggtagtgtttagtgcgaaggggtacggagtggtgcgaggtgcgcggaggtgtgtcgagcgttgcggaatngcgcgtagcgtggtggagtgtggcgaggggtgcggagcgttgtgtgttgttcggagcgtgcgggcggtgcggaatggtgcgggcggtgcggagtggggcggggtgtgtcggagcgtgcggggcggaggggagcgttgcggagtggtgcggagcggtgtcggatttgcgtattgggatgttgcgtgtggtttcgagtttgttagatgttggggggtggtgttagtatgatcgacgtgttagaacgttgcgcgatggtgcgcgggtgcgggagttgtcggaagtggtcgagaattgtgcggtagtgttgggggacgggtggagttgtaggtcgcggggggagtaaaggttgtggcggagcggacggtgaaaagatgtcggtgtttggcggggtaatgggggtggggtttgggagagggtgtgggttgcgttggggggttattttgtgcggtttgtcggtgcgagagg

SEQ ID NO: 23546 - DNA, 705 bp, Artificial Sequence
  chemically treated genomic DNA (Homo sapiens) CpG-island No: 23546
  misc_feature (466)..(466): n is either a, c, g or t
cctctcgcaccgacaaaccgcacaaaataaccccccaacgcaacccacaccctctcccaaaccccacccccattaccccgccaaacaccgacatcttttcaccgtccgctccgccacaacctttactccccccgcgacctacaactccacccgtcccccaacactaccgcacaattctcgaccacttccgacaactcccgcacccgcgcaccatcgcgcaacgttctaacacgtcgatcatactaacaccaccccccaacatctaacaaactcgaaaccacacgcaacatcccaatacgcaaatccgacaccgctccgcaccactccgcaacgctcccctccgccccgcacgctccgacacaccccgccccactccgcaccgcccgcaccattccgcaccgcccgcacgctccgaacaacacacaacgctccgcacccctcgccacactccaccacgctacgcgcnattccgcaacgctcgacacacctccgcgcacctcgcaccactccgtaccccttcgcactaaacactaccactctcacgactccgctcgctcgcacactcgcacactcacacgcacgcacactcgcacgctcgcacgctcgcactcgcacgctcgcacactcgcacgctcgcacgcacactcgcacgctcgcacgctcacacgctcgcacactcgcacgctcacacgctcgcacgctcgc

SEQ ID NO: 23547 - DNA, 705 bp, Artificial Sequence
  chemically treated genomic DNA (Homo sapiens) CpG-island No: 23547
  misc_feature (466)..(466): n is either a, c, g or t
tttttcgtatcggtaaatcgtatagaataattttttaacgtaatttatatttttttttaaattttatttttattatttcgttaagtatcgatatttttttatcgttcgtttcgttataatttttatttttttcgcggtttataattttattcgttttttaatattatcgtataattttcgattattttcgatagttttcgtattcgcgtattatcgcgtagcgttttgatacgtcggttatattaatattattttttaatatttgataagttcggaattatacgtaatattttaatacgtaagttcggtatcgtttcgtattatttcgtaacgttttttttcgtttcgtacgtttcggtatatttcgttttatttcgtatcgttcgtattatttcgtatcgttcgtacgtttcgaataatatataacgtttcgtatttttcgttatattttattacgttgcgcgtnatttcgtagcgttcggtatattttcgcgtatttcgtattatttcgtattttttcgtattggatattattatttttacggtttcgttcgttcgtatattcgtatatttatacgtacgtatattcgtacgttcgtacgttcgtattcgtacgttcgtatattcgtacgttcgtacgtatattcgtacgttcgtacgtttatacgttcgtatattcgtacgtttatacgttcgtacgttcgt

SEQ ID NO: 23548 - DNA, 705 bp, Artificial Sequence
  chemically treated genomic DNA (Homo sapiens) CpG-island No: 23548
  misc_feature (240)..(240): n is either a, c, g or t
acgaacgtacgaacgtataaacgtacgaatatacgaacgtataaacgtacgaacgtacgaatatacgtacgaacgtacgaatatacgaacgtacgaatacgaacgtacgaacgtacgaatatacgtacgtataaatatacgaatatacgaacgaacgaaaccgtaaaaataataatatccaatacgaaaaaatacgaaataatacgaaatacgcgaaaatataccgaacgctacgaaatnacgcgcaacgtaataaaatataacgaaaaatacgaaacgttatatattattcgaaacgtacgaacgatacgaaataatacgaacgatacgaaataaaacgaaatataccgaaacgtacgaaacgaaaaaaaacgttacgaaataatacgaaacgataccgaacttacgtattaaaatattacgtataattccgaacttatcaaatattaaaaaataatattaatataaccgacgtatcaaaacgctacgcgataatacgcgaatacgaaaactatcgaaaataatcgaaaattatacgataatattaaaaaacgaataaaattataaaccgcgaaaaaaataaaaattataacgaaacgaacgataaaaaaatatcgatacttaacgaaataataaaaataaaatttaaaaaaaaatataaattacgttaaaaaattattctatacgatttaccgatacgaaaaa

SEQ ID NO: 23549 - DNA, 888 bp, Artificial Sequence
  chemically treated genomic DNA (Homo sapiens) CpG-island No: 23549
ttttcgttcgagttatagattattcgtttttcgtttaggattttatcggttatagcggggcgtcgtagggtttcgcggttttttttttattgattttgtcgtttgcggtggcggtcgtcgtaacgagcggattatagttattgaggcgttttgcgtcgggttttaggcgtttcgtatattcgttcgttttttagcgaaagtagcggcggaggcggcggtcgtagcggtggtgggtggtagttttttcgtttcgttcgtcggaagtttttacgcgtatattatataatagaggtcgcggcggttttgttagttaggtcgggtacggtttagagggagttcgtttcggttattgttttcgtagttagcgtcgcggcgtatattcggattttatttttttattcgggtcgtcgttatttttcggtttttttgtcgaagcggcggttttttaggttttagattcggttcggttttaagaggcgattttcgttcgggtttatttaagtcgggtcgtatttagttcgtcgtttttttttttttttgttcggcgtttacgattcgtagcgttcgttcggggtgagcggggcgtcgcgttttatcgaatttaaggcgaagaggaaagagttagaaattttcgatgtatcggtaattgcggcggtgttttttttgcgatcggaattaacgttaggaggagggagaggtgttattttcgttcggatcgtttttttatcgcgagattttttttttttgtttcgttttgatcgtggataggcgttttcgttttttttattgcgcgcggattagggtgagggattgggataggggaggggagagacgtttttagttttttttatttttttattgggttttacgtcgtttggatatttgttt

SEQ ID NO: 23550 - DNA, 888 bp, Artificial Sequence
  chemically treated genomic DNA (Homo sapiens) CpG-island No: 23550
aaacaaatatccaaacgacgtaaaacccaataaaaaaataaaaaaaactaaaaacgtctctcccctcccctatcccaatccctcaccctaatccgcgcgcaataaaaaaaacgaaaacgcctatccacgatcaaaacgaaacaaaaaaaaaaaatctcgcgataaaaaaacgatccgaacgaaaataacacctctccctcctcctaacgttaattccgatcgcaaaaaaaacaccgccgcaattaccgatacatcgaaaatttctaactctttcctcttcgccttaaattcgataaaacgcgacgccccgctcaccccgaacgaacgctacgaatcgtaaacgccgaacaaaaaaaaaaaaaaacgacgaactaaatacgacccgacttaaataaacccgaacgaaaatcgcctcttaaaaccgaaccgaatctaaaacctaaaaaaccgccgcttcgacaaaaaaaccgaaaaataacgacgacccgaataaaaaaataaaatccgaatatacgccgcgacgctaactacgaaaacaataaccgaaacgaactccctctaaaccgtacccgacctaactaacaaaaccgccgcgacctctattatataatatacgcgtaaaaacttccgacgaacgaaacgaaaaaactaccacccaccaccgctacgaccgccgcctccgccgctactttcgctaaaaaacgaacgaatatacgaaacgcctaaaacccgacgcaaaacgcctcaataactataatccgctcgttacgacgaccgccaccgcaaacgacaaaatcaataaaaaaaaaaccgcgaaaccctacgacgccccgctataaccgataaaatcctaaacgaaaaacgaataatctataactcgaacgaaaa

SEQ ID NO: 23551 - DNA, 888 bp, Artificial Sequence
  chemically treated genomic DNA (Homo sapiens) CpG-island No: 23551
ggataagtgtttaggcgacgtggaatttagtaagggaataaagaagattggaaacgtttttttttttttttattttagttttttattttaattcgcgcgtaatagaaaaggcggaagcgtttgtttacgattagggcggggtaaggggaagaaatttcgcgataggagagcggttcgggcgggggtggtatttttttttttttttggcgttagtttcggtcgtagaggagatatcgtcgtagttgtcggtatatcggggatttttggttttttttttttcgttttaaattcggtgagacgcggcgtttcgtttatttcgggcggacgttgcgggtcgtggacgtcgggtagagggagagggaggcggcgggttggatgcggttcggtttggatgggttcgaacggaggtcgttttttgaggtcgggtcggatttagggtttgaaaggtcgtcgtttcggtagggaggtcgaggggtagcggcggttcgggtggggaggtggggttcgggtgtgcgtcgcggcgttggttgcgaaggtagtggtcgaggcgggttttttttgggtcgtgttcggtttggttaataaagtcgtcgcggtttttgttgtgtgatgtacgcgtgggggttttcggcgggcggggcggaggggttgttatttattatcgttgcggtcgtcgttttcgtcgttgttttcgttggagggcgggcggatgtacggggcgtttggggttcggcgtaaagcgttttagtgattgtggttcgttcgttgcggcggtcgttatcgtaggcgatagggttagtggagaaagagtcgcgggattttacggcgtttcgttgtggtcgatggggttttgggcgggaagcgggtgatttgtggttcgggcgggag

SEQ ID NO: 23552 - DNA, 888 bp, Artificial Sequence
  chemically treated genomic DNA (Homo sapiens) CpG-island No: 23552
ctcccgcccgaaccacaaatcacccgcttcccgcccaaaaccccatcgaccacaacgaaacgccgtaaaatcccgcgactctttctccactaaccctatcgcctacgataacgaccgccgcaacgaacgaaccacaatcactaaaacgctttacgccgaaccccaaacgccccgtacatccgcccgccctccaacgaaaacaacgacgaaaacgacgaccgcaacgataataaataacaacccctccgccccgcccgccgaaaacccccacgcgtacatcacacaacaaaaaccgcgacgactttattaaccaaaccgaacacgacccaaaaaaaacccgcctcgaccactaccttcgcaaccaacgccgcgacgcacacccgaaccccacctccccacccgaaccgccgctacccctcgacctccctaccgaaacgacgacctttcaaaccctaaatccgacccgacctcaaaaaacgacctccgttcgaacccatccaaaccgaaccgcatccaacccgccgcctccctctccctctacccgacgtccacgacccgcaacgtccgcccgaaataaacgaaacgccgcgtctcaccgaatttaaaacgaaaaaaaaaaaaccaaaaatccccgatataccgacaactacgacgatatctcctctacgaccgaaactaacgccaaaaaaaaaaaaaaataccacccccgcccgaaccgctctcctatcgcgaaatttcttccccttaccccgccctaatcgtaaacaaacgcttccgccttttctattacgcgcgaattaaaataaaaaactaaaataaaaaaaaaaaaaaacgtttccaatcttctttattcccttactaaattccacgtcgcctaaacacttatcc

SEQ ID NO: 23553 - DNA, 716 bp, Artificial Sequence
  chemically treated genomic DNA (Homo sapiens) CpG-island No: 23553
ttcgcggtcggttcgacggtagtatatttagtaggaacgttcgtaaggtaggttatggtggtagggtttggggtgttagcggtagagcgatacgtcgtttttttcgtattttttgcggtattgtttgtacggattatcgcggtagagcgggtttcggttttagcgcgagtttgtggttcgtacgttaaacgtttcgatgatgtttttgaagtggtggtaggtgtatttgagggcggttagcgcgcgcgtgggtaggaagttgaagattttgattagtacgtgttcgggtagtagtagtatgtattgtcgcggttttagtagtcgttgaattttgaagcggatttttaggaagtcgtgcgatacgtgtcggtataagcggtatagggaggtgttcgtcgtgttttcggtatcgtttgggtcgggcgtagtggtcggggagtcggtcgggggtggtttcgggggttcgttcggttcgcggttttggagaaagaagagttggttcggaggcggcggttttttcgggttgatcgttaggtatatagtttttttttttacgtttttggtgtcgtttttgttaaagaagatgtatttatttattacgttcgttattattacgtttacgtggaagtttgacgtttcgtagtttcgggtagggggcggagggggcgtcgggggagtgtttttaggtttggcgggtgtcgggttgttatttttat

SEQ ID NO: 23554 - DNA, 716 bp, Artificial Sequence
  chemically treated genomic DNA (Homo sapiens) CpG-island No: 23554
ataaaaataacaacccgacacccgccaaacctaaaaacactcccccgacgccccctccgccccctacccgaaactacgaaacgtcaaacttccacgtaaacgtaataataacgaacgtaataaataaatacatcttctttaacaaaaacgacaccaaaaacgtaaaaaaaaaaactatatacctaacgatcaacccgaaaaaaccgccgcctccgaaccaactcttctttctccaaaaccgcgaaccgaacgaacccccgaaaccacccccgaccgactccccgaccactacgcccgacccaaacgataccgaaaacacgacgaacacctccctataccgcttataccgacacgtatcgcacgacttcctaaaaatccgcttcaaaattcaacgactactaaaaccgcgacaatacatactactactacccgaacacgtactaatcaaaatcttcaacttcctacccacgcgcgcgctaaccgccctcaaatacacctaccaccacttcaaaaacatcatcgaaacgtttaacgtacgaaccacaaactcgcgctaaaaccgaaacccgctctaccgcgataatccgtacaaacaataccgcaaaaaatacgaaaaaaacgacgtatcgctctaccgctaacaccccaaaccctaccaccataacctaccttacgaacgttcctactaaatatactaccgtcgaaccgaccgcgaa

SEQ ID NO: 23555 - DNA, 716 bp, Artificial Sequence
  chemically treated genomic DNA (Homo sapiens) CpG-island No: 23555
gtgagggtgatagttcggtattcgttaggtttgaggatattttttcggcgtttttttcgttttttgttcgggattgcggagcgttaggtttttacgtggacgtggtggtgacgggcgtggtagatgagtgtattttttttggtaaggacggtattaagaacgtgaaggaggagattgtgtgtttgacggttagttcggaggaatcgtcgttttcgggttagtttttttttttttagaatcgcgggtcggacgggttttcggagttattttcggtcgatttttcggttattgcgttcggtttagacgatgtcgagggtacggcggatatttttttgtgtcgtttgtatcggtacgtgtcgtacgattttttagagattcgttttaagatttagcggttgttggagtcgcgatagtatatgttgttgttgttcgagtacgtgttggttaagatttttagttttttgtttacgcgcgcgttggtcgtttttaagtgtatttgttattattttaagggtattatcgaggcgtttggcgtgcgggttatagattcgcgttggagtcgagattcgttttatcgcgatgattcgtgtaaatagtgtcgtaagagatacgagaagggcgacgtgtcgttttgtcgttggtattttaagttttattattatgatttgttttacggacgtttttattggatgtgttgtcgtcgagtcgatcgcgag

SEQ ID NO: 23556 - DNA, 716 bp, Artificial Sequence
  chemically treated genomic DNA (Homo sapiens) CpG-island No: 23556
ctcgcgatcgactcgacgacaacacatccaataaaaacgtccgtaaaacaaatcataataataaaacttaaaataccaacgacaaaacgacacgtcgcccttctcgtatctcttacgacactatttacacgaatcatcgcgataaaacgaatctcgactccaacgcgaatctataacccgcacgccaaacgcctcgataatacccttaaaataataacaaatacacttaaaaacgaccaacgcgcgcgtaaacaaaaaactaaaaatcttaaccaacacgtactcgaacaacaacaacatatactatcgcgactccaacaaccgctaaatcttaaaacgaatctctaaaaaatcgtacgacacgtaccgatacaaacgacacaaaaaaatatccgccgtaccctcgacatcgtctaaaccgaacgcaataaccgaaaaatcgaccgaaaataactccgaaaacccgtccgacccgcgattctaaaaaaaaaaaaactaacccgaaaacgacgattcctccgaactaaccgtcaaacacacaatctcctccttcacgttcttaataccgtccttaccaaaaaaaatacactcatctaccacgcccgtcaccaccacgtccacgtaaaaacctaacgctccgcaatcccgaacaaaaaacgaaaaaaacgccgaaaaaatatcctcaaacctaacgaataccgaactatcaccctcac

SEQ ID NO: 23557 - DNA, 680 bp, Artificial Sequence
  chemically treated genomic DNA (Homo sapiens) CpG-island No: 23557
gtgcggtcgtagagagtgttcggttattttcgaaagcgttcgggcgtttttaagtttagtcgagtttagtttcggatttttcgtcgattcgattgtattcggttatttttggaaacgttcggttgtttcgggggtattttttagtttattagtttcgcgggattacgttcggttattttcggaaatattcgggtgtttttttattttaggtttcgtttcggtttcggtttattcgttcggttcgaatgcgttcgggtattttcgtcgggggcgggttaggtcgttcggaatcgtggcggcggcggaggcggggatttcgcggttgcggcgacggtggtcgcggtggagttacggggcgggtttggtttggtgtgacggcggttgcggcggcggtggcggtcgcgattaggtgagttttgattggttttcgtggcgggggcggttgggagtgtgtttaaatgcggggcgttcgggggtagtgtcgggtttcggtggaagttagaacgtaagcgttaggttgcgtcgggtttcgcgggaattgggggggtcgtaggtaagggggggtttcgggttcggtttcgtagcggtgtagtttttttgggacggtcggggtagaatggggagagatttttcgcgtttaagatatcggattggagtcgaggttttaaatgaagggaggt

SEQ ID NO: 23558 - DNA, 680 bp, Artificial Sequence
  chemically treated genomic DNA (Homo sapiens) CpG-island No: 23558
acctcccttcatttaaaacctcgactccaatccgatatcttaaacgcgaaaaatctctccccattctaccccgaccgtcccaaaaaaactacaccgctacgaaaccgaacccgaaacccccccttacctacgacccccccaattcccgcgaaacccgacgcaacctaacgcttacgttctaacttccaccgaaacccgacactacccccgaacgccccgcatttaaacacactcccaaccgcccccgccacgaaaaccaatcaaaactcacctaatcgcgaccgccaccgccgccgcaaccgccgtcacaccaaaccaaacccgccccgtaactccaccgcgaccaccgtcgccgcaaccgcgaaatccccgcctccgccgccgccacgattccgaacgacctaacccgcccccgacgaaaatacccgaacgcattcgaaccgaacgaataaaccgaaaccgaaacgaaacctaaaataaaaaaacacccgaatatttccgaaaataaccgaacgtaatcccgcgaaactaataaactaaaaaatacccccgaaacaaccgaacgtttccaaaaataaccgaatacaatcgaatcgacgaaaaatccgaaactaaactcgactaaacttaaaaacgcccgaacgctttcgaaaataaccgaacactctctacgaccgcac

SEQ ID NO: 23559 - DNA, 680 bp, Artificial Sequence
  chemically treated genomic DNA (Homo sapiens) CpG-island No: 23559
gtttttttttatttggggtttcggttttagttcggtattttggacgcggggagtttttttttattttgtttcgatcgttttaaggaggttgtatcgttgcggagtcgagttcgaggtttttttttgtttgcggtttttttagttttcgcggggttcgacgtagtttggcgtttgcgttttggtttttatcggggttcggtattgttttcgggcgtttcgtatttaagtatatttttagtcgttttcgttacgagggttagttaggatttatttggtcgcggtcgttatcgtcgtcgtagtcgtcgttatattaagttaagttcgtttcgtggttttatcgcggttatcgtcgtcgtagtcgcgggattttcgttttcgtcgtcgttacggtttcgagcggtttggttcgttttcggcggaaatgttcgagcgtattcgagtcgggcggatgaatcgaggtcgaggcggagtttgaggtaagggggtattcgagtgttttcggaagtagtcgaacgtaatttcgcgggattggtggattagagggtgttttcgagatagtcgagcgtttttagaggtagtcgagtgtaatcgggtcggcgagggattcgagattgggttcggttgggtttagagacgttcgagcgttttcggaaatggtcgaatattttttacggtcgtat

SEQ ID NO: 23560 - DNA, 680 bp, Artificial Sequence
  chemically treated genomic DNA (Homo sapiens) CpG-island No: 23560
atacgaccgtaaaaaatattcgaccatttccgaaaacgctcgaacgtctctaaacccaaccgaacccaatctcgaatccctcgccgacccgattacactcgactacctctaaaaacgctcgactatctcgaaaacaccctctaatccaccaatcccgcgaaattacgttcgactacttccgaaaacactcgaatacccccttacctcaaactccgcctcgacctcgattcatccgcccgactcgaatacgctcgaacatttccgccgaaaacgaaccaaaccgctcgaaaccgtaacgacgacgaaaacgaaaatcccgcgactacgacgacgataaccgcgataaaaccacgaaacgaacttaacttaatataacgacgactacgacgacgataacgaccgcgaccaaataaatcctaactaaccctcgtaacgaaaacgactaaaaatatacttaaatacgaaacgcccgaaaacaataccgaaccccgataaaaaccaaaacgcaaacgccaaactacgtcgaaccccgcgaaaactaaaaaaaccgcaaacaaaaaaaaacctcgaactcgactccgcaacgatacaacctccttaaaacgatcgaaacaaaataaaaaaaaactccccgcgtccaaaataccgaactaaaaccgaaaccccaaataaaaaaaaac

SEQ ID NO: 23561 - DNA, 1273 bp, Artificial Sequence
  chemically treated genomic DNA (Homo sapiens) CpG-island No: 23561
ttttttttttttatttttcgtttttttttcgcgcgttattcgtttttttttttttttcgttaataacggttgggtggttgggggaggagggaaggtggtttcggcggagtttgggcgggcgttttttatttagtcgttagtcgtcgtgggagtcggaggatggcggcggtagtagcggtcgtcggagattaggcggtgcggaggttcggggcgttaagcgcggcggtagaaagcggtagcggttcgttatggcgtattagaatcgaaattagcggtagtcgtatcgttatttgagtcgtttttttttgttggagatagcgaggggtgtttgtagtcgggatattttttttttcgcgttttttcgtttttcgcgttcgcgttaggtcgttagttttgtttatcgtttcgagaagagcgcgtcgggcgtcgattgtttttcggggcgtcgggcggcggttttggacgtgcgggggtttttttgggtcggtcgtagcgtttcggttttgttttttagttttcgcgttcgtttttgtttttttggttttcggggtatagcgcgcggttcggttcggagtagggcggatatgagcgttaagtagagcggtttggtcgtcgtttacggcgtacgcgcgcgtattcggttcggatttattttttagtagtagcggagtggttaatgggatcgggattagagtcgggggtcggaggtcgtcgtcgcggggaggttttcggtttaggtgtttagcgtttattagttcggcggcgtcgcggcggtttcgtagttgttttttcgggggggcgtggcgtcgggggttttcgcggcgtagtttttttttagtatttcgaatagtagtagcggttcgtaggattcgtaggattcggtgtatagtagttttgaggatggcggcggcggtcggtatcggtcggtgggttggagtttcggcgggtcgtttttggtgatcggttttttattagtttattttttatcgcgtatgtttggaggtacggatttttttttacgcgttcgcgttcggttttttcgcggttgtacgtgggtcgtggtcgtcggttatttttatttttttttttttttttttcggtcggggcgtcgggggttgtttttcggtttagttcgcgtcggtttttattttgggaagaaattcggtacgtaatatttgcggtgtcgttgtcgcgtagatacgtggttttgtttttaaatatcgtgagtatttatattttagcgggtatttagtagagatagtttattttttag

SEQ ID NO: 23562 - DNA, 1273 bp, Artificial Sequence
  chemically treated genomic DNA (Homo sapiens) CpG-island No: 23562
ctaaaaaataaactatctctactaaatacccgctaaaatataaatactcacgatatttaaaaacaaaaccacgtatctacgcgacaacgacaccgcaaatattacgtaccgaatttcttcccaaaataaaaaccgacgcgaactaaaccgaaaaacaacccccgacgccccgaccgaaaaaaaaaaaaaaaaaaataaaaataaccgacgaccacgacccacgtacaaccgcgaaaaaaccgaacgcgaacgcgtaaaaaaaaatccgtacctccaaacatacgcgataaaaaataaactaataaaaaaccgatcaccaaaaacgacccgccgaaactccaacccaccgaccgataccgaccgccgccgccatcctcaaaactactatacaccgaatcctacgaatcctacgaaccgctactactattcgaaatactaaaaaaaaactacgccgcgaaaacccccgacgccacgcccccccgaaaaaacaactacgaaaccgccgcgacgccgccgaactaataaacgctaaacacctaaaccgaaaacctccccgcgacgacgacctccgacccccgactctaatcccgatcccattaaccactccgctactactaaaaaataaatccgaaccgaatacgcgcgcgtacgccgtaaacgacgaccaaaccgctctacttaacgctcatatccgccctactccgaaccgaaccgcgcgctataccccgaaaaccaaaaaaacaaaaacgaacgcgaaaactaaaaaacaaaaccgaaacgctacgaccgacccaaaaaaacccccgcacgtccaaaaccgccgcccgacgccccgaaaaacaatcgacgcccgacgcgctcttctcgaaacgataaacaaaactaacgacctaacgcgaacgcgaaaaacgaaaaaacgcgaaaaaaaaaatatcccgactacaaacacccctcgctatctccaacaaaaaaaaacgactcaaataacgatacgactaccgctaatttcgattctaatacgccataacgaaccgctaccgctttctaccgccgcgcttaacgccccgaacctccgcaccgcctaatctccgacgaccgctactaccgccgccatcctccgactcccacgacgactaacgactaaataaaaaacgcccgcccaaactccgccgaaaccaccttccctcctcccccaaccacccaaccgttattaacgaaaaaaaaaaaaaaacgaataacgcgcgaaaaaaaaacgaaaaataaaaaaaaaaaa

SEQ ID NO: 23563 - DNA, 1273 bp, Artificial Sequence
  chemically treated genomic DNA (Homo sapiens) CpG-island No: 23563
ttggaaaatagattatttttattgagtattcgttgaggtgtgggtgtttacgatgtttaaaaataaaattacgtgtttacgcggtagcgatatcgtaggtgttacgtgtcgggtttttttttaggatggagatcggcgcgggttgggtcgggaagtagttttcggcgtttcggtcgaaggagaaaaggagaagggtaaaaatagtcggcggttacggtttacgtgtagtcgcgggaggatcgagcgcgggcgcgtggagaggggttcgtatttttaaatatgcgcggtgagaggtgagttggtaaggagtcgattattaggagcggttcgtcggggttttagtttatcggtcggtgtcggtcgtcgtcgttatttttagggttgttgtgtatcgagttttgcgagttttacgggtcgttgttgttgttcgggatgttgaaagaggattgcgtcgcgaaggttttcgacgttacgttttttcgaggaaatagttgcggggtcgtcgcggcgtcgtcgggttggtgagcgttgggtatttgggtcgggaattttttcgcggcggcggttttcggttttcggttttggtttcggttttattggttatttcgttgttattggaaggtagattcgagtcgagtacgcgcgcgtgcgtcgtgagcggcggttaggtcgttttgtttggcgtttatgttcgttttgtttcggatcgggtcgcgcgttgtgtttcgagagttaagaaggtaggagcgaacgcgggagttagagggtagggtcgaggcgttgcggtcggtttagagaggttttcgtacgtttagggtcgtcgttcggcgtttcgaggggtagtcggcgttcggcgcgtttttttcggggcggtgggtaaggttggcggtttgacgcgggcgcgggagacgaggagacgcggagaagaaggtgtttcggttgtaggtatttttcgttgtttttagtaggaaggggcgatttaggtggcggtgcgattgtcgttggtttcggttttggtgcgttatgacgggtcgttgtcgttttttgtcgtcgcgtttggcgtttcgggttttcgtatcgtttagttttcggcggtcgttgttatcgtcgttatttttcggtttttacggcggttggcggttgagtgggaggcgttcgtttagatttcgtcggagttattttttttttttttttagttatttagtcgttattaacggagaaagaggaaaaacgggtggcgcgcgaggggaggacgaagaatgggagggaggga

SEQ ID NO: 23564 - DNA, 1273 bp, Artificial Sequence
  chemically treated genomic DNA (Homo sapiens) CpG-island No: 23564
tccctccctcccattcttcgtcctcccctcgcgcgccacccgtttttcctctttctccgttaataacgactaaataactaaaaaaaaaaaaaaaataactccgacgaaatctaaacgaacgcctcccactcaaccgccaaccgccgtaaaaaccgaaaaataacgacgataacaacgaccgccgaaaactaaacgatacgaaaacccgaaacgccaaacgcgacgacaaaaaacgacaacgacccgtcataacgcaccaaaaccgaaaccaacgacaatcgcaccgccacctaaatcgccccttcctactaaaaacaacgaaaaatacctacaaccgaaacaccttcttctccgcgtctcctcgtctcccgcgcccgcgtcaaaccgccaaccttacccaccgccccgaaaaaaacgcgccgaacgccgactacccctcgaaacgccgaacgacgaccctaaacgtacgaaaacctctctaaaccgaccgcaacgcctcgaccctaccctctaactcccgcgttcgctcctaccttcttaactctcgaaacacaacgcgcgacccgatccgaaacaaaacgaacataaacgccaaacaaaacgacctaaccgccgctcacgacgcacgcgcgcgtactcgactcgaatctaccttccaataacaacgaaataaccaataaaaccgaaaccaaaaccgaaaaccgaaaaccgccgccgcgaaaaaattcccgacccaaatacccaacgctcaccaacccgacgacgccgcgacgaccccgcaactatttcctcgaaaaaacgtaacgtcgaaaaccttcgcgacgcaatcctctttcaacatcccgaacaacaacaacgacccgtaaaactcgcaaaactcgatacacaacaaccctaaaaataacgacgacgaccgacaccgaccgataaactaaaaccccgacgaaccgctcctaataatcgactccttaccaactcacctctcaccgcgcatatttaaaaatacgaacccctctccacgcgcccgcgctcgatcctcccgcgactacacgtaaaccgtaaccgccgactatttttacccttctccttttctccttcgaccgaaacgccgaaaactacttcccgacccaacccgcgccgatctccatcctaaaaaaaaacccgacacgtaacacctacgatatcgctaccgcgtaaacacgtaattttatttttaaacatcgtaaacacccacacctcaacgaatactcaataaaaataatctattttccaa

SEQ ID NO: 23565 - DNA, 707 bp, Artificial Sequence
  chemically treated genomic DNA (Homo sapiens) CpG-island No: 23565
agcgcggttaaaggtgaggggtgcggggagagggcgttcgggcggtttgggtttcgcgtatttggtacggtcggtacggttaattcggtaggtattattgggcgggttgcgaattcgcggttcgggtttcgttgagttcgagttgtattggcgtagtggttgttcgttatttcgggtcgtatttttgttacggttttcgttagtcgtcggtgttcgggttggaggtgggttagcgcgttttggtttttggtttattcgggcgtgcgcggattaaggtttatttttttatacgttttttatcggtttcgatatttttttatatcgggtttgtttttcgtttttattttagcggcgattacggttagcgattttttttaggttgttagcggtgcggataggggcgggcgttagagttttgttcgcggaggggcgaggcgagcgttttaggttcgttttcggcgcgggcgcgggagggcggcgaggtcgcgatcggggtcgtgggtttggaattttgtattagttttaggttattcgttgggaacgtattcgttttattcgcgtcggggtcgcggtttcgttttttttttcggggttgggtagcgagaaggcggggttttcgagtttgaggcggggcgggtaggaaattataatttttagtaggttttgcgttggggtcgtggaggtcgttgggagagtggttttttttt

SEQ ID NO: 23566 - DNA, 707 bp, Artificial Sequence
  chemically treated genomic DNA (Homo sapiens) CpG-island No: 23566
aaaaaaaaaccactctcccaacgacctccacgaccccaacgcaaaacctactaaaaattataatttcctacccgccccgcctcaaactcgaaaaccccgccttctcgctacccaaccccgaaaaaaaaaacgaaaccgcgaccccgacgcgaataaaacgaatacgttcccaacgaataacctaaaactaatacaaaattccaaacccacgaccccgatcgcgacctcgccgccctcccgcgcccgcgccgaaaacgaacctaaaacgctcgcctcgcccctccgcgaacaaaactctaacgcccgcccctatccgcaccgctaacaacctaaaaaaaatcgctaaccgtaatcgccgctaaaataaaaacgaaaaacaaacccgatataaaaaaatatcgaaaccgataaaaaacgtataaaaaaataaaccttaatccgcgcacgcccgaataaaccaaaaaccaaaacgcgctaacccacctccaacccgaacaccgacgactaacgaaaaccgtaacaaaaatacgacccgaaataacgaacaaccactacgccaatacaactcgaactcaacgaaacccgaaccgcgaattcgcaacccgcccaataatacctaccgaattaaccgtaccgaccgtaccaaatacgcgaaacccaaaccgcccgaacgccctctccccgcacccctcacctttaaccgcgct

SEQ ID NO: 23567 - DNA, 707 bp, Artificial Sequence
  chemically treated genomic DNA (Homo sapiens) CpG-island No: 23567
aaaggagagttatttttttagcggtttttacggttttagcgtaagatttgttgggaattgtagttttttgttcgtttcgttttaagttcgaaggtttcgttttttcgttgtttagtttcggggagggaggcggggtcgcgatttcggcgcgggtggggcgaatgcgtttttagcgggtagtttgggattggtgtagagttttaagtttacggtttcggtcgcggtttcgtcgttttttcgcgttcgcgtcgggagcgggtttagagcgttcgtttcgttttttcgcgagtagggttttggcgttcgtttttgttcgtatcgttggtagtttgaagagagtcgttggtcgtggtcgtcgttagggtaaagacgggaggtaggttcggtatgggaaggtgtcggggtcggtgggggacgtgtgagggagtgagttttggttcgcgtacgttcgggtaagttagaggttagaacgcgttagtttatttttagttcgagtatcggcggttggcgggagtcgtggtaagaatgcggttcgaggtggcgagtagttattgcgttagtgtagttcgggtttagcggggttcgggtcgcgggttcgtagttcgtttagtggtgtttgtcgggttggtcgtgtcggtcgtgttaggtgcgcggggtttaggtcgttcgggcgtttttttttcgtattttttatttttggtcgcgtt

SEQ ID NO: 23568 - DNA, 707 bp, Artificial Sequence
  chemically treated genomic DNA (Homo sapiens) CpG-island No: 23568
aacgcgaccaaaaataaaaaatacgaaaaaaaaacgcccgaacgacctaaaccccgcgcacctaacacgaccgacacgaccaacccgacaaacaccactaaacgaactacgaacccgcgacccgaaccccgctaaacccgaactacactaacgcaataactactcgccacctcgaaccgcattcttaccacgactcccgccaaccgccgatactcgaactaaaaataaactaacgcgttctaacctctaacttacccgaacgtacgcgaaccaaaactcactccctcacacgtcccccaccgaccccgacaccttcccataccgaacctacctcccgtctttaccctaacgacgaccacgaccaacgactctcttcaaactaccaacgatacgaacaaaaacgaacgccaaaaccctactcgcgaaaaaacgaaacgaacgctctaaacccgctcccgacgcgaacgcgaaaaaacgacgaaaccgcgaccgaaaccgtaaacttaaaactctacaccaatcccaaactacccgctaaaaacgcattcgccccacccgcgccgaaatcgcgaccccgcctccctccccgaaactaaacaacgaaaaaacgaaaccttcgaacttaaaacgaaacgaacaaaaaactacaattcccaacaaatcttacgctaaaaccgtaaaaaccgctaaaaaaataactctccttt

SEQ ID NO: 23569 - DNA, 762 bp, Artificial Sequence
  chemically treated genomic DNA (Homo sapiens) CpG-island No: 23569
cgttatattttattgtcgtagtagaatcggtgttttttatttgtttgcgttttttgtagttcgttaagtagcgtttttagtttttgtgatattttagggagaaagtcgtagtatcggcgatgttggtcgttattaacgttcggtaaagcgttcggaattagaagtagcgaagaattcgggtgggtagcgatcgtgatagtcgagtcggaagcggagttgcgggaggggtttcgacgtttttttattttttattggagtttatcgttgttagtcgcgttgtttgttcgttttatttttttcgtgtaggtatttagttaaatgacgggcggagttcggcggcggttttcggtcgggggaaaaaagttgggtcgaaggaggggtcgggaagacgtaagaggaagaagagaaaacggtcgggcggcggtggttgtaggttgtgcggttgtagcggtttttttttgggcggacgatggatagttagggtaggaaggtggtggtgtgcgataacggtatcggggtaagggtcgcgcgaggagagttttggcggttatagacgtcggcggggacgagatagttggcgatagcgttttcgtttttagggttgtatttcgggtttcggggcgaaggggcgcgggcggtgttttttattttcgcgggcgtgggagcgagtcggtcgttttttggttttttttgagtttgttatttatttagtttgttatttttttattttcgggtgggggcggcgggcgagatcggtattgg

SEQ ID NO: 23570 - DNA, 762 bp, Artificial Sequence
  chemically treated genomic DNA (Homo sapiens) CpG-island No: 23570
ccaataccgatctcgcccgccgcccccacccgaaaataaaaaaataacaaactaaataaataacaaactcaaaaaaaaccaaaaaacgaccgactcgctcccacgcccgcgaaaataaaaaacaccgcccgcgccccttcgccccgaaacccgaaatacaaccctaaaaacgaaaacgctatcgccaactatctcgtccccgccgacgtctataaccgccaaaactctcctcgcgcgacccttaccccgataccgttatcgcacaccaccaccttcctaccctaactatccatcgtccgcccaaaaaaaaaccgctacaaccgcacaacctacaaccaccgccgcccgaccgttttctcttcttcctcttacgtcttcccgacccctccttcgacccaacttttttcccccgaccgaaaaccgccgccgaactccgcccgtcatttaactaaatacctacacgaaaaaaataaaacgaacaaacaacgcgactaacaacgataaactccaataaaaaataaaaaaacgtcgaaacccctcccgcaactccgcttccgactcgactatcacgatcgctacccacccgaattcttcgctacttctaattccgaacgctttaccgaacgttaataacgaccaacatcgccgatactacgactttctccctaaaatatcacaaaaactaaaaacgctacttaacgaactacaaaaaacgcaaacaaataaaaaacaccgattctactacgacaataaaatataacg

SEQ ID NO: 23571 - DNA, 762 bp, Artificial Sequence
  chemically treated genomic DNA (Homo sapiens) CpG-island No: 23571
ttagtgtcggtttcgttcgtcgtttttattcggaagtgagggggtggtaggttaaatgggtggtaggtttaagggagattagggaacggtcggttcgtttttacgttcgcggaggtgggaggtatcgttcgcgttttttcgtttcgaggttcggagtgtagttttgggggcgagggcgttgtcgttagttgtttcgttttcgtcggcgtttgtggtcgttaaggtttttttcgcgcggtttttatttcggtgtcgttgtcgtatattattatttttttgttttggttgtttatcgttcgtttagggaagagtcgttgtagtcgtataatttatagttatcgtcgttcggtcgttttttttttttttttttgcgttttttcggtttttttttcggtttaatttttttttttcgatcggaagtcgtcgtcgggtttcgttcgttatttagttgaatgtttgtacgaaaagggtgggacgggtaggtagcgcgattggtagcggtgagttttaataaaagatggaggagcgtcgaggtttttttcgtagtttcgttttcggttcggttgttacggtcgttgtttattcgggtttttcgttgtttttagtttcgggcgttttgtcgggcgttaatggcggttaatatcgtcggtgttgcggttttttttttaaagtgttataggagttaagggcgttgtttaacgaattgtagaagacgtaggtaggtgaaggatatcggttttgttgcggtagtggaatgtggcg

SEQ ID NO: 23572 - DNA, 762 bp, Artificial Sequence
  chemically treated genomic DNA (Homo sapiens) CpG-island No: 23572
cgccacattccactaccgcaacaaaaccgatatccttcacctacctacgtcttctacaattcgttaaacaacgcccttaactcctataacactttaaaaaaaaaaccgcaacaccgacgatattaaccgccattaacgcccgacaaaacgcccgaaactaaaaacaacgaaaaacccgaataaacaacgaccgtaacaaccgaaccgaaaacgaaactacgaaaaaaacctcgacgctcctccatcttttattaaaactcaccgctaccaatcgcgctacctacccgtcccacccttttcgtacaaacattcaactaaataacgaacgaaacccgacgacgacttccgatcgaaaaaaaaaaattaaaccgaaaaaaaaaccgaaaaaacgcaaaaaaaaaaaaaaaaaacgaccgaacgacgataactataaattatacgactacaacgactcttccctaaacgaacgataaacaaccaaaacaaaaaaataataatatacgacaacgacaccgaaataaaaaccgcgcgaaaaaaaccttaacgaccacaaacgccgacgaaaacgaaacaactaacgacaacgccctcgcccccaaaactacactccgaacctcgaaacgaaaaaacgcgaacgatacctcccacctccgcgaacgtaaaaacgaaccgaccgttccctaatctcccttaaacctaccacccatttaacctaccaccccctcacttccgaataaaaacgacgaacgaaaccgacactaa

SEQ ID NO: 23573 - DNA, 519 bp, Artificial Sequence
  chemically treated genomic DNA (Homo sapiens) CpG-island No: 23573
cgtataattttatacgatcgacgtttttgggtttaaataggaggaagaaggacgtatgcgttacgcgtacgttaggggtgttttttcggagcgttttcgaggcgcggacgtaggttatagtagcgtttggtttttgttgatgtcgtcgttattttatttttttttcgttttagttttacggcggcgcgcgttttaggtcggtcgttttatttttcggttttcgggattgtggattttacgattttgttttcggttttgttcgcgtcgaagtagttcgggattgcgtagttttcgcgtgtcggtgagcgatttcggacgtgtagtttttaggttttttttcggagcgaggttgagttgcgtcgcgtttgagtcgggtttgataaggaggggaggtcgttggggtgttgggttagtcgtaggtacggcggcggttagggttggtgatcgagttgttgtgtcgtttttaatgaggtttagttagggaatattcggtttcgtttaagttttatttttgggttg

SEQ ID NO: 23574 - DNA, 519 bp, Artificial Sequence
  chemically treated genomic DNA (Homo sapiens) CpG-island No: 23574
caacccaaaaataaaacttaaacgaaaccgaatattccctaactaaacctcattaaaaacgacacaacaactcgatcaccaaccctaaccgccgccgtacctacgactaacccaacaccccaacgacctcccctccttatcaaacccgactcaaacgcgacgcaactcaacctcgctccgaaaaaaaacctaaaaactacacgtccgaaatcgctcaccgacacgcgaaaactacgcaatcccgaactacttcgacgcgaacaaaaccgaaaacaaaatcgtaaaatccacaatcccgaaaaccgaaaaataaaacgaccgacctaaaacgcgcgccgccgtaaaactaaaacgaaaaaaaaataaaataacgacgacatcaacaaaaaccaaacgctactataacctacgtccgcgcctcgaaaacgctccgaaaaaacacccctaacgtacgcgtaacgcatacgtccttcttcctcctatttaaacccaaaaacgtcgatcgtataaaattatacg

SEQ ID NO: 23575 - DNA, 519 bp, Artificial Sequence
  chemically treated genomic DNA (Homo sapiens) CpG-island No: 23575
taatttagaggtagggtttgggcgaagtcgagtgttttttggttgggttttattagaggcgatatagtaattcgattattagttttgatcgtcgtcgtatttgcggttggtttagtattttagcggttttttttttttgttaggttcggtttaagcgcggcgtagtttagtttcgtttcggaaggggatttggggattgtacgttcggggtcgtttatcggtacgcgggggttgcgtagtttcgggttgtttcggcgcggatagggtcgaggatagggtcgtggagtttatagtttcgggagtcggggggtggagcgatcggtttggagcgcgcgtcgtcgtagagttgggacgggggaggggtaggataacgacggtattagtagaggttaagcgttgttgtaatttgcgttcgcgtttcgagagcgtttcggagggatatttttggcgtgcgcgtgacgtatgcgttttttttttttttgtttgagtttagaggcgtcgatcgtgtgagattgtgcg

SEQ ID NO: 23576 - DNA, 519 bp, Artificial Sequence
  chemically treated genomic DNA (Homo sapiens) CpG-island No: 23576
cgcacaatctcacacgatcgacgcctctaaactcaaacaaaaaaaaaaaaaacgcatacgtcacgcgcacgccaaaaatatccctccgaaacgctctcgaaacgcgaacgcaaattacaacaacgcttaacctctactaataccgtcgttatcctacccctcccccgtcccaactctacgacgacgcgcgctccaaaccgatcgctccaccccccgactcccgaaactataaactccacgaccctatcctcgaccctatccgcgccgaaacaacccgaaactacgcaacccccgcgtaccgataaacgaccccgaacgtacaatccccaaatccccttccgaaacgaaactaaactacgccgcgcttaaaccgaacctaacaaaaaaaaaaaaccgctaaaatactaaaccaaccgcaaatacgacgacgatcaaaactaataatcgaattactatatcgcctctaataaaacccaaccaaaaaacactcgacttcgcccaaaccctacctctaaatta

SEQ ID NO: 23577 - DNA, 612 bp, Artificial Sequence
  chemically treated genomic DNA (Homo sapiens) CpG-island No: 23577
gaggagtcgggtgggaacggtcgcgttttcgttttcgtttttttttttttgttttttggacgtcgttgggagtcgggtttcgcggtggatggtattatcgagattttttttattagaaatacgcggttcgttttcgcgtggggttttggtggagattttcgacgttaaggcgggggtttgttttcggttttttttttttttttcgtttcgcggggagttcggttttttttttgcggggggggaagttatttttcgaattcgcgcgttttttggcggtttgagtcggtgtagaagttaggttgtgttgatttcgttcgcgagtattttgtttggggatcgcgcgtcgcggggtagttttttattttcgtttcggagggatatagtttgtttgggcgtagtttttcggcgcggttttcgcggttttttcggcgttttttcgcggggtttttttagtcgtcgttttcggagtttttcgtttttttgtgttttcggtcgcgtgacgttttttatcgtggaacggggtagttgcgggacgtgtttttttttttattggatttagatttttttaggggagatttcgttagaggcgtattttcggagtttttttttcgg

SEQ ID NO: 23578 - DNA, 612 bp, Artificial Sequence
  chemically treated genomic DNA (Homo sapiens) CpG-island No: 23578
ccgaaaaaaaaactccgaaaatacgcctctaacgaaatctcccctaaaaaaatctaaatccaataaaaaaaaaaacacgtcccgcaactaccccgttccacgataaaaaacgtcacgcgaccgaaaacacaaaaaaacgaaaaactccgaaaacgacgactaaaaaaaccccgcgaaaaaacgccgaaaaaaccgcgaaaaccgcgccgaaaaactacgcccaaacaaactatatccctccgaaacgaaaataaaaaactaccccgcgacgcgcgatccccaaacaaaatactcgcgaacgaaatcaacacaacctaacttctacaccgactcaaaccgccaaaaaacgcgcgaattcgaaaaataacttccccccccgcaaaaaaaaaaccgaactccccgcgaaacgaaaaaaaaaaaaaaaaccgaaaacaaacccccgccttaacgtcgaaaatctccaccaaaaccccacgcgaaaacgaaccgcgtatttctaataaaaaaaatctcgataataccatccaccgcgaaacccgactcccaacgacgtccaaaaaacaaaaaaaaaaaaacgaaaacgaaaacgcgaccgttcccacccgactcctc

SEQ ID NO: 23579 - DNA, 612 bp, Artificial Sequence
  chemically treated genomic DNA (Homo sapiens) CpG-island No: 23579
tcggggaggagatttcggggatgcgtttttggcgggattttttttggaagaatttgagtttagtggggagaggaatacgtttcgtagttgtttcgttttacggtgggaggcgttacgcggtcgggaatatagggaggcggggggtttcggaggcggcggttgggaggatttcgcgggagggcgtcggggaggtcgcgaggatcgcgtcggggggttgcgtttaggtaagttgtgttttttcgaggcgaagataggaagttgtttcgcggcgcgcggtttttaggtagggtgttcgcgggcggagttaatatagtttggtttttgtatcggtttaggtcgttagagggcgcgcgggttcgggaaatggttttttttttcgtaggaggagggtcgagtttttcgcggggcgggaggaggagggaaaatcgaggataagttttcgttttggcgtcgagggtttttattaaagttttacgcgagaacgggtcgcgtgtttttggtgagaggggtttcgatagtgttatttatcgcgaggttcgatttttagcggcgtttaggaagtaagggagggagggcgggagcggggacgcggtcgtttttattcggtttttt

SEQ ID NO: 23580 - DNA, 612 bp, Artificial Sequence
  chemically treated genomic DNA (Homo sapiens) CpG-island No: 23580
aaaaaaccgaataaaaacgaccgcgtccccgctcccgccctccctcccttacttcctaaacgccgctaaaaatcgaacctcgcgataaataacactatcgaaacccctctcaccaaaaacacgcgacccgttctcgcgtaaaactttaataaaaaccctcgacgccaaaacgaaaacttatcctcgattttccctcctcctcccgccccgcgaaaaactcgaccctcctcctacgaaaaaaaaaaccatttcccgaacccgcgcgccctctaacgacctaaaccgatacaaaaaccaaactatattaactccgcccgcgaacaccctacctaaaaaccgcgcgccgcgaaacaacttcctatcttcgcctcgaaaaaacacaacttacctaaacgcaaccccccgacgcgatcctcgcgacctccccgacgccctcccgcgaaatcctcccaaccgccgcctccgaaaccccccgcctccctatattcccgaccgcgtaacgcctcccaccgtaaaacgaaacaactacgaaacgtattcctctccccactaaactcaaattcttccaaaaaaaatcccgccaaaaacgcatccccgaaatctcctccccga

SEQ ID NO: 23581 - DNA, 897 bp, Artificial Sequence
  chemically treated genomic DNA (Homo sapiens) CpG-island No: 23581
gcgtttcgggcgttcgggggcgggttttgtatagcgacgttacggcgtatcgtgcgttgggttaaagtttagtttcgttttcgtttttttttcgttgtttttttcggtttgtgtcgtcgtcgacgtcgtttgtgggttcgatttcgttttgtttgtttcgttatttttttttcgagtattgttcggtcggtcgttatggttaacgtggttgatacgaagttgtacgatattttgggcgtttcgttcggcgttagcgagaacgagttgaagaaggtatttgggagcgggtcgggcgggtgtgaggggcgcggggtttgcgcggttagggatgttttttttagttaggtcgcgttattgggttgttcgcgagtcggcgttcggtcgtgattggttcgggttgggagtcggcggcggcggcgggatcggtttcgtcgcgagtcgcgtatttcggtttcggttgattttggggtcgtcggtttcgttcgttcgtagatgtagtaaataaaatttatttttgcgtaaatacgatgggagttttttttttttttttttttgaacgagcgtcgggggttggtatttttcgggaggtagtagttcgttcggtttttcgcgtcgaggttattatttcggaaaaataggttggatcgaggtgtttagcgtatttcggtttcgagagagaagttgttcgtttcgcggtcgtcggtttcgggtttggtgtttcgcggggaggaacggcggggaggtcgaggtcgtttttatagagcgtttcgggcggatggggttgttttttgggtttcgcggtcgtcggttgcgggagtttttttttttttgcgtttttcgtttattgattcggaggtagttgggtttgtgtttggatgtattgttttttgggtaggt

SEQ ID NO: 23582 - DNA, 897 bp, Artificial Sequence
  chemically treated genomic DNA (Homo sapiens) CpG-island No: 23582
acctacccaaaaaacaatacatccaaacacaaacccaactacctccgaatcaataaacgaaaaacgcaaaaaaaaaaaaactcccgcaaccgacgaccgcgaaacccaaaaaacaaccccatccgcccgaaacgctctataaaaacgacctcgacctccccgccgttcctccccgcgaaacaccaaacccgaaaccgacgaccgcgaaacgaacaacttctctctcgaaaccgaaatacgctaaacacctcgatccaacctatttttccgaaataataacctcgacgcgaaaaaccgaacgaactactacctcccgaaaaataccaacccccgacgctcgttcaaaaaaaaaaaaaaaaaaaactcccatcgtatttacgcaaaaataaattttatttactacatctacgaacgaacgaaaccgacgaccccaaaatcaaccgaaaccgaaatacgcgactcgcgacgaaaccgatcccgccgccgccgccgactcccaacccgaaccaatcacgaccgaacgccgactcgcgaacaacccaataacgcgacctaactaaaaaaaacatccctaaccgcgcaaaccccgcgcccctcacacccgcccgacccgctcccaaataccttcttcaactcgttctcgctaacgccgaacgaaacgcccaaaatatcgtacaacttcgtatcaaccacgttaaccataacgaccgaccgaacaatactcgaaaaaaaaataacgaaacaaacaaaacgaaatcgaacccacaaacgacgtcgacgacgacacaaaccgaaaaaaacaacgaaaaaaaaacgaaaacgaaactaaactttaacccaacgcacgatacgccgtaacgtcgctatacaaaacccgcccccgaacgcccgaaacgc

SEQ ID NO: 23583 - DNA, 897 bp, Artificial Sequence
  chemically treated genomic DNA (Homo sapiens) CpG-island No: 23583
atttgtttaaagaataatgtatttaaatatagatttagttattttcgggttaatgggcgagggacgtagagagggaggagttttcgtagtcggcggtcgcggaatttaggaaataattttattcgttcgaggcgttttgtgggggcggtttcgattttttcgtcgttttttttcgcggagtattagattcggggtcgacggtcgcggggcggatagtttttttttcggggtcgggatgcgttgagtatttcggtttaatttgttttttcggggtggtgatttcgacgcgaaggatcgggcgagttgttgtttttcgggggatattagttttcggcgttcgtttaaggagggaggaaggaagggtttttatcgtgtttgcgtaggagtgagttttatttgttgtatttgcgggcgggcggggtcggcggttttaaggttagtcgaggtcggagtgcgcggttcgcggcgaggtcggtttcgtcgtcgtcgtcgatttttagttcgggttagttacggtcgggcgtcggttcgcgggtagtttagtagcgcggtttggttgaagaagatatttttggtcgcgtaggtttcgcgttttttatattcgttcggttcgtttttagatattttttttagttcgttttcgttggcgtcgggcgggacgtttaggatgtcgtatagtttcgtgttagttacgttagttatggcggtcggtcgggtagtgttcggggagaaggtggcgaagtagatagagcggagtcgggtttataagcggcgtcggcggcggtataggtcgagggagatagcgagggggaagcgggggcggggttgaattttgatttagcgtacggtgcgtcgtgacgtcgttgtgtagagttcgttttcgagcgttcgaggcgt

SEQ ID NO: 23584 - DNA, 897 bp, Artificial Sequence
  chemically treated genomic DNA (Homo sapiens) CpG-island No: 23584
acgcctcgaacgctcgaaaacgaactctacacaacgacgtcacgacgcaccgtacgctaaatcaaaattcaaccccgcccccgcttccccctcgctatctccctcgacctataccgccgccgacgccgcttataaacccgactccgctctatctacttcgccaccttctccccgaacactacccgaccgaccgccataactaacgtaactaacacgaaactatacgacatcctaaacgtcccgcccgacgccaacgaaaacgaactaaaaaaaatatctaaaaacgaaccgaacgaatataaaaaacgcgaaacctacgcgaccaaaaatatcttcttcaaccaaaccgcgctactaaactacccgcgaaccgacgcccgaccgtaactaacccgaactaaaaatcgacgacgacgacgaaaccgacctcgccgcgaaccgcgcactccgacctcgactaaccttaaaaccgccgaccccgcccgcccgcaaatacaacaaataaaactcactcctacgcaaacacgataaaaacccttccttcctccctccttaaacgaacgccgaaaactaatatcccccgaaaaacaacaactcgcccgatccttcgcgtcgaaatcaccaccccgaaaaaacaaattaaaccgaaatactcaacgcatcccgaccccgaaaaaaaaactatccgccccgcgaccgtcgaccccgaatctaatactccgcgaaaaaaaacgacgaaaaaatcgaaaccgcccccacaaaacgcctcgaacgaataaaattatttcctaaattccgcgaccgccgactacgaaaactcctccctctctacgtccctcgcccattaacccgaaaataactaaatctatatttaaatacattattctttaaacaaat

SEQ ID NO: 23585 - DNA, 556 bp, Artificial Sequence
  chemically treated genomic DNA (Homo sapiens) CpG-island No: 23585
  misc_feature (503)..(503): n is either a, c, g or t
  misc_feature (506)..(506): n is either a, c, g or t
  misc_feature (513)..(515): n is either a, c, g or t
  misc_feature (517)..(517): n is either a, c, g or t
  misc_feature (520)..(524): n is either a, c, g or t
  misc_feature (552)..(552): n is either a, c, g or t
gagggcgaggagagagcggggagagagagaggggagggggagagggagggaggggggcgagagagagagagagggtgggagggaggagagagtgagtaggaggaaggaggcgggggagcgagagggcgggggagaggagggggagagaggggagagagagagagtgggagggagagagagggggagaggaggaggggggggagggggggagagagagggagagcgagggagagagagagggagagagagaggggaggggggaggggagagagaggagggagtgagaggagagagagggacgagagaggagaggggggagaggggagagaggagaggagagaggagaggggagaggggcgagagaagaggcgtggggagaggagaggagaggagaggaggagaggagggaggagaggtgagcgagaggggaggaggggagaggaggagagaggagagcgaggagaggcgaggaggaggagtagaggaggagtagaggaggtagngangaggggnnnantannnnnaggaggaggaggggaggagggagaggantaat

SEQ ID NO: 23586 - DNA, 556 bp, Artificial Sequence
  chemically treated genomic DNA (Homo sapiens) CpG-island No: 23586
  misc_feature (5)..(5): n is either a, c, g or t
  misc_feature (33)..(37): n is either a, c, g or t
  misc_feature (40)..(40): n is either a, c, g or t
  misc_feature (42)..(44): n is either a, c, g or t
  misc_feature (51)..(51): n is either a, c, g or t
  misc_feature (54)..(54): n is either a, c, g or t
attantcctctccctcctcccctcctcctcctnnnnntantnnncccctcntcnctacctcctctactcctcctctactcctcctcctcgcctctcctcgctctcctctctcctcctctcccctcctcccctctcgctcacctctcctccctcctctcctcctctcctctcctctcctctccccacgcctcttctctcgcccctctcccctctcctctctcctctcctctctcccctctcccccctctcctctctcgtccctctctctcctctcactccctcctctctctcccctcccccctcccctctctctctccctctctctctccctcgctctccctctctctccccccctcccccccctcctcctctccccctctctctccctcccactctctctctctcccctctctccccctcctctcccccgccctctcgctcccccgcctccttcctcctactcactctctcctccctcccaccctctctctctctctcgcccccctccctccctctccccctcccctctctctctccccgctctctcctcgccctc

SEQ ID NO: 23587 - DNA, 556 bp, Artificial Sequence
  chemically treated genomic DNA (Homo sapiens) CpG-island No: 23587
  misc_feature (5)..(5): n is either a, c, g or t
  misc_feature (33)..(37): n is either a, c, g or t
  misc_feature (40)..(40): n is either a, c, g or t
  misc_feature (42)..(44): n is either a, c, g or t
  misc_feature (51)..(51): n is either a, c, g or t
  misc_feature (54)..(54): n is either a, c, g or t
attantttttttttttttttttttttttttttnnnnntgntnnnttttttnttnttattttttttattttttttttatttttttttttcgttttttttcgttttttttttttttttttttttttttttttttttcgtttattttttttttttttttttttttttttttttttttttttttttttacgttttttttttcgttttttttttttttttttttttttttttttttttttttttttttttttttttttttcgtttttttttttttttttattttttttttttttttttttttttttttttttttttttttttttttttttttttttcgttttttttttttttttttttttttttttttttttttttttttttttttttttttttttattttttttttttttttttttttttttttttttttttcgttttttcgttttttcgtttttttttttttatttattttttttttttttttattttttttttttttttcgtttttttttttttttttttttttttttttttttttttttcgtttttttttcgttttt

SEQ ID NO: 23588 - DNA, 556 bp, Artificial Sequence
  chemically treated genomic DNA (Homo sapiens) CpG-island No: 23588
  misc_feature (503)..(503): n is either a, c, g or t
  misc_feature (506)..(506): n is either a, c, g or t
  misc_feature (513)..(515): n is either a, c, g or t
  misc_feature (517)..(517): n is either a, c, g or t
  misc_feature (520)..(524): n is either a, c, g or t
  misc_feature (552)..(552): n is either a, c, g or t
aaaaacgaaaaaaaaacgaaaaaaaaaaaaaaaaaaaaaaaaaaaaaaaaaaaaaaacgaaaaaaaaaaaaaaaataaaaaaaaaaaaaaaataaataaaaaaaaaaaaacgaaaaaacgaaaaaacgaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaaaacgaaaaaaaaaaaaaaaaaaaaaaaaaaaaaaaaaaaaaaaaaaaaaaaaaaaaaaaataaaaaaaaaaaaaaaaacgaaaaaaaaaaaaaaaaaaaaaaaaaaaaaaaaaaaaaaaaaaaaaaaaaaaaaaaacgaaaaaaaaaacgtaaaaaaaaaaaaaaaaaaaaaaaaaaaaaaaaaaaaaaaaaaaataaacgaaaaaaaaaaaaaaaaaaaaaaaaaaaaaaaaaacgaaaaaaaacgaaaaaaaaaaataaaaaaaaaataaaaaaaataanaanaaaaaannnancannnnnaaaaaaaaaaaaaaaaaaaaaaaaaaantaat

SEQ ID NO: 23589 - DNA, 772 bp, Artificial Sequence
  chemically treated genomic DNA (Homo sapiens) CpG-island No: 23589
gaggagggtaggaagtcgggattgcgtttttgttttcgtatttcgatttatttatcgtcggggtcgcggttagcgttagggttggggtcgggcggagtgagcgggtcggcgtagaggagagttgaggcggtttgggcggtagcggcggtcggtataatttcgggtagtcgcggttttagaggcgtttttttaggatgtggagttggaagattgtggcggcggtggtggaggcggaggtttttggttgcggacgtggcgttcgacgcgattcgtttttttcgtcgtttttttagttttcgttttttttcgcggttttagtttcgacgcgtacgcgcgttcgtgtagttcgggtttttttcgcgtttatcgggtatacgtttattcgttttcgtagggttcggtttttttagtagtttttagtcggttgtgttttaattgcgtacgcgcgacgtttcgaggttcgttttcgttttttcgttttttggacgttttcgtgggaattttcggtcggtttgcgcgtttttttttcgggggttttttcgtttttttttcgttattatttaattaaatcgggcgaggggcgcgaagttcgggagacgcgtaggtcgcggtttttaggttcggtgttttgacgtcggcggtgttcgcgtttcgcgtcgagtaacggttttcggaatttagagttttcgttttagggaaggtgggacggtcgttagtttttttagtatttttttcgtttagggacgttaattttttttgtatgttgttttta

SEQ ID NO: 23590 - DNA, 772 bp, Artificial Sequence
  chemically treated genomic DNA (Homo sapiens) CpG-island No: 23590
taaaaacaacatacaaaaaaaattaacgtccctaaacgaaaaaaatactaaaaaaactaacgaccgtcccaccttccctaaaacgaaaactctaaattccgaaaaccgttactcgacgcgaaacgcgaacaccgccgacgtcaaaacaccgaacctaaaaaccgcgacctacgcgtctcccgaacttcgcgcccctcgcccgatttaattaaataataacgaaaaaaaaacgaaaaaacccccgaaaaaaaaacgcgcaaaccgaccgaaaattcccacgaaaacgtccaaaaaacgaaaaaacgaaaacgaacctcgaaacgtcgcgcgtacgcaattaaaacacaaccgactaaaaactactaaaaaaaccgaaccctacgaaaacgaataaacgtatacccgataaacgcgaaaaaaacccgaactacacgaacgcgcgtacgcgtcgaaactaaaaccgcgaaaaaaaacgaaaactaaaaaaacgacgaaaaaaacgaatcgcgtcgaacgccacgtccgcaaccaaaaacctccgcctccaccaccgccgccacaatcttccaactccacatcctaaaaaaacgcctctaaaaccgcgactacccgaaattataccgaccgccgctaccgcccaaaccgcctcaactctcctctacgccgacccgctcactccgcccgaccccaaccctaacgctaaccgcgaccccgacgataaataaatcgaaatacgaaaacaaaaacgcaatcccgacttcctaccctcctc

SEQ ID NO: 23591 - DNA, 772 bp, Artificial Sequence
  chemically treated genomic DNA (Homo sapiens) CpG-island No: 23591
tgaggatagtatgtaagggaggttgacgtttttggacgaagaaagtgttggagaaattggcgatcgttttattttttttaaggcgaaggttttgaatttcgaagatcgttattcggcgcggaacgcgggtatcgtcgacgttaaaatatcgggtttgggggtcgcggtttacgcgtttttcgggtttcgcgtttttcgttcgatttgattggatggtggcgggaagaaggcggggagattttcggaggaggggcgcgtaggtcggtcgggggtttttacggaggcgtttagggggcgaaggggcgggagcgggtttcggagcgtcgcgcgtgcgtaattgggatatagtcggttggggattgttgggagggtcggattttgcgagaacgggtgggcgtgtgttcggtgggcgcgggaggggttcgggttgtacgagcgcgcgtgcgcgtcggaattggagtcgcgggaggaggcgggagttgaggaggcggcggagggggcgggtcgcgtcgggcgttacgttcgtagttagaggttttcgtttttattatcgtcgttatagttttttagttttatattttgagaggacgtttttggagtcgcgattgttcggggttgtgtcggtcgtcgttgtcgtttaggtcgttttagtttttttttgcgtcggttcgtttatttcgttcggttttagttttagcgttggtcgcgatttcggcggtgagtgagtcgggatgcgagggtaggggcgtagtttcggttttttgtttttttt

SEQ ID NO: 23592 - DNA, 772 bp, Artificial Sequence
  chemically treated genomic DNA (Homo sapiens) CpG-island No: 23592
aaaaaaaacaaaaaaccgaaactacgcccctaccctcgcatcccgactcactcaccgccgaaatcgcgaccaacgctaaaactaaaaccgaacgaaataaacgaaccgacgcaaaaaaaaactaaaacgacctaaacgacaacgacgaccgacacaaccccgaacaatcgcgactccaaaaacgtcctctcaaaatataaaactaaaaaactataacgacgataataaaaacgaaaacctctaactacgaacgtaacgcccgacgcgacccgccccctccgccgcctcctcaactcccgcctcctcccgcgactccaattccgacgcgcacgcgcgctcgtacaacccgaacccctcccgcgcccaccgaacacacgcccacccgttctcgcaaaatccgaccctcccaacaatccccaaccgactatatcccaattacgcacgcgcgacgctccgaaacccgctcccgccccttcgccccctaaacgcctccgtaaaaacccccgaccgacctacgcgcccctcctccgaaaatctccccgccttcttcccgccaccatccaatcaaatcgaacgaaaaacgcgaaacccgaaaaacgcgtaaaccgcgacccccaaacccgatattttaacgtcgacgatacccgcgttccgcgccgaataacgatcttcgaaattcaaaaccttcgccttaaaaaaaataaaacgatcgccaatttctccaacactttcttcgtccaaaaacgtcaacctcccttacatactatcctca

SEQ ID NO: 23593 - DNA, 530 bp, Artificial Sequence
  chemically treated genomic DNA (Homo sapiens) CpG-island No: 23593
tgtttgtagtggtttagtacgtgggttcgttttgtaagtaagttcggttttcgttcgtttcgttcgtttcgtttcgtttcgtttcgtttcgttcgtttcgtttcgtttcgtttcgttcgtttcgtttcgcgttcgtttttttcgttttggttcggtttcgttttttagttcgtgcgcgcgcgcgcgggagagcggtcgttcgttcggaagtgacgtaattttacggtttagtaatcgttgttaaggagttcgattttgggagcggtttagagttcgggcgttttttggggggtggggaaacggtttcgtgaggagaatttgaggtaatttcgttaattcgcggtcggaagtttttttgaatttcgaaataggagagagttttcgttttttttcggttttgatgtagtatttcgtaagtggaaggggtcgtcgcggttaagttttcggataggggaatcgggttttttttgggattcgagcggatttaggtcgttttttggagggatgaattgtcgaggggtttagggtag

SEQ ID NO: 23594 - DNA, 530 bp, Artificial Sequence
  chemically treated genomic DNA (Homo sapiens) CpG-island No: 23594
ctaccctaaacccctcgacaattcatccctccaaaaaacgacctaaatccgctcgaatcccaaaaaaaacccgattcccctatccgaaaacttaaccgcgacgaccccttccacttacgaaatactacatcaaaaccgaaaaaaaacgaaaactctctcctatttcgaaattcaaaaaaacttccgaccgcgaattaacgaaattacctcaaattctcctcacgaaaccgtttccccaccccccaaaaaacgcccgaactctaaaccgctcccaaaatcgaactccttaacaacgattactaaaccgtaaaattacgtcacttccgaacgaacgaccgctctcccgcgcgcgcgcgcacgaactaaaaaacgaaaccgaaccaaaacgaaaaaaacgaacgcgaaacgaaacgaacgaaacgaaacgaaacgaaacgaacgaaacgaaacgaaacgaaacgaaacgaacgaaacgaacgaaaaccgaacttacttacaaaacgaacccacgtactaaaccactacaaaca

SEQ ID NO: 23595 - DNA, 530 bp, Artificial Sequence
  chemically treated genomic DNA (Homo sapiens) CpG-island No: 23595
ttgttttgggtttttcgatagtttatttttttagggagcggtttggattcgttcgaattttagaaggggttcgatttttttattcgggggtttaatcgcgacgattttttttatttgcgaggtgttgtattaggatcgagagaggacgggagtttttttttatttcggggtttagaggagttttcgatcgcgagttggcgaggttattttaaattttttttacgaaatcgtttttttattttttaggaggcgttcgggttttagatcgtttttagagtcgagttttttggtaacggttgttaggtcgtagagttacgttattttcgggcgagcggtcgttttttcgcgcgcgcgcgtacgagttggggggcggggtcgggttagggcggggaggacgggcgcggggcggagcggacggggcggggcggggcggagcggacgggacggggcgggacggggcggggcggacggggcggacgggagtcgggtttatttgtaaagcgggtttacgtgttgagttattgtagata

SEQ ID NO: 23596 - DNA, 530 bp, Artificial Sequence
  chemically treated genomic DNA (Homo sapiens) CpG-island No: 23596
tatctacaataactcaacacgtaaacccgctttacaaataaacccgactcccgtccgccccgtccgccccgccccgtcccgccccgtcccgtccgctccgccccgccccgccccgtccgctccgccccgcgcccgtcctccccgccctaacccgaccccgccccccaactcgtacgcgcgcgcgcgaaaaaacgaccgctcgcccgaaaataacgtaactctacgacctaacaaccgttaccaaaaaactcgactctaaaaacgatctaaaacccgaacgcctcctaaaaaataaaaaaacgatttcgtaaaaaaaatttaaaataacctcgccaactcgcgatcgaaaactcctctaaaccccgaaataaaaaaaaactcccgtcctctctcgatcctaatacaacacctcgcaaataaaaaaaatcgtcgcgattaaacccccgaataaaaaaatcgaaccccttctaaaattcgaacgaatccaaaccgctccctaaaaaaataaactatcgaaaaacccaaaacaa

SEQ ID NO: 23597 - DNA, 1189 bp, Artificial Sequence
  chemically treated genomic DNA (Homo sapiens) CpG-island No: 23597
gcggttaaattcgaatagtaaaacgttgttgacgttaatgaagttatgttcgaaatggagcgaggcggcggagttggggaggcggtaatttcgcgagatggaagttagttttcgttaggttcggaagtttcgtttgagggggcgggggacggaggagggagcgggagtcgagcgagagtttgtggaggagttcgtttgttgtagcgtgcgtaagtaaggtagttacgtcgggcggttacgttgcggaatcggcgtaggcgtttttggagaatcggcgggttgcgtttcgttggggttggtcgcggagggggggaggggatgtcggttagtgcgagattcgttgttgttgaggagaggagcgttaatagtagtattatgggtgagttttagtttcgggtgtcgcgatttggggttagcggtttcgaatgtcgggaagttttgcggtcgttggatcgagttagggaacgttttgaggcgaggcggaggtagcggcgaggggagtcgggatgggggttattgcgggttcggggcgcggtagcggcgggttcggggggaggggaggcggcggcggtgatagtttgaattgaacgtgaggagagtcgaggcggcggtattttttgtgtcgcggcgggttggttttcggcgtagagtcgcggttttcgcggtcggagtagtttgagcgtggtggttttagttttgtttttgttttttttcgttttttcgtttttttttagttttttttcgggttcgtcggttttcgcggtttcgtttttttttgttttcggtcgtattttcgtcggtagaagttttttcgtggggtagtgggtttggttaggagggtggggacgagtgtgaacgttcgggcgagggtgttgtgtgggttaattcgggcgggcggcggcggggagggaggaagaaggatgtattaggttgaggttgtggtggaggcggcggcggcggttgtagtcgtagttttagttatcgcgtcgttttttcgttttttttttcgtttttcggggttgtttttttttaggcgtagttcggaaggtcggtggatggcgggcgagttttgagaacggagggagaatcggtagtttggtttggaatttgggtttaatttttaggagtaagggaaagagaacgtttgggaagggcgtttttcggaggagatagaaagggtgggaagggt

SEQ ID NO: 23598 - DNA, 1189 bp, Artificial Sequence
  chemically treated genomic DNA (Homo sapiens) CpG-island No: 23598
acccttcccaccctttctatctcctccgaaaaacgcccttcccaaacgttctctttcccttactcctaaaaattaaacccaaattccaaaccaaactaccgattctccctccgttctcaaaactcgcccgccatccaccgaccttccgaactacgcctaaaaaaaaacaaccccgaaaaacgaaaaaaaaaacgaaaaaacgacgcgataactaaaactacgactacaaccgccgccgccgcctccaccacaacctcaacctaatacatccttcttcctccctccccgccgccgcccgcccgaattaacccacacaacaccctcgcccgaacgttcacactcgtccccaccctcctaaccaaacccactaccccacgaaaaaacttctaccgacgaaaatacgaccgaaaacaaaaaaaaacgaaaccgcgaaaaccgacgaacccgaaaaaaaactaaaaaaaaacgaaaaaacgaaaaaaaacaaaaacaaaactaaaaccaccacgctcaaactactccgaccgcgaaaaccgcgactctacgccgaaaaccaacccgccgcgacacaaaaaataccgccgcctcgactctcctcacgttcaattcaaactatcaccgccgccgcctcccctccccccgaacccgccgctaccgcgccccgaacccgcaataacccccatcccgactcccctcgccgctacctccgcctcgcctcaaaacgttccctaactcgatccaacgaccgcaaaacttcccgacattcgaaaccgctaaccccaaatcgcgacacccgaaactaaaactcacccataatactactattaacgctcctctcctcaacaacaacgaatctcgcactaaccgacatcccctccccccctccgcgaccaaccccaacgaaacgcaacccgccgattctccaaaaacgcctacgccgattccgcaacgtaaccgcccgacgtaactaccttacttacgcacgctacaacaaacgaactcctccacaaactctcgctcgactcccgctccctcctccgtcccccgccccctcaaacgaaacttccgaacctaacgaaaactaacttccatctcgcgaaattaccgcctccccaactccgccgcctcgctccatttcgaacataacttcattaacgtcaacaacgttttactattcgaatttaaccgc

SEQ ID NO: 23599 - DNA, 1189 bp, Artificial Sequence
  chemically treated genomic DNA (Homo sapiens) CpG-island No: 23599
attttttttattttttttatttttttcggggggcgttttttttaggcgtttttttttttttatttttaaaaattaagtttaaattttaaattaaattatcgatttttttttcgtttttaagattcgttcgttatttatcggtttttcgggttgcgtttggagagaggtaatttcgagaggcgggaggaggagcggggaggcgacgcggtgattggagttgcggttgtagtcgtcgtcgtcgtttttattatagttttagtttggtgtattttttttttttttttttcgtcgtcgttcgttcgggttggtttatatagtattttcgttcgagcgtttatattcgtttttatttttttagttaggtttattgttttacgaggggatttttgtcgacggggatgcggtcggggataggaggaagcggggtcgcggaagtcggcgggttcgggaggagattgaggaaaggcgaagggacggagagaagtaagggtagggttgagattattacgtttaggttgtttcggtcgcggaggtcgcggttttgcgtcgggggttagttcgtcgcggtataggaaatgtcgtcgtttcggttttttttacgtttaatttaaattgttatcgtcgtcgtttttttttttttcgagttcgtcgttgtcgcgtttcgggttcgtagtggtttttatttcggtttttttcgtcgttgttttcgtttcgttttagggcgttttttagttcggtttagcggtcgtagagtttttcggtattcggagtcgttgattttaagtcgcggtattcgaagttgagatttatttatggtgttgttgttgacgtttttttttttagtagtagcggatttcgtattgatcgatatttttttttttttttcgcgattagttttagcggagcgtagttcgtcgattttttaaaggcgtttacgtcgatttcgtagcgtagtcgttcggcgtagttgttttgtttacgtacgttatagtaggcggatttttttataggttttcgttcgattttcgttttttttttcgtttttcgtttttttagacgaggttttcgggtttagcggaggttggtttttatttcgcgagattatcgtttttttagtttcgtcgtttcgttttatttcgagtatgattttattggcgttagtaacgttttgttgttcgggtttagtcgt

SEQ ID NO: 23600 - DNA, 1189 bp, Artificial Sequence
  chemically treated genomic DNA (Homo sapiens) CpG-island No: 23600
acgactaaacccgaacaacaaaacgttactaacgccaataaaatcatactcgaaataaaacgaaacgacgaaactaaaaaaacgataatctcgcgaaataaaaaccaacctccgctaaacccgaaaacctcgtctaaaaaaacgaaaaacgaaaaaaaaaacgaaaatcgaacgaaaacctataaaaaaatccgcctactataacgtacgtaaacaaaacaactacgccgaacgactacgctacgaaatcgacgtaaacgcctttaaaaaatcgacgaactacgctccgctaaaactaatcgcgaaaaaaaaaaaaaaatatcgatcaatacgaaatccgctactactaaaaaaaaaaacgtcaacaacaacaccataaataaatctcaacttcgaataccgcgacttaaaatcaacgactccgaataccgaaaaactctacgaccgctaaaccgaactaaaaaacgccctaaaacgaaacgaaaacaacgacgaaaaaaaccgaaataaaaaccactacgaacccgaaacgcgacaacgacgaactcgaaaaaaaaaaaaacgacgacgataacaatttaaattaaacgtaaaaaaaaccgaaacgacgacatttcctataccgcgacgaactaacccccgacgcaaaaccgcgacctccgcgaccgaaacaacctaaacgtaataatctcaaccctacccttacttctctccgtcccttcgcctttcctcaatctcctcccgaacccgccgacttccgcgaccccgcttcctcctatccccgaccgcatccccgtcgacaaaaatcccctcgtaaaacaataaacctaactaaaaaaataaaaacgaatataaacgctcgaacgaaaatactatataaaccaacccgaacgaacgacgacgaaaaaaaaaaaaaaaaaatacaccaaactaaaactataataaaaacgacgacgacgactacaaccgcaactccaatcaccgcgtcgcctccccgctcctcctcccgcctctcgaaattacctctctccaaacgcaacccgaaaaaccgataaataacgaacgaatcttaaaaacgaaaaaaaaatcgataatttaatttaaaatttaaacttaatttttaaaaataaaaaaaaaaaaacgcctaaaaaaaacgccccccgaaaaaaataaaaaaaataaaaaaaat

SEQ ID NO: 23601 - DNA, 527 bp, Artificial Sequence
  chemically treated genomic DNA (Homo sapiens) CpG-island No: 23601
gtgcgcgatttcggttcgcgttttttcggatattttttagtttagcgcgtcgtcgcgttttcgtttagtaatcgtttcgggcgcgtaaagtttaaggatcgtcgtttcgttttttgagggggacggagcgggttttaggatcgggagggtgcgcggacgcggcgggcgggggttcgttgattttagggttttcggaattttattttttcgtagtaatataatagggggtcgcggtcggtttcgcgttgggttttcggttttcgtttggattgttaaatttcggcggtcggaagtttcgtttcgagtgacgttacggggcgaggcgttgcgtgcggttgtggtttttggtcggatagaagtcggggtatagagggtttggttagggcggcgttgggtagtcgcgggggaagttattttagtgttagggcgggaattgcgggtcggggcggttttttttacgttttagcgacggagtttcggttattgttaattgtttgttatttatttgttgtttattgtgtgttagg

SEQ ID NO: 23602 - DNA, 527 bp, Artificial Sequence
  chemically treated genomic DNA (Homo sapiens) CpG-island No: 23602
cctaacacacaataaacaacaaataaataacaaacaattaacaataaccgaaactccgtcgctaaaacgtaaaaaaaaccgccccgacccgcaattcccgccctaacactaaaataacttcccccgcgactacccaacgccgccctaaccaaaccctctataccccgacttctatccgaccaaaaaccacaaccgcacgcaacgcctcgccccgtaacgtcactcgaaacgaaacttccgaccgccgaaatttaacaatccaaacgaaaaccgaaaacccaacgcgaaaccgaccgcgaccccctattatattactacgaaaaaataaaattccgaaaaccctaaaatcaacgaacccccgcccgccgcgtccgcgcaccctcccgatcctaaaacccgctccgtccccctcaaaaaacgaaacgacgatccttaaactttacgcgcccgaaacgattactaaacgaaaacgcgacgacgcgctaaactaaaaaatatccgaaaaaacgcgaaccgaaatcgcgcac

SEQ ID NO: 23603 - DNA, 527 bp, Artificial Sequence
  chemically treated genomic DNA (Homo sapiens) CpG-island No: 23603
tttggtatatagtaaatagtaagtgaatgataagtagttggtagtggtcggagtttcgtcgttggggcgtggagagggtcgtttcggttcgtagttttcgttttgatattgggataatttttttcgcggttgtttagcgtcgttttgattagattttttgtatttcgatttttgttcggttagaagttatagtcgtacgtagcgtttcgtttcgtgacgttattcggggcgggattttcggtcgtcgaagtttaatagtttaggcgggagtcggaagtttagcgcggagtcggtcgcggttttttgttgtgttgttgcggagaggtgaggtttcggaggttttgaggttagcgggttttcgttcgtcgcgttcgcgtattttttcgattttaagattcgtttcgttttttttagagggcggggcggcggtttttgggttttgcgcgttcggagcggttgttgggcgggggcgcggcggcgcgttgggttgggaagtgttcggggaggcgcgggtcggggtcgcgtat

SEQ ID NO: 23604 - DNA, 527 bp, Artificial Sequence
  chemically treated genomic DNA (Homo sapiens) CpG-island No: 23604
atacgcgaccccgacccgcgcctccccgaacacttcccaacccaacgcgccgccgcgcccccgcccaacaaccgctccgaacgcgcaaaacccaaaaaccgccgccccgccctctaaaaaaaacgaaacgaatcttaaaatcgaaaaaatacgcgaacgcgacgaacgaaaacccgctaacctcaaaacctccgaaacctcacctctccgcaacaacacaacaaaaaaccgcgaccgactccgcgctaaacttccgactcccgcctaaactattaaacttcgacgaccgaaaatcccgccccgaataacgtcacgaaacgaaacgctacgtacgactataacttctaaccgaacaaaaatcgaaatacaaaaaatctaatcaaaacgacgctaaacaaccgcgaaaaaaattatcccaatatcaaaacgaaaactacgaaccgaaacgaccctctccacgccccaacgacgaaactccgaccactaccaactacttatcattcacttactatttactatataccaaa

SEQ ID NO: 23605 - DNA, 953 bp, Artificial Sequence
  chemically treated genomic DNA (Homo sapiens) CpG-island No: 23605
cgacgcgcggttgtttgtgtggggcggggtatagggcgtgtttacgcggtcgagtatcgttttcgtcgttttcgtatcgttttattcgaaagtagtcgttaatgaggcgtcggtttgggggcggggtttaggttttcgaggggcgtgttcgcgcgttcgagtatcgttttcgacgtattttttcgtttcgtagttttcgggcggtggagttattttataaagcggcgatcgttttcgcggggcggggcgtagtcggtttcgttttacggggtgttttttcgttcgttcgttagtttttcgcgtttaggacggtcggtagagggcgttgcgttacggggtcgggtcgcggcgacggtggcggcggcggcggcgaggcggcgcgtggtcggtaggcggcgttgttcggttcggtttcggtttgtacggcggttgcggcggcggtagcggtagcggcggcggcggcggcggcggcggcggcggcggcggcggcggcggcggtagcggcggcggtttgggttcgggcgtagcggcggcggcggcggggtttggagtcggatttaagatggtagcggcggcggcggcggtggggtcgggcgcgggcggcgcggggtcggcggtttcgggcggcgcggggttttgcgttatcgtgtcggtgtttttcggcgttcgtttttttattatcggcgacgcgaacggcgagatttagcggtacgcggagtagtaggcgttgcgtttcgaggtgcgcgtcggttcggattcggcgggtatcgttttttatagtcgtgagtacggggtttcggggtaggcgtagggtcggggttgtttacgaggtcggttcggggcgggggtcggcggggaggggttttgagcgcgggggtttggcgtggggttttcgggattgagtcggtggtttgtagggagcgatcgtggagggtcggtgttaggggatagat

SEQ ID NO: 23606 - DNA, 953 bp, Artificial Sequence
  chemically treated genomic DNA (Homo sapiens) CpG-island No: 23606
atctatcccctaacaccgaccctccacgatcgctccctacaaaccaccgactcaatcccgaaaaccccacgccaaacccccgcgctcaaaacccctccccgccgacccccgccccgaaccgacctcgtaaacaaccccgaccctacgcctaccccgaaaccccgtactcacgactataaaaaacgatacccgccgaatccgaaccgacgcgcacctcgaaacgcaacgcctactactccgcgtaccgctaaatctcgccgttcgcgtcgccgataataaaaaaacgaacgccgaaaaacaccgacacgataacgcaaaaccccgcgccgcccgaaaccgccgaccccgcgccgcccgcgcccgaccccaccgccgccgccgccgctaccatcttaaatccgactccaaaccccgccgccgccgccgctacgcccgaacccaaaccgccgccgctaccgccgccgccgccgccgccgccgccgccgccgccgccgccgccgccgctaccgctaccgccgccgcaaccgccgtacaaaccgaaaccgaaccgaacaacgccgcctaccgaccacgcgccgcctcgccgccgccgccgccaccgtcgccgcgacccgaccccgtaacgcaacgccctctaccgaccgtcctaaacgcgaaaaactaacgaacgaacgaaaaaacaccccgtaaaacgaaaccgactacgccccgccccgcgaaaacgatcgccgctttataaaataactccaccgcccgaaaactacgaaacgaaaaaatacgtcgaaaacgatactcgaacgcgcgaacacgcccctcgaaaacctaaaccccgcccccaaaccgacgcctcattaacgactactttcgaataaaacgatacgaaaacgacgaaaacgatactcgaccgcgtaaacacgccctataccccgccccacacaaacaaccgcgcgtcg

SEQ ID NO: 23607 - DNA, 953 bp, Artificial Sequence
  chemically treated genomic DNA (Homo sapiens) CpG-island No: 23607
gtttgttttttggtatcggttttttacggtcgttttttgtaggttatcggtttagtttcggggattttacgttaggttttcgcgtttagggttttttttcgtcggttttcgtttcgggtcggtttcgtgagtagtttcggttttgcgtttgtttcggggtttcgtatttacggttgtagagggcgatgttcgtcgagttcgggtcggcgcgtatttcgaggcgtagcgtttgttgtttcgcgtgtcgttggatttcgtcgttcgcgtcgtcgatggtgaggaggcgggcgtcggggaatatcgatacggtagcgtagggtttcgcgtcgttcgggatcgtcgatttcgcgtcgttcgcgttcggttttatcgtcgtcgtcgtcgttgttattttagattcggttttaggtttcgtcgtcgtcgtcgttgcgttcgggtttaggtcgtcgtcgttgtcgtcgtcgtcgtcgtcgtcgtcgtcgtcgtcgtcgtcgtcgtcgtcgttgtcgttatcgtcgtcgtagtcgtcgtgtaggtcgaggtcgagtcgggtagcgtcgtttgtcggttacgcgtcgtttcgtcgtcgtcgtcgttatcgtcgtcgcggttcggtttcgtggcgtagcgttttttgtcggtcgttttgggcgcggggagttagcgagcgaacgagagggtatttcgtggggcgggatcggttacgtttcgtttcgcgagaacggtcgtcgttttgtgaggtggttttatcgttcgggaattgcggggcgggagggtacgtcgggggcggtgttcgggcgcgcgggtacgtttttcggaggtttgggtttcgtttttaggtcggcgttttattaacggttgttttcgagtgaggcggtgcggggacggcgggggcggtgttcggtcgcgtggatacgttttgtatttcgttttatataagtagtcgcgcgtcg

SEQ ID NO: 23608 - DNA, 953 bp, Artificial Sequence
  chemically treated genomic DNA (Homo sapiens) CpG-island No: 23608
cgacgcgcgactacttatataaaacgaaatacaaaacgtatccacgcgaccgaacaccgcccccgccgtccccgcaccgcctcactcgaaaacaaccgttaataaaacgccgacctaaaaacgaaacccaaacctccgaaaaacgtacccgcgcgcccgaacaccgcccccgacgtaccctcccgccccgcaattcccgaacgataaaaccacctcacaaaacgacgaccgttctcgcgaaacgaaacgtaaccgatcccgccccacgaaataccctctcgttcgctcgctaactccccgcgcccaaaacgaccgacaaaaaacgctacgccacgaaaccgaaccgcgacgacgataacgacgacgacgacgaaacgacgcgtaaccgacaaacgacgctacccgactcgacctcgacctacacgacgactacgacgacgataacgacaacgacgacgacgacgacgacgacgacgacgacgacgacgacgacgacgacaacgacgacgacctaaacccgaacgcaacgacgacgacgacgaaacctaaaaccgaatctaaaataacaacgacgacgacgacgataaaaccgaacgcgaacgacgcgaaatcgacgatcccgaacgacgcgaaaccctacgctaccgtatcgatattccccgacgcccgcctcctcaccatcgacgacgcgaacgacgaaatccaacgacacgcgaaacaacaaacgctacgcctcgaaatacgcgccgacccgaactcgacgaacatcgccctctacaaccgtaaatacgaaaccccgaaacaaacgcaaaaccgaaactactcacgaaaccgacccgaaacgaaaaccgacgaaaaaaaaccctaaacgcgaaaacctaacgtaaaatccccgaaactaaaccgataacctacaaaaaacgaccgtaaaaaaccgataccaaaaaacaaac

SEQ ID NO: 23609 - DNA, 594 bp, Artificial Sequence
  chemically treated genomic DNA (Homo sapiens) CpG-island No: 23609
ttcggcggcgttcgggtggtagtcggtgtttcgtcgcgtttttgagaggtttcggtttcgttcgattttaggttgaagattaggtggttcggggtcggtaggttatttgtagtagatgtagttgggttacgagacgtcgcggtaggtggaggaagtagtcgcgagcgttggtgaaggttatagttattgtcgtttcgttttttttagtattcgttaggcgatcgttgttttatatcgtttcggagcgtcgttttgggttcgtttattttagcgtcgtaaaggattcgggattcggtaggtcgaggacgtcggagtcggaggagatcgatcggtttcgttttttgcggtttcgtttttttttttcgttgcgtattttgtcgtaagtttgtagtgggtgggataagaaagtttttgttatttatcgcgttttttcgtcgagtcgttcgggggcggtatttcgtttattaaattttcgtacgtaggaaacgatggtcgacgttgtcgattttttagttaattttggtattttttaatttatttcgtttttttattggataaaagggagtttagtagggcggatgttgttttttttgt

SEQ ID NO: 23610 - DNA, 594 bp, Artificial Sequence
  chemically treated genomic DNA (Homo sapiens) CpG-island No: 23610
acaaaaaaaacaacatccgccctactaaactcccttttatccaataaaaaaacgaaataaattaaaaaataccaaaattaactaaaaaatcgacaacgtcgaccatcgtttcctacgtacgaaaatttaataaacgaaataccgcccccgaacgactcgacgaaaaaacgcgataaataacaaaaactttcttatcccacccactacaaacttacgacaaaatacgcaacgaaaaaaaaaaacgaaaccgcaaaaaacgaaaccgatcgatctcctccgactccgacgtcctcgacctaccgaatcccgaatcctttacgacgctaaaataaacgaacccaaaacgacgctccgaaacgatataaaacaacgatcgcctaacgaatactaaaaaaaacgaaacgacaataactataaccttcaccaacgctcgcgactacttcctccacctaccgcgacgtctcgtaacccaactacatctactacaaataacctaccgaccccgaaccacctaatcttcaacctaaaatcgaacgaaaccgaaacctctcaaaaacgcgacgaaacaccgactaccacccgaacgccgccgaa

SEQ ID NO: 23611 - DNA, 594 bp, Artificial Sequence
  chemically treated genomic DNA (Homo sapiens) CpG-island No: 23611
gtagggaggataatattcgttttattgagtttttttttatttaataagagagcgggatgagttaaggagtgttaggattggttggagaatcgatagcgtcggttatcgttttttgcgtgcgaagatttgatgaacgaggtgtcgttttcgagcggttcggcggagaggcgcggtgggtgatagaagtttttttgttttatttattataggtttacggtaggatgcgtagcggggagagggggcggggtcgtagggggcggggtcgatcgatttttttcggtttcgacgttttcggtttgtcgggtttcgggttttttgcggcgttagggtgggcgaatttagagcgacgtttcgggacgatgtggggtagcgatcgtttggcgggtgttgggggaggcggggcggtagtgattgtggtttttattaacgttcgcgattgttttttttatttgtcgcggcgtttcgtggtttagttgtatttgttgtaggtaatttgtcggtttcgagttatttgatttttagtttggggtcggacgaggtcgaagttttttagggacgcggcgggatatcggttgttattcgggcgtcgtcgaa

SEQ ID NO: 23612 - DNA, 594 bp, Artificial Sequence
  chemically treated genomic DNA (Homo sapiens) CpG-island No: 23612
ttcgacgacgcccgaataacaaccgatatcccgccgcgtccctaaaaaacttcgacctcgtccgaccccaaactaaaaatcaaataactcgaaaccgacaaattacctacaacaaatacaactaaaccacgaaacgccgcgacaaataaaaaaaacaatcgcgaacgttaataaaaaccacaatcactaccgccccgcctcccccaacacccgccaaacgatcgctaccccacatcgtcccgaaacgtcgctctaaattcgcccaccctaacgccgcaaaaaacccgaaacccgacaaaccgaaaacgtcgaaaccgaaaaaaatcgatcgaccccgccccctacgaccccgccccctctccccgctacgcatcctaccgtaaacctataataaataaaacaaaaaaacttctatcacccaccgcgcctctccgccgaaccgctcgaaaacgacacctcgttcatcaaatcttcgcacgcaaaaaacgataaccgacgctatcgattctccaaccaatcctaacactccttaactcatcccgctctcttattaaataaaaaaaaactcaataaaacgaatattatcctccctac

SEQ ID NO: 23613 - DNA, 798 bp, Artificial Sequence
  chemically treated genomic DNA (Homo sapiens) CpG-island No: 23613
tagtttcgttttatttcggttcgcggtttcgtattcggttaggagcgtttcggatttcgaaagttttttttttatagggattttgttttacgttttttacgttatttggttcggtttttaatttttttttttcgagttttcgatagtagttttcggttttaattttttgtaatttagttcgtgaattcgcgtttcgcgcgtttatttagtattgttttttttatttagttttgtttttcgtttcgtcggtttttgttaggcggcgtaggtatatgtttagaggataggttcgttcgttcgattcgtttttaggttgttttcgtcgggcgcgagtcgtttattcgggtcgaggtgtttgaggcgtcgtcgtcgaagttttcgttgtaaagtcgggcgaagtttttaatcgttgtcgtttttagtttggtattgagcgtcgtgcgggggaggggcgcgggtagtcgttatcgttttcgttatcgcgcgtaggtttcgttttcgcgtcgcgcgggatttaattagggttgtcgggtcgttgtgcgttacgtttattttcggaggggaagttcgttttttattttacgttttacgtttcgttacgttttttttggtcgtatcgagggatgtaggcggtgtttaagcgtacgtttcgttttttagttatttgagtggtagagggttacgtttataggcgttttcgagtaacgtttattgttttttagatttcggagcggggtttttagagtttcgtttattgattcgttaggttttgtaaggttacgttttttggttttttaa

SEQ ID NO: 23614 - DNA, 798 bp, Artificial Sequence
  chemically treated genomic DNA (Homo sapiens) CpG-island No: 23614
ttaaaaaaccaaaaaacgtaaccttacaaaacctaacgaatcaataaacgaaactctaaaaaccccgctccgaaatctaaaaaacaataaacgttactcgaaaacgcctataaacgtaaccctctaccactcaaataactaaaaaacgaaacgtacgcttaaacaccgcctacatccctcgatacgaccaaaaaaaacgtaacgaaacgtaaaacgtaaaataaaaaacgaacttcccctccgaaaataaacgtaacgcacaacgacccgacaaccctaattaaatcccgcgcgacgcgaaaacgaaacctacgcgcgataacgaaaacgataacgactacccgcgcccctcccccgcacgacgctcaataccaaactaaaaacgacaacgattaaaaacttcgcccgactttacaacgaaaacttcgacgacgacgcctcaaacacctcgacccgaataaacgactcgcgcccgacgaaaacaacctaaaaacgaatcgaacgaacgaacctatcctctaaacatatacctacgccgcctaacaaaaaccgacgaaacgaaaaacaaaactaaataaaaaaaacaatactaaataaacgcgcgaaacgcgaattcacgaactaaattacaaaaaattaaaaccgaaaactactatcgaaaactcgaaaaaaaaaaattaaaaaccgaaccaaataacgtaaaaaacgtaaaacaaaatccctataaaaaaaaaactttcgaaatccgaaacgctcctaaccgaatacgaaaccgcgaaccgaaataaaacgaaacta

SEQ ID NO: 23615 - DNA, 798 bp, Artificial Sequence
  chemically treated genomic DNA (Homo sapiens) CpG-island No: 23615
ttgaggagttaggggacgtggttttgtagagtttagcgggttagtgggcggggttttaagaatttcgtttcggggtttaaggagtagtgggcgttgttcggaggcgtttgtgggcgtggttttttattatttagatgattggagagcggggcgtgcgtttgggtatcgtttgtatttttcggtgcgattagagggggcgtagcgaggcgtggaacgtggggtgggaagcgggtttttttttcggaagtgggcgtggcgtatagcggttcggtagttttggttgggtttcgcgcggcgcgggggcggggtttacgcgcggtggcgggggcggtggcggttgttcgcgtttttttttcgtacggcgtttagtgttaggttggaggcggtagcggttggaggtttcgttcggttttgtagcggggatttcggcggcggcgttttaggtatttcggttcgggtgagcggttcgcgttcggcgggggtagtttgagagcgagtcgggcgggcggatttgttttttgagtatgtgtttgcgtcgtttgataggagtcggcggggcgaggggtagggttaggtggaggggatagtgttgggtgggcgcgcggggcgcgggtttacgggttgggttgtaaggggttagggtcgggggttgttgtcgggggttcggggaaagggagttggggatcgaattaggtggcgtggggagcgtgaagtagggtttttgtggggaggaggttttcgaggttcggaacgtttttggtcgggtgcggagtcgcgggtcgaggtgggacgaggttg

SEQ ID NO: 23616 - DNA, 798 bp, Artificial Sequence
  chemically treated genomic DNA (Homo sapiens) CpG-island No: 23616
caacctcgtcccacctcgacccgcgactccgcacccgaccaaaaacgttccgaacctcgaaaacctcctccccacaaaaaccctacttcacgctccccacgccacctaattcgatccccaactccctttccccgaacccccgacaacaacccccgaccctaaccccttacaacccaacccgtaaacccgcgccccgcgcgcccacccaacactatcccctccacctaaccctacccctcgccccgccgactcctatcaaacgacgcaaacacatactcaaaaaacaaatccgcccgcccgactcgctctcaaactacccccgccgaacgcgaaccgctcacccgaaccgaaatacctaaaacgccgccgccgaaatccccgctacaaaaccgaacgaaacctccaaccgctaccgcctccaacctaacactaaacgccgtacgaaaaaaaaacgcgaacaaccgccaccgcccccgccaccgcgcgtaaaccccgcccccgcgccgcgcgaaacccaaccaaaactaccgaaccgctatacgccacgcccacttccgaaaaaaaaacccgcttcccaccccacgttccacgcctcgctacgccccctctaatcgcaccgaaaaatacaaacgatacccaaacgcacgccccgctctccaatcatctaaataataaaaaaccacgcccacaaacgcctccgaacaacgcccactactccttaaaccccgaaacgaaattcttaaaaccccgcccactaacccgctaaactctacaaaaccacgtcccctaactcctcaa

SEQ ID NO: 23617 - DNA, 587 bp, Artificial Sequence
  chemically treated genomic DNA (Homo sapiens) CpG-island No: 23617
tcgatcgttttacgttaattaattcgttcgttgattttgttacgaaatcgcgtttttttttttgttttttttcgaggggacgggacgtttttttttttatttaaatttatatatcgtggcggtagtttttttatattagcgttcgttatacgttagtttagtttatgtttaacgtattgaaatcgttgcgagtcgttcgtattacgatatttttaattttttacgatgattttatagttaacgttatttttttcgagacggttatgtattatattatatatagatagcgatacggcgatatatagtgcgtgatattgttattcgtatatagtaatagcggttacgcggtaataacgtatgtttagcgtagacgcgtatatattgtttagtgtattcgtagcgcgagtttaatatacggatcgtttagtacgttcgggatttcgtttattttgaattgatttttaggtgatattgtttagagtttacgtatagaacggcggacgtagttaacgttgaggtacgattcgcgatacgcgaggagagagattcgtaacgcgtttttggttttttaggatacgtattgatcg

SEQ ID NO: 23618 - DNA, 587 bp, Artificial Sequence
  chemically treated genomic DNA (Homo sapiens) CpG-island No: 23618
cgatcaatacgtatcctaaaaaaccaaaaacgcgttacgaatctctctcctcgcgtatcgcgaatcgtacctcaacgttaactacgtccgccgttctatacgtaaactctaaacaatatcacctaaaaatcaattcaaaataaacgaaatcccgaacgtactaaacgatccgtatattaaactcgcgctacgaatacactaaacaatatatacgcgtctacgctaaacatacgttattaccgcgtaaccgctattactatatacgaataacaatatcacgcactatatatcgccgtatcgctatctatatataatataatacataaccgtctcgaaaaaaataacgttaactataaaatcatcgtaaaaaattaaaaatatcgtaatacgaacgactcgcaacgatttcaatacgttaaacataaactaaactaacgtataacgaacgctaatataaaaaaactaccgccacgatatataaatttaaataaaaaaaaaaacgtcccgtcccctcgaaaaaaaacaaaaaaaaaaacgcgatttcgtaacaaaatcaacgaacgaattaattaacgtaaaacgatcga

SEQ ID NO: 23619 - DNA, 587 bp, Artificial Sequence
  chemically treated genomic DNA (Homo sapiens) CpG-island No: 23619
cggttagtgcgtgttttgagaggttaagagcgcgttgcgggttttttttttcgcgtatcgcgggtcgtattttagcgttggttgcgttcgtcgttttgtgcgtgggttttgggtagtgttatttagaggttagtttagagtgagcggagtttcgggcgtgttgagcggttcgtgtgttgggttcgcgttgcgagtgtattgggtagtgtgtgcgcgtttgcgttggatatgcgttgttgtcgcgtggtcgttgttgttgtatgcgagtggtagtgttacgtattgtgtgtcgtcgtgtcgttgtttgtgtgtggtgtggtgtatggtcgtttcgaggagagtagcgttggttgtgaagttatcgtgagaagttgggggtgtcgtgatacgggcggttcgtagcggttttagtgcgttgggtataggttgggttgacgtgtagcgggcgttggtgtagaggggttgtcgttacggtgtgtggatttgggtgagggggagggcgtttcgttttttcggagaggggtaggggggagggcgcggtttcgtgatagggttagcgggcgggttggttggcgtgggacggtcgg

SEQ ID NO: 23620 - DNA, 587 bp, Artificial Sequence
  chemically treated genomic DNA (Homo sapiens) CpG-island No: 23620
ccgaccgtcccacgccaaccaacccgcccgctaaccctatcacgaaaccgcgccctcccccctacccctctccgaaaaaacgaaacgccctccccctcacccaaatccacacaccgtaacgacaacccctctacaccaacgcccgctacacgtcaacccaacctatacccaacgcactaaaaccgctacgaaccgcccgtatcacgacacccccaacttctcacgataacttcacaaccaacgctactctcctcgaaacgaccatacaccacaccacacacaaacaacgacacgacgacacacaatacgtaacactaccactcgcatacaacaacaacgaccacgcgacaacaacgcatatccaacgcaaacgcgcacacactacccaatacactcgcaacgcgaacccaacacacgaaccgctcaacacgcccgaaactccgctcactctaaactaacctctaaataacactacccaaaacccacgcacaaaacgacgaacgcaaccaacgctaaaatacgacccgcgatacgcgaaaaaaaaaacccgcaacgcgctcttaacctctcaaaacacgcactaaccg

SEQ ID NO: 23621 - DNA, 618 bp, Artificial Sequence
  chemically treated genomic DNA (Homo sapiens) CpG-island No: 23621
cgaattggagaggaagtaaagaagatttggtttggtagaaagtttttacgtttagcggtagaggaaaaaatttacgcggggaaaaattttagggagaaggatttatcgcggatagtttatttaggaggaatagacggggaaaaatcgaattttatttacggatggaggagtataagttcgcggatgttacggttataatgtaagagggcgtaacgataagaggggtaattaatcggcgcgacgttaatcggtttatttaaggagcgtgggttttcgtcgttaacggacgtaatagtttgttttttagaaagttaacggagagaatataatttatatagacgtagcgatcgtgttataggtagagatatagtcgagttaagagtgcgtgttatagaagcgagcgtcgattatttacgcgatagagagcggcgcgatagaaacgatattcgtgagggagaggagagtttttatagacgttacgagtgagtattggggagcgacgaagaggaatatcgatttttttttacgagacgagagaagattcgtgtcgcgtttcgatcgttgagtatacgatagattagtttggattagtcgacgtttcgagaatacgacgagacg

SEQ ID NO: 23622 - DNA, 618 bp, Artificial Sequence
  chemically treated genomic DNA (Homo sapiens) CpG-island No: 23622
cgtctcgtcgtattctcgaaacgtcgactaatccaaactaatctatcgtatactcaacgatcgaaacgcgacacgaatcttctctcgtctcgtaaaaaaaaatcgatattcctcttcgtcgctccccaatactcactcgtaacgtctataaaaactctcctctccctcacgaatatcgtttctatcgcgccgctctctatcgcgtaaataatcgacgctcgcttctataacacgcactcttaactcgactatatctctacctataacacgatcgctacgtctatataaattatattctctccgttaactttctaaaaaacaaactattacgtccgttaacgacgaaaacccacgctccttaaataaaccgattaacgtcgcgccgattaattacccctcttatcgttacgccctcttacattataaccgtaacatccgcgaacttatactcctccatccgtaaataaaattcgatttttccccgtctattcctcctaaataaactatccgcgataaatccttctccctaaaatttttccccgcgtaaattttttcctctaccgctaaacgtaaaaactttctaccaaaccaaatcttctttacttcctctccaattcg

SEQ ID NO: 23623 - DNA, 618 bp, Artificial Sequence
  chemically treated genomic DNA (Homo sapiens) CpG-island No: 23623
cgtttcgtcgtgttttcgaggcgtcggttggtttaagttggtttgtcgtgtgtttagcggtcgaggcgcgatacgagttttttttcgtttcgtggggagagatcggtgttttttttcgtcgttttttagtatttattcgtggcgtttgtgggggttttttttttttttacgagtgtcgtttttgtcgcgtcgttttttgtcgcgtgagtggtcgacgttcgtttttgtgatacgtatttttagttcggttgtgtttttgtttgtgatacggtcgttgcgtttgtgtggattgtgtttttttcgttgattttttgagaggtaagttgttacgttcgttaacggcgagagtttacgttttttgagtgggtcggttggcgtcgcgtcggttgattgttttttttgtcgttgcgtttttttgtattgtgatcgtgatattcgcgggtttatgtttttttattcgtgagtagggttcgattttttttcgtttattttttttgagtgggttattcgcggtgggtttttttttttggagttttttttcgcgtggatttttttttttgtcgttgagcgtaaaagttttttgttagattaggttttttttgttttttttttagttcg

SEQ ID NO: 23624 - DNA, 618 bp, Artificial Sequence
  chemically treated genomic DNA (Homo sapiens) CpG-island No: 23624
cgaactaaaaaaaaaacaaaaaaaacctaatctaacaaaaaacttttacgctcaacgacaaaaaaaaaaatccacgcgaaaaaaaactccaaaaaaaaaaacccaccgcgaataacccactcaaaaaaaataaacgaaaaaaaatcgaaccctactcacgaataaaaaaacataaacccgcgaatatcacgatcacaatacaaaaaaacgcaacgacaaaaaaaacaatcaaccgacgcgacgccaaccgacccactcaaaaaacgtaaactctcgccgttaacgaacgtaacaacttacctctcaaaaaatcaacgaaaaaaacacaatccacacaaacgcaacgaccgtatcacaaacaaaaacacaaccgaactaaaaatacgtatcacaaaaacgaacgtcgaccactcacgcgacaaaaaacgacgcgacaaaaacgacactcgtaaaaaaaaaaaaaacccccacaaacgccacgaataaatactaaaaaacgacgaaaaaaaacaccgatctctccccacgaaacgaaaaaaaactcgtatcgcgcctcgaccgctaaacacacgacaaaccaacttaaaccaaccgacgcctcgaaaacacgacgaaacg

SEQ ID NO: 23625 - DNA, 1074 bp, Artificial Sequence
  chemically treated genomic DNA (Homo sapiens) CpG-island No: 23625
  misc_feature (603)..(603): n is either a, c, g or t
aaaggaggcgtcggtagaaaataagggcggggcgggtataaaaaacgggggggggattcgaaaaaagaagggcgcgtagaggaaaaaaaaaggggggcgcggtaaaaaagaaggaggcgggtttaaataaaaggggggcgcgcggcgggaaaaatagggggcgagagcgtaaaaaaaggggggggcggaggaaaaaaaagggcgggcgcgcggataaaaaaaagcgcggagcggaaagaaaaaaaaacgcggggcgcggaaaaaaaagtcgcgggggggcgtaaaaaaaaatagggggggggcgggtaaataaagacggggggggggggtattataaaaaacggggggggggggatataaaaaaagcgcgggcggcgcggaaaataaaaaaaaggcgcggggggtcgaaaaatagagaagggggggcggggagaataaaaaaaaaaagggcggagggggaatagaaaaagaagcggggggcgcggggcggtaataaaaataaagagaggcgcggaagcgtttgaataaaataagaacgcggcggggcgcgcgacgataaagaaataagagcgggtagcggcggggagaaaataaaataatagngggcgcgtcggcgcgcgaaaaaaagaaaagaggagcgcgcggtcgggttttaataaataaattaggggagggcgcgtcgtcgtaataagaaataaagcgggcgggcgcggttacgtatatattaataaagggagcggcgcggcggcggataaatataaaataaagagcgaggcgcgggcggtgaaaaaataaaaaattagggagggggggcgcgagatgtagtaaagataagcgaagagagggaggcgggcgagatcgaaaaaaaataaaaataatacgggcgtagggcgggcgatttaaataaaataagacggcgggggcgtcgaacgcgtaattttatagaaaaataaacgacgagggggggagtcggtcgcggtaaaatataataataacgcgagaggcggcgcgcgatcggtaatataataaaataaataaaagaaacgcgggagtttaacgttttagaacgagaga

SEQ ID NO: 23626 - DNA, 1074 bp, Artificial Sequence
  chemically treated genomic DNA (Homo sapiens) CpG-island No: 23626
  misc_feature (472)..(472): n is either a, c, g or t
tctctcgttctaaaacgttaaactcccgcgtttcttttatttattttattatattaccgatcgcgcgccgcctctcgcgttattattatattttaccgcgaccgactccccccctcgtcgtttatttttctataaaattacgcgttcgacgcccccgccgtcttattttatttaaatcgcccgccctacgcccgtattatttttattttttttcgatctcgcccgcctccctctcttcgcttatctttactacatctcgcgccccccctccctaattttttattttttcaccgcccgcgcctcgctctttattttatatttatccgccgccgcgccgctccctttattaatatatacgtaaccgcgcccgcccgctttatttcttattacgacgacgcgccctcccctaatttatttattaaaacccgaccgcgcgctcctcttttctttttttcgcgcgccgacgcgcccnctattattttattttctccccgccgctacccgctcttatttctttatcgtcgcgcgccccgccgcgttcttattttattcaaacgcttccgcgcctctctttatttttattaccgccccgcgccccccgcttctttttctattccccctccgccctttttttttttattctccccgcccccccttctctatttttcgaccccccgcgccttttttttattttccgcgccgcccgcgctttttttatatccccccccccccgttttttataataccccccccccccgtctttatttacccgccccccccctatttttttttacgcccccccgcgacttttttttccgcgccccgcgtttttttttctttccgctccgcgcttttttttatccgcgcgcccgcccttttttttcctccgcccccccctttttttacgctctcgccccctatttttcccgccgcgcgccccccttttatttaaacccgcctccttcttttttaccgcgcccccctttttttttcctctacgcgcccttcttttttcgaatcccccccccgttttttatacccgccccgcccttattttctaccgacgcctccttt

SEQ ID NO: 23627 - DNA, 1074 bp, Artificial Sequence
  chemically treated genomic DNA (Homo sapiens) CpG-island No: 23627
  misc_feature (472)..(472): n is either a, c, g or t
tttttcgttttgaagcgttgggttttcgcgttttttttgtttgttttgttgtgttatcgatcgcgcgtcgtttttcgcgttgttgttgtattttatcgcggtcggttttttttttcgtcgtttgtttttttgtgaggttgcgcgttcggcgttttcgtcgttttgttttatttgggtcgttcgttttgcgttcgtgttgtttttgttttttttcggtttcgttcgttttttttttttcgtttatttttattgtatttcgcgttttttttttttggttttttgtttttttatcgttcgcgtttcgttttttgttttgtatttgttcgtcgtcgcgtcgttttttttgttagtgtatgcgtggtcgcgttcgttcgttttgttttttgttgcggcggcgcgtttttttttggtttgtttgttggggttcggtcgcgcgttttttttttttttttttcgcgcgtcggcgcgtttnttgttgttttatttttttttcgtcgttgttcgtttttgtttttttgtcgtcgcgcgtttcgtcgcgtttttattttgtttaggcgttttcgcgtttttttttgtttttgttgtcgtttcgcgtttttcgtttttttttttatttttttttcgttttttttttttttgtttttttcgtttttttttttttatttttcggtttttcgcgttttttttttgtttttcgcgtcgttcgcgttttttttatgttttttttttttcgttttttgtggtgtttttttttttcgtttttgtttgttcgttttttttttgtttttttttgcgttttttcgcggttttttttttcgcgtttcgcgttttttttttttttcgtttcgcgtttttttttgttcgcgcgttcgtttttttttttttttcgtttttttttttttttgcgttttcgttttttgtttttttcgtcgcgcgttttttttttgtttgggttcgttttttttttttttgtcgcgttttttttttttttttttttgcgcgttttttttttttcgggtttttttttcgttttttgtgttcgtttcgtttttgttttttatcggcgtttttttt

SEQ ID NO: 23628 - DNA, 1074 bp, Artificial Sequence
  chemically treated genomic DNA (Homo sapiens) CpG-island No: 23628
  misc_feature (603)..(603): n is either a, c, g or t
aaaaaaaacgccgataaaaaacaaaaacgaaacgaacacaaaaaacgaaaaaaaaacccgaaaaaaaaaaaacgcgcaaaaaaaaaaaaaaaaaaaacgcgacaaaaaaaaaaaaaacgaacccaaacaaaaaaaaaacgcgcgacgaaaaaaacaaaaaacgaaaacgcaaaaaaaaaaaaaaacgaaaaaaaaaaaaaaacgaacgcgcgaacaaaaaaaaacgcgaaacgaaaaaaaaaaaaaacgcgaaacgcgaaaaaaaaaaccgcgaaaaaacgcaaaaaaaaacaaaaaaaaaacgaacaaacaaaaacgaaaaaaaaaaacaccacaaaaaacgaaaaaaaaaaaacataaaaaaaacgcgaacgacgcgaaaaacaaaaaaaaaacgcgaaaaaccgaaaaataaaaaaaaaaaaacgaaaaaaacaaaaaaaaaaaaaacgaaaaaaaaataaaaaaaaaaacgaaaaacgcgaaacgacaacaaaaacaaaaaaaaacgcgaaaacgcctaaacaaaataaaaacgcgacgaaacgcgcgacgacaaaaaaacaaaaacgaacaacgacgaaaaaaaaataaaacaacaanaaacgcgccgacgcgcgaaaaaaaaaaaaaaaaaacgcgcgaccgaaccccaacaaacaaaccaaaaaaaaacgcgccgccgcaacaaaaaacaaaacgaacgaacgcgaccacgcatacactaacaaaaaaaacgacgcgacgacgaacaaatacaaaacaaaaaacgaaacgcgaacgataaaaaaacaaaaaaccaaaaaaaaaaaacgcgaaatacaataaaaataaacgaaaaaaaaaaaacgaacgaaaccgaaaaaaaacaaaaacaacacgaacgcaaaacgaacgacccaaataaaacaaaacgacgaaaacgccgaacgcgcaacctcacaaaaaaacaaacgacgaaaaaaaaaaccgaccgcgataaaatacaacaacaacgcgaaaaacgacgcgcgatcgataacacaacaaaacaaacaaaaaaaacgcgaaaacccaacgcttcaaaacgaaaaa

SEQ ID NO: 23629 - DNA, 951 bp, Artificial Sequence
  chemically treated genomic DNA (Homo sapiens) CpG-island No: 23629
gtgtgtgtcggcgcgtttgtgcgtggagggggataattgtatttagcgcgaggtattgggggaggaggaagcggtagtagagatttgaataattgattttttagtcgtattagacgttcgggagcgggcggagagcgtggttttaatattacggatagtagcgcgcgtcgtcgtaggcgttttcgtcgttagttagttatttattttggttttatttgtcgtcgtgcgttttcggaacgggtggtcgcgtttcgcgtcgtcgtcgagggattgcggggtttgtttcgatttatttaggagagaggttgcgggtaggagacgttttcgttcgtcggagttcgaagttttttgggtttgagcgggggttattgcgtttcgtcggttgagaataagtttttaagttggtgtggagggcgtcgttatttttttttttttttttttcggaggcgatcgtagtagaaagacgtttcgggaattcggttttgttagtgttgtgaattagggtgtttaggcgtttatcggattttcgttgggaagtggggagtcgaacgttcggcgcggagttggtttagtagcgaagggttcggagggagttgttttttttcgttcgcgtttttttcggtcggggatcgcggggattttcggttatacgcgagcgcgtttttatatttatatatatattcgtttttaaatatattagttcggagttgggttgcggagagggtgtttcggcgcgtttagaggatcgggtagttgtcgttcggagtggggtaggaagcggagttagggattttggaggggagtttttagggtttggtcggattatgggatcgggtgagcgttgagaatcgcggtcgtagttattagttttggagatgattaggagcggttattgttgagaattatgtggagagaggttgcggtgagtgttagcgcgggacgtcgggtttt

SEQ ID NO: 23630 - DNA, 951 bp, Artificial Sequence
  chemically treated genomic DNA (Homo sapiens) CpG-island No: 23630
aaaacccgacgtcccgcgctaacactcaccgcaacctctctccacataattctcaacaataaccgctcctaatcatctccaaaactaataactacgaccgcgattctcaacgctcacccgatcccataatccgaccaaaccctaaaaactcccctccaaaatccctaactccgcttcctaccccactccgaacgacaactacccgatcctctaaacgcgccgaaacaccctctccgcaacccaactccgaactaatatatttaaaaacgaatatatatataaatataaaaacgcgctcgcgtataaccgaaaatccccgcgatccccgaccgaaaaaaacgcgaacgaaaaaaaacaactccctccgaacccttcgctactaaaccaactccgcgccgaacgttcgactccccacttcccaacgaaaatccgataaacgcctaaacaccctaattcacaacactaacaaaaccgaattcccgaaacgtctttctactacgatcgcctccgaaaaaaaaaaaaaaaaaaataacgacgccctccacaccaacttaaaaacttattctcaaccgacgaaacgcaataacccccgctcaaacccaaaaaacttcgaactccgacgaacgaaaacgtctcctacccgcaacctctctcctaaataaatcgaaacaaaccccgcaatccctcgacgacgacgcgaaacgcgaccacccgttccgaaaacgcacgacgacaaataaaaccaaaataaataactaactaacgacgaaaacgcctacgacgacgcgcgctactatccgtaatattaaaaccacgctctccgcccgctcccgaacgtctaatacgactaaaaaatcaattattcaaatctctactaccgcttcctcctcccccaatacctcgcgctaaatacaattatccccctccacgcacaaacgcgccgacacacac

SEQ ID NO: 23631 - DNA, 951 bp, Artificial Sequence
  chemically treated genomic DNA (Homo sapiens) CpG-island No: 23631
agggttcggcgtttcgcgttagtatttatcgtagtttttttttatatagtttttagtagtggtcgtttttggttatttttagggttgatggttgcggtcgcgatttttagcgtttattcggttttatgattcggttaagttttaggagtttttttttaagatttttagtttcgttttttgttttatttcggacggtaattgttcggttttttgagcgcgtcggagtatttttttcgtaatttagtttcgggttggtgtgtttgagggcgagtgtgtgtgtgagtgtgggagcgcgttcgcgtgtggtcggggattttcgcggttttcggtcgagagaggcgcgggcggggaaaggtagtttttttcgggtttttcgttgttgggttagtttcgcgtcgggcgttcggttttttattttttagcgggagttcggtgagcgtttggatattttggtttatagtattggtaaagtcgggttttcggggcgtttttttgttgcggtcgttttcgaggaagaggagaaggaaggtagcggcgttttttatattaatttagggatttgtttttagtcggcgagacgtagtagttttcgtttaagtttaagaggtttcgagtttcggcgggcgaaagcgttttttgttcgtagttttttttttaggtgggtcgagatagatttcgtagtttttcggcggcgacgcggagcgcggttattcgtttcgagagcgtacggcggtaaataaggttaggataggtggttggttggcgacgggggcgtttgcggcggcgcgcgttgttgttcgtggtgttggaattacgtttttcgttcgttttcgggcgtttggtgcggttgaagaattaattatttagatttttgttatcgttttttttttttttagtgtttcgcgttgggtatagttatttttttttacgtataggcgcgtcgatatatat

SEQ ID NO: 23632 - DNA, 951 bp, Artificial Sequence
  chemically treated genomic DNA (Homo sapiens) CpG-island No: 23632
atatatatcgacgcgcctatacgtaaaaaaaaataactatacccaacgcgaaacactaaaaaaaaaaaaaacgataacaaaaatctaaataattaattcttcaaccgcaccaaacgcccgaaaacgaacgaaaaacgtaattccaacaccacgaacaacaacgcgcgccgccgcaaacgcccccgtcgccaaccaaccacctatcctaaccttatttaccgccgtacgctctcgaaacgaataaccgcgctccgcgtcgccgccgaaaaactacgaaatctatctcgacccacctaaaaaaaaaactacgaacaaaaaacgctttcgcccgccgaaactcgaaacctcttaaacttaaacgaaaactactacgtctcgccgactaaaaacaaatccctaaattaatataaaaaacgccgctaccttccttctcctcttcctcgaaaacgaccgcaacaaaaaaacgccccgaaaacccgactttaccaatactataaaccaaaatatccaaacgctcaccgaactcccgctaaaaaataaaaaaccgaacgcccgacgcgaaactaacccaacaacgaaaaacccgaaaaaaactacctttccccgcccgcgcctctctcgaccgaaaaccgcgaaaatccccgaccacacgcgaacgcgctcccacactcacacacacactcgccctcaaacacaccaacccgaaactaaattacgaaaaaaatactccgacgcgctcaaaaaaccgaacaattaccgtccgaaataaaacaaaaaacgaaactaaaaatcttaaaaaaaaactcctaaaacttaaccgaatcataaaaccgaataaacgctaaaaatcgcgaccgcaaccatcaaccctaaaaataaccaaaaacgaccactactaaaaactatataaaaaaaaactacgataaatactaacgcgaaacgccgaaccct

SEQ ID NO: 23633 - DNA, 589 bp, Artificial Sequence
  chemically treated genomic DNA (Homo sapiens) CpG-island No: 23633
tttgtgtgcgcgtgttatcgatgggttgggtgcgagagatagcgttagcgcgcggttataacgtattgcggggtcgagagtcggtaggaaatcgaaaaagttgttcgtcggtagaggttgggaggttggaagggttttttattcgttcggtgttttagaaacgcgtcggttttgtttcgacgcgatcgtttggggagtttaaggggcgcgtagggggtttcggggcgttcggtagtcgcggggtcgagcgcgcgtgtgagcgagtgcgaggttgcgggcggcgggcgggcgagtgtgcgcgggagggagggggagcgcgcgcgcgttcgggtttcggtttttttagtttttcggttttcgcgtttgtttttcgttcgcgcgtatcgttgttcgttgtcgcggttttcgttcgcgtcggcgttgtacggtagttagttcgtcgtcgtcgtttgttttgtgttttttatagaagatgggagcgatttttttttgatcgggagttgtttaaaaggagggagtgcgtcgtattttttattagcgtggaggaacggaggaagaatttatttatattttttaaattaggtaggat

SEQ ID NO: 23634 - DNA, 589 bp, Artificial Sequence
  chemically treated genomic DNA (Homo sapiens) CpG-island No: 23634
atcctacctaatttaaaaaatataaataaattcttcctccgttcctccacgctaataaaaaatacgacgcactccctccttttaaacaactcccgatcaaaaaaaaatcgctcccatcttctataaaaaacacaaaacaaacgacgacgacgaactaactaccgtacaacgccgacgcgaacgaaaaccgcgacaacgaacaacgatacgcgcgaacgaaaaacaaacgcgaaaaccgaaaaactaaaaaaaccgaaacccgaacgcgcgcgcgctccccctccctcccgcgcacactcgcccgcccgccgcccgcaacctcgcactcgctcacacgcgcgctcgaccccgcgactaccgaacgccccgaaaccccctacgcgccccttaaactccccaaacgatcgcgtcgaaacaaaaccgacgcgtttctaaaacaccgaacgaataaaaaacccttccaacctcccaacctctaccgacgaacaactttttcgatttcctaccgactctcgaccccgcaatacgttataaccgcgcgctaacgctatctctcgcacccaacccatcgataacacgcgcacacaaa

SEQ ID NO: 23635 - DNA, 589 bp, Artificial Sequence
  chemically treated genomic DNA (Homo sapiens) CpG-island No: 23635
attttatttggtttggggagtgtgaatggatttttttttcgtttttttacgttagtagaaaatacggcgtattttttttttttaaatagttttcgattaggaagaggtcgtttttattttttgtgggaagtataaagtaggcggcggcggcgggttgattatcgtgtagcgtcggcgcgagcgggagtcgcggtagcgggtagcggtgcgcgcgggcgggaggtaggcgcggaggtcgggaggttgggagggtcggggttcgggcgcgcgcgcgttttttttttttttcgcgtatattcgttcgttcgtcgttcgtagtttcgtattcgtttatacgcgcgttcggtttcgcggttgtcgggcgtttcggggttttttgcgcgttttttgggttttttaggcgatcgcgtcggggtaaagtcggcgcgtttttggagtatcgagcgggtggggagtttttttagttttttagtttttgtcggcgagtagttttttcgattttttgtcggttttcggtttcgtagtgcgttgtggtcgcgcgttagcgttgtttttcgtatttagtttatcgatgatacgcgtatatagg

SEQ ID NO: 23636 - DNA, 589 bp, Artificial Sequence
  chemically treated genomic DNA (Homo sapiens) CpG-island No: 23636
cctatatacgcgtatcatcgataaactaaatacgaaaaacaacgctaacgcgcgaccacaacgcactacgaaaccgaaaaccgacaaaaaatcgaaaaaactactcgccgacaaaaactaaaaaactaaaaaaactccccacccgctcgatactccaaaaacgcgccgactttaccccgacgcgatcgcctaaaaaacccaaaaaacgcgcaaaaaaccccgaaacgcccgacaaccgcgaaaccgaacgcgcgtataaacgaatacgaaactacgaacgacgaacgaacgaatatacgcgaaaaaaaaaaaaaacgcgcgcgcgcccgaaccccgaccctcccaacctcccgacctccgcgcctacctcccgcccgcgcgcaccgctacccgctaccgcgactcccgctcgcgccgacgctacacgataatcaacccgccgccgccgcctactttatacttcccacaaaaaataaaaacgacctcttcctaatcgaaaactatttaaaaaaaaaaaatacgccgtattttctactaacgtaaaaaaacgaaaaaaaaatccattcacactccccaaaccaaataaaat

SEQ ID NO: 23637 - DNA, 791 bp, Artificial Sequence
  chemically treated genomic DNA (Homo sapiens) CpG-island No: 23637
ttaattttagatcgtttttggtggggcgggcgcgagcgtaggatcgcggagtttgttgcgttgttcggttgtaggggaggagttgggtttcgttttcggtttttcgcgtttcgcgtttattggttggtttcgggggtgggcgggtttcgtcgtacggagttttgcgttttgaggtttaagcggcggcgtgtaaggcgtgtgaggcgcgtagagagtcgcgcgcgtcgtttgcgatgtttcgggacggcgtttttgtcgggaatattatttcggcggtattaggttgtcgcgtagagttcggatttcgcgattgtcggggtatcgtaggttttggattcgttgaagcggtgagttttgtttttgttttatatgtcgcgttttcgttcgtgttttggggtagttggtagtgggtgggtaggaaggggcgggtcggtagggcgtcgtacgttggcgttttcgcgtcgcgggaatggggttcggatttttttcgtgaatgttattttttaggttatcggtttttagcgttaagttgtatgggttggtgtgttagtcggttagcgaatagcggtagaacgtttggtcgggtcggcgtttttcgggatattcgtttcggtttcgtagtggtagcgttttttgcgagtttagatcggtttagtggacgcgtcgcgttgtgtacgcgggtttggggagacggcggtttttgaatgattttttatattgtagggtatttgggagcggtggattgagggggtataacgtggtttttgtgtcggtgaaatcgtttggattag

SEQ ID NO: 23638 - DNA, 791 bp, Artificial Sequence
  chemically treated genomic DNA (Homo sapiens) CpG-island No: 23638
ctaatccaaacgatttcaccgacacaaaaaccacgttataccccctcaatccaccgctcccaaataccctacaatataaaaaatcattcaaaaaccgccgtctccccaaacccgcgtacacaacgcgacgcgtccactaaaccgatctaaactcgcaaaaaacgctaccactacgaaaccgaaacgaatatcccgaaaaacgccgacccgaccaaacgttctaccgctattcgctaaccgactaacacaccaacccatacaacttaacgctaaaaaccgataacctaaaaaataacattcacgaaaaaaatccgaaccccattcccgcgacgcgaaaacgccaacgtacgacgccctaccgacccgccccttcctacccacccactaccaactaccccaaaacacgaacgaaaacgcgacatataaaacaaaaacaaaactcaccgcttcaacgaatccaaaacctacgataccccgacaatcgcgaaatccgaactctacgcgacaacctaataccgccgaaataatattcccgacaaaaacgccgtcccgaaacatcgcaaacgacgcgcgcgactctctacgcgcctcacacgccttacacgccgccgcttaaacctcaaaacgcaaaactccgtacgacgaaacccgcccacccccgaaaccaaccaataaacgcgaaacgcgaaaaaccgaaaacgaaacccaactcctcccctacaaccgaacaacgcaacaaactccgcgatcctacgctcgcgcccgccccaccaaaaacgatctaaaattaa

SEQ ID NO: 23639 - DNA, 791 bp, Artificial Sequence
  chemically treated genomic DNA (Homo sapiens) CpG-island No: 23639
ttggtttaagcgattttatcgatatagaagttacgttgtgtttttttaatttatcgtttttagatattttgtagtgtgagggattatttaagaatcgtcgtttttttagattcgcgtgtatagcgcggcgcgtttattgagtcggtttaggttcgtaggaggcgttgttattgcgaggtcgaaacgagtgtttcggaaaacgtcggttcggttaggcgttttgtcgttattcgttgatcgattggtatattagtttatgtaatttagcgttaaagatcggtagtttggggaatgatatttacggggggaattcgaattttattttcgcgacgcggggacgttaacgtgcgacgttttgtcggttcgtttttttttgtttatttattgttaattgttttagagtacgggcgagagcgcggtatatagggtaaaggtagagtttatcgttttagcgagtttaaaatttgcggtgtttcggtagtcgcggaattcgggttttgcgcggtagtttggtgtcgtcggggtggtattttcggtaggaacgtcgtttcggggtatcgtagacggcgcgcgcggttttttacgcgttttatacgttttgtacgtcgtcgtttgagttttaaggcgtaggatttcgtgcggcgggattcgtttattttcgaggttagttaatggacgcggagcgcgggaagtcgggggcggggtttagttttttttttgtagtcgagtaacgtagtaggtttcgcggttttgcgttcgcgttcgttttattaggagcggtttgggattgg

SEQ ID NO: 23640 - DNA, 791 bp, Artificial Sequence
  chemically treated genomic DNA (Homo sapiens) CpG-island No: 23640
ccaatcccaaaccgctcctaataaaacgaacgcgaacgcaaaaccgcgaaacctactacgttactcgactacaaaaaaaaaactaaaccccgcccccgacttcccgcgctccgcgtccattaactaacctcgaaaataaacgaatcccgccgcacgaaatcctacgccttaaaactcaaacgacgacgtacaaaacgtataaaacgcgtaaaaaaccgcgcgcgccgtctacgataccccgaaacgacgttcctaccgaaaataccaccccgacgacaccaaactaccgcgcaaaacccgaattccgcgactaccgaaacaccgcaaattttaaactcgctaaaacgataaactctacctttaccctatataccgcgctctcgcccgtactctaaaacaattaacaataaataaacaaaaaaaaacgaaccgacaaaacgtcgcacgttaacgtccccgcgtcgcgaaaataaaattcgaattccccccgtaaatatcattccccaaactaccgatctttaacgctaaattacataaactaatataccaatcgatcaacgaataacgacaaaacgcctaaccgaaccgacgttttccgaaacactcgtttcgacctcgcaataacaacgcctcctacgaacctaaaccgactcaataaacgcgccgcgctatacacgcgaatctaaaaaaacgacgattcttaaataatccctcacactacaaaatatctaaaaacgataaattaaaaaaacacaacgtaacttctatatcgataaaatcgcttaaaccaa

SEQ ID NO: 23641 - DNA, 566 bp, Artificial Sequence
  chemically treated genomic DNA (Homo sapiens) CpG-island No: 23641
ttcgggtcgattattgtatttgtgtcgtagcggtttcgtataaaatggcggcgggtagacggcgggggcgggaggaggttgggggattttcgggatgggaagggaagttgtgttgtgttgttttgtttcgtcgtttatttatttcgttattcgggagggttcgttcgggtattcgtgaaggattttgtttcgagaagagttgtttgacgtcgttgtattgggtcgaggatcgtgaagagttttttggcgaggtcgaggcggttttttttttagtagcgttcggtttgtcgaggttgcgttgggtttgatagtcgaggaagcggtggtgagggaatgtcgagtagggaggaagcgttttcgtcgggttcgaagaggcggtggagtttgagtcgagttttttgattagcgatattgtgtaagaagcgtggagagaagagcgtgtttgtgtttggggttggggagggggtgtcgggatgaaggagggaatgttaggatttagcggttttttcgggttggtgttttgtgttgcgtagtgtaggtatgaaattaaagaaaatattattttt

SEQ ID NO: 23642 - DNA, 566 bp, Artificial Sequence
  chemically treated genomic DNA (Homo sapiens) CpG-island No: 23642
aaaaataatattttctttaatttcatacctacactacgcaacacaaaacaccaacccgaaaaaaccgctaaatcctaacattccctccttcatcccgacaccccctccccaaccccaaacacaaacacgctcttctctccacgcttcttacacaatatcgctaatcaaaaaactcgactcaaactccaccgcctcttcgaacccgacgaaaacgcttcctccctactcgacattccctcaccaccgcttcctcgactatcaaacccaacgcaacctcgacaaaccgaacgctactaaaaaaaaaaccgcctcgacctcgccaaaaaactcttcacgatcctcgacccaatacaacgacgtcaaacaactcttctcgaaacaaaatccttcacgaatacccgaacgaaccctcccgaataacgaaataaataaacgacgaaacaaaacaacacaacacaacttcccttcccatcccgaaaatcccccaacctcctcccgcccccgccgtctacccgccgccattttatacgaaaccgctacgacacaaatacaataatcgacccgaa

SEQ ID NO: 23643 - DNA, 566 bp, Artificial Sequence
  chemically treated genomic DNA (Homo sapiens) CpG-island No: 23643
agaggtgatattttttttggttttatatttgtattacgtagtatagaatattagttcggaaaagtcgttggattttaatatttttttttttatttcgatattttttttttaattttaaatataaatacgtttttttttttacgttttttgtataatgtcgttggttagagggttcggtttaaattttatcgttttttcgggttcgacgggaacgttttttttttgttcggtatttttttattatcgttttttcggttgttaggtttagcgtagtttcggtaggtcgggcgttgttggggaaggggtcgtttcggtttcgttaaagggttttttacgattttcggtttagtgtaacggcgttaggtagtttttttcgaggtagggttttttacgagtattcggacgggttttttcgggtagcgaagtgaataaacgacggagtagggtagtatagtatagtttttttttttatttcgggggttttttaattttttttcgttttcgtcgtttgttcgtcgttattttgtgcggagtcgttgcgatatagatataatagtcggttcgga

SEQ ID NO: 23644 - DNA, 566 bp, Artificial Sequence
  chemically treated genomic DNA (Homo sapiens) CpG-island No: 23644
tccgaaccgactattatatctatatcgcaacgactccgcacaaaataacgacgaacaaacgacgaaaacgaaaaaaaattaaaaaacccccgaaataaaaaaaaaaactatactatactaccctactccgtcgtttattcacttcgctacccgaaaaaacccgtccgaatactcgtaaaaaaccctacctcgaaaaaaactacctaacgccgttacactaaaccgaaaatcgtaaaaaaccctttaacgaaaccgaaacgaccccttccccaacaacgcccgacctaccgaaactacgctaaacctaacaaccgaaaaaacgataataaaaaaataccgaacaaaaaaaaaacgttcccgtcgaacccgaaaaaacgataaaatttaaaccgaaccctctaaccaacgacattatacaaaaaacgtaaaaaaaaaaacgtatttatatttaaaattaaaaaaaaaatatcgaaataaaaaaaaaaatattaaaatccaacgacttttccgaactaatattctatactacgtaatacaaatataaaaccaaaaaaaatatcacctct

SEQ ID NO: 23645 - DNA, 538 bp, Artificial Sequence
  chemically treated genomic DNA (Homo sapiens) CpG-island No: 23645
gtttcgcgcggtttttgtttcgtgtttaggcggaggcggggtggttattgtttttttttttcgtttcgtttttcggcggttttttcgcggttttttgcgtcgcgttttttttaggaggcgttttgatttcgtatttcggttttttatttttcgatcgttagttttagggtcgcgcggcgacgcgcgattttttttttttgaggggcgcgggtttcggacgcgtcgggttttgttaggtatttagtggagggtcggaggtcggcgattagttcgagtttagtcgtttcgggagtggcgcgagtgtcgttacgattttttttgttttttgcgttcgcgttgttcgttcgggcggtcgttttagtttttttatatagttttttaaaaatagttcgtttcgtatcgttttgtaaggtagtagggagattcgtagcgtgttaattcgcgttcgtcgttaggttaagttcgttttaggttttgtttcgggttttttattggtttttagtgattttatgagttttttgtttattttatatggtta

SEQ ID NO: 23646 - DNA, 538 bp, Artificial Sequence
  chemically treated genomic DNA (Homo sapiens) CpG-island No: 23646
taaccatataaaataaacaaaaaactcataaaatcactaaaaaccaataaaaaacccgaaacaaaacctaaaacgaacttaacctaacgacgaacgcgaattaacacgctacgaatctccctactaccttacaaaacgatacgaaacgaactatttttaaaaaactatataaaaaaactaaaacgaccgcccgaacgaacaacgcgaacgcaaaaaacaaaaaaaatcgtaacgacactcgcgccactcccgaaacgactaaactcgaactaatcgccgacctccgaccctccactaaatacctaacaaaacccgacgcgtccgaaacccgcgcccctcaaaaaaaaaaaatcgcgcgtcgccgcgcgaccctaaaactaacgatcgaaaaataaaaaaccgaaatacgaaatcaaaacgcctcctaaaaaaaacgcgacgcaaaaaaccgcgaaaaaaccgccgaaaaacgaaacgaaaaaaaaaaacaataaccaccccgcctccgcctaaacacgaaacaaaaaccgcgcgaaac

SEQ ID NO: 23647 - DNA, 538 bp, Artificial Sequence
  chemically treated genomic DNA (Homo sapiens) CpG-island No: 23647
tgattatgtaaggtaaatagggggtttatgaagttattgaggattaatggggagttcggagtagagtttggggcgggtttggtttggcggcgggcgcggattggtacgttgcggatttttttgttgttttataaggcggtgcgaggcgagttatttttagagggttatataagggggttgaggcggtcgttcgggcgggtagcgcgagcgtaagggatagggagggtcgtggcgatattcgcgttattttcgggacggttgggttcgggttggtcgtcgattttcgattttttattagatgtttggtagagttcggcgcgttcggagttcgcgttttttagagggaaggggtcgcgcgtcgtcgcgcggttttgaggttgacggtcgggaggtgaaaggtcggagtgcggggttaggacgttttttggagggggcgcggcgtagggggtcgcggggaagtcgtcgaggggcggagcgggaaggaaggatagtggttatttcgttttcgtttgggtacggggtagggatcgcgcgaggt

SEQ ID NO: 23648 - DNA, 538 bp, Artificial Sequence
  chemically treated genomic DNA (Homo sapiens) CpG-island No: 23648
acctcgcgcgatccctaccccgtacccaaacgaaaacgaaataaccactatccttccttcccgctccgcccctcgacgacttccccgcgaccccctacgccgcgccccctccaaaaaacgtcctaaccccgcactccgacctttcacctcccgaccgtcaacctcaaaaccgcgcgacgacgcgcgaccccttccctctaaaaaacgcgaactccgaacgcgccgaactctaccaaacatctaataaaaaatcgaaaatcgacgaccaacccgaacccaaccgtcccgaaaataacgcgaatatcgccacgaccctccctatcccttacgctcgcgctacccgcccgaacgaccgcctcaacccccttatataaccctctaaaaataactcgcctcgcaccgccttataaaacaacaaaaaaatccgcaacgtaccaatccgcgcccgccgccaaaccaaacccgccccaaactctactccgaactccccattaatcctcaataacttcataaaccccctatttaccttacataatca

SEQ ID NO: 23649 - DNA, 535 bp, Artificial Sequence
  chemically treated genomic DNA (Homo sapiens) CpG-island No: 23649
  misc_feature (33)..(33): n is either a, c, g or t
  misc_feature (49)..(49): n is either a, c, g or t
  misc_feature (54)..(54): n is either a, c, g or t
  misc_feature (56)..(56): n is either a, c, g or t
  misc_feature (69)..(69): n is either a, c, g or t
  misc_feature (87)..(87): n is either a, c, g or t
tttcggttcggtttggtttcgtcggttttattntggcggcgcgttgttncgttntnttagttattttgntttcggttaggagtcganttcggatgtttgtagttttttttcgttttttatttttgtatttatttttttttttttcggttttattaaaggtttcgagttttttgaagataagtgagcgtcggtcggttaaaagaatcgataatcgcgagttaaagttattatagcgaagacggtcggtatgtcggtgcggggcgcgtacgtagtaataagataaaaaatcgtcgcgtcgcgtacgcgcgattcgggcgacgattattgttaggtgcggggttcgcggcgcgatgcgttaaacggtcgttaagcgttaggatcgtttacggtcgtttaaacgtcgggcgtcgttgattgttatcgattgtgcgggtcgttaagtttgggttgtgtttagatatgtgttttcgcgatagttttttgtcgtcgagttattatttgttatttttgtgggtggtatttgattttaatttaa

SEQ ID NO: 23650 - DNA, 535 bp, Artificial Sequence
  chemically treated genomic DNA (Homo sapiens) CpG-island No: 23650
  misc_feature (449)..(449): n is either a, c, g or t
  misc_feature (467)..(467): n is either a, c, g or t
  misc_feature (480)..(480): n is either a, c, g or t
  misc_feature (482)..(482): n is either a, c, g or t
  misc_feature (487)..(487): n is either a, c, g or t
  misc_feature (503)..(503): n is either a, c, g or t
ttaaattaaaatcaaataccacccacaaaaataacaaataataactcgacgacaaaaaactatcgcgaaaacacatatctaaacacaacccaaacttaacgacccgcacaatcgataacaatcaacgacgcccgacgtttaaacgaccgtaaacgatcctaacgcttaacgaccgtttaacgcatcgcgccgcgaaccccgcacctaacaataatcgtcgcccgaatcgcgcgtacgcgacgcgacgattttttatcttattactacgtacgcgccccgcaccgacataccgaccgtcttcgctataataactttaactcgcgattatcgattcttttaaccgaccgacgctcacttatcttcaaaaaactcgaaacctttaataaaaccgaaaaaaaaaaaaataaatacaaaaataaaaaacgaaaaaaaactacaaacatccgaantcgactcctaaccgaaancaaaataactaananaacgnaacaacgcgccgccanaataaaaccgacgaaaccaaaccgaaccgaaa

SEQ ID NO: 23651 - DNA, 535 bp, Artificial Sequence
  chemically treated genomic DNA (Homo sapiens) CpG-island No: 23651
  misc_feature (449)..(449): n is either a, c, g or t
  misc_feature (467)..(467): n is either a, c, g or t
  misc_feature (480)..(480): n is either a, c, g or t
  misc_feature (482)..(482): n is either a, c, g or t
  misc_feature (487)..(487): n is either a, c, g or t
  misc_feature (503)..(503): n is either a, c, g or t
ttgggttagggttagatattatttataaagatgataggtggtaattcggcgataggagattgtcgcggaaatatatgtttgagtataatttaaatttgacggttcgtataatcgatggtagttagcggcgttcgacgtttgggcggtcgtgagcggttttagcgtttggcggtcgtttggcgtatcgcgtcgcgggtttcgtatttgatagtggtcgtcgttcgggtcgcgcgtgcgcggcgcggcggttttttattttgttgttgcgtgcgcgtttcgtatcgatatgtcgatcgttttcgttgtggtgattttaattcgcggttgtcggtttttttagtcggtcggcgtttatttgtttttaggaagttcggagtttttggtggagtcggggagaggaagggtgggtgtaagagtgaaaggcgagaggggattgtaagtattcgggntcggtttttggtcggagntaagatggttgangnggcgnagtagcgcgtcgttanggtaaggtcggcggggttaggtcgggtcgggg

SEQ ID NO: 23652 - DNA, 535 bp, Artificial Sequence
  chemically treated genomic DNA (Homo sapiens) CpG-island No: 23652
  misc_feature (33)..(33): n is either a, c, g or t
  misc_feature (49)..(49): n is either a, c, g or t
  misc_feature (54)..(54): n is either a, c, g or t
  misc_feature (56)..(56): n is either a, c, g or t
  misc_feature (69)..(69): n is either a, c, g or t
  misc_feature (87)..(87): n is either a, c, g or t
ccccgacccgacctaaccccgccgaccttaccntaacgacgcgctactncgccncntcaaccatcttanctccgaccaaaaaccgancccgaatacttacaatcccctctcgcctttcactcttacacccacccttcctctccccgactccaccaaaaactccgaacttcctaaaaacaaataaacgccgaccgactaaaaaaaccgacaaccgcgaattaaaatcaccacaacgaaaacgatcgacatatcgatacgaaacgcgcacgcaacaacaaaataaaaaaccgccgcgccgcgcacgcgcgacccgaacgacgaccactatcaaatacgaaacccgcgacgcgatacgccaaacgaccgccaaacgctaaaaccgctcacgaccgcccaaacgtcgaacgccgctaactaccatcgattatacgaaccgtcaaatttaaattatactcaaacatatatttccgcgacaatctcctatcgccgaattaccacctatcatctttataaataatatctaaccctaacccaa

SEQ ID NO: 23653 - DNA, 623 bp, Artificial Sequence
  chemically treated genomic DNA (Homo sapiens) CpG-island No: 23653
  misc_feature (45)..(45): n is either a, c, g or t
  misc_feature (146)..(146): n is either a, c, g or t
  misc_feature (168)..(168): n is either a, c, g or t
  misc_feature (181)..(181): n is either a, c, g or t
  misc_feature (185)..(185): n is either a, c, g or t
  misc_feature (326)..(326): n is either a, c, g or t
tcgtggtttcgttttcgattcgtagttagtttattgcgattcgtntattcggcgacgtttcgttttttcgttttcgttttttttgtttttttttaaggagatttcgttttatcgatgtttcgttttcgttttatagttaatttttngggtatcgttgttcgttcgggnttcgttatcgttntagntttcgtttcgcgagttttttttttcgggtgtttgttcgtagttcgttcggtttagagggtgggcgcggggttgtttttatcggttggcggttgtaatttagcgattttggttcgaaggttttagtaaggatttatcgattnttagttcggcggcgcggattttgttcggtgtgtggggcggagcggattgcgtgttcgcggacgggtagcgaagatgttagttttcgttgttaggatcgtggtgagtgcggcggaataatcgtttgagggttttggacggtttgggcgggtcgtgcggttgcgttcgggaacggagtaaaatcgtttgcggtcgttgttcgattcggtttttagttgatggggtggggttaggcgggcgttttaggtttggtagagtaggagattggggcgtaaggttagaagcgggattaaatttat

SEQ ID NO: 23654 - DNA, 623 bp, Artificial Sequence
  chemically treated genomic DNA (Homo sapiens) CpG-island No: 23654
  misc_feature (298)..(298): n is either a, c, g or t
  misc_feature (439)..(439): n is either a, c, g or t
  misc_feature (443)..(443): n is either a, c, g or t
  misc_feature (456)..(456): n is either a, c, g or t
  misc_feature (478)..(478): n is either a, c, g or t
  misc_feature (579)..(579): n is either a, c, g or t
ataaatttaatcccgcttctaaccttacgccccaatctcctactctaccaaacctaaaacgcccgcctaaccccaccccatcaactaaaaaccgaatcgaacaacgaccgcaaacgattttactccgttcccgaacgcaaccgcacgacccgcccaaaccgtccaaaaccctcaaacgattattccgccgcactcaccacgatcctaacaacgaaaactaacatcttcgctacccgtccgcgaacacgcaatccgctccgccccacacaccgaacaaaatccgcgccgccgaactaanaatcgataaatccttactaaaaccttcgaaccaaaatcgctaaattacaaccgccaaccgataaaaacaaccccgcgcccaccctctaaaccgaacgaactacgaacaaacacccgaaaaaaaaaactcgcgaaacgaaanctanaacgataacgaancccgaacgaacaacgatacccnaaaaattaactataaaacgaaaacgaaacatcgataaaacgaaatctccttaaaaaaaaacaaaaaaaacgaaaacgaaaaaacgaaacgtcgccgaatanacgaatcgcaataaactaactacgaatcgaaaacgaaaccacga

SEQ ID NO: 23655 - DNA, 623 bp, Artificial Sequence
  chemically treated genomic DNA (Homo sapiens) CpG-island No: 23655
  misc_feature (298)..(298): n is either a, c, g or t
  misc_feature (439)..(439): n is either a, c, g or t
  misc_feature (443)..(443): n is either a, c, g or t
  misc_feature (456)..(456): n is either a, c, g or t
  misc_feature (478)..(478): n is either a, c, g or t
  misc_feature (579)..(579): n is either a, c, g or t
gtgggtttaatttcgtttttgattttgcgttttaattttttgttttgttaaatttgggacgttcgtttgattttattttattagttggaggtcgggtcgaatagcggtcgtaggcggttttgtttcgttttcggacgtaatcgtacggttcgtttaggtcgtttagggtttttaggcgattgtttcgtcgtatttattacggttttggtagcgaaggttaatattttcgttgttcgttcgcggatacgtagttcgtttcgttttatatatcgggtaaagttcgcgtcgtcgggttggnggtcggtgggtttttgttagagttttcgggttaaggtcgttgagttatagtcgttagtcggtagaggtagtttcgcgtttattttttgggtcgagcgggttgcgggtaggtattcggggaggaggattcgcgaggcggggnttgnggcggtagcgggnttcgggcgggtaacggtgtttnggaggttggttgtggggcgggggcggggtatcgatggggcggagtttttttgaggagggataggaggggcggggacggaggggcggggcgtcgtcgggtangcgggtcgtagtaggttggttgcgagtcgggggcgggattacgg

SEQ ID NO: 23656 - DNA, 623 bp, Artificial Sequence
  chemically treated genomic DNA (Homo sapiens) CpG-island No: 23656
  misc_feature (45)..(45): n is either a, c, g or t
  misc_feature (146)..(146): n is either a, c, g or t
  misc_feature (168)..(168): n is either a, c, g or t
  misc_feature (181)..(181): n is either a, c, g or t
  misc_feature (185)..(185): n is either a, c, g or t
  misc_feature (326)..(326): n is either a, c, g or t
ccgtaatcccgcccccgactcgcaaccaacctactacgacccgcntacccgacgacgccccgcccctccgtccccgcccctcctatccctcctcaaaaaaactccgccccatcgataccccgcccccgccccacaaccaacctccnaaacaccgttacccgcccgaancccgctaccgccncaanccccgcctcgcgaatcctcctccccgaatacctacccgcaacccgctcgacccaaaaaataaacgcgaaactacctctaccgactaacgactataactcaacgaccttaacccgaaaactctaacaaaaacccaccgaccnccaacccgacgacgcgaactttacccgatatataaaacgaaacgaactacgtatccgcgaacgaacaacgaaaatattaaccttcgctaccaaaaccgtaataaatacgacgaaacaatcgcctaaaaaccctaaacgacctaaacgaaccgtacgattacgtccgaaaacgaaacaaaaccgcctacgaccgctattcgacccgacctccaactaataaaataaaatcaaacgaacgtcccaaatttaacaaaacaaaaaattaaaacgcaaaatcaaaaacgaaattaaacccac

SEQ ID NO: 23657 - DNA, 588 bp, Artificial Sequence
  chemically treated genomic DNA (Homo sapiens) CpG-island No: 23657
  misc_feature (56)..(56): n is either a, c, g or t
  misc_feature (228)..(228): n is either a, c, g or t
  misc_feature (245)..(245): n is either a, c, g or t
  misc_feature (305)..(306): n is either a, c, g or t
  misc_feature (376)..(376): n is either a, c, g or t
  misc_feature (395)..(395): n is either a, c, g or t
  misc_feature (416)..(416): n is either a, c, g or t
ggcggggacgagggtagtagttcgggagggttttttcgcgtttttaggcgtttgtngtagggtgtttttcgatcgtcgtatattcgggttttcgcgtacggcgagacgttagattttatttgtatcgttcgggtgaagaagatgttcgcgttcgacgttagtttttttatgttgaagtttatggcgtgttcgtacggtcgtcgcgtacggttcgagcgtagtcggtangttttcggtttagtcgntcgtcgataatcgtatttcgtttatttgttgcggggtattagtttttcgcgtatttcgtnngtcggtttgttcgtttgttcgttcgtcgtagtcgtcgagttagttcgagcgcgtagggcggggcgcgaangttcgggggcgaagtaagnaggggcgggggcgaaattgtncgtattcgacgcgggacgagacggtattggggcgaatttaaaggcgcgcggatcgggttggtttttcgaattcgggcggattaggaggaattagaattatatatataggggcggagcgagagtatagtggggcggagttatatgggtgggggagagattttgttcggttaga

SEQ ID NO: 23658 - DNA, 588 bp, Artificial Sequence
  chemically treated genomic DNA (Homo sapiens) CpG-island No: 23658
  misc_feature (173)..(173): n is either a, c, g or t
  misc_feature (194)..(194): n is either a, c, g or t
  misc_feature (213)..(213): n is either a, c, g or t
  misc_feature (283)..(284): n is either a, c, g or t
  misc_feature (344)..(344): n is either a, c, g or t
  misc_feature (361)..(361): n is either a, c, g or t
  misc_feature (533)..(533): n is either a, c, g or t
tctaaccgaacaaaatctctcccccacccatataactccgccccactatactctcgctccgcccctatatatataattctaattcctcctaatccgcccgaattcgaaaaaccaacccgatccgcgcgcctttaaattcgccccaataccgtctcgtcccgcgtcgaatacgnacaatttcgcccccgcccctncttacttcgcccccgaacnttcgcgccccgccctacgcgctcgaactaactcgacgactacgacgaacgaacaaacgaacaaaccgacnnacgaaatacgcgaaaaactaataccccgcaacaaataaacgaaatacgattatcgacgancgactaaaccgaaaacntaccgactacgctcgaaccgtacgcgacgaccgtacgaacacgccataaacttcaacataaaaaaactaacgtcgaacgcgaacatcttcttcacccgaacgatacaaataaaatctaacgtctcgccgtacgcgaaaacccgaatatacgacgatcgaaaaacaccctacnacaaacgcctaaaaacgcgaaaaaaccctcccgaactactaccctcgtccccgcc

SEQ ID NO: 23659 - DNA, 588 bp, Artificial Sequence
  chemically treated genomic DNA (Homo sapiens) CpG-island No: 23659
  misc_feature (173)..(173): n is either a, c, g or t
  misc_feature (194)..(194): n is either a, c, g or t
  misc_feature (213)..(213): n is either a, c, g or t
  misc_feature (283)..(284): n is either a, c, g or t
  misc_feature (344)..(344): n is either a, c, g or t
  misc_feature (361)..(361): n is either a, c, g or t
  misc_feature (533)..(533): n is either a, c, g or t
tttggtcgggtaaggttttttttttatttatgtagtttcgttttattgtgttttcgtttcgtttttgtgtatgtagttttggttttttttaattcgttcgggttcgggaaattagttcggttcgcgcgtttttgagttcgttttagtgtcgtttcgtttcgcgtcggatgcgngtagtttcgttttcgtttttntttgtttcgttttcgggtnttcgcgtttcgttttgcgcgttcgggttggttcggcggttgcggcgggcgggtaggcgggtaggtcggtnnacgaggtgcgcggagggttggtgtttcgtagtaggtgggcggggtgcggttgtcggcggncggttgggtcgggggtntgtcggttgcgttcgggtcgtgcgcggcggtcgtgcgggtacgttatggattttaatatgaagaagttggcgtcggacgcgggtattttttttattcgggcggtgtaggtgaggtttggcgtttcgtcgtgcgcgggggttcggatgtgcggcggtcggggagtattttgtngtagacgtttggggacgcgggaaagttttttcgggttgttgttttcgttttcgtt

SEQ ID NO: 23660 - DNA, 588 bp, Artificial Sequence
  chemically treated genomic DNA (Homo sapiens) CpG-island No: 23660
  misc_feature (56)..(56): n is either a, c, g or t
  misc_feature (228)..(228): n is either a, c, g or t
  misc_feature (245)..(245): n is either a, c, g or t
  misc_feature (305)..(306): n is either a, c, g or t
  misc_feature (376)..(376): n is either a, c, g or t
  misc_feature (395)..(395): n is either a, c, g or t
  misc_feature (416)..(416): n is either a, c, g or t
aacgaaaacgaaaacaacaacccgaaaaaactttcccgcgtccccaaacgtctacnacaaaatactccccgaccgccgcacatccgaacccccgcgcacgacgaaacgccaaacctcacctacaccgcccgaataaaaaaaatacccgcgtccgacgccaacttcttcatattaaaatccataacgtacccgcacgaccgccgcgcacgacccgaacgcaaccgacanacccccgacccaaccgnccgccgacaaccgcaccccgcccacctactacgaaacaccaaccctccgcgcacctcgtnnaccgacctacccgcctacccgcccgccgcaaccgccgaaccaacccgaacgcgcaaaacgaaacgcgaanacccgaaaacgaaacaaanaaaaacgaaaacgaaactacncgcatccgacgcgaaacgaaacgacactaaaacgaactcaaaaacgcgcgaaccgaactaatttcccgaacccgaacgaattaaaaaaaaccaaaactacatacacaaaaacgaaacgaaaacacaataaaacgaaactacataaataaaaaaaaaaccttacccgaccaaa

SEQ ID NO: 23661 - DNA, 528 bp, Artificial Sequence
  chemically treated genomic DNA (Homo sapiens) CpG-island No: 23661
acgattcgacgtatttacgttttatattttataacgcgtttttttaggtcgttttttttcgttttttttttattttttttaaatttttattaatttttttatttttttttatttatttttatattataatttaaattagtaacgtatagtataattatcgatcgatcgtaatttattatacgacgtaatttatcgcgtatttgtattcgtattgttttatttattcgttttcgtattttattttatgtcgatttttcggtacgttatagcgtatcgcgaataggtagatatcggtttcgtttatcggaaggataggtttagtagtacggttatacgtatggatacgttatattttcgtgattgttaagtgtaacgtattcgttttttttcgaaagacgaagcgttggttcggttcgtcgtatgttacgtttagttatcgttaggaagttacggttatttacgtaattgattgttattatcgtttgcgatcgtacgtagtacgtatatttcgtatttttgtattatcga

SEQ ID NO: 23662 - DNA, 528 bp, Artificial Sequence
  chemically treated genomic DNA (Homo sapiens) CpG-island No: 23662
tcgataatacaaaaatacgaaatatacgtactacgtacgatcgcaaacgataataacaatcaattacgtaaataaccgtaacttcctaacgataactaaacgtaacatacgacgaaccgaaccaacgcttcgtctttcgaaaaaaaacgaatacgttacacttaacaatcacgaaaatataacgtatccatacgtataaccgtactactaaacctatccttccgataaacgaaaccgatatctacctattcgcgatacgctataacgtaccgaaaaatcgacataaaataaaatacgaaaacgaataaataaaacaatacgaatacaaatacgcgataaattacgtcgtataataaattacgatcgatcgataattatactatacgttactaatttaaattataatataaaaataaataaaaaaaaataaaaaaattaataaaaatttaaaaaaaataaaaaaaaaacgaaaaaaaacgacctaaaaaaacgcgttataaaatataaaacgtaaatacgtcgaatcgt

SEQ ID NO: 23663 - DNA, 528 bp, Artificial Sequence
  chemically treated genomic DNA (Homo sapiens) CpG-island No: 23663
tcgatagtatagaggtacgaagtatacgtgttacgtacggtcgtagacgatggtaatagttaattgcgtggatagtcgtagttttttgacggtagttaggcgtagtatgcgacgagtcgggttaacgtttcgtttttcgagaggaagcgaatgcgttgtatttgatagttacggaagtgtgacgtatttatacgtgtggtcgtattgttagatttgttttttcggtagacggaatcggtgtttgtttgttcgcgatgcgttgtgacgtgtcgagaagtcggtatgaggtgggatacgagagcggatggatagagtagtgcgagtgtaggtacgcgatggattacgtcgtgtagtaggttgcgatcggtcgatggttgtgttgtgcgttgttgatttgggttgtggtatgagagtgggtagaggaaggtggaggagttggtagaggtttagagagggtagggggaggacgaagggaggcgatttgaaagggcgcgttataaggtgtgagacgtgaatgcgtcgggtcgt

SEQ ID NO: 23664 - DNA, 528 bp, Artificial Sequence
  chemically treated genomic DNA (Homo sapiens) CpG-island No: 23664
acgacccgacgcattcacgtctcacaccttataacgcgccctttcaaatcgcctcccttcgtcctccccctaccctctctaaacctctaccaactcctccaccttcctctacccactctcataccacaacccaaatcaacaacgcacaacacaaccatcgaccgatcgcaacctactacacgacgtaatccatcgcgtacctacactcgcactactctatccatccgctctcgtatcccacctcataccgacttctcgacacgtcacaacgcatcgcgaacaaacaaacaccgattccgtctaccgaaaaaacaaatctaacaatacgaccacacgtataaatacgtcacacttccgtaactatcaaatacaacgcattcgcttcctctcgaaaaacgaaacgttaacccgactcgtcgcatactacgcctaactaccgtcaaaaaactacgactatccacgcaattaactattaccatcgtctacgaccgtacgtaacacgtatacttcgtacctctatactatcga

SEQ ID NO: 23665 - DNA, 691 bp, Artificial Sequence
  chemically treated genomic DNA (Homo sapiens) CpG-island No: 23665
  misc_feature (109)..(109): n is either a, c, g or t
  misc_feature (393)..(393): n is either a, c, g or t
gttcgacgttcggtatacgcgagtacgtttacgttagatcgcgaaataaaatcgttttaatttttatcgcgagtgtttatgtcgatacgttaaatttttttttatttantatttattttattaagtttgatttatttcgcgttattttgtttatcgtttgcgtttacgcggatacggtatagattgattcgtattatcgtatatatcgtttcgtagatttatagtttatatatttgacgtttttcgttattcggttcgcgtattcgcgtatatttattatatcgacgcgttaatttttattaatatcgatttattttgattttattaatttatttatatagtatatttatttatacgagtatttgttatttcgttattttatcgatatagttncgtcggtattcgatcgattttgtaatttttttaatttacgatttattcgtttgtcgtaaagtaatattcgttcgttaacgtttacgtatatttagattcgtatcgttttcgtaattttaaagcgttttattgatttatatttattcggtttacgcgtttcgtagtttattagattattttttaaacgtaatttttatatatcgttttagtacgttttttatttacgagggtacgatatttttacgttgttaatatttatttgtattattaacgtataaagttttttattacgtatttt

SEQ ID NO: 23666 - DNA, 691 bp, Artificial Sequence
  chemically treated genomic DNA (Homo sapiens) CpG-island No: 23666
  misc_feature (299)..(299): n is either a, c, g or t
  misc_feature (583)..(583): n is either a, c, g or t
aaaatacgtaataaaaaactttatacgttaataatacaaataaatattaacaacgtaaaaatatcgtaccctcgtaaataaaaaacgtactaaaacgatatataaaaattacgtttaaaaaataatctaataaactacgaaacgcgtaaaccgaataaatataaatcaataaaacgctttaaaattacgaaaacgatacgaatctaaatatacgtaaacgttaacgaacgaatattactttacgacaaacgaataaatcgtaaattaaaaaaattacaaaatcgatcgaataccgacgnaactatatcgataaaataacgaaataacaaatactcgtataaataaatatactatataaataaattaataaaatcaaaataaatcgatattaataaaaattaacgcgtcgatataataaatatacgcgaatacgcgaaccgaataacgaaaaacgtcaaatatataaactataaatctacgaaacgatatatacgataatacgaatcaatctataccgtatccgcgtaaacgcaaacgataaacaaaataacgcgaaataaatcaaacttaataaaataaatantaaataaaaaaaaatttaacgtatcgacataaacactcgcgataaaaattaaaacgattttatttcgcgatctaacgtaaacgtactcgcgtataccgaacgtcgaac

SEQ ID NO: 23667 - DNA, 691 bp, Artificial Sequence
  chemically treated genomic DNA (Homo sapiens) CpG-island No: 23667
  misc_feature (299)..(299): n is either a, c, g or t
  misc_feature (583)..(583): n is either a, c, g or t
ggggtgcgtagtgaggggttttgtgcgttggtagtgtaaatgggtattaatagcgtgggggtgtcgtgttttcgtgagtggagggcgtgttggaacgatgtgtgggggttacgtttgggaggtggtttagtgaattgcggagcgcgtgggtcgggtgggtgtggattagtggagcgttttggagttgcggaggcggtgcgggtttgggtatacgtgagcgttagcgagcgagtgttgttttgcggtaagcgggtaggtcgtgggttaggagagttgtaggatcggtcgagtatcggcgnggttgtgtcggtggggtgacgaagtagtaagtgttcgtgtgggtgagtatgttatgtagatgggttggtagggttagagtaggtcgatattggtgggggttaacgcgtcgatgtagtgagtgtgcgcgagtgcgcgagtcgggtggcggagagcgttaggtgtgtaggttgtgagtttgcggggcggtatgtacgatagtgcgggttagtttgtatcgtgttcgcgtgggcgtaggcgatgagtagagtgacgcggggtgagttaggtttggtggggtgaatgntaggtggaaaggggtttggcgtgtcggtatgggtattcgcggtgagggttggggcggttttgtttcgcgatttagcgtgagcgtgttcgcgtgtgtcgggcgtcggat

SEQ ID NO: 23668 - DNA, 691 bp, Artificial Sequence
  chemically treated genomic DNA (Homo sapiens) CpG-island No: 23668
  misc_feature (109)..(109): n is either a, c, g or t
  misc_feature (393)..(393): n is either a, c, g or t
atccgacgcccgacacacgcgaacacgctcacgctaaatcgcgaaacaaaaccgccccaaccctcaccgcgaatacccataccgacacgccaaacccctttccacctancattcaccccaccaaacctaactcaccccgcgtcactctactcatcgcctacgcccacgcgaacacgatacaaactaacccgcactatcgtacataccgccccgcaaactcacaacctacacacctaacgctctccgccacccgactcgcgcactcgcgcacactcactacatcgacgcgttaacccccaccaatatcgacctactctaaccctaccaacccatctacataacatactcacccacacgaacacttactacttcgtcaccccaccgacacaaccncgccgatactcgaccgatcctacaactctcctaacccacgacctacccgcttaccgcaaaacaacactcgctcgctaacgctcacgtatacccaaacccgcaccgcctccgcaactccaaaacgctccactaatccacacccacccgacccacgcgctccgcaattcactaaaccacctcccaaacgtaacccccacacatcgttccaacacgccctccactcacgaaaacacgacacccccacgctattaatacccatttacactaccaacgcacaaaacccctcactacgcacccc

SEQ ID NO: 23669 - DNA, 818 bp, Artificial Sequence
  chemically treated genomic DNA (Homo sapiens) CpG-island No: 23669
tatacgaggttttcggaacggaacgattttttttattatttgggttttatgttatatttgggagtttcggtattagattaatatgcgaagtttgcgttcgatttttgggtaacggttacgttattttttcgttatttatcgcgaaatatacggcgtatattggtttcggatatatattattattttcgtgtttttaagttaagtttagagatatattatttttacggttaaagaataggcgtattttaacgttttgacgtatttgataagagttattcgtgatttgacgcggtaagcgagaatattacgttgtttggtaaaagtattcgttttcgtttatcgtattttttgaatatgaatcgtatatggtattatagtagcggtattatatattttgtacggtatatattattttatttcgttttagcgttcggcgaattttttagcgcgcgcgtataatgtttaacgcgtcggtgaatagtttttagttaaagtttcgtgtttacgttatacgtgattgatgtatgtagtaggcgttaggcgtttagtttattgtaatatttacgtatatgaggtgttgcgtaatgtattgggttaatgcgttcggattagtcgtaacgtaaaggtgtaatgttaaggtttacggcgtacgagttatcggtaaggtattcgttttttttcgagttacgtattagcggtggcgtaagcgtgacgtttatttttatgtttttcgtattattatagcgtttcgtggtcgttgagcgttatgttgtagttttaacgttaatcggaattgtatagtattcgtgttatattcg

SEQ ID NO: 23670 - DNA, 818 bp, Artificial Sequence
  chemically treated genomic DNA (Homo sapiens) CpG-island No: 23670
cgaatataacacgaatactatacaattccgattaacgttaaaactacaacataacgctcaacgaccacgaaacgctataataatacgaaaaacataaaaataaacgtcacgcttacgccaccgctaatacgtaactcgaaaaaaaacgaataccttaccgataactcgtacgccgtaaaccttaacattacacctttacgttacgactaatccgaacgcattaacccaatacattacgcaacacctcatatacgtaaatattacaataaactaaacgcctaacgcctactacatacatcaatcacgtataacgtaaacacgaaactttaactaaaaactattcaccgacgcgttaaacattatacgcgcgcgctaaaaaattcgccgaacgctaaaacgaaataaaataatatataccgtacaaaatatataataccgctactataataccatatacgattcatattcaaaaaatacgataaacgaaaacgaatacttttaccaaacaacgtaatattctcgcttaccgcgtcaaatcacgaataactcttatcaaatacgtcaaaacgttaaaatacgcctattctttaaccgtaaaaataatatatctctaaacttaacttaaaaacacgaaaataataatatatatccgaaaccaatatacgccgtatatttcgcgataaataacgaaaaaataacgtaaccgttacccaaaaatcgaacgcaaacttcgcatattaatctaataccgaaactcccaaatataacataaaacccaaataataaaaaaaatcgttccgttccgaaaacctcgtata

SEQ ID NO: 23671 - DNA, 818 bp, Artificial Sequence
  chemically treated genomic DNA (Homo sapiens) CpG-island No: 23671
cgggtgtggtacgagtgttatgtagtttcgattggcgttgaggttgtagtatagcgtttagcgattacggagcgttgtggtagtgcgagaggtatgggagtgggcgttacgtttacgttatcgttagtacgtaattcgagggggagcgagtgttttatcgatagttcgtgcgtcgtagattttgatattgtatttttacgttacgattgattcggacgtattggtttagtgtattgcgtagtattttatgtgcgtagatgttgtagtgagttaggcgtttgacgtttattgtatatattagttacgtatggcgtgaatacggagttttagttggagattgtttatcggcgcgttaggtattgtacgcgcgcgttgaggggttcgtcgaacgttggagcgagatggagtggtgtatgtcgtatagggtatatgatatcgttattgtgatgttatgtgcggtttatgtttaaggagtacggtaggcgggagcgaatatttttattaggtagcgtagtgttttcgtttatcgcgttaggttacgggtagtttttattaggtgcgttaaggcgttgagatgcgtttgttttttggtcgtgaaggtggtatgtttttaggtttagtttgagggtacgagggtagtggtgtgtattcggagttagtgtacgtcgtgtgtttcgcgatgggtggcggaaaaatgacgtgatcgttgtttagaggtcgggcgtaggtttcgtatgttagtttgatatcgaagtttttaggtatggtatggagtttaggtgatggggaagatcgtttcgtttcgaaggtttcgtata

SEQ ID NO: 23672 - DNA, 818 bp, Artificial Sequence
  chemically treated genomic DNA (Homo sapiens) CpG-island No: 23672
tatacgaaaccttcgaaacgaaacgatcttccccatcacctaaactccataccatacctaaaaacttcgatatcaaactaacatacgaaacctacgcccgacctctaaacaacgatcacgtcatttttccgccacccatcgcgaaacacacgacgtacactaactccgaatacacaccactaccctcgtaccctcaaactaaacctaaaaacataccaccttcacgaccaaaaaacaaacgcatctcaacgccttaacgcacctaataaaaactacccgtaacctaacgcgataaacgaaaacactacgctacctaataaaaatattcgctcccgcctaccgtactccttaaacataaaccgcacataacatcacaataacgatatcatataccctatacgacatacaccactccatctcgctccaacgttcgacgaacccctcaacgcgcgcgtacaatacctaacgcgccgataaacaatctccaactaaaactccgtattcacgccatacgtaactaatatatacaataaacgtcaaacgcctaactcactacaacatctacgcacataaaatactacgcaatacactaaaccaatacgtccgaatcaatcgtaacgtaaaaatacaatatcaaaatctacgacgcacgaactatcgataaaacactcgctccccctcgaattacgtactaacgataacgtaaacgtaacgcccactcccatacctctcgcactaccacaacgctccgtaatcgctaaacgctatactacaacctcaacgccaatcgaaactacataacactcgtaccacacccg

SEQ ID NO: 23673 - DNA, 556 bp, Artificial Sequence
  chemically treated genomic DNA (Homo sapiens) CpG-island No: 23673
ttatttcgattttttttttaatttaggcgttataattatatgttttttcgatattaggtttttatttttttatttagttcgtttcgatgtgttttatttttttaaattcgttatttcgttttttttttttttttagtttttttttttattgtgtttcgttttttttttgcgtatttgaagagattttaacggtatcgtttgtttttggttacgtttcgcgttgttgaagttattttttttttttttgcgttcgttttcgttaatttacgcgttatttatcgcgtatttcgtttttatgtcgaacgttttcggatttttgtaattagttatttgtttttgtgtatcgtgatttattaatttggtcgcggttattttcgttatcgtatttattcgatttattgtcggttacgttttttagtaacgtattatagtatattacgttacgttacgtatttgaagtatcggttgttatcgttcgtttcgtatgtattttatcgtaacgaaggacgtttcggtcgtttaggttatttcgattaggttcgtttcggacgtttcg

SEQ ID NO: 23674 - DNA, 556 bp, Artificial Sequence
  chemically treated genomic DNA (Homo sapiens) CpG-island No: 23674
cgaaacgtccgaaacgaacctaatcgaaataacctaaacgaccgaaacgtccttcgttacgataaaatacatacgaaacgaacgataacaaccgatacttcaaatacgtaacgtaacgtaatatactataatacgttactaaaaaacgtaaccgacaataaatcgaataaatacgataacgaaaataaccgcgaccaaattaataaatcacgatacacaaaaacaaataactaattacaaaaatccgaaaacgttcgacataaaaacgaaatacgcgataaataacgcgtaaattaacgaaaacgaacgcaaaaaaaaaaaaaataacttcaacaacgcgaaacgtaaccaaaaacaaacgataccgttaaaatctcttcaaatacgcaaaaaaaaaacgaaacacaataaaaaaaaaaactaaaaaaaaaaaaaaaacgaaataacgaatttaaaaaaataaaacacatcgaaacgaactaaataaaaaaataaaaacctaatatcgaaaaaacatataattataacgcctaaattaaaaaaaaaatcgaaataa

SEQ ID NO: 23675 - DNA, 556 bp, Artificial Sequence
  chemically treated genomic DNA (Homo sapiens) CpG-island No: 23675
cggagcgttcggagcggatttgatcggagtgatttgagcgatcggggcgtttttcgttacggtggagtatatgcggagcgagcggtgataatcggtgttttagatgcgtgacgtggcgtggtatgttataatgcgttgttggagggcgtagtcggtagtaagtcggatagatacggtgacggaggtgatcgcggttagattgataggttacggtgtatagggatagatgattgattgtaggggttcgggggcgttcggtatgagagcgaggtgcgcggtagatgacgcgtaggttggcgaggacgagcgtaaagagaagagaggtgattttagtagcgcggggcgtagttaaaagtaggcggtgtcgttgaggtttttttaggtgcgtaaagggagagcggagtataatgagagagagggttgggggggaggagaagacgaagtagcgggtttggaggagtgggatatatcggggcgggttgagtgggggggtaaaggtttggtatcggaagggtatatagttatagcgtttgggttgggaaagggatcgggatga

SEQ ID NO: 23676 - DNA, 556 bp, Artificial Sequence
  chemically treated genomic DNA (Homo sapiens) CpG-island No: 23676
tcatcccgatccctttcccaacccaaacgctataactatatacccttccgataccaaacctttacccccccactcaacccgccccgatatatcccactcctccaaacccgctacttcgtcttctcctcccccccaaccctctctctcattatactccgctctccctttacgcacctaaaaaaacctcaacgacaccgcctacttttaactacgccccgcgctactaaaatcacctctcttctctttacgctcgtcctcgccaacctacgcgtcatctaccgcgcacctcgctctcataccgaacgcccccgaacccctacaatcaatcatctatccctatacaccgtaacctatcaatctaaccgcgatcacctccgtcaccgtatctatccgacttactaccgactacgccctccaacaacgcattataacataccacgccacgtcacgcatctaaaacaccgattatcaccgctcgctccgcatatactccaccgtaacgaaaaacgccccgatcgctcaaatcactccgatcaaatccgctccgaacgctccg

SEQ ID NO: 23677 - DNA, 918 bp, Artificial Sequence
  chemically treated genomic DNA (Homo sapiens) CpG-island No: 23677
  misc_feature (861)..(861): n is either a, c, g or t
gtttattacgatttttttattttttttcggattggttttttttattaattttttcgttttatttattttatattatatcgttttcgtcgttttagtcgagacgttttcgatattttgcgtttttcgtttcgtattatacgtatattttatcggattagtgtgattttatttttatcgtgtagtacgtatttatcgatattgtacgaggacgcgtattcgtttatttatcgtattgcgtacgcgtataggttggattttcgtgcgaacgttgtatttataacgttttatttttatatttagtattttatttatgttatatttttatatcgttttcgtattgtatataatatcgttttcgatattattgcgtttacgtaatagttttattattatttttttatttattatttttcgtgacgaacgtattattgtattatatgtatattaagttcgattgttatatatattttacgttatattatcggtttgttagttacggatcgtattttttagacgcgtatttatcgtacgtatttatatttattttttcgatcgtatgtaatttagtattttatattacgaatgattttttacgcgcgtatttaatcgattagttatcgtttttatttagttatcggcgtattaatatgcgtatcgacgattatcgtttcgacgtattattttttttattattcgttttttttttacgtatcgttttattatttatttttttattattattttttatattgatacgttatttttttatagttagttatagttattttagtaacgtagtatattcgtattcgtttatttatatttaatttagttttttatcgcgtattttatatttaagtnatatttagtatttaattttttaacgttttacgtaatttattttttttgaattttttt

SEQ ID NO: 23678 - DNA, 918 bp, Artificial Sequence
  chemically treated genomic DNA (Homo sapiens) CpG-island No: 23678
  misc_feature (58)..(58): n is either a, c, g or t
aaaaaaattcaaaaaaaataaattacgtaaaacgttaaaaaattaaatactaaatatnacttaaatataaaatacgcgataaaaaactaaattaaatataaataaacgaatacgaatatactacgttactaaaataactataactaactataaaaaaataacgtatcaatataaaaaataataataaaaaaataaataataaaacgatacgtaaaaaaaaaacgaataataaaaaaaataatacgtcgaaacgataatcgtcgatacgcatattaatacgccgataactaaataaaaacgataactaatcgattaaatacgcgcgtaaaaaatcattcgtaatataaaatactaaattacatacgatcgaaaaaataaatataaatacgtacgataaatacgcgtctaaaaaatacgatccgtaactaacaaaccgataatataacgtaaaatatatataacaatcgaacttaatatacatataatacaataatacgttcgtcacgaaaaataataaataaaaaaataataataaaactattacgtaaacgcaataatatcgaaaacgatattatatacaatacgaaaacgatataaaaatataacataaataaaatactaaatataaaaataaaacgttataaatacaacgttcgcacgaaaatccaacctatacgcgtacgcaatacgataaataaacgaatacgcgtcctcgtacaatatcgataaatacgtactacacgataaaaataaaatcacactaatccgataaaatatacgtataatacgaaacgaaaaacgcaaaatatcgaaaacgtctcgactaaaacgacgaaaacgatataatataaaataaataaaacgaaaaaattaataaaaaaaaccaatccgaaaaaaaataaaaaaatcgtaataaac

SEQ ID NO: 23679 - DNA, 918 bp, Artificial Sequence
  chemically treated genomic DNA (Homo sapiens) CpG-island No: 23679
  misc_feature (58)..(58): n is either a, c, g or t
agggggatttagggggggtgggttgcgtgagacgttaggagattgggtgttgggtgtnatttggatgtggagtgcgcggtggagagttgggttggatgtgagtgagcgggtacgggtatgttacgttgttagggtggttatggttggttgtgggggggtggcgtattagtgtggagggtagtggtgggggggtggatggtaaggcggtgcgtgggaggggagcgggtggtgggggggatggtgcgtcgggacgatggtcgtcggtgcgtatgttggtgcgtcggtagttgggtgggggcgatggttggtcggttgggtacgcgcgtggagagttattcgtagtgtgggatgttgggttatatgcggtcgaagagatgggtgtaggtgcgtgcggtggatgcgcgtttgaagggtacgattcgtggttgataggtcggtggtgtggcgtagggtgtgtgtggtagtcgagtttggtgtgtatgtggtgtagtggtgcgttcgttacggggggtggtgggtgaggagatagtggtgaggttgttgcgtagacgtagtggtatcgagggcggtgttatatgtagtacgagagcggtgtgagagtgtggtatagatagaatgttaggtgtggaagtgaggcgttgtgagtgtagcgttcgtacgagggtttagtttgtgcgcgtgcgtagtgcggtgagtgggcggatgcgcgttttcgtgtagtgtcgataagtacgtgttgtacggtagaggtgaggttatattagttcggtgaggtgtgcgtgtgatgcggagcgagggacgtaaggtgtcggggacgtttcggttggagcggcgagggcgatgtgatgtggggtgagtggagcgggggggttaatgggagaagttagttcggaggggggtggaggggtcgtgatgggt

SEQ ID NO: 23680 - DNA, 918 bp, Artificial Sequence
  chemically treated genomic DNA (Homo sapiens) CpG-island No: 23680
  misc_feature (861)..(861): n is either a, c, g or t
acccatcacgacccctccacccccctccgaactaacttctcccattaacccccccgctccactcaccccacatcacatcgccctcgccgctccaaccgaaacgtccccgacaccttacgtccctcgctccgcatcacacgcacacctcaccgaactaatataacctcacctctaccgtacaacacgtacttatcgacactacacgaaaacgcgcatccgcccactcaccgcactacgcacgcgcacaaactaaaccctcgtacgaacgctacactcacaacgcctcacttccacacctaacattctatctataccacactctcacaccgctctcgtactacatataacaccgccctcgataccactacgtctacgcaacaacctcaccactatctcctcacccaccaccccccgtaacgaacgcaccactacaccacatacacaccaaactcgactaccacacacaccctacgccacaccaccgacctatcaaccacgaatcgtacccttcaaacgcgcatccaccgcacgcacctacacccatctcttcgaccgcatataacccaacatcccacactacgaataactctccacgcgcgtacccaaccgaccaaccatcgcccccacccaactaccgacgcaccaacatacgcaccgacgaccatcgtcccgacgcaccatcccccccaccacccgctcccctcccacgcaccgccttaccatccacccccccaccactaccctccacactaatacgccacccccccacaaccaaccataaccaccctaacaacgtaacatacccgtacccgctcactcacatccaacccaactctccaccgcgcactccacatccaaatnacacccaacacccaatctcctaacgtctcacgcaacccaccccccctaaatccccct

SEQ ID NO: 23681 - DNA, 540 bp, Artificial Sequence
  chemically treated genomic DNA (Homo sapiens) CpG-island No: 23681
  misc_feature (33)..(33): n is either a, c, g or t
  misc_feature (117)..(117): n is either a, c, g or t
  misc_feature (130)..(130): n is either a, c, g or t
  misc_feature (507)..(507): n is either a, c, g or t
tagcgttttaaatttaggcgtgaatttcggtanttttttgcgtttttgttttttttaagcggcgttttttttaagggtttttttttttatattttttcgattaacggggcgtatttncggttacgtttangtgtttttttcggggtttttttacggggcgtgtattattcgacgggattttttttttttattgtttggttcgcgcgacgtatttttgttttataatattataattttttgatgtgggtcgtttgatggttttttaaacgtttttgggataggtttattttttacgttatacgcgggcgttcgtcggcgagcgttttttttattcggtttattcgtttttattcgtttttttcgcgacgtgttatcgattttgtttttttttgcgtttatattcgggcgtttttttgagtcgattatcgttacgcggagtttgtttcggttcgtttattcgtatcgttacgacgaaagtcgtacggggtaggtcgtatcgatacgttnattttttattgtaatcgcgtcgtcgcggtcgtt

SEQ ID NO: 23682 - DNA, 540 bp, Artificial Sequence
  chemically treated genomic DNA (Homo sapiens) CpG-island No: 23682
  misc_feature (34)..(34): n is either a, c, g or t
  misc_feature (411)..(411): n is either a, c, g or t
  misc_feature (424)..(424): n is either a, c, g or t
  misc_feature (508)..(508): n is either a, c, g or t
aacgaccgcgacgacgcgattacaataaaaaatnaacgtatcgatacgacctaccccgtacgactttcgtcgtaacgatacgaataaacgaaccgaaacaaactccgcgtaacgataatcgactcaaaaaaacgcccgaatataaacgcaaaaaaaaacaaaatcgataacacgtcgcgaaaaaaacgaataaaaacgaataaaccgaataaaaaaaacgctcgccgacgaacgcccgcgtataacgtaaaaaataaacctatcccaaaaacgtttaaaaaaccatcaaacgacccacatcaaaaaattataatattataaaacaaaaatacgtcgcgcgaaccaaacaataaaaaaaaaaaatcccgtcgaataatacacgccccgtaaaaaaaccccgaaaaaaacacntaaacgtaaccgnaaatacgccccgttaatcgaaaaaatataaaaaaaaaaacccttaaaaaaaacgccgcttaaaaaaaacaaaaacgcaaaaaantaccgaaattcacgcctaaatttaaaacgcta

SEQ ID NO: 23683 - DNA, 540 bp, Artificial Sequence
  chemically treated genomic DNA (Homo sapiens) CpG-island No: 23683
  misc_feature (34)..(34): n is either a, c, g or t
  misc_feature (411)..(411): n is either a, c, g or t
  misc_feature (424)..(424): n is either a, c, g or t
  misc_feature (508)..(508): n is either a, c, g or t
agcgatcgcgacgacgcggttgtagtggggggtnagcgtgtcgatacggtttatttcgtacggttttcgtcgtggcgatacgggtgggcgggtcggaatagatttcgcgtgacgatagtcggtttagagagacgttcgggtgtgagcgtagagggaaatagggtcggtaatacgtcgcgggagaagcggataagaacggatggatcgagtagggggaacgttcgtcgacgagcgttcgcgtatgacgtggggggtaaatttattttaaaggcgtttggggggttattaggcggtttatattagggggttgtggtattataaaataggggtgcgtcgcgcgggttaagtaatagggggggggggtttcgtcggatgatatacgtttcgtgggggagtttcggggaaagtatntggacgtagtcgngggtgcgtttcgttggtcgaagggatatggggggggggatttttagggaaggcgtcgtttaaagagagtaaaggcgtaaggaantgtcggggtttacgtttggatttgaggcgtta

SEQ ID NO: 23684 - DNA, 540 bp, Artificial Sequence
  chemically treated genomic DNA (Homo sapiens) CpG-island No: 23684
  misc_feature (33)..(33): n is either a, c, g or t
  misc_feature (117)..(117): n is either a, c, g or t
  misc_feature (130)..(130): n is either a, c, g or t
  misc_feature (507)..(507): n is either a, c, g or t
taacgcctcaaatccaaacgtaaaccccgacanttccttacgcctttactctctttaaacgacgccttccctaaaaatccccccccccatatcccttcgaccaacgaaacgcacccncgactacgtccanatactttccccgaaactcccccacgaaacgtatatcatccgacgaaaccccccccccctattacttaacccgcgcgacgcacccctattttataataccacaaccccctaatataaaccgcctaataaccccccaaacgcctttaaaataaatttaccccccacgtcatacgcgaacgctcgtcgacgaacgttccccctactcgatccatccgttcttatccgcttctcccgcgacgtattaccgaccctatttccctctacgctcacacccgaacgtctctctaaaccgactatcgtcacgcgaaatctattccgacccgcccacccgtatcgccacgacgaaaaccgtacgaaataaaccgtatcgacacgctnaccccccactacaaccgcgtcgtcgcgatcgct

SEQ ID NO: 23685 - DNA, 760 bp, Artificial Sequence
  chemically treated genomic DNA (Homo sapiens) CpG-island No: 23685
agaagcgcgttcgtaagatagcgtagttttcgcgggtcggaggaggcggggtcgcggtaggtagaggtagggtcgggtaagttttcgtttttcgtcgtttgacgggaattgtagtttttgggagaagtcgggttgttttacgaggtattaggaattatatttttcggtgagagagcggtttcggtcggtcgcgcggtatcggagcgtcgtattgttagcggttagagagtttggggtagatcgaaaagggagtgttttttttttttttttcgcgttttggcggtgtaagcggttttgttttttttcgtttcgtcgtcgggtgttttttgttcgttttttcgtgttagttttttttgggtttcgtcgggaaagtttgggtttcgaaattcgaaggtagcggcggttgtttagtacgggagtgtggggcgcgttattcggcggtttagtttatttagggttcggttcgcgtttttatgggttcgattcggaagtttaacgtgtgtagtcggttgagtcgtcgggcgttgggttgtttttcgcgcgacgtaggcgtggtgtagaggattaatttgggtattttgcgggcgttggtgtgttaggtgatcgttagtcggtcggggcgggacggagggtcgcgggcgcgcggcggtcgagttttttgcggggatgcggttttaacgcgttggggtttttttttatagggttatatgtgatggggaggaggatataagttcggaatttgggataggtggtaataggg

SEQ ID NO: 23686 - DNA, 760 bp, Artificial Sequence
  chemically treated genomic DNA (Homo sapiens) CpG-island No: 23686
ccctattaccacctatcccaaattccgaacttatatcctcctccccatcacatataaccctataaaaaaaaaccccaacgcgttaaaaccgcatccccgcaaaaaactcgaccgccgcgcgcccgcgaccctccgtcccgccccgaccgactaacgatcacctaacacaccaacgcccgcaaaatacccaaattaatcctctacaccacgcctacgtcgcgcgaaaaacaacccaacgcccgacgactcaaccgactacacacgttaaacttccgaatcgaacccataaaaacgcgaaccgaaccctaaataaactaaaccgccgaataacgcgccccacactcccgtactaaacaaccgccgctaccttcgaatttcgaaacccaaactttcccgacgaaacccaaaaaaaactaacacgaaaaaacgaacaaaaaacacccgacgacgaaacgaaaaaaaacaaaaccgcttacaccgccaaaacgcgaaaaaaaaaaaaaaaacactcccttttcgatctaccccaaactctctaaccgctaacaatacgacgctccgataccgcgcgaccgaccgaaaccgctctctcaccgaaaaatataattcctaatacctcgtaaaacaacccgacttctcccaaaaactacaattcccgtcaaacgacgaaaaacgaaaacttacccgaccctacctctacctaccgcgaccccgcctcctccgacccgcgaaaactacgctatcttacgaacgcgcttct

SEQ ID NO: 23687 - DNA, 760 bp, Artificial Sequence
  chemically treated genomic DNA (Homo sapiens) CpG-island No: 23687
ttttattattatttattttagatttcgggtttgtatttttttttttattatatgtgattttataaagggaggttttagcgcgttaaaatcgtattttcgtaggaggttcggtcgtcgcgcgttcgcggtttttcgtttcgtttcggtcggttggcggttatttggtatattagcgttcgtaggatgtttaggttggttttttgtattacgtttgcgtcgcgcgagaagtagtttagcgttcggcgatttagtcggttgtatacgttgggttttcgggtcgggtttatggaggcgcgggtcgggttttgggtaggttgggtcgtcgagtggcgcgttttatattttcgtgttgggtagtcgtcgttgttttcgaatttcgaggtttagattttttcggcggggtttagggaaagttgatacggggaggcgggtagggagtattcgacggcggggcgagggaaagtagagtcgtttgtatcgttagagcgcggagagaagggaagaagtatttttttttcgatttgttttaggttttttggtcgttgatagtgcgacgtttcggtatcgcgcggtcggtcggagtcgtttttttatcgggaaatgtagtttttagtgtttcgtgaggtagttcggttttttttaggaattataattttcgttaggcggcggggagcgagggtttgttcggttttgtttttgtttgtcgcggtttcgtttttttcggttcgcggaggttgcgttgttttgcgggcgcgttttt

SEQ ID NO: 23688 - DNA, 760 bp, Artificial Sequence
  chemically treated genomic DNA (Homo sapiens) CpG-island No: 23688
aaaaacgcgcccgcaaaacaacgcaacctccgcgaaccgaaaaaaacgaaaccgcgacaaacaaaaacaaaaccgaacaaaccctcgctccccgccgcctaacgaaaattataattcctaaaaaaaaccgaactacctcacgaaacactaaaaactacatttcccgataaaaaaacgactccgaccgaccgcgcgataccgaaacgtcgcactatcaacgaccaaaaaacctaaaacaaatcgaaaaaaaaatacttcttcccttctctccgcgctctaacgatacaaacgactctactttccctcgccccgccgtcgaatactccctacccgcctccccgtatcaactttccctaaaccccgccgaaaaaatctaaacctcgaaattcgaaaacaacgacgactacccaacacgaaaatataaaacgcgccactcgacgacccaacctacccaaaacccgacccgcgcctccataaacccgacccgaaaacccaacgtatacaaccgactaaatcgccgaacgctaaactacttctcgcgcgacgcaaacgtaatacaaaaaaccaacctaaacatcctacgaacgctaatataccaaataaccgccaaccgaccgaaacgaaacgaaaaaccgcgaacgcgcgacgaccgaacctcctacgaaaatacgattttaacgcgctaaaacctccctttataaaatcacatataataaaaaaaaaaatacaaacccgaaatctaaaataaataataataaaa

SEQ ID NO: 23689 - DNA, 523 bp, Artificial Sequence
  chemically treated genomic DNA (Homo sapiens) CpG-island No: 23689
tttcggtaatttttttttcgttgtttttttttttttatttgtagtttggaagtaagtttagtaaaaggttgaggcgaaagtgttttcgcgttttcgatcgcgtaggttcggtttataggggcgatttttcggggcgcgtgggttgtagcggttcgattgcgcggcgtttcggtatcgcgttcgggtttaagtttttgggttttggaggtttttttagtgcgttttagttagtcgtcgtaaagagttaattaagtggggtcggttcgtttcgtcgtttttagtagcgcgtttttatcgcgtattttcggtttcgcgttcgcggcgatttttttgaatcgtagttttgtttcgttttagagttagttagtttttttttcgtttagtcgatttggtttttcgcgcgttttttatcgtattttttcgggtttcgcgattttttagtatttttttagttggaaggggttttacggaggattttttgttttcgtcgtttttttcgttttttttttcgtatttttttagg

SEQ ID NO: 23690 - DNA, 523 bp, Artificial Sequence
  chemically treated genomic DNA (Homo sapiens) CpG-island No: 23690
cctaaaaaaatacgaaaaaaaaaacgaaaaaaacgacgaaaacaaaaaatcctccgtaaaaccccttccaactaaaaaaatactaaaaaatcgcgaaacccgaaaaaatacgataaaaaacgcgcgaaaaaccaaatcgactaaacgaaaaaaaaactaactaactctaaaacgaaacaaaactacgattcaaaaaaatcgccgcgaacgcgaaaccgaaaatacgcgataaaaacgcgctactaaaaacgacgaaacgaaccgaccccacttaattaactctttacgacgactaactaaaacgcactaaaaaaacctccaaaacccaaaaacttaaacccgaacgcgataccgaaacgccgcgcaatcgaaccgctacaacccacgcgccccgaaaaatcgcccctataaaccgaacctacgcgatcgaaaacgcgaaaacactttcgcctcaaccttttactaaacttacttccaaactacaaataaaaaaaaaaaaacaacgaaaaaaaaattaccgaaa

SEQ ID NO: 23691 - DNA, 523 bp, Artificial Sequence
  chemically treated genomic DNA (Homo sapiens) CpG-island No: 23691
tttgggggggtgcggggaggaaagcggggagaacggcgggggtagagggtttttcgtgaagttttttttagttgaggaagtgttggaggatcgcggggttcggaggagtgcggtgaggagcgcgcgggaagttaagtcggttgggcgggagggaggttggttggttttggggcgggatagagttgcggtttaggaggatcgtcgcgagcgcggggtcgggggtgcgcggtggagacgcgttgttgggggcggcggagcgggtcggttttatttggttaattttttgcggcgattggttaggacgtattggaggggtttttaagatttagaaatttgagttcgggcgcgatgtcggagcgtcgcgtagtcgggtcgttgtagtttacgcgtttcggaaagtcgtttttgtggatcgagtttgcgcgatcgggggcgcggaaatattttcgttttagttttttgttgaatttgtttttaggttgtagatgaggaggggaaggtagcggggaaaagattgtcggag

SEQ ID NO: 23692 - DNA, 523 bp, Artificial Sequence
  chemically treated genomic DNA (Homo sapiens) CpG-island No: 23692
ctccgacaatcttttccccgctaccttcccctcctcatctacaacctaaaaacaaattcaacaaaaaactaaaacgaaaatatttccgcgcccccgatcgcgcaaactcgatccacaaaaacgactttccgaaacgcgtaaactacaacgacccgactacgcgacgctccgacatcgcgcccgaactcaaatttctaaatcttaaaaacccctccaatacgtcctaaccaatcgccgcaaaaaattaaccaaataaaaccgacccgctccgccgcccccaacaacgcgtctccaccgcgcacccccgaccccgcgctcgcgacgatcctcctaaaccgcaactctatcccgccccaaaaccaaccaacctccctcccgcccaaccgacttaacttcccgcgcgctcctcaccgcactcctccgaaccccgcgatcctccaacacttcctcaactaaaaaaaacttcacgaaaaaccctctacccccgccgttctccccgctttcctccccgcacccccccaaa

SEQ ID NO: 23693 - DNA, 813 bp, Artificial Sequence
  chemically treated genomic DNA (Homo sapiens) CpG-island No: 23693
ggcgatgtcgtgggcggcgttttttttggcgatgttttgggcggcgttttcgttggcgatgttttgggcggcgttttcgttggcgatgttttgggcggtattttttttggcgatgttttggacggcgttttcgttggcgatgtcgtgggcggcgttttcgttggcgatttcgtgggcggcgttttcgttggcgatgttttgggcggtagttttcgttggcgatgttttgggcggcgttttttttggcgatgttttgggcggcgttttcgttggcgatgttttgggcggcgttttttttggcgatgttttgggcggcgttttttttggcgatgttttgggcggcgttttcgttggcgatgttttgggcggcgttttttttggcgatgttttggacggcgttttcgttggcgatgtcgtgggcggcgttttcgttggcgatttcgtgggcggagttttcgttggcgatgttttgggcggcgttttcgttggcgatgttttgggcggcgttttttttggcgatgttttgggcggcgttttcgttggcgatgttttgggcggcgttttcgttggcgatgttttgggcggcgttttcgttggcgatgtcgtgggcggcgttttcgttggcgatgtcgtgggcggcgttttcgttggcgatgtttttgtcggcggtttcgttagcgatgtcgtgtatagtattttcgttagcgatgtcgtgtgtggcgttttcgttagtgatgtcgtgtacggtgtttttatggggagttagaaaaatatagagttaaggttagtgttttggtggtggagattgtgaat

SEQ ID NO: 23694 - DNA, 813 bp, Artificial Sequence
  chemically treated genomic DNA (Homo sapiens) CpG-island No: 23694
attcacaatctccaccaccaaaacactaaccttaactctatatttttctaactccccataaaaacaccgtacacgacatcactaacgaaaacgccacacacgacatcgctaacgaaaatactatacacgacatcgctaacgaaaccgccgacaaaaacatcgccaacgaaaacgccgcccacgacatcgccaacgaaaacgccgcccacgacatcgccaacgaaaacgccgcccaaaacatcgccaacgaaaacgccgcccaaaacatcgccaacgaaaacgccgcccaaaacatcgccaaaaaaaacgccgcccaaaacatcgccaacgaaaacgccgcccaaaacatcgccaacgaaaactccgcccacgaaatcgccaacgaaaacgccgcccacgacatcgccaacgaaaacgccgtccaaaacatcgccaaaaaaaacgccgcccaaaacatcgccaacgaaaacgccgcccaaaacatcgccaaaaaaaacgccgcccaaaacatcgccaaaaaaaacgccgcccaaaacatcgccaacgaaaacgccgcccaaaacatcgccaaaaaaaacgccgcccaaaacatcgccaacgaaaactaccgcccaaaacatcgccaacgaaaacgccgcccacgaaatcgccaacgaaaacgccgcccacgacatcgccaacgaaaacgccgtccaaaacatcgccaaaaaaaataccgcccaaaacatcgccaacgaaaacgccgcccaaaacatcgccaacgaaaacgccgcccaaaacatcgccaaaaaaaacgccgcccacgacatcgcc

SEQ ID NO: 23695 - DNA, 813 bp, Artificial Sequence
  chemically treated genomic DNA (Homo sapiens) CpG-island No: 23695
atttatagtttttattattagggtattgattttaattttgtgtttttttagttttttatgaggatatcgtatacgatattattaacgaggacgttatatacgatatcgttaacgaggatattgtatacgatatcgttaacgaggtcgtcgataagggtatcgttaacgaggacgtcgtttacggtatcgttagcgaggacgtcgtttacggtatcgttagcgaggacgtcgtttagggtatcgttagcgaggacgtcgtttagggtatcgttagcgaggacgtcgtttagggtatcgttaaagaggacgtcgtttagggtatcgttaacgaggacgtcgtttagggtatcgttaacgaggatttcgtttacggaatcgttagcgaggacgtcgtttacggtatcgttagcgaggacgtcgtttagggtatcgttaaggaggacgtcgtttagggtatcgttaacgaggacgtcgtttagggtatcgttaaggaggacgtcgtttagggtatcgttaaggaggacgtcgtttagggtatcgttaacgagggcgtcgtttagggtatcgttaaagaggacgtcgtttagggtatcgttaacgaggattgtcgtttagggtatcgttaacgaggacgtcgtttacggaatcgttagcgaggacgtcgtttacggtatcgttagcgaggacgtcgtttagggtatcgttaaggaggatgtcgtttagggtatcgttaacgaggacgtcgtttagggtatcgttaacgaggacgtcgtttagggtatcgttaaagaggacgtcgtttacggtatcgtt

SEQ ID NO: 23696 - DNA, 813 bp, Artificial Sequence
  chemically treated genomic DNA (Homo sapiens) CpG-island No: 23696
aacgataccgtaaacgacgtcctctttaacgataccctaaacgacgtcctcgttaacgataccctaaacgacgtcctcgttaacgataccctaaacgacatcctccttaacgataccctaaacgacgtcctcgctaacgataccgtaaacgacgtcctcgctaacgattccgtaaacgacgtcctcgttaacgataccctaaacgacaatcctcgttaacgataccctaaacgacgtcctctttaacgataccctaaacgacgccctcgttaacgataccctaaacgacgtcctccttaacgataccctaaacgacgtcctccttaacgataccctaaacgacgtcctcgttaacgataccctaaacgacgtcctccttaacgataccctaaacgacgtcctcgctaacgataccgtaaacgacgtcctcgctaacgattccgtaaacgaaatcctcgttaacgataccctaaacgacgtcctcgttaacgataccctaaacgacgtcctctttaacgataccctaaacgacgtcctcgctaacgataccctaaacgacgtcctcgctaacgataccctaaacgacgtcctcgctaacgataccgtaaacgacgtcctcgctaacgataccgtaaacgacgtcctcgttaacgatacccttatcgacgacctcgttaacgatatcgtatacaatatcctcgttaacgatatcgtatataacgtcctcgttaataatatcgtatacgatatcctcataaaaaactaaaaaaacacaaaattaaaatcaataccctaataataaaaactataaat

SEQ ID NO: 23697 - DNA, 610 bp, Artificial Sequence
  chemically treated genomic DNA (Homo sapiens) CpG-island No: 23697
acgaacgtagtttattttttttttgtcggttattttcgttttggttttaggttcgtatttatcggttatttcgagttcgggtttatcgtcgggggcgttcgtcggggtttcgattttatttggggaggtcggcggggaaagtcgggtcgggaagggggagtttaatttcggagatcgtagatttcgttatttcggttttttgtcgttttacgttttggtttcggttttcgggatttttgagttgatttttgtcgtttttggtttcgtcggcgttttaggggttttaatttcgtcggtcgtcgttcgtttcgcgagtttttaagatgttcggtttcgggatcgggcgttgttggaataatggaggtttttagaggtagcgcgaggatagcggcggcggagatcgtggcggtaaaggttgtggtagcggcggcggtatagcggcggcgacggcgtttgcgtagggtaaacgtggcgtcgcggtttattgagttgtattttcgttacggattttcgttcgtacgtttaggttcgaaagatcgtgtttcgggatttagaaaggattttggatattttatagggtttttttagtttttttattttagagtggagt

SEQ ID NO: 23698 - DNA, 610 bp, Artificial Sequence
  chemically treated genomic DNA (Homo sapiens) CpG-island No: 23698
actccactctaaaataaaaaaactaaaaaaaccctataaaatatccaaaatcctttctaaatcccgaaacacgatctttcgaacctaaacgtacgaacgaaaatccgtaacgaaaatacaactcaataaaccgcgacgccacgtttaccctacgcaaacgccgtcgccgccgctataccgccgccgctaccacaacctttaccgccacgatctccgccgccgctatcctcgcgctacctctaaaaacctccattattccaacaacgcccgatcccgaaaccgaacatcttaaaaactcgcgaaacgaacgacgaccgacgaaattaaaacccctaaaacgccgacgaaaccaaaaacgacaaaaatcaactcaaaaatcccgaaaaccgaaaccaaaacgtaaaacgacaaaaaaccgaaataacgaaatctacgatctccgaaattaaactcccccttcccgacccgactttccccgccgacctccccaaataaaatcgaaaccccgacgaacgcccccgacgataaacccgaactcgaaataaccgataaatacgaacctaaaaccaaaacgaaaataaccgacaaaaaaaaaataaactacgttcgt

SEQ ID NO: 23699 - DNA, 610 bp, Artificial Sequence
  chemically treated genomic DNA (Homo sapiens) CpG-island No: 23699
attttattttaagatgggagagttagagaagttttgtggggtatttagggttttttttgaatttcggagtacggtttttcgagtttgagcgtgcgggcggggattcgtggcgaaggtgtagtttagtaggtcgcggcgttacgtttattttgcgtagacgtcgtcgtcgtcgttgtgtcgtcgtcgttgttatagtttttgtcgttacggttttcgtcgtcgttgttttcgcgttgtttttgggagtttttattgttttagtagcgttcggtttcgagatcgggtattttgggggttcgcgaaacgggcggcggtcgacggagttgagatttttagggcgtcggcgggattaggagcggtaggggttagtttaggaatttcgggagtcgggattaaagcgtggggcggtagggggtcggggtggcgaggtttacggttttcggagttgggtttttttttttcggttcgatttttttcgtcgatttttttaagtggggtcggagtttcggcgggcgttttcggcgatgagttcggattcgaggtggtcggtgagtgcgggtttgggattagggcgggagtggtcggtagggaaggggtaggttacgttcgt

SEQ ID NO: 23700 - DNA, 610 bp, Artificial Sequence
  chemically treated genomic DNA (Homo sapiens) CpG-island No: 23700
acgaacgtaacctaccccttccctaccgaccactcccgccctaatcccaaacccgcactcaccgaccacctcgaatccgaactcatcgccgaaaacgcccgccgaaactccgaccccacttaaaaaaatcgacgaaaaaaatcgaaccgaaaaaaaaaaacccaactccgaaaaccgtaaacctcgccaccccgaccccctaccgccccacgctttaatcccgactcccgaaattcctaaactaacccctaccgctcctaatcccgccgacgccctaaaaatctcaactccgtcgaccgccgcccgtttcgcgaacccccaaaatacccgatctcgaaaccgaacgctactaaaacaataaaaactcccaaaaacaacgcgaaaacaacgacgacgaaaaccgtaacgacaaaaactataacaacgacgacgacacaacgacgacgacgacgtctacgcaaaataaacgtaacgccgcgacctactaaactacaccttcgccacgaatccccgcccgcacgctcaaactcgaaaaaccgtactccgaaattcaaaaaaaaccctaaataccccacaaaacttctctaactctcccatcttaaaataaaat

SEQ ID NO: 23701 - DNA, 681 bp, Artificial Sequence
  chemically treated genomic DNA (Homo sapiens) CpG-island No: 23701
atatcggttgatgttttatttggttagggaattatttagcgtttagtatatttggcgttaatcggcggggattaattttatatttcgtagttggcggaaagtagcgggaggaggtatttagttttggggttgagattttagttttcgcgtgcgtaaattacgtttttgtagattttcgttgttgcgtgttcgcgcgcgtttcggagtgcgtatgcgtagcggcgggggttgtttcggttgttttttattgaggggattcgttagtttttaatttagtggcgtttgttttgattttcggggtttggtttttagcgtagtaattttgtcggcgaagaaggtgagcgtagtgttgtgtggtagtagagttttttaggacgaggagtagcgggacgaggaagggtagattggtgaaatcgtaaattgggcgtttgtttcggcgtcggatttttatttgtaaaggtgggtggttcgttcggagcgggaaaatatttcggaagtggagggtcgggttagcgtgattgataagcgggaatttttgtgtggggacgggtaggtttaggaaggttgtgtttgcggtggaattgggcggtgcgtagaagtgggtattaatagtagtcgcgtgtttgggttttagatttggtttagttgtgttgagttttttatggattattttacgtagat

SEQ ID NO: 23702 - DNA, 681 bp, Artificial Sequence
  chemically treated genomic DNA (Homo sapiens) CpG-island No: 23702
atctacgtaaaataatccataaaaaactcaacacaactaaaccaaatctaaaacccaaacacgcgactactattaatacccacttctacgcaccgcccaattccaccgcaaacacaaccttcctaaacctacccgtccccacacaaaaattcccgcttatcaatcacgctaacccgaccctccacttccgaaatattttcccgctccgaacgaaccacccacctttacaaataaaaatccgacgccgaaacaaacgcccaatttacgatttcaccaatctacccttcctcgtcccgctactcctcgtcctaaaaaactctactaccacacaacactacgctcaccttcttcgccgacaaaattactacgctaaaaaccaaaccccgaaaatcaaaacaaacgccactaaattaaaaactaacgaatcccctcaataaaaaacaaccgaaacaacccccgccgctacgcatacgcactccgaaacgcgcgcgaacacgcaacaacgaaaatctacaaaaacgtaatttacgcacgcgaaaactaaaatctcaaccccaaaactaaatacctcctcccgctactttccgccaactacgaaatataaaattaatccccgccgattaacgccaaatatactaaacgctaaataattccctaaccaaataaaacatcaaccgatat

SEQ ID NO: 23703 - DNA, 681 bp, Artificial Sequence
  chemically treated genomic DNA (Homo sapiens) CpG-island No: 23703
atttacgtaagataatttatgaaaagtttaatatagttgggttaaatttaagatttagatacgcggttgttgttaatgtttatttttgcgtatcgtttagttttatcgtaggtataatttttttaggtttattcgtttttatataggggttttcgtttgttaattacgttggttcggttttttattttcggaatgttttttcgtttcggacgggttatttatttttgtaaataggggttcggcgtcggaatagacgtttagtttgcgattttattagtttgttttttttcgtttcgttgtttttcgttttaaggagttttgttgttatatagtattgcgtttatttttttcgtcggtagaattgttacgttgaaagttaggtttcgggaattagggtaaacgttattgagttagaaattggcgggtttttttagtgaaaggtagtcggaataattttcgtcgttgcgtatgcgtatttcgggacgcgcgcgaatacgtagtagcgagaatttataggggcgtggtttgcgtacgcgggaattgggattttaattttagggttaggtgttttttttcgttgtttttcgttagttgcggggtgtgagattaattttcgtcgattagcgttaggtgtattaagcgttggatggttttttgattagatgaaatattagtcgatgt

SEQ ID NO: 23704 - DNA, 681 bp, Artificial Sequence
  chemically treated genomic DNA (Homo sapiens) CpG-island No: 23704
acatcgactaatatttcatctaatcaaaaaaccatccaacgcttaatacacctaacgctaatcgacgaaaattaatctcacaccccgcaactaacgaaaaacaacgaaaaaaaacacctaaccctaaaattaaaatcccaattcccgcgtacgcaaaccacgcccctataaattctcgctactacgtattcgcgcgcgtcccgaaatacgcatacgcaacgacgaaaattattccgactacctttcactaaaaaaacccgccaatttctaactcaataacgtttaccctaattcccgaaacctaactttcaacgtaacaattctaccgacgaaaaaaataaacgcaatactatataacaacaaaactccttaaaacgaaaaacaacgaaacgaaaaaaaacaaactaataaaatcgcaaactaaacgtctattccgacgccgaacccctatttacaaaaataaataacccgtccgaaacgaaaaaacattccgaaaataaaaaaccgaaccaacgtaattaacaaacgaaaacccctatataaaaacgaataaacctaaaaaaattatacctacgataaaactaaacgatacgcaaaaataaacattaacaacaaccgcgtatctaaatcttaaatttaacccaactatattaaacttttcataaattatcttacgtaaat

SEQ ID NO: 23705 - DNA, 540 bp, Artificial Sequence
  chemically treated genomic DNA (Homo sapiens) CpG-island No: 23705
cgttatatacgatatcgttaacgaggatattgtatacgatatcgttaacgaggtcgtcgataagggtatcgttaacgaggatgtcgtttacggtatcgttagcgaggacgtcgtttacggtatcgttagcgaggacgtcgtttacggtatcgttagcgaggacgtcgtttacggtatcgttagcgaggacgtcgtttacggtatcgttagcgaggacgtcgtttagggtatcgttaacgaggacgtcgtttagggtatcgttaaggaggacgtcgtttacggtatcgttaacgaggacgtcgtttagggtatcgttaaggaggacgtcgtttagggtatcgttaaggaggacgtcgtttagggtatcgttaacgaggacgtcgtttagggtatcgttaacgaggacgtcgtttagggtatcgttaaagaggacgtcgtttacggtatcgttaacgagttgtatacgatatcgttaacgaggatattttataagtcgtcgttaataagtatattgtatataatatcgttaatgagggtatt

SEQ ID NO: 23706 - DNA, 540 bp, Artificial Sequence
  chemically treated genomic DNA (Homo sapiens) CpG-island No: 23706
aataccctcattaacgatattatatacaatatacttattaacgacgacttataaaatatcctcgttaacgatatcgtatacaactcgttaacgataccgtaaacgacgtcctctttaacgataccctaaacgacgtcctcgttaacgataccctaaacgacgtcctcgttaacgataccctaaacgacgtcctccttaacgataccctaaacgacgtcctccttaacgataccctaaacgacgtcctcgttaacgataccgtaaacgacgtcctccttaacgataccctaaacgacgtcctcgttaacgataccctaaacgacgtcctcgctaacgataccgtaaacgacgtcctcgctaacgataccgtaaacgacgtcctcgctaacgataccgtaaacgacgtcctcgctaacgataccgtaaacgacgtcctcgctaacgataccgtaaacgacatcctcgttaacgatacccttatcgacgacctcgttaacgatatcgtatacaatatcctcgttaacgatatcgtatataacg

SEQ ID NO: 23707 - DNA, 540 bp, Artificial Sequence
  chemically treated genomic DNA (Homo sapiens) CpG-island No: 23707
agtgtttttattagcgatgttgtgtatagtgtatttgttagcgacggtttgtaaggtgttttcgttagcgatgtcgtatatagttcgttggcgatgtcgtgggcggcgttttttttggcgatgttttgggcggcgttttcgttggcgatgttttgggcggcgttttcgttggcgatgttttgggcggcgttttttttggcgatgttttgggcggcgttttttttggcgatgttttgggcggcgttttcgttggcgatgtcgtggacggcgttttttttggcgatgttttggacggcgttttcgttggcgatgttttgggcggcgttttcgttggcgatgtcgtgggcggcgttttcgttggcgatgtcgtgggcggcgttttcgttggcgatgtcgtgggcggcgttttcgttggcgatgtcgtgggcggcgttttcgttggcgatgtcgtgggcggtattttcgttggcgatgtttttgtcggcggtttcgttagcgatgtcgtgtatagtattttcgttagcgatgtcgtgtgtggcg

SEQ ID NO: 23708 - DNA, 540 bp, Artificial Sequence
  chemically treated genomic DNA (Homo sapiens) CpG-island No: 23708
cgccacacacgacatcgctaacgaaaatactatacacgacatcgctaacgaaaccgccgacaaaaacatcgccaacgaaaataccgcccacgacatcgccaacgaaaacgccgcccacgacatcgccaacgaaaacgccgcccacgacatcgccaacgaaaacgccgcccacgacatcgccaacgaaaacgccgcccacgacatcgccaacgaaaacgccgcccaaaacatcgccaacgaaaacgccgtccaaaacatcgccaaaaaaaacgccgtccacgacatcgccaacgaaaacgccgcccaaaacatcgccaaaaaaaacgccgcccaaaacatcgccaaaaaaaacgccgcccaaaacatcgccaacgaaaacgccgcccaaaacatcgccaacgaaaacgccgcccaaaacatcgccaaaaaaaacgccgcccacgacatcgccaacgaactatatacgacatcgctaacgaaaacaccttacaaaccgtcgctaacaaatacactatacacaacatcgctaataaaaacact

SEQ ID NO: 23709 - DNA, 522 bp, Artificial Sequence
  chemically treated genomic DNA (Homo sapiens) CpG-island No: 23709
  misc_feature (70)..(70): n is either a, c, g or t
  misc_feature (170)..(170): n is either a, c, g or t
  misc_feature (205)..(205): n is either a, c, g or t
  misc_feature (429)..(429): n is either a, c, g or t
  misc_feature (460)..(460): n is either a, c, g or t
  misc_feature (496)..(496): n is either a, c, g or t
  misc_feature (517)..(517): n is either a, c, g or t
gtttaggattagttgaggacgcggtttttcggtggtaattttggtaattagttagcgcgtcgttgcgttnttcggaagttagatttcgtcgggttgagtcgagttacgttagcgtcgattggttacgtggaggagtttgcgtagaggagatatttgattcggatggagancggttaggggagcgcgcgcggattggttggagttngacggggaacgtttgggcggggcgcggattgggggatagtagtttcgcggagcgtatcggaagttttcgtttggtttagtcgcggggtataagatagtggcgttaggagtagcgatttatcgatattagtcgggaaggggttttcgatcgagcgggaggttgggggtagtttggaggtgagatttcgttgcgtttatagagttggcggtcgcggcgtttgcgtnttatcggtaagcgaggagtggagtagagttntatatgtttatggggagaggtttgggggatcgtagnaggatgtaggcgtcgggtgtntaatg

SEQ ID NO: 23710 - DNA, 522 bp, Artificial Sequence
  chemically treated genomic DNA (Homo sapiens) CpG-island No: 23710
  misc_feature (6)..(6): n is either a, c, g or t
  misc_feature (27)..(27): n is either a, c, g or t
  misc_feature (63)..(63): n is either a, c, g or t
  misc_feature (94)..(94): n is either a, c, g or t
  misc_feature (318)..(318): n is either a, c, g or t
  misc_feature (353)..(353): n is either a, c, g or t
  misc_feature (453)..(453): n is either a, c, g or t
cattanacacccgacgcctacatcctnctacgatcccccaaacctctccccataaacatatanaactctactccactcctcgcttaccgataanacgcaaacgccgcgaccgccaactctataaacgcaacgaaatctcacctccaaactacccccaacctcccgctcgatcgaaaaccccttcccgactaatatcgataaatcgctactcctaacgccactatcttataccccgcgactaaaccaaacgaaaacttccgatacgctccgcgaaactactatcccccaatccgcgccccgcccaaacgttccccgtcnaactccaaccaatccgcgcgcgctcccctaaccgntctccatccgaatcaaatatctcctctacgcaaactcctccacgtaaccaatcgacgctaacgtaactcgactcaacccgacgaaatctaacttccgaanaacgcaacgacgcgctaactaattaccaaaattaccaccgaaaaaccgcgtcctcaactaatcctaaac

SEQ ID NO: 23711 - DNA, 522 bp, Artificial Sequence
  chemically treated genomic DNA (Homo sapiens) CpG-island No: 23711
  misc_feature (6)..(6): n is either a, c, g or t
  misc_feature (27)..(27): n is either a, c, g or t
  misc_feature (63)..(63): n is either a, c, g or t
  misc_feature (94)..(94): n is either a, c, g or t
  misc_feature (318)..(318): n is either a, c, g or t
  misc_feature (353)..(353): n is either a, c, g or t
  misc_feature (453)..(453): n is either a, c, g or t
tattgngtattcggcgtttatattttnttgcggttttttaggtttttttttataggtatatgnagttttgttttatttttcgtttgtcggtggnacgtaggcgtcgcggtcgttagttttgtgaacgtagcggggttttatttttaggttatttttaatttttcgttcggtcgggggttttttttcggttggtgtcggtgggtcgttgtttttggcgttattattttgtatttcgcggttgggttaggcgagaattttcggtgcgtttcgcgggattgttgttttttagttcgcgtttcgtttaggcgtttttcgttnggttttagttaattcgcgcgcgtttttttggtcgntttttattcggattaggtgttttttttgcgtagatttttttacgtagttagtcggcgttggcgtagttcggtttagttcggcggagtttgattttcgganggcgtagcggcgcgttggttggttattaaggttattatcgagaggtcgcgtttttagttggttttagat

SEQ ID NO: 23712 - DNA, 522 bp, Artificial Sequence
  chemically treated genomic DNA (Homo sapiens) CpG-island No: 23712
  misc_feature (70)..(70): n is either a, c, g or t
  misc_feature (170)..(170): n is either a, c, g or t
  misc_feature (205)..(205): n is either a, c, g or t
  misc_feature (429)..(429): n is either a, c, g or t
  misc_feature (460)..(460): n is either a, c, g or t
  misc_feature (496)..(496): n is either a, c, g or t
  misc_feature (517)..(517): n is either a, c, g or t
atctaaaaccaactaaaaacgcgacctctcgataataaccttaataaccaaccaacgcgccgctacgccntccgaaaatcaaactccgccgaactaaaccgaactacgccaacgccgactaactacgtaaaaaaatctacgcaaaaaaaacacctaatccgaataaaaancgaccaaaaaaacgcgcgcgaattaactaaaaccnaacgaaaaacgcctaaacgaaacgcgaactaaaaaacaacaatcccgcgaaacgcaccgaaaattctcgcctaacccaaccgcgaaatacaaaataataacgccaaaaacaacgacccaccgacaccaaccgaaaaaaaacccccgaccgaacgaaaaattaaaaataacctaaaaataaaaccccgctacgttcacaaaactaacgaccgcgacgcctacgtnccaccgacaaacgaaaaataaaacaaaactncatatacctataaaaaaaaacctaaaaaaccgcaanaaaatataaacgccgaatacncaata

SEQ ID NO: 23713 - DNA, 668 bp, Artificial Sequence
  chemically treated genomic DNA (Homo sapiens) CpG-island No: 23713
  misc_feature (144)..(144): n is either a, c, g or t
  misc_feature (304)..(304): n is either a, c, g or t
  misc_feature (337)..(337): n is either a, c, g or t
  misc_feature (455)..(455): n is either a, c, g or t
  misc_feature (525)..(525): n is either a, c, g or t
ggattcgattcgattcgatggtgcggatttaagttcgtggaagtcggaagtggtgacgcgggtcgcgagaagcggggtcgggatgtggtgaggggggtcgttcggagacgggacgggaagtggcgtcgagtagagagttcgtangcgtgaaggtttttttaatgagcgtttttagcgttgttcgcggttttttttgattgttagttggagcggggatagtatgggcgcggcgttaaggtagcgtcgagtgaggggaagattgatgggcgtttggagacgagtttttatagcggttatttatttnggagttgggcgtcggggttcgttcgtttcgttngcgtcgttagttgttttttttgtttggttttcgtgttttgcgtttttttgtgtcgtttagttttatagttttgaggttttttcggcgtacgtatttcgtttcgatttttcggcgttanttttagttttgacggtcggggaggttttttttagttcggcgtttcgaggatcgttttagtggttaaaggncgcgcggggtgcgttcgggttgtgttttcgggaggttggatcgttagttcgcgtatgaggttatttgtgaggtacgagtgtaggagagtgaaggagatcggggcgtgttgagtagggattttttttagtgattggaaggttat

SEQ ID NO: 23714 - DNA, 668 bp, Artificial Sequence
  chemically treated genomic DNA (Homo sapiens) CpG-island No: 23714
  misc_feature (144)..(144): n is either a, c, g or t
  misc_feature (214)..(214): n is either a, c, g or t
  misc_feature (332)..(332): n is either a, c, g or t
  misc_feature (365)..(365): n is either a, c, g or t
  misc_feature (525)..(525): n is either a, c, g or t
ataaccttccaatcactaaaaaaaatccctactcaacacgccccgatctccttcactctcctacactcgtacctcacaaataacctcatacgcgaactaacgatccaacctcccgaaaacacaacccgaacgcaccccgcgcgncctttaaccactaaaacgatcctcgaaacgccgaactaaaaaaaacctccccgaccgtcaaaactaaaantaacgccgaaaaatcgaaacgaaatacgtacgccgaaaaaacctcaaaactataaaactaaacgacacaaaaaaacgcaaaacacgaaaaccaaacaaaaaaaacaactaacgacgcnaacgaaacgaacgaaccccgacgcccaactccnaaataaataaccgctataaaaactcgtctccaaacgcccatcaatcttcccctcactcgacgctaccttaacgccgcgcccatactatccccgctccaactaacaatcaaaaaaaaccgcgaacaacgctaaaaacgctcattaaaaaaaccttcacgcntacgaactctctactcgacgccacttcccgtcccgtctccgaacgacccccctcaccacatcccgaccccgcttctcgcgacccgcgtcaccacttccgacttccacgaacttaaatccgcaccatcgaatcgaatcgaatcc

SEQ ID NO: 23715 - DNA, 668 bp, Artificial Sequence
  chemically treated genomic DNA (Homo sapiens) CpG-island No: 23715
  misc_feature (144)..(144): n is either a, c, g or t
  misc_feature (214)..(214): n is either a, c, g or t
  misc_feature (332)..(332): n is either a, c, g or t
  misc_feature (365)..(365): n is either a, c, g or t
  misc_feature (525)..(525): n is either a, c, g or t
ataattttttagttattgaaggaggtttttatttagtacgtttcggttttttttatttttttgtattcgtgttttatagatggttttatgcgcggattggcggtttagtttttcggggatatagttcgggcgtatttcgcgcgntttttggttattgaggcggttttcgaggcgtcgggttagggaaagttttttcggtcgttaaggttgggantagcgtcgggggatcggggcggggtgcgtgcgtcgaaagggttttaaagttgtagggttggacggtataaaggggcgtaaggtacggaggttaggtagaggggatagttagcggcgtnggcgggacgggcgggtttcgacgtttagttttnaaatgggtggtcgttgtgggagttcgtttttaggcgtttattagttttttttttattcgacgttattttggcgtcgcgtttatgttgttttcgttttaattagtagttaggaggggtcgcgggtagcgttggagacgtttattgagaggatttttacgtntgcgggttttttgttcgacgttatttttcgtttcgttttcgggcggttttttttattatatttcggtttcgtttttcgcggttcgcgttattattttcggtttttacgggtttaggttcgtattatcgagtcgaatcgagttt

SEQ ID NO: 23716 - DNA, 668 bp, Artificial Sequence
  chemically treated genomic DNA (Homo sapiens) CpG-island No: 23716
  misc_feature (144)..(144): n is either a, c, g or t
  misc_feature (304)..(304): n is either a, c, g or t
  misc_feature (337)..(337): n is either a, c, g or t
  misc_feature (455)..(455): n is either a, c, g or t
  misc_feature (525)..(525): n is either a, c, g or t
aaactcgattcgactcgataatacgaacctaaacccgtaaaaaccgaaaataataacgcgaaccgcgaaaaacgaaaccgaaatataataaaaaaaaccgcccgaaaacgaaacgaaaaataacgtcgaacaaaaaacccgcanacgtaaaaatcctctcaataaacgtctccaacgctacccgcgacccctcctaactactaattaaaacgaaaacaacataaacgcgacgccaaaataacgtcgaataaaaaaaaaactaataaacgcctaaaaacgaactcccacaacgaccacccatttnaaaactaaacgtcgaaacccgcccgtcccgccnacgccgctaactatcccctctacctaacctccgtaccttacgcccctttataccgtccaaccctacaactttaaaaccctttcgacgcacgcaccccgccccgatcccccgacgctantcccaaccttaacgaccgaaaaaactttccctaacccgacgcctcgaaaaccgcctcaataaccaaaaancgcgcgaaatacgcccgaactatatccccgaaaaactaaaccgccaatccgcgcataaaaccatctataaaacacgaatacaaaaaaataaaaaaaaccgaaacgtactaaataaaaacctccttcaataactaaaaaattat

SEQ ID NO: 23717 - DNA, 675 bp, Artificial Sequence
  chemically treated genomic DNA (Homo sapiens) CpG-island No: 23717
  misc_feature (125)..(125): n is either a, c, g or t
  misc_feature (211)..(211): n is either a, c, g or t
  misc_feature (231)..(231): n is either a, c, g or t
  misc_feature (234)..(235): n is either a, c, g or t
  misc_feature (250)..(250): n is either a, c, g or t
  misc_feature (261)..(261): n is either a, c, g or t
  misc_feature (385)..(385): n is either a, c, g or t
  misc_feature (393)..(393): n is either a, c, g or t
  misc_feature (505)..(505): n is either a, c, g or t
  misc_feature (551)..(551): n is either a, c, g or t
  misc_feature (559)..(559): n is either a, c, g or t
  misc_feature (577)..(577): n is either a, c, g or t
acgtagggttttcgttcggttttttagggagttgggagtttagttttcgtttatttttatagtcgcgacggaatgaggttttatcgtaggtcgttattgtttcgcgttcgtttatttcgttgagngtttcgcgttgttgggtcgttcgtatagagttcgtagttgttgtttcggtgttattggcgacgggtatcggttattttcggtattncgggcggtattttagttaanttnnggcgcgcgtcgtatnttcgttggagngaataggtggttagcgtatcgacgtttttttgtttttttcggtttgtttttcgtcggttttagttttagtttaagttttacgtcgtcgtcgtttgtcgagtcggttttttggaatagtaaagtngtattcgntcgatgtttattttagtttcggaattattgacgatttgagtttttcgggttttttagaacggtttcggggatgaattttcgtttcgcgatttgtcgttttgcgttttcgtgntcgttttttaagtattgttttaggtttaagaattcgagaaattttntcgtattnttcgcggggatcgtttgncgcgatttttttaatttttttaattcgtatcgtttttattttattttttttttttatagatttcgtgggtttgataagtatagggttgtagattttgg

SEQ ID NO: 23718 - DNA, 675 bp, Artificial Sequence
  chemically treated genomic DNA (Homo sapiens) CpG-island No: 23718
  misc_feature (99)..(99): n is either a, c, g or t
  misc_feature (117)..(117): n is either a, c, g or t
  misc_feature (125)..(125): n is either a, c, g or t
  misc_feature (171)..(171): n is either a, c, g or t
  misc_feature (283)..(283): n is either a, c, g or t
  misc_feature (291)..(291): n is either a, c, g or t
  misc_feature (415)..(415): n is either a, c, g or t
  misc_feature (426)..(426): n is either a, c, g or t
  misc_feature (441)..(442): n is either a, c, g or t
  misc_feature (445)..(445): n is either a, c, g or t
  misc_feature (465)..(465): n is either a, c, g or t
  misc_feature (551)..(551): n is either a, c, g or t
ccaaaatctacaaccctatacttatcaaacccacgaaatctataaaaaaaaaaaataaaataaaaacgatacgaattaaaaaaattaaaaaaatcgcgncaaacgatccccgcgaanaatacganaaaatttctcgaattcttaaacctaaaacaatacttaaaaaacgancacgaaaacgcaaaacgacaaatcgcgaaacgaaaattcatccccgaaaccgttctaaaaaacccgaaaaactcaaatcgtcaataattccgaaactaaaataaacatcgancgaatacnactttactattccaaaaaaccgactcgacaaacgacgacgacgtaaaacttaaactaaaactaaaaccgacgaaaaacaaaccgaaaaaaacaaaaaaacgtcgatacgctaaccacctattcnctccaacgaanatacgacgcgcgccnnaanttaactaaaataccgcccgnaataccgaaaataaccgatacccgtcgccaataacaccgaaacaacaactacgaactctatacgaacgacccaacaacgcgaaacnctcaacgaaataaacgaacgcgaaacaataacgacctacgataaaacctcattccgtcgcgactataaaaataaacgaaaactaaactcccaactccctaaaaaaccgaacgaaaaccctacgt

SEQ ID NO: 23719 - DNA, 675 bp, Artificial Sequence
  chemically treated genomic DNA (Homo sapiens) CpG-island No: 23719
  misc_feature (99)..(99): n is either a, c, g or t
  misc_feature (117)..(117): n is either a, c, g or t
  misc_feature (125)..(125): n is either a, c, g or t
  misc_feature (171)..(171): n is either a, c, g or t
  misc_feature (283)..(283): n is either a, c, g or t
  misc_feature (291)..(291): n is either a, c, g or t
  misc_feature (415)..(415): n is either a, c, g or t
  misc_feature (426)..(426): n is either a, c, g or t
  misc_feature (441)..(442): n is either a, c, g or t
  misc_feature (445)..(445): n is either a, c, g or t
  misc_feature (465)..(465): n is either a, c, g or t
  misc_feature (551)..(551): n is either a, c, g or t
ttaggatttgtagttttgtgtttattagatttacggagtttgtggaaaggaaggatgggataagaacgatgcgggttgggagagttaaaagggtcgcgntaaacggttttcgcgggnaatgcganaggatttttcgagtttttgagtttagagtaatgtttggggagcgantacgagggcgtagagcggtagatcgcggagcgaaagtttattttcggagtcgttttaggaaattcggaggatttaggtcgttaatgatttcggggttgaagtgggtatcgancgggtgtnattttgttgttttagggagtcggttcggtaggcggcggcgacgtggaatttgggttagggttagaatcggcgaaaagtaagtcggaaaaggtaagggggcgtcggtgcgttgattatttgtttnttttagcggangtgcgacgcgcgttnnganttggttggagtgtcgttcgnggtatcggaagtggtcgatgttcgtcgttagtgatatcgggataatagttgcgggttttgtgcgagcggtttagtagcgcggagtntttagcggagtgagcgagcgcggggtagtagcggtttgcggtgagattttatttcgtcgcggttgtgggggtaggcgggggttgggtttttagttttttagagagtcgagcggaaattttacgt

SEQ ID NO: 23720 - DNA, 675 bp, Artificial Sequence
  chemically treated genomic DNA (Homo sapiens) CpG-island No: 23720
  misc_feature (125)..(125): n is either a, c, g or t
  misc_feature (211)..(211): n is either a, c, g or t
  misc_feature (231)..(231): n is either a, c, g or t
  misc_feature (234)..(235): n is either a, c, g or t
  misc_feature (250)..(250): n is either a, c, g or t
  misc_feature (261)..(261): n is either a, c, g or t
  misc_feature (385)..(385): n is either a, c, g or t
  misc_feature (393)..(393): n is either a, c, g or t
  misc_feature (505)..(505): n is either a, c, g or t
  misc_feature (551)..(551): n is either a, c, g or t
  misc_feature (559)..(559): n is either a, c, g or t
  misc_feature (577)..(577): n is either a, c, g or t
acgtaaaatttccgctcgactctctaaaaaactaaaaacccaacccccgcctacccccacaaccgcgacgaaataaaatctcaccgcaaaccgctactaccccgcgctcgctcactccgctaaanactccgcgctactaaaccgctcgcacaaaacccgcaactattatcccgatatcactaacgacgaacatcgaccacttccgataccncgaacgacactccaaccaantcnnaacgcgcgtcgcacntccgctaaaanaaacaaataatcaacgcaccgacgcccccttaccttttccgacttacttttcgccgattctaaccctaacccaaattccacgtcgccgccgcctaccgaaccgactccctaaaacaacaaaatnacacccgntcgatacccacttcaaccccgaaatcattaacgacctaaatcctccgaatttcctaaaacgactccgaaaataaactttcgctccgcgatctaccgctctacgccctcgtantcgctccccaaacattactctaaactcaaaaactcgaaaaatcctntcgcattncccgcgaaaaccgtttancgcgacccttttaactctcccaacccgcatcgttcttatcccatccttcctttccacaaactccgtaaatctaataaacacaaaactacaaatcctaa

SEQ ID NO: 23721 - DNA, 678 bp, Artificial Sequence
  chemically treated genomic DNA (Homo sapiens) CpG-island No: 23721
atttgttcgggatttgttcgagaatattttagggagaaggtacgttcggttttgggtttggtcgagagtttagggtaggagcgtcggcggggagtttttcgggtgttggagaatgcgtgttcggaaagaagtagggcgcgtttcgtggatgtaattagggtcgtttcgcgtattttttttttattttgggatagcgtttgaattggagttgggcgtatatattttacggagttagttcgggtttttacgttttggtttattttcgttcgtcgttttaggatgtaggtgttgcggcgttttttggtagtttttcgcgttttttgggggcgcgtttttttttattttagggaagttttcggataggtgtttacgttttacgttgttcggtagaagttcgcgggtttaggtcgatttgcgcggtcgtttttttttagggagagaagttggagttttttttacgcggttttaaggcggggtcggttgggtcggagtgggcgcggttagggtgttttagcgcgttttttgtcgatcgcgcgttgcggggggtaattttattttttttggggaggtttcgttttcgttgtagggagattaaagcgtgggttcgcgattagtcggtttaggaacgaaaattttggaattaaaaataaaaaataaaattggtgagtgcgtagcgtg

SEQ ID NO: 23722 - DNA, 678 bp, Artificial Sequence
  chemically treated genomic DNA (Homo sapiens) CpG-island No: 23722
cacgctacgcactcaccaattttattttttatttttaattccaaaattttcgttcctaaaccgactaatcgcgaacccacgctttaatctccctacaacgaaaacgaaacctccccaaaaaaaataaaattaccccccgcaacgcgcgatcgacaaaaaacgcgctaaaacaccctaaccgcgcccactccgacccaaccgaccccgccttaaaaccgcgtaaaaaaaactccaacttctctccctaaaaaaaaacgaccgcgcaaatcgacctaaacccgcgaacttctaccgaacaacgtaaaacgtaaacacctatccgaaaacttccctaaaataaaaaaaaacgcgcccccaaaaaacgcgaaaaactaccaaaaaacgccgcaacacctacatcctaaaacgacgaacgaaaataaaccaaaacgtaaaaacccgaactaactccgtaaaatatatacgcccaactccaattcaaacgctatcccaaaataaaaaaaaaatacgcgaaacgaccctaattacatccacgaaacgcgccctacttctttccgaacacgcattctccaacacccgaaaaactccccgccgacgctcctaccctaaactctcgaccaaacccaaaaccgaacgtaccttctccctaaaatattctcgaacaaatcccgaacaaat

SEQ ID NO: 23723 - DNA, 678 bp, Artificial Sequence
  chemically treated genomic DNA (Homo sapiens) CpG-island No: 23723
tacgttgcgtatttattagttttattttttgtttttagttttagagttttcgtttttaaatcggttggtcgcggatttacgttttagtttttttgtagcggggacgaggtttttttaggggaggtggagttgtttttcgtagcgcgcggtcggtagggggcgcgttgggatattttggtcgcgtttatttcggtttagtcggtttcgttttagggtcgcgtgggggaagttttagtttttttttttggggagaagcggtcgcgtaagtcggtttgagttcgcgggtttttatcggatagcgtaaaacgtgggtatttgttcggggatttttttgaaatggaggaaagcgcgtttttagggagcgcgggaggttattagggagcgtcgtagtatttgtattttggggcggcgggcgggggtgagttagggcgtaagaattcgagttggtttcgtaaagtgtgtgcgtttagttttagtttaggcgttgttttagggtaggaagaaagtgcgcgagacggttttggttgtatttacgaagcgcgttttattttttttcggatacgtattttttagtattcggggagtttttcgtcggcgtttttgttttaaattttcggttaagtttaaagtcgggcgtgttttttttttagaatgttttcgagtaaatttcgaataagt

SEQ ID NO: 23724 - DNA, 678 bp, Artificial Sequence
  chemically treated genomic DNA (Homo sapiens) CpG-island No: 23724
acttattcgaaatttactcgaaaacattctaaaaaaaaaacacgcccgactttaaacttaaccgaaaatttaaaacaaaaacgccgacgaaaaactccccgaatactaaaaaatacgtatccgaaaaaaaataaaacgcgcttcgtaaatacaaccaaaaccgtctcgcgcactttcttcctaccctaaaacaacgcctaaactaaaactaaacgcacacactttacgaaaccaactcgaattcttacgccctaactcacccccgcccgccgccccaaaatacaaatactacgacgctccctaataacctcccgcgctccctaaaaacgcgctttcctccatttcaaaaaaatccccgaacaaatacccacgttttacgctatccgataaaaacccgcgaactcaaaccgacttacgcgaccgcttctccccaaaaaaaaaaactaaaacttcccccacgcgaccctaaaacgaaaccgactaaaccgaaataaacgcgaccaaaatatcccaacgcgccccctaccgaccgcgcgctacgaaaaacaactccacctcccctaaaaaaacctcgtccccgctacaaaaaaactaaaacgtaaatccgcgaccaaccgatttaaaaacgaaaactctaaaactaaaaacaaaaaataaaactaataaatacgcaacgta

SEQ ID NO: 23725 - DNA, 565 bp, Artificial Sequence
  chemically treated genomic DNA (Homo sapiens) CpG-island No: 23725
tgcgagtgtggtgagtgagaatgtggggtgtcggagtgtggagtgtgtgagtgtggagcgtggagtatggggtgttcgagtttggggtgttggagtgcggggtgtgagaatgcgggattgcggcgcgcggtagcgtgagagtttgagtttgggtgtgggagttagtatgtggggcgcggtattgcggggcgtgagtgtggggcgcgggagcgtggggtgtgggaatatgagggcgtgcgagtttcgggcgtcggagttcggcgtttagtttgcgtttcggatcgcggggttgtcggtttcggcgtttcggggttttagtttagtgcgtgggagtttggagcgcgcgagttcggcgcgttagagtttaggtcgtaggagtgtggggagtaggatcgcgagtttttgcgagttcggggcgcgggattttcgagtttcgatttcgggcgcgagattttcgttttcggatttttcggtcgggagtacgaggttcggagtgatgagcgcggagcgacggagtttcggcgcgggagttcgtttcgcgggagtttcgttttcgagttttagt

SEQ ID NO: 23726 - DNA, 565 bp, Artificial Sequence
  chemically treated genomic DNA (Homo sapiens) CpG-island No: 23726
actaaaactcgaaaacgaaactcccgcgaaacgaactcccgcgccgaaactccgtcgctccgcgctcatcactccgaacctcgtactcccgaccgaaaaatccgaaaacgaaaatctcgcgcccgaaatcgaaactcgaaaatcccgcgccccgaactcgcaaaaactcgcgatcctactccccacactcctacgacctaaactctaacgcgccgaactcgcgcgctccaaactcccacgcactaaactaaaaccccgaaacgccgaaaccgacaaccccgcgatccgaaacgcaaactaaacgccgaactccgacgcccgaaactcgcacgccctcatattcccacaccccacgctcccgcgccccacactcacgccccgcaataccgcgccccacatactaactcccacacccaaactcaaactctcacgctaccgcgcgccgcaatcccgcattctcacaccccgcactccaacaccccaaactcgaacaccccatactccacgctccacactcacacactccacactccgacaccccacattctcactcaccacactcgca

SEQ ID NO: 23727 - DNA, 565 bp, Artificial Sequence
  chemically treated genomic DNA (Homo sapiens) CpG-island No: 23727
attgagattcggggacgggattttcgcggggcgggttttcgcgtcgggatttcgtcgtttcgcgtttattatttcgaatttcgtattttcggtcggagggttcgggagcggaggtttcgcgttcgaagtcgaggttcgggggtttcgcgtttcggattcgtaggggttcgcggttttgttttttatatttttacggtttagattttgacgcgtcggattcgcgcgttttaggtttttacgtattggattgggatttcgggacgtcggggtcggtagtttcgcggttcggagcgtagattggacgtcggatttcggcgttcgaggttcgtacgtttttatatttttatattttacgttttcgcgttttatatttacgtttcgtagtgtcgcgttttatatgttgatttttatatttagatttagatttttacgttgtcgcgcgtcgtagtttcgtatttttatatttcgtattttagtattttagattcggatattttatattttacgttttatatttatatattttatatttcgatattttatatttttatttattatattcgta

SEQ ID NO: 23728 - DNA, 565 bp, Artificial Sequence
  chemically treated genomic DNA (Homo sapiens) CpG-island No: 23728
tacgaatataataaataaaaatataaaatatcgaaatataaaatatataaatataaaacgtaaaatataaaatatccgaatctaaaatactaaaatacgaaatataaaaatacgaaactacgacgcgcgacaacgtaaaaatctaaatctaaatataaaaatcaacatataaaacgcgacactacgaaacgtaaatataaaacgcgaaaacgtaaaatataaaaatataaaaacgtacgaacctcgaacgccgaaatccgacgtccaatctacgctccgaaccgcgaaactaccgaccccgacgtcccgaaatcccaatccaatacgtaaaaacctaaaacgcgcgaatccgacgcgtcaaaatctaaaccgtaaaaatataaaaaacaaaaccgcgaacccctacgaatccgaaacgcgaaacccccgaacctcgacttcgaacgcgaaacctccgctcccgaaccctccgaccgaaaatacgaaattcgaaataataaacgcgaaacgacgaaatcccgacgcgaaaacccgccccgcgaaaatcccgtccccgaatctcaat

SEQ ID NO: 23729 - DNA, 532 bp, Artificial Sequence
  chemically treated genomic DNA (Homo sapiens) CpG-island No: 23729
tagtttttcgtcgaatggggtcgcgatgttcggaagaggggttttcgttcggaggttcggcgtcggggtagtagtgtgtgtaggggcgcgtcgggaaggggggatttattttttcggaggttgatttttgttttattcggcgaattttcgttttaggaattgtattttggttttttgtcgttagtcgttattaattttttagcgcgcggcggtttagtttggtaggttgtagttttcggcggagtcgggattttttcgggggcgtttcgggagtcgtcgaggcgagcggagatcgtagagggcggatattaaattagcgggagatagaatgatttttagtagaattttagcgaataaacgttgtttttcggtcggtttcgcggcggtaggtatatttgtatatagagtgtttgggcgtgtgttgcgcgtattggacgttcgggcgtatttgtgtttagcggtgtaggagtttttatcgatttgatttttttattttaggaaaatagaaatgttggcgtttttttggtggtta

SEQ ID NO: 23730 - DNA, 532 bp, Artificial Sequence
  chemically treated genomic DNA (Homo sapiens) CpG-island No: 23730
taaccaccaaaaaaacgccaacatttctattttcctaaaataaaaaaatcaaatcgataaaaactcctacaccgctaaacacaaatacgcccgaacgtccaatacgcgcaacacacgcccaaacactctatatacaaatatacctaccgccgcgaaaccgaccgaaaaacaacgtttattcgctaaaattctactaaaaatcattctatctcccgctaatttaatatccgccctctacgatctccgctcgcctcgacgactcccgaaacgcccccgaaaaaatcccgactccgccgaaaactacaacctaccaaactaaaccgccgcgcgctaaaaaattaataacgactaacgacaaaaaaccaaaatacaattcctaaaacgaaaattcgccgaataaaacaaaaatcaacctccgaaaaaataaatccccccttcccgacgcgcccctacacacactactaccccgacgccgaacctccgaacgaaaacccctcttccgaacatcgcgaccccattcgacgaaaaacta

SEQ ID NO: 23731 - DNA, 532 bp, Artificial Sequence
  chemically treated genomic DNA (Homo sapiens) CpG-island No: 23731
tgattattaagagggcgttagtatttttgtttttttagagtgaaaaggttaaatcgatgggggtttttatatcgttggatataggtgcgttcgggcgtttagtgcgcgtaatatacgtttagatattttatatgtaaatatgtttgtcgtcgcggagtcggtcgggaggtagcgtttgttcgttggggttttgttagaagttattttgtttttcgttggtttaatattcgttttttgcggttttcgttcgtttcggcggttttcgaagcgttttcgggagggtttcggtttcgtcgaaaattgtagtttgttaggttgagtcgtcgcgcgttgggaggttaatagcgattgacgataaagggttaaggtgtaatttttaaagcggggattcgtcgggtgaggtagaaattagttttcggggagatgggtttttttttttcgacgcgtttttgtatatattgttgtttcggcgtcgggttttcgggcggggatttttttttcgggtatcgcggttttattcggcggagagtta

SEQ ID NO: 23732 - DNA, 532 bp, Artificial Sequence
  chemically treated genomic DNA (Homo sapiens) CpG-island No: 23732
taactctccgccgaataaaaccgcgatacccgaaaaaaaaatccccgcccgaaaacccgacgccgaaacaacaatatatacaaaaacgcgtcgaaaaaaaaaaacccatctccccgaaaactaatttctacctcacccgacgaatccccgctttaaaaattacaccttaaccctttatcgtcaatcgctattaacctcccaacgcgcgacgactcaacctaacaaactacaattttcgacgaaaccgaaaccctcccgaaaacgcttcgaaaaccgccgaaacgaacgaaaaccgcaaaaaacgaatattaaaccaacgaaaaacaaaataacttctaacaaaaccccaacgaacaaacgctacctcccgaccgactccgcgacgacaaacatatttacatataaaatatctaaacgtatattacgcgcactaaacgcccgaacgcacctatatccaacgatataaaaacccccatcgatttaaccttttcactctaaaaaaacaaaaatactaacgccctcttaataatca

SEQ ID NO: 23733 - DNA, 1185 bp, Artificial Sequence
  chemically treated genomic DNA (Homo sapiens) CpG-island No: 23733
tatagtaaattttatattggtttttcggggacgtttttttaaattagttttcgcgttttttcgcggcgtatacggagattttcgcgtttttatttcgtcgagtttttcgagggcgtgcgcggcggtcgcggttagggttgaggttttataagtcgtcggtcgcgttcggagttatttttgaatttacgaattgggttagaaatattacgagtcgtttcgttcgtttagacgatgagagatttaatagagttaagttttcgatttcgtcgcgtagcgggtgtttagatagtcgtagtggttcggcggggacgcgggtcgtttttcgggtttttcgttttttttcgcgttcggtcgtttcgggtttcggcgtcgcgttttgggtcgttcggggtagagttgcgcgtatgtaggtagcgcgtttttcggcgtttacgtcgttcgggtcggtttcgcgtcgtcgtcgttcggcgttttcgttcgtacgttttagtcggttttcgagggtgtcggcgtcgcggttagcgtcgttatcgttcgtacgtatatggaggttttttttcgcggtcgcgtttcgttgcggtcgggagttttatcggcgtgcggcgcgttttcgtcgagtttcgtagagtttcgcggttcgagtcgtatgggtgagagaacgcgaggttaggacgtcggcgcggttgggtcgttcgcgtttttcggtcgttcgtcgttttcgtcgtttcggttttcgcgcgggttcggaaatttttaggttattcggcgtaatttgagatatttttattttggatttttgtttttatttttaatagagttttttcgagtgacgtcgtaggtcggttttttggatacgtgtttcgggttaatggcgcggcgtcgcgcgtttacgtgacgtttcggtcgtcgttgggtgataggagtagttcgtcgttttttttttttttaaagcggtcgcgtttttcgtttcgggtgcgggagtttaggaattcggagagattttcgatcgcgttttttgcgttcgttcgcgttttttttgtcgtttcgcggtttaggggtgtgagttattcggcgatagtttcgttaggttatttcggggcgcgtaggtggatacgtataggaagatcgttatttttaagatttttatattgtttatcgtggggcgaaattttataattttttgta

SEQ ID NO: 23734 - DNA, 1185 bp, Artificial Sequence
  chemically treated genomic DNA (Homo sapiens) CpG-island No: 23734
tacaaaaaattataaaatttcgccccacgataaacaatataaaaatcttaaaaataacgatcttcctatacgtatccacctacgcgccccgaaataacctaacgaaactatcgccgaataactcacacccctaaaccgcgaaacgacaaaaaaaacgcgaacgaacgcaaaaaacgcgatcgaaaatctctccgaattcctaaactcccgcacccgaaacgaaaaacgcgaccgctttaaaaaaaaaaaaaacgacgaactactcctatcacccaacgacgaccgaaacgtcacgtaaacgcgcgacgccgcgccattaacccgaaacacgtatccaaaaaaccgacctacgacgtcactcgaaaaaactctattaaaaataaaaacaaaaatccaaaataaaaatatctcaaattacgccgaataacctaaaaatttccgaacccgcgcgaaaaccgaaacgacgaaaacgacgaacgaccgaaaaacgcgaacgacccaaccgcgccgacgtcctaacctcgcgttctctcacccatacgactcgaaccgcgaaactctacgaaactcgacgaaaacgcgccgcacgccgataaaactcccgaccgcaacgaaacgcgaccgcgaaaaaaaacctccatatacgtacgaacgataacgacgctaaccgcgacgccgacaccctcgaaaaccgactaaaacgtacgaacgaaaacgccgaacgacgacgacgcgaaaccgacccgaacgacgtaaacgccgaaaaacgcgctacctacatacgcgcaactctaccccgaacgacccaaaacgcgacgccgaaacccgaaacgaccgaacgcgaaaaaaaacgaaaaacccgaaaaacgacccgcgtccccgccgaaccactacgactatctaaacacccgctacgcgacgaaatcgaaaacttaactctattaaatctctcatcgtctaaacgaacgaaacgactcgtaatatttctaacccaattcgtaaattcaaaaataactccgaacgcgaccgacgacttataaaacctcaaccctaaccgcgaccgccgcgcacgccctcgaaaaactcgacgaaataaaaacgcgaaaatctccgtatacgccgcgaaaaaacgcgaaaactaatttaaaaaaacgtccccgaaaaaccaatataaaatttactata

SEQ ID NO: 23735 - DNA, 1185 bp, Artificial Sequence
  chemically treated genomic DNA (Homo sapiens) CpG-island No: 23735
tgtaaggaattgtgggatttcgttttacggtaaataatatggaaattttaaaaatagcgatttttttgtgcgtgtttatttacgcgtttcggggtgatttggcggggttgtcgtcgggtgatttatatttttgaatcgcgaagcgatagggaaagcgcgggcgagcgtaggagacgcggtcgggggttttttcgggtttttgggttttcgtattcggagcgggggacgcggtcgttttaaggggaggaggggcggcgggttgtttttgttatttagcggcggtcggagcgttacgtgggcgcgcggcgtcgcgttattggttcgaggtacgtgtttaggagatcggtttgcgacgttattcgagggggttttgttaaaaataagaataaaaatttagagtgaaagtgttttaggttgcgtcgagtggtttggaaattttcgagttcgcgcggaggtcgaggcggcgagggcggcggacggtcggggagcgcgggcgatttagtcgcgtcggcgttttggtttcgcgtttttttatttatgcgattcgggtcgcggagttttgcggggttcggcgggagcgcgtcgtacgtcggtggggttttcggtcgtagcggggcgcggtcgcgaggaggggtttttatgtgcgtgcgggcggtggcggcgttgatcgcggcgtcggtattttcgagggtcggttagggcgtgcgggcggggacgtcgggcggcggcggcgcggagtcggttcgggcggcgtgagcgtcggggaacgcgttgtttgtatgcgcgtagttttgtttcgggcggtttagggcgcggcgtcggagttcgaggcggtcggacgcggagaggagcggggagttcgggaggcggttcgcgttttcgtcggattattgcgattgtttagatattcgttgcgcggcgaagtcgaggatttggttttgttgaattttttatcgtttgggcgagcggggcggttcgtggtgtttttaatttagttcgtggatttaaaggtggtttcgagcgcggtcggcgatttgtaggattttagttttggtcgcggtcgtcgcgtacgttttcggaagattcggcggggtgggggcgcgggggttttcgtgtgcgtcgcgggagggcgcgaaggttgatttggaagggcgttttcggagaattagtgtgggatttattgtg

SEQ ID NO: 23736 - DNA, 1185 bp, Artificial Sequence
  chemically treated genomic DNA (Homo sapiens) CpG-island No: 23736
cacaataaatcccacactaattctccgaaaacgcccttccaaatcaaccttcgcgccctcccgcgacgcacacgaaaacccccgcgcccccaccccgccgaatcttccgaaaacgtacgcgacgaccgcgaccaaaactaaaatcctacaaatcgccgaccgcgctcgaaaccacctttaaatccacgaactaaattaaaaacaccacgaaccgccccgctcgcccaaacgataaaaaattcaacaaaaccaaatcctcgacttcgccgcgcaacgaatatctaaacaatcgcaataatccgacgaaaacgcgaaccgcctcccgaactccccgctcctctccgcgtccgaccgcctcgaactccgacgccgcgccctaaaccgcccgaaacaaaactacgcgcatacaaacaacgcgttccccgacgctcacgccgcccgaaccgactccgcgccgccgccgcccgacgtccccgcccgcacgccctaaccgaccctcgaaaataccgacgccgcgatcaacgccgccaccgcccgcacgcacataaaaacccctcctcgcgaccgcgccccgctacgaccgaaaaccccaccgacgtacgacgcgctcccgccgaaccccgcaaaactccgcgacccgaatcgcataaataaaaaaacgcgaaaccaaaacgccgacgcgactaaatcgcccgcgctccccgaccgtccgccgccctcgccgcctcgacctccgcgcgaactcgaaaatttccaaaccactcgacgcaacctaaaacactttcactctaaatttttattcttatttttaacaaaaccccctcgaataacgtcgcaaaccgatctcctaaacacgtacctcgaaccaataacgcgacgccgcgcgcccacgtaacgctccgaccgccgctaaataacaaaaacaacccgccgcccctcctccccttaaaacgaccgcgtcccccgctccgaatacgaaaacccaaaaacccgaaaaaacccccgaccgcgtctcctacgctcgcccgcgctttccctatcgcttcgcgattcaaaaatataaatcacccgacgacaaccccgccaaatcaccccgaaacgcgtaaataaacacgcacaaaaaaatcgctatttttaaaatttccatattatttaccgtaaaacgaaatcccacaattccttaca

SEQ ID NO: 23737 - DNA, 735 bp, Artificial Sequence
  chemically treated genomic DNA (Homo sapiens) CpG-island No: 23737
gaagcgcgtatgaggatcggtttcggtcgtttgttttagttgggacggcgtttcgcgttttttggggatgcggggtagtggcgtgttttttttttgcgatgttagtttcggttgtcgcgttttcgcgagtttagagttttcgttttttttttcgaacgatcgtcgtttttaaggtcggtttttttgtgcggattagacgagtttttttcggatattagtttttttcgggatggaaagtggggtattgattcgggaatttcgttttttttttagttttatttaggaatcggagagcgttcgcgattattcgtttgcggaggacggttttttatattttttaggttcgttgtataaagaggggtttcggagagggcgagtaggaaagtagtttttagacgtcgtgcgttttaggatacggacgttagttttgtaaataaaattttagtgaagcgtttcggagatatcgggcgttcggatgtcgagttaggttttcgtttttatttgaaaacgaggttagagaagggtgattttttcggtttttttgcgttttttttattcgtttcgtttttttagtttgacgtggtgatatttggaaaaatggatttaatgaaagtcgttcgttcgcggcggtttcgttattcgcggggtagagacgtttaataatttttgagagcgagatttttattttagttaaagtaggtttggttagttttgcgttttcggttgggagtcgag

SEQ ID NO: 23738 - DNA, 735 bp, Artificial Sequence
  chemically treated genomic DNA (Homo sapiens) CpG-island No: 23738
ctcgactcccaaccgaaaacgcaaaactaaccaaacctactttaactaaaataaaaatctcgctctcaaaaattattaaacgtctctaccccgcgaataacgaaaccgccgcgaacgaacgactttcattaaatccatttttccaaatatcaccacgtcaaactaaaaaaacgaaacgaataaaaaaaacgcaaaaaaaccgaaaaaatcacccttctctaacctcgttttcaaataaaaacgaaaacctaactcgacatccgaacgcccgatatctccgaaacgcttcactaaaattttatttacaaaactaacgtccgtatcctaaaacgcacgacgtctaaaaactactttcctactcgccctctccgaaacccctctttatacaacgaacctaaaaaatataaaaaaccgtcctccgcaaacgaataatcgcgaacgctctccgattcctaaataaaactaaaaaaaaaacgaaattcccgaatcaataccccactttccatcccgaaaaaaactaatatccgaaaaaaactcgtctaatccgcacaaaaaaaccgaccttaaaaacgacgatcgttcgaaaaaaaaaacgaaaactctaaactcgcgaaaacgcgacaaccgaaactaacatcgcaaaaaaaaaacacgccactaccccgcatccccaaaaaacgcgaaacgccgtcccaactaaaacaaacgaccgaaaccgatcctcatacgcgcttc

SEQ ID NO: 23739 - DNA, 735 bp, Artificial Sequence
  chemically treated genomic DNA (Homo sapiens) CpG-island No: 23739
ttcggtttttagtcgagggcgtagggttggttaggtttgttttggttgaggtggagatttcgtttttagggattgttgggcgtttttgtttcgcgagtaacgagatcgtcgcgagcgaacggtttttattgagtttatttttttaagtgttattacgttaagttagagaagcgaggcgagtggaggggacgtagaggggtcggaaaagttatttttttttggtttcgtttttagataaaaacgggagtttggttcggtattcgggcgttcggtgttttcggggcgttttattgaggttttgtttgtaaaattagcgttcgtgttttgaagcgtacggcgtttggaagttgtttttttgttcgtttttttcgaggtttttttttgtgtagcgagtttgagaaatatggaggatcgtttttcgtaagcgggtggtcgcgggcgtttttcgatttttgggtgaagttagagggaaaacggggttttcgggttagtgttttattttttatttcgggagaaattaatgttcggagagggttcgtttgattcgtatagaaaggtcgattttgagggcggcggtcgttcgggggagaaagcggaggttttgggttcgcgggagcgcggtagtcggggttggtatcgtagaggagagatacgttattgtttcgtatttttagaaagcgcgaggcgtcgttttagttggggtaggcggtcgaggtcggtttttatgcgcgtttt

SEQ ID NO: 23740 - DNA, 735 bp, Artificial Sequence
  chemically treated genomic DNA (Homo sapiens) CpG-island No: 23740
aaaacgcgcataaaaaccgacctcgaccgcctaccccaactaaaacgacgcctcgcgctttctaaaaatacgaaacaataacgtatctctcctctacgataccaaccccgactaccgcgctcccgcgaacccaaaacctccgctttctcccccgaacgaccgccgccctcaaaatcgacctttctatacgaatcaaacgaaccctctccgaacattaatttctcccgaaataaaaaataaaacactaacccgaaaaccccgttttccctctaacttcacccaaaaatcgaaaaacgcccgcgaccacccgcttacgaaaaacgatcctccatatttctcaaactcgctacacaaaaaaaaacctcgaaaaaaacgaacaaaaaaacaacttccaaacgccgtacgcttcaaaacacgaacgctaattttacaaacaaaacctcaataaaacgccccgaaaacaccgaacgcccgaataccgaaccaaactcccgtttttatctaaaaacgaaaccaaaaaaaaataacttttccgacccctctacgtcccctccactcgcctcgcttctctaacttaacgtaataacacttaaaaaaataaactcaataaaaaccgttcgctcgcgacgatctcgttactcgcgaaacaaaaacgcccaacaatccctaaaaacgaaatctccacctcaaccaaaacaaacctaaccaaccctacgccctcgactaaaaaccgaa

SEQ ID NO: 23741 - DNA, 760 bp, Artificial Sequence
  chemically treated genomic DNA (Homo sapiens) CpG-island No: 23741
tattttcgtaggaggttcggtcgtcgcgcgttcgcggtttttcgtttcgtttcggtcggttggcggttatttggtatattagcgttcgtaggatgtttaggttggttttttgtattacgtttgcgtcgcgcgagaagtagtttagcgttcggcgatttagtcggttgtatacgttgggttttcgggtcgggtttatggaggcgcgggtcgggttttgggtaggttgggtcgtcgagtggcgcgttttatattttcgtgttgggtagtcgtcgttgttttcgaatttcgaggtttagattttttcggcggggtttagggaaagttgatacggggaggcgggtagggagtattcgacggcggggcgagggaaagtagagtcgtttgtatcgttagagcgcggagagaagggaagaagtatttttttttcgatttgttttaggttttttggtcgttgatagtgcgacgtttcggtatcgcgcggtcggtcggagtcgtttttttatcgggaaatgtagtttttagtgtttcgtgaggtagttcggttttttttaggaattataattttcgttaggcggcggggagcgagggtttgttcggttttgtttttgtttgtcgcggtttcgtttttttcggttcgcggaggttgcgttgttttgcgggcgcgtttttttgtgttgcgagtggttagttgggtagagttttgggggcgcggtgttgtcgtttttaggttttcgtttcgtgtgtgcgttttgtatttagg

SEQ ID NO: 23742 - DNA, 760 bp, Artificial Sequence
  chemically treated genomic DNA (Homo sapiens) CpG-island No: 23742
cctaaatacaaaacgcacacacgaaacgaaaacctaaaaacgacaacaccgcgcccccaaaactctacccaactaaccactcgcaacacaaaaaaacgcgcccgcaaaacaacgcaacctccgcgaaccgaaaaaaacgaaaccgcgacaaacaaaaacaaaaccgaacaaaccctcgctccccgccgcctaacgaaaattataattcctaaaaaaaaccgaactacctcacgaaacactaaaaactacatttcccgataaaaaaacgactccgaccgaccgcgcgataccgaaacgtcgcactatcaacgaccaaaaaacctaaaacaaatcgaaaaaaaaatacttcttcccttctctccgcgctctaacgatacaaacgactctactttccctcgccccgccgtcgaatactccctacccgcctccccgtatcaactttccctaaaccccgccgaaaaaatctaaacctcgaaattcgaaaacaacgacgactacccaacacgaaaatataaaacgcgccactcgacgacccaacctacccaaaacccgacccgcgcctccataaacccgacccgaaaacccaacgtatacaaccgactaaatcgccgaacgctaaactacttctcgcgcgacgcaaacgtaatacaaaaaaccaacctaaacatcctacgaacgctaatataccaaataaccgccaaccgaccgaaacgaaacgaaaaaccgcgaacgcgcgacgaccgaacctcctacgaaaata

SEQ ID NO: 23743 - DNA, 760 bp, Artificial Sequence
  chemically treated genomic DNA (Homo sapiens) CpG-island No: 23743
tttaagtgtagggcgtatatacggggcggagatttggaggcggtagtatcgcgtttttagggttttgtttagttagttattcgtagtatagagaagcgcgttcgtaagatagcgtagttttcgcgggtcggaggaggcggggtcgcggtaggtagaggtagggtcgggtaagttttcgtttttcgtcgtttgacgggaattgtagtttttgggagaagtcgggttgttttacgaggtattaggaattatatttttcggtgagagagcggtttcggtcggtcgcgcggtatcggagcgtcgtattgttagcggttagagagtttggggtagatcgaaaagggagtgttttttttttttttttcgcgttttggcggtgtaagcggttttgttttttttcgtttcgtcgtcgggtgttttttgttcgttttttcgtgttagttttttttgggtttcgtcgggaaagtttgggtttcgaaattcgaaggtagcggcggttgtttagtacgggagtgtggggcgcgttattcggcggtttagtttatttagggttcggttcgcgtttttatgggttcgattcggaagtttaacgtgtgtagtcggttgagtcgtcgggcgttgggttgtttttcgcgcgacgtaggcgtggtgtagaggattaatttgggtattttgcgggcgttggtgtgttaggtgatcgttagtcggtcggggcgggacggagggtcgcgggcgcgcggcggtcgagttttttgcggggatg

SEQ ID NO: 23744 - DNA, 760 bp, Artificial Sequence
  chemically treated genomic DNA (Homo sapiens) CpG-island No: 23744
catccccgcaaaaaactcgaccgccgcgcgcccgcgaccctccgtcccgccccgaccgactaacgatcacctaacacaccaacgcccgcaaaatacccaaattaatcctctacaccacgcctacgtcgcgcgaaaaacaacccaacgcccgacgactcaaccgactacacacgttaaacttccgaatcgaacccataaaaacgcgaaccgaaccctaaataaactaaaccgccgaataacgcgccccacactcccgtactaaacaaccgccgctaccttcgaatttcgaaacccaaactttcccgacgaaacccaaaaaaaactaacacgaaaaaacgaacaaaaaacacccgacgacgaaacgaaaaaaaacaaaaccgcttacaccgccaaaacgcgaaaaaaaaaaaaaaaacactcccttttcgatctaccccaaactctctaaccgctaacaatacgacgctccgataccgcgcgaccgaccgaaaccgctctctcaccgaaaaatataattcctaatacctcgtaaaacaacccgacttctcccaaaaactacaattcccgtcaaacgacgaaaaacgaaaacttacccgaccctacctctacctaccgcgaccccgcctcctccgacccgcgaaaactacgctatcttacgaacgcgcttctctatactacgaataactaactaaacaaaaccctaaaaacgcgatactaccgcctccaaatctccgccccgtatatacgccctacacttaaa

SEQ ID NO: 23745 - DNA, 704 bp, Artificial Sequence
  chemically treated genomic DNA (Homo sapiens) CpG-island No: 23745
gtcgtttcgcgtagggtagtagtttgttgtagacgatttttttttgcgggacgaagtttcggggtttcggttcgggacgttcgttcggtttcgggggtttttcgattttcgttcgttcggtcggttttatgagtttagggatattttttttatttttttttaatacgttaataataattttattttttttcgggtttcgttttttcgcgttttcgtcgttttgcggtcgttggcgcgatcgttttcggatcgatcgttaggtttttttttttggtcggcgtgttgttgggttttacgcggtttttagttcgttggcggcggtagcggtcgttttgttcgtttcgtatcggttttgttggtgacgttgtagtcgtcgggtttagaggtttcggatcggttttaagttattttcggggcggggcggggcggagcgacggcgtcgggggaggcggtggtggcggtagttggagtttaacgggttgcgtttttttcgtcgtgggttcggttcggagtttttattttaggttttatcggtttagcgcgaggttgttttatcggaaatacgaggtcgaattttaagttattgttttgtttcgtcgggggtcgcgtattttaagcggtagtttattggagttttagtcgttacgataggcggtagttaggtcggtttggtttttttagtcgagtagtttcggtttttgggt

SEQ ID NO: 23746 - DNA, 704 bp, Artificial Sequence
  chemically treated genomic DNA (Homo sapiens) CpG-island No: 23746
acccaaaaaccgaaactactcgactaaaaaaaccaaaccgacctaactaccgcctatcgtaacgactaaaactccaataaactaccgcttaaaatacgcgacccccgacgaaacaaaacaataacttaaaattcgacctcgtatttccgataaaacaacctcgcgctaaaccgataaaacctaaaataaaaactccgaaccgaacccacgacgaaaaaaacgcaacccgttaaactccaactaccgccaccaccgcctcccccgacgccgtcgctccgccccgccccgccccgaaaataacttaaaaccgatccgaaacctctaaacccgacgactacaacgtcaccaacaaaaccgatacgaaacgaacaaaacgaccgctaccgccgccaacgaactaaaaaccgcgtaaaacccaacaacacgccgaccaaaaaaaaaaacctaacgatcgatccgaaaacgatcgcgccaacgaccgcaaaacgacgaaaacgcgaaaaaacgaaacccgaaaaaaaataaaattattattaacgtattaaaaaaaaataaaaaaaatatccctaaactcataaaaccgaccgaacgaacgaaaatcgaaaaacccccgaaaccgaacgaacgtcccgaaccgaaaccccgaaacttcgtcccgcaaaaaaaaatcgtctacaacaaactactaccctacgcgaaacgac

SEQ ID NO: 23747 - DNA, 704 bp, Artificial Sequence
  chemically treated genomic DNA (Homo sapiens) CpG-island No: 23747
atttagaagtcggggttgttcggttagggggattaggtcgatttggttgtcgtttgtcgtggcgattgggattttagtgggttgtcgtttggagtgcgcgattttcggcgaagtaggataatagtttggaattcggtttcgtgttttcggtgaggtagtttcgcgttgggtcggtgaggtttggggtgggggtttcgagtcgggtttacggcgaagaaggcgtagttcgttgggttttagttgtcgttattatcgtttttttcgacgtcgtcgtttcgtttcgtttcgtttcggaagtgatttgaggtcggttcggaatttttgggttcggcggttgtagcgttattagtagagtcggtgcggggcgggtagagcggtcgttgtcgtcgttaacgaattgagagtcgcgtggggtttagtagtacgtcggttagggaagggggtttagcgatcggttcgagggcgatcgcgttagcggtcgtagggcgacgaagacgcggaggagcggagttcggagagggatgggattattattagcgtgttgggagggggtggggggggtgtttttgggtttatggagtcggtcgagcgggcgggagtcggagagttttcggagtcgggcgggcgtttcgagtcggagtttcggggtttcgtttcgtagaaggagatcgtttataataagttgttgttttacgcggagcggt

SEQ ID NO: 23748 - DNA, 704 bp, Artificial Sequence
  chemically treated genomic DNA (Homo sapiens) CpG-island No: 23748
accgctccgcgtaaaacaacaacttattataaacgatctccttctacgaaacgaaaccccgaaactccgactcgaaacgcccgcccgactccgaaaactctccgactcccgcccgctcgaccgactccataaacccaaaaacaccccccccaccccctcccaacacgctaataataatcccatccctctccgaactccgctcctccgcgtcttcgtcgccctacgaccgctaacgcgatcgccctcgaaccgatcgctaaacccccttccctaaccgacgtactactaaaccccacgcgactctcaattcgttaacgacgacaacgaccgctctacccgccccgcaccgactctactaataacgctacaaccgccgaacccaaaaattccgaaccgacctcaaatcacttccgaaacgaaacgaaacgaaacgacgacgtcgaaaaaaacgataataacgacaactaaaacccaacgaactacgccttcttcgccgtaaacccgactcgaaacccccaccccaaacctcaccgacccaacgcgaaactacctcaccgaaaacacgaaaccgaattccaaactattatcctacttcgccgaaaatcgcgcactccaaacgacaacccactaaaatcccaatcgccacgacaaacgacaaccaaatcgacctaatccccctaaccgaacaaccccgacttctaaat

SEQ ID NO: 23749 - DNA, 750 bp, Artificial Sequence
  chemically treated genomic DNA (Homo sapiens) CpG-island No: 23749
  misc_feature (597)..(597): n is either a, c, g or t
agcgggtagggtttttggggcgtacgggtttcgggcggcgcgcgcgttttcgagttttaggtttgatagcggggcgcgcgggcgggggcgcgtgtgtcgggcgcgcgagggacgtgatcgattagtcgaggtttcgggtagtttttagggttttcgcgtacgcgcgttttttcgtttcgttttgttcgttttttcgtttatttcgcgtattgaggtttgcgcgcgtcggcgcgggaggcgggagttgggggcgggggcggtggcgacgtcgagggggaggggcgggttcggttcggttcggttcggtcgttcgcgcgcggttttaggaggtttcgggttcggttcgggcggcggtggcggtggcggttttagttcgagacgtttgtggcgttttcgtatcgcgtcgtagttatggttttggtgattttgtagcgttcgtttacgtttagcgtcgtttttttttcggttagtaatagcgaggtgagtatcgggttcgtcgcgtttcggtttgggtcgtcggacgtagcgtcgacgtcgtcggagtttggggaagcgcgtacggggtaagggggcggttgcgcgggtttttcgggtttncgtcgtaggaatagagtcgggtagtcggatcggggtgatcgtgcgaggattgtgtgcgatgtgattttgttttggggagttgtgcggggattttgtgtgcggtgtgatttttatcggggggcgattttgtagggattgtgtatgtagtgcgat

SEQ ID NO: 23750 - DNA, 750 bp, Artificial Sequence
  chemically treated genomic DNA (Homo sapiens) CpG-island No: 23750
  misc_feature (154)..(154): n is either a, c, g or t
atcgcactacatacacaatccctacaaaatcgccccccgataaaaatcacaccgcacacaaaatccccgcacaactccccaaaacaaaatcacatcgcacacaatcctcgcacgatcaccccgatccgactacccgactctattcctacgacgnaaacccgaaaaacccgcgcaaccgcccccttaccccgtacgcgcttccccaaactccgacgacgtcgacgctacgtccgacgacccaaaccgaaacgcgacgaacccgatactcacctcgctattactaaccgaaaaaaaaacgacgctaaacgtaaacgaacgctacaaaatcaccaaaaccataactacgacgcgatacgaaaacgccacaaacgtctcgaactaaaaccgccaccgccaccgccgcccgaaccgaacccgaaacctcctaaaaccgcgcgcgaacgaccgaaccgaaccgaaccgaacccgcccctccccctcgacgtcgccaccgcccccgcccccaactcccgcctcccgcgccgacgcgcgcaaacctcaatacgcgaaataaacgaaaaaacgaacaaaacgaaacgaaaaaacgcgcgtacgcgaaaaccctaaaaactacccgaaacctcgactaatcgatcacgtccctcgcgcgcccgacacacgcgcccccgcccgcgcgccccgctatcaaacctaaaactcgaaaacgcgcgcgccgcccgaaacccgtacgccccaaaaaccctacccgct

SEQ ID NO: 23751 - DNA, 750 bp, Artificial Sequence
  chemically treated genomic DNA (Homo sapiens) CpG-island No: 23751
  misc_feature (154)..(154): n is either a, c, g or t
gtcgtattgtatatatagtttttgtaaagtcgtttttcgataggggttatatcgtatataaagttttcgtatagttttttaagatagggttatatcgtatatagttttcgtacggttatttcggttcggttgttcggttttgtttttacggcgngggttcgaggagttcgcgtagtcgtttttttgtttcgtacgcgtttttttaagtttcggcggcgtcggcgttgcgttcggcggtttaggtcggggcgcggcgagttcggtgtttatttcgttgttgttggtcgaggaggaggcggcgttgggcgtgggcgagcgttgtagggttattagggttatggttgcggcgcggtgcgagggcgttatagacgtttcgagttagagtcgttatcgttatcgtcgttcgggtcgggttcggggttttttggagtcgcgcgcgggcggtcgggtcgagtcgggtcgggttcgtttttttttttcggcgtcgttatcgttttcgtttttagttttcgtttttcgcgtcggcgcgcgtaggttttagtgcgcggagtgggcggggaagcgggtagggcgggacgaggaggcgcgcgtgcgcgggggttttgagggttgttcgaggtttcggttggtcgattacgtttttcgcgcgttcgatatacgcgttttcgttcgcgcgtttcgttattaggtttgggattcgggggcgcgcgcgtcgttcggagttcgtacgttttaggggttttgttcgtt

SEQ ID NO: 23752 - DNA, 750 bp, Artificial Sequence
  chemically treated genomic DNA (Homo sapiens) CpG-island No: 23752
  misc_feature (597)..(597): n is either a, c, g or t
aacgaacaaaacccctaaaacgtacgaactccgaacgacgcgcgcgcccccgaatcccaaacctaataacgaaacgcgcgaacgaaaacgcgtatatcgaacgcgcgaaaaacgtaatcgaccaaccgaaacctcgaacaaccctcaaaacccccgcgcacgcgcgcctcctcgtcccgccctacccgcttccccgcccactccgcgcactaaaacctacgcgcgccgacgcgaaaaacgaaaactaaaaacgaaaacgataacgacgccgaaaaaaaaaaacgaacccgacccgactcgacccgaccgcccgcgcgcgactccaaaaaaccccgaacccgacccgaacgacgataacgataacgactctaactcgaaacgtctataacgccctcgcaccgcgccgcaaccataaccctaataaccctacaacgctcgcccacgcccaacgccgcctcctcctcgaccaacaacaacgaaataaacaccgaactcgccgcgccccgacctaaaccgccgaacgcaacgccgacgccgccgaaacttaaaaaaacgcgtacgaaacaaaaaaacgactacgcgaactcctcgaacccncgccgtaaaaacaaaaccgaacaaccgaaccgaaataaccgtacgaaaactatatacgatataaccctatcttaaaaaactatacgaaaactttatatacgatataacccctatcgaaaaacgactttacaaaaactatatatacaatacgac

SEQ ID NO: 23753 - DNA, 548 bp, Artificial Sequence
  chemically treated genomic DNA (Homo sapiens) CpG-island No: 23753
gtagatttcgtattcgcgcgacggatttgtttttgggatgttcgatataacggagcggatacggtagttggtttggttcgcgatgtgtatatggttatcgggtgtgatagtaagggcggcgatcgtgttgaatttggtattggtggttagatagtgtttcgtttcgaagtagtcgtaatcgcgttttaggtaattgtatttggattcggtattagtaaacggagcgattttttcgttcgtgtcgattacgcgtattcggtttattcgttgagagtcgtttttcgttacgtaaagtttatcgagtggatcgaacgcgatagattgcggtattattagggtagcgtgggtagttagattcgtatcgtaggtagtggaggttgtggcgtaatgtaggggacggtcggagatgacgcgtatacgatcgtttggtgttattcgtagattatgtggtcgtcgattatgtgtagcgtgttgtttatcggggagattgttagtttagtgggttagcgaagatgtattttttttagttttagggtttttttcgtagg

SEQ ID NO: 23754 - DNA, 548 bp, Artificial Sequence
  chemically treated genomic DNA (Homo sapiens) CpG-island No: 23754
cctacgaaaaaaaccctaaaactaaaaaaaatacatcttcgctaacccactaaactaacaatctccccgataaacaacacgctacacataatcgacgaccacataatctacgaataacaccaaacgatcgtatacgcgtcatctccgaccgtcccctacattacgccacaacctccactacctacgatacgaatctaactacccacgctaccctaataataccgcaatctatcgcgttcgatccactcgataaactttacgtaacgaaaaacgactctcaacgaataaaccgaatacgcgtaatcgacacgaacgaaaaaatcgctccgtttactaataccgaatccaaatacaattacctaaaacgcgattacgactacttcgaaacgaaacactatctaaccaccaataccaaattcaacacgatcgccgcccttactatcacacccgataaccatatacacatcgcgaaccaaaccaactaccgtatccgctccgttatatcgaacatcccaaaaacaaatccgtcgcgcgaatacgaaatctac

SEQ ID NO: 23755 - DNA, 548 bp, Artificial Sequence
  chemically treated genomic DNA (Homo sapiens) CpG-island No: 23755
tttgcgaggggaattttgaagttggaggagatgtattttcgttggtttattgagttagtagttttttcgatggataatacgttgtatataatcgacgattatatgatttgcggatgatattagacggtcgtgtgcgcgttattttcggtcgttttttatattgcgttatagtttttattgtttacgatacggatttggttatttacgttattttggtgatgtcgtagtttatcgcgttcggtttattcggtgagttttacgtggcggaaagcgatttttaacgaataaatcgggtgcgcgtgatcggtacggacggaaggatcgtttcgtttgttggtgtcgaatttaagtgtaattgtttggagcgcggttgcgattgtttcgaagcggaatattatttggttattagtgttaagtttaatacgatcgtcgtttttgttgttatattcgatagttatgtatatatcgcggattaggttaattatcgtattcgtttcgttatgtcgagtattttagaggtaagttcgtcgcgcgagtacgagatttat

SEQ ID NO: 23756 - DNA, 548 bp, Artificial Sequence
  chemically treated genomic DNA (Homo sapiens) CpG-island No: 23756
ataaatctcgtactcgcgcgacgaacttacctctaaaatactcgacataacgaaacgaatacgataattaacctaatccgcgatatatacataactatcgaatataacaacaaaaacgacgatcgtattaaacttaacactaataaccaaataatattccgcttcgaaacaatcgcaaccgcgctccaaacaattacacttaaattcgacaccaacaaacgaaacgatccttccgtccgtaccgatcacgcgcacccgatttattcgttaaaaatcgctttccgccacgtaaaactcaccgaataaaccgaacgcgataaactacgacatcaccaaaataacgtaaataaccaaatccgtatcgtaaacaataaaaactataacgcaatataaaaaacgaccgaaaataacgcgcacacgaccgtctaatatcatccgcaaatcatataatcgtcgattatatacaacgtattatccatcgaaaaaactactaactcaataaaccaacgaaaatacatctcctccaacttcaaaattcccctcgcaaa

SEQ ID NO: 23757 - DNA, 559 bp, Artificial Sequence
  chemically treated genomic DNA (Homo sapiens) CpG-island No: 23757
  misc_feature (164)..(164): n is either a, c, g or t
  misc_feature (186)..(186): n is either a, c, g or t
  misc_feature (227)..(227): n is either a, c, g or t
  misc_feature (320)..(320): n is either a, c, g or t
cgcggggtcgtcgggatattgcgttgttcgggagatatttgacgtgataggaacgtcgttagttttagttcgtcgtgattttatagtttttcggtttcggaagtgttttggtttgtcggaagtgtcggagcggttgatagagcggttgacggagtcgggtttanttaggtcgttgtcgcgagggangttgttgtgttggggtttgggtggcggttggaggtttgagnttgggttcgcggcgggggtcggtagggggtcgggtggcggaatgatggaggaggaggaattggagttcgtggaggagttggaagtcgtgttgntagtttacgttcgaggtgtagttggttatcgagtaggtaagcgtttcgttttttaggaggggaaacgggagtgcgggaggggagacggtagtttcgggcgttggggaggtcgcggcgggtggacggagggtcgggggttcgcggtagaagggaaagtggaggtggggaggtggtgcgggtgagaagcggtttttgaattagaaggaaaggaaagagaattttttttaggttttgattgt

SEQ ID NO: 23758 - DNA, 559 bp, Artificial Sequence
  chemically treated genomic DNA (Homo sapiens) CpG-island No: 23758
  misc_feature (240)..(240): n is either a, c, g or t
  misc_feature (333)..(333): n is either a, c, g or t
  misc_feature (374)..(374): n is either a, c, g or t
  misc_feature (396)..(396): n is either a, c, g or t
acaatcaaaacctaaaaaaaattctctttcctttccttctaattcaaaaaccgcttctcacccgcaccacctccccacctccactttcccttctaccgcgaacccccgaccctccgtccacccgccgcgacctccccaacgcccgaaactaccgtctcccctcccgcactcccgtttcccctcctaaaaaacgaaacgcttacctactcgataaccaactacacctcgaacgtaaactancaacacgacttccaactcctccacgaactccaattcctcctcctccatcattccgccacccgaccccctaccgacccccgccgcgaacccaanctcaaacctccaaccgccacccaaaccccaacacaacaacntccctcgcgacaacgacctaantaaacccgactccgtcaaccgctctatcaaccgctccgacacttccgacaaaccaaaacacttccgaaaccgaaaaactataaaatcacgacgaactaaaactaacgacgttcctatcacgtcaaatatctcccgaacaacgcaatatcccgacgaccccgcg

SEQ ID NO: 23759 - DNA, 559 bp, Artificial Sequence
  chemically treated genomic DNA (Homo sapiens) CpG-island No: 23759
  misc_feature (240)..(240): n is either a, c, g or t
  misc_feature (333)..(333): n is either a, c, g or t
  misc_feature (374)..(374): n is either a, c, g or t
  misc_feature (396)..(396): n is either a, c, g or t
ataattaaagtttagaaagggtttttttttttttttttttgatttagaaatcgttttttattcgtattatttttttatttttatttttttttttgtcgcgagttttcggtttttcgtttattcgtcgcggtttttttagcgttcggagttgtcgttttttttttcgtattttcgtttttttttttgaggggcggaacgtttatttgttcgatggttagttgtatttcgggcgtgagttgntagtacggtttttagtttttttacgaattttagtttttttttttttattatttcgttattcggttttttgtcgattttcgtcgcgagtttaantttaggtttttagtcgttatttaggttttagtatagtaatntttttcgcggtagcgatttggntgagttcggtttcgttagtcgttttgttagtcgtttcggtattttcggtaggttagggtattttcgggatcggggaattgtgggattacggcggattgagattggcggcgtttttgttacgttaggtgtttttcgggtaacgtagtatttcggcggtttcgcg

SEQ ID NO: 23760 - DNA, 559 bp, Artificial Sequence
  chemically treated genomic DNA (Homo sapiens) CpG-island No: 23760
  misc_feature (164)..(164): n is either a, c, g or t
  misc_feature (186)..(186): n is either a, c, g or t
  misc_feature (227)..(227): n is either a, c, g or t
  misc_feature (320)..(320): n is either a, c, g or t
cgcgaaaccgccgaaatactacgttacccgaaaaacacctaacgtaacaaaaacgccgccaatctcaatccgccgtaatcccacaattccccgatcccgaaaataccctaacctaccgaaaataccgaaacgactaacaaaacgactaacgaaaccgaactcanccaaatcgctaccgcgaaaaanattactatactaaaacctaaataacgactaaaaacctaaanttaaactcgcgacgaaaatcgacaaaaaaccgaataacgaaataataaaaaaaaaaaaactaaaattcgtaaaaaaactaaaaaccgtactancaactcacgcccgaaatacaactaaccatcgaacaaataaacgttccgcccctcaaaaaaaaaaacgaaaatacgaaaaaaaaaacgacaactccgaacgctaaaaaaaccgcgacgaataaacgaaaaaccgaaaactcgcgacaaaaaaaaaaataaaaataaaaaaataatacgaataaaaaacgatttctaaatcaaaaaaaaaaaaaaaaaaaccctttctaaactttaattat

SEQ ID NO: 23761 - DNA, 685 bp, Artificial Sequence
  chemically treated genomic DNA (Homo sapiens) CpG-island No: 23761
tagcgggtcggaggagaacggaagtttggggagattcgcgcgattcgtttggttgtattttatattttttttttcggtagttggggttacgaaggttgttttcgtcggcggtgttggaacgtggatacgtgcgttttggtaatagggtagtttttttcgcgggcgtagttttcgttgcgagcgttttcggttgttgaggcgggatcgaggattcggagatttgagtcgcgggtgggcggggaggggtttttgtgatttgttcgttttttttcggtattgtgatgtcggggggtagttgcgggttcggcgcgtttgttttcggcgtttttttttttcggtgtgttataacggcggaggcggttgtatttggagtagtcggggcgggtaggtttagttgagaggtgcgcgggcgaggatagcggtagcgatggtgaggtttttcggggttaggcgggttgcgggcgcgcggtaggcgtaggatcgagagtcgagtttacgcggaggcgtacggattcgtttttttggagtcgtagggtttaaggttttttgggggtggtagtttagggtcgaggagttcgtattttcgggcgggaatattcggtgttttttatcgtatgggggaaatagagattaggggttagttgttttttaaagggatttaagggagttttgcgtgtagacgagg

SEQ ID NO: 23762 - DNA, 685 bp, Artificial Sequence
  chemically treated genomic DNA (Homo sapiens) CpG-island No: 23762
cctcgtctacacgcaaaactcccttaaatccctttaaaaaacaactaacccctaatctctatttcccccatacgataaaaaacaccgaatattcccgcccgaaaatacgaactcctcgaccctaaactaccacccccaaaaaaccttaaaccctacgactccaaaaaaacgaatccgtacgcctccgcgtaaactcgactctcgatcctacgcctaccgcgcgcccgcaacccgcctaaccccgaaaaacctcaccatcgctaccgctatcctcgcccgcgcacctctcaactaaacctacccgccccgactactccaaatacaaccgcctccgccgttataacacaccgaaaaaaaaaaacgccgaaaacaaacgcgccgaacccgcaactaccccccgacatcacaataccgaaaaaaaacgaacaaatcacaaaaacccctccccgcccacccgcgactcaaatctccgaatcctcgatcccgcctcaacaaccgaaaacgctcgcaacgaaaactacgcccgcgaaaaaaactaccctattaccaaaacgcacgtatccacgttccaacaccgccgacgaaaacaaccttcgtaaccccaactaccgaaaaaaaaaatataaaatacaaccaaacgaatcgcgcgaatctccccaaacttccgttctcctccgacccgcta

SEQ ID NO: 23763 - DNA, 685 bp, Artificial Sequence
  chemically treated genomic DNA (Homo sapiens) CpG-island No: 23763
tttcgtttgtacgtaaagtttttttaggtttttttaaggaataattggtttttggtttttattttttttatacgataaagggtatcgggtgttttcgttcgagggtgcggatttttcgattttgaattgttatttttagaaggttttgagttttgcggttttaggaagacgggttcgtgcgttttcgcgtagattcggttttcggttttacgtttgtcgcgcgttcgtagttcgtttggtttcgggaagttttattatcgttgtcgttgttttcgttcgcgtattttttagttgggtttgttcgtttcgattgttttagatatagtcgttttcgtcgttgtgatatatcgggagggggggacgtcggggataggcgcgtcgggttcgtagttgtttttcggtattatagtgtcggggaggggcgggtaggttataaaggttttttttcgtttattcgcggtttaaattttcgggttttcggtttcgttttagtagtcgggggcgttcgtagcggggattgcgttcgcgggggaggttgttttattattaaagcgtacgtgtttacgttttaatatcgtcggcgagagtagttttcgtgattttagttgtcggagaaagaaatgtaaaatgtagttaggcgaatcgcgcgggtttttttaaattttcgttttttttcgattcgttg

SEQ ID NO: 23764 - DNA, 685 bp, Artificial Sequence
  chemically treated genomic DNA (Homo sapiens) CpG-island No: 23764
caacgaatcgaaaaaaaacgaaaatttaaaaaaacccgcgcgattcgcctaactacattttacatttctttctccgacaactaaaatcacgaaaactactctcgccgacgatattaaaacgtaaacacgtacgctttaataataaaacaacctcccccgcgaacgcaatccccgctacgaacgcccccgactactaaaacgaaaccgaaaacccgaaaatttaaaccgcgaataaacgaaaaaaaacctttataacctacccgcccctccccgacactataataccgaaaaacaactacgaacccgacgcgcctatccccgacgtccccccctcccgatatatcacaacgacgaaaacgactatatctaaaacaatcgaaacgaacaaacccaactaaaaaatacgcgaacgaaaacaacgacaacgataataaaacttcccgaaaccaaacgaactacgaacgcgcgacaaacgtaaaaccgaaaaccgaatctacgcgaaaacgcacgaacccgtcttcctaaaaccgcaaaactcaaaaccttctaaaaataacaattcaaaatcgaaaaatccgcaccctcgaacgaaaacacccgataccctttatcgtataaaaaaaataaaaaccaaaaaccaattattccttaaaaaaacctaaaaaaactttacgtacaaacgaaa

SEQ ID NO: 23765 - DNA, 881 bp, Artificial Sequence
  chemically treated genomic DNA (Homo sapiens) CpG-island No: 23765
gaggcgtcgatttcgaggaggcggtattttttttcgttgttttcgcgtatttcgatgttcgttttgtaggcgtaggcgttggttgtataggtttttttcggtgaggtgttggatttttagtagtttttgtacgatttcgaatacggtgtcgtcgagaagcgttagggttaggtcgtttagcgtggtgtaggataagcgttgttggaatgagttgcggggtagaggagcgcggtgagtttcggcgggatacgatgcggtttcggtaggtcgtcgttcgtttcgttcgcgtatttcggtaatttttttattaggttttgtaacgtcgatagtagttggtagtgtcgtttttgttgtcgggtatcgttcgttattttttttaaggcgtcggcgtagcgttttatggcgcggacgttcgttagtcgtcggttgtagcgacgagcgtttttagtttacgttatttcgatcgcggcgcgtttcgttttttttatgatagtttttagcgtagcgcgtttcgttcgttttaggatagttttcgatcgcggcgcgtttcgcgtttttttcgttttattacgcgtttcgttttttgcgttatttagaaggagacgcgtttcgttttttcgtggtggttgtaaggagggtttcgtttagttgaggttcgtatttttttgtttttcgggttattttagaggcgagatttcgtcgtttggatatcgtaggattatgtagaattttatcggtttttgttgagttattgcgggttgaggttcgggtttcgcgtcggcgcgtttgcgaggtggattgtttcggttatcggtttttttagagggaggggtttcgggttagagtttataggatttgggtttaaggtattatcgcggtcg

SEQ ID NO: 23766 - DNA, 881 bp, Artificial Sequence
  chemically treated genomic DNA (Homo sapiens) CpG-island No: 23766
cgaccgcgataataccttaaacccaaatcctataaactctaacccgaaacccctccctctaaaaaaaccgataaccgaaacaatccacctcgcaaacgcgccgacgcgaaacccgaacctcaacccgcaataactcaacaaaaaccgataaaattctacataatcctacgatatccaaacgacgaaatctcgcctctaaaataacccgaaaaacaaaaaaatacgaacctcaactaaacgaaaccctccttacaaccaccacgaaaaaacgaaacgcgtctccttctaaataacgcaaaaaacgaaacgcgtaataaaacgaaaaaaacgcgaaacgcgccgcgatcgaaaactatcctaaaacgaacgaaacgcgctacgctaaaaactatcataaaaaaaacgaaacgcgccgcgatcgaaataacgtaaactaaaaacgctcgtcgctacaaccgacgactaacgaacgtccgcgccataaaacgctacgccgacgccttaaaaaaaataacgaacgatacccgacaacaaaaacgacactaccaactactatcgacgttacaaaacctaataaaaaaattaccgaaatacgcgaacgaaacgaacgacgacctaccgaaaccgcatcgtatcccgccgaaactcaccgcgctcctctaccccgcaactcattccaacaacgcttatcctacaccacgctaaacgacctaaccctaacgcttctcgacgacaccgtattcgaaatcgtacaaaaactactaaaaatccaacacctcaccgaaaaaaacctatacaaccaacgcctacgcctacaaaacgaacatcgaaatacgcgaaaacaacgaaaaaaaataccgcctcctcgaaatcgacgcctc

SEQ ID NO: 23767 - DNA, 881 bp, Artificial Sequence
  chemically treated genomic DNA (Homo sapiens) CpG-island No: 23767
cggtcgcgatggtgttttagatttaggttttgtgggttttggttcgagatttttttttttgggaaggtcggtgatcgggatagtttatttcgtaggcgcgtcggcgcggagttcggattttagttcgtaatgatttagtaagggtcggtgggattttatatggttttgcgatatttaggcgacggagtttcgtttttaaagtggttcggggagtaggaaggtacgagttttagttgagcgaaattttttttgtagttattacggagggacggggcgcgtttttttttgaatgacgtaaggggcggggcgcgtggtggggcggggaaggcgcgaggcgcgtcgcgatcggggattgttttaagacgggcggggcgcgttgcgttagggattgttataaaaggggcgggacgcgtcgcggtcgggatgacgtgagttgggggcgttcgtcgttgtagtcggcggttagcgggcgttcgcgttatggagcgttacgtcggcgttttggaggaggtggcggacggtgttcggtagtaggagcgatattattagttgttgtcggcgttatagagtttggtgaaggagttgtcgaggtacgcgggcggggcgggcggcggtttgtcgaggtcgtatcgtgtttcgtcggggtttatcgcgtttttttatttcgtagtttattttagtagcgtttgttttatattacgttgagcgatttggttttggcgtttttcgacggtatcgtgttcgaaatcgtgtaggggttattggagatttagtattttatcgaaaagagtttgtataattagcgtttgcgtttatagaacgagtatcgaggtgcgcgggggtagcgggaggaggtgtcgttttttcggggtcggcgtttt

SEQ ID NO: 23768 - DNA, 881 bp, Artificial Sequence
  chemically treated genomic DNA (Homo sapiens) CpG-island No: 23768
aaaacgccgaccccgaaaaaacgacacctcctcccgctacccccgcgcacctcgatactcgttctataaacgcaaacgctaattatacaaactcttttcgataaaatactaaatctccaataacccctacacgatttcgaacacgataccgtcgaaaaacgccaaaaccaaatcgctcaacgtaatataaaacaaacgctactaaaataaactacgaaataaaaaaacgcgataaaccccgacgaaacacgatacgacctcgacaaaccgccgcccgccccgcccgcgtacctcgacaactccttcaccaaactctataacgccgacaacaactaataatatcgctcctactaccgaacaccgtccgccacctcctccaaaacgccgacgtaacgctccataacgcgaacgcccgctaaccgccgactacaacgacgaacgcccccaactcacgtcatcccgaccgcgacgcgtcccgccccttttataacaatccctaacgcaacgcgccccgcccgtcttaaaacaatccccgatcgcgacgcgcctcgcgccttccccgccccaccacgcgccccgccccttacgtcattcaaaaaaaaacgcgccccgtccctccgtaataactacaaaaaaaatttcgctcaactaaaactcgtaccttcctactccccgaaccactttaaaaacgaaactccgtcgcctaaatatcgcaaaaccatataaaatcccaccgacccttactaaatcattacgaactaaaatccgaactccgcgccgacgcgcctacgaaataaactatcccgatcaccgaccttcccaaaaaaaaaaatctcgaaccaaaacccacaaaacctaaatctaaaacaccatcgcgaccg

SEQ ID NO: 23769 - DNA, 766 bp, Artificial Sequence
  chemically treated genomic DNA (Homo sapiens) CpG-island No: 23769
cgttatatacgatatcgttaacgaggatattgtatacgatatcgttaacgaggtcgtcgataagggtatcgttaacgaggacgtcgtttacggtatcgttagcgaggacgtcgtttacggaatcgttagcgaggacgtcgtttacggtatcgttagcgaggacgtcgtttagggtatcgttagcgaggacgtcgtttagggtatcgttagggaggacgtcgtttagggtatcgttaaggaggacgtcgtttagggtatcgttaaggagggcgtcgtttagggtatcgttaaggaggacgtcgtttacggtatcgttaacgaggatttcgtttacggaatcgttagcgaggacgtcgtttacggtatcgttagcgaggacgtcgtttagggtatcgttaaggaggacgtcgtttagggtatcgttaacgaggacgtcgtttagggtatcgttaaggaggacgtcgtttagggtatcgttaaggaggacgtcgtttagggtatcgttaacgagggcgtcgtttagggtatcgttaaagaggacgtcgtttagggtatcgttaacgaggacgtcgtttagggtatcgttaacgaggacgtcgtttacggaatcgttagcgaggacgtcgtttacggtatcgttagcgaggacgtcgtttagggtatcgttaaggaggatgtcgtttagggtatcgttaacgaggacgtcgtttagggtatcgttaacgaggacgtcgtttagggtatcgttaaagaggacgtcgtttat

SEQ ID NO: 23770 - DNA, 766 bp, Artificial Sequence
  chemically treated genomic DNA (Homo sapiens) CpG-island No: 23770
ataaacgacgtcctctttaacgataccctaaacgacgtcctcgttaacgataccctaaacgacgtcctcgttaacgataccctaaacgacatcctccttaacgataccctaaacgacgtcctcgctaacgataccgtaaacgacgtcctcgctaacgattccgtaaacgacgtcctcgttaacgataccctaaacgacgtcctcgttaacgataccctaaacgacgtcctctttaacgataccctaaacgacgccctcgttaacgataccctaaacgacgtcctccttaacgataccctaaacgacgtcctccttaacgataccctaaacgacgtcctcgttaacgataccctaaacgacgtcctccttaacgataccctaaacgacgtcctcgctaacgataccgtaaacgacgtcctcgctaacgattccgtaaacgaaatcctcgttaacgataccgtaaacgacgtcctccttaacgataccctaaacgacgccctccttaacgataccctaaacgacgtcctccttaacgataccctaaacgacgtcctccctaacgataccctaaacgacgtcctcgctaacgataccctaaacgacgtcctcgctaacgataccgtaaacgacgtcctcgctaacgattccgtaaacgacgtcctcgctaacgataccgtaaacgacgtcctcgttaacgatacccttatcgacgacctcgttaacgatatcgtatacaatatcctcgttaacgatatcgtatataacg

SEQ ID NO: 23771 - DNA, 766 bp, Artificial Sequence
  chemically treated genomic DNA (Homo sapiens) CpG-island No: 23771
gtgggcggcgttttttttggcgatgttttgggcggcgttttcgttggcgatgttttgggcggcgttttcgttggcgatgttttgggcggtattttttttggcgatgttttggacggcgttttcgttggcgatgtcgtgggcggcgttttcgttggcgatttcgtgggcggcgttttcgttggcgatgttttgggcggcgttttcgttggcgatgttttgggcggcgttttttttggcgatgttttgggcggcgttttcgttggcgatgttttgggcggcgttttttttggcgatgttttgggcggcgttttttttggcgatgttttgggcggcgttttcgttggcgatgttttgggcggcgttttttttggcgatgttttggacggcgttttcgttggcgatgtcgtgggcggcgttttcgttggcgatttcgtgggcggagttttcgttggcgatgtcgtgggcggcgttttttttggcgatgttttgggcggcgttttttttggcgatgttttgggcggcgttttttttggcgatgttttgggcggcgttttttttggcgatgttttgggcggcgttttcgttggcgatgttttgggcggcgttttcgttggcgatgtcgtgggcggcgttttcgttggcgatttcgtgggcggcgttttcgttggcgatgtcgtgggcggcgttttcgttggcgatgtttttgtcggcggtttcgttagcgatgtcgtgtatagtattttcgttagcgatgtcgtgtgtggcg

SEQ ID NO: 23772 - DNA, 766 bp, Artificial Sequence
  chemically treated genomic DNA (Homo sapiens) CpG-island No: 23772
cgccacacacgacatcgctaacgaaaatactatacacgacatcgctaacgaaaccgccgacaaaaacatcgccaacgaaaacgccgcccacgacatcgccaacgaaaacgccgcccacgaaatcgccaacgaaaacgccgcccacgacatcgccaacgaaaacgccgcccaaaacatcgccaacgaaaacgccgcccaaaacatcgccaaaaaaaacgccgcccaaaacatcgccaaaaaaaacgccgcccaaaacatcgccaaaaaaaacgccgcccaaaacatcgccaaaaaaaacgccgcccacgacatcgccaacgaaaactccgcccacgaaatcgccaacgaaaacgccgcccacgacatcgccaacgaaaacgccgtccaaaacatcgccaaaaaaaacgccgcccaaaacatcgccaacgaaaacgccgcccaaaacatcgccaaaaaaaacgccgcccaaaacatcgccaaaaaaaacgccgcccaaaacatcgccaacgaaaacgccgcccaaaacatcgccaaaaaaaacgccgcccaaaacatcgccaacgaaaacgccgcccaaaacatcgccaacgaaaacgccgcccacgaaatcgccaacgaaaacgccgcccacgacatcgccaacgaaaacgccgtccaaaacatcgccaaaaaaaataccgcccaaaacatcgccaacgaaaacgccgcccaaaacatcgccaacgaaaacgccgcccaaaacatcgccaaaaaaaacgccgcccac

SEQ ID NO: 23773 - DNA, 838 bp, Artificial Sequence
  chemically treated genomic DNA (Homo sapiens) CpG-island No: 23773
  misc_feature (49)..(49): n is either a, c, g or t
  misc_feature (190)..(190): n is either a, c, g or t
  misc_feature (192)..(192): n is either a, c, g or t
  misc_feature (203)..(203): n is either a, c, g or t
  misc_feature (258)..(258): n is either a, c, g or t
  misc_feature (293)..(293): n is either a, c, g or t
  misc_feature (540)..(540): n is either a, c, g or t
  misc_feature (599)..(599): n is either a, c, g or t
ggcgtcggcgggttagtgttgcggcggttcgtttgagttcgcgtcgtancgtgtcggtattaggttcgttagtacgtagtttagtattttcgagggtaaattgaagaattttttttgtttaggcgttagcgagtttgtttcggtcgtgatggtgcggttttcgtttagtaggaagatacggtttttttgntncgtgtcggttngattacgcggtagcggtgttataaaagttcgatttgtattaggtatagttcgttngggcgaggtcgaagcgttgtttagcgtttattggntcgcggtggtcgtcgttttttggatttttcggtttagtcgtaggtattcgtttcgtcgttcgtttattagtttttatagttgtatcgggattatatcgggatgtacgtttacgaaggatattcgtagggttagcgaggttttcggcgtcggtatttcgggcgtcgagtatattttgacggcgcgcgcggtttttattttcggaaattaagggtcgcgttttagggtttcgaaatttttcgcgttttntgaaggcgagttttagttaaattaggtttaaaggatttagtggaggggaagaatgtcgncgaggttttttttcggtaattttttcgtcgagggtttttcgggattttcgttacggattggtaagattcggtagtttttttaatcgttcgaggtcgcgttttcgggtacgtagtttattttatttcgcgtcgttattttcggtcgcggagagtgggcggggttagtcgaggtttggggttggtttaacgtttaagggtttaaggagtttgttgggacgtttaggagatttcgaggtggg

SEQ ID NO: 23774 - DNA, 838 bp, Artificial Sequence
  chemically treated genomic DNA (Homo sapiens) CpG-island No: 23774
  misc_feature (240)..(240): n is either a, c, g or t
  misc_feature (299)..(299): n is either a, c, g or t
  misc_feature (546)..(546): n is either a, c, g or t
  misc_feature (581)..(581): n is either a, c, g or t
  misc_feature (636)..(636): n is either a, c, g or t
  misc_feature (647)..(647): n is either a, c, g or t
  misc_feature (649)..(649): n is either a, c, g or t
  misc_feature (790)..(790): n is either a, c, g or t
cccacctcgaaatctcctaaacgtcccaacaaactccttaaacccttaaacgttaaaccaaccccaaacctcgactaaccccgcccactctccgcgaccgaaaataacgacgcgaaataaaataaactacgtacccgaaaacgcgacctcgaacgattaaaaaaactaccgaatcttaccaatccgtaacgaaaatcccgaaaaaccctcgacgaaaaaattaccgaaaaaaaacctcgncgacattcttcccctccactaaatcctttaaacctaatttaactaaaactcgccttcanaaaacgcgaaaaatttcgaaaccctaaaacgcgacccttaatttccgaaaataaaaaccgcgcgcgccgtcaaaatatactcgacgcccgaaataccgacgccgaaaacctcgctaaccctacgaatatccttcgtaaacgtacatcccgatataatcccgatacaactataaaaactaataaacgaacgacgaaacgaatacctacgactaaaccgaaaaatccaaaaaacgacgaccaccgcganccaataaacgctaaacaacgcttcgacctcgcccnaacgaactatacctaatacaaatcgaacttttataacaccgctaccgcgtaatcnaaccgacacgnancaaaaaaaccgtatcttcctactaaacgaaaaccgcaccatcacgaccgaaacaaactcgctaacgcctaaacaaaaaaaattcttcaatttaccctcgaaaatactaaactacgtactaacgaacctaataccgacacgntacgacgcgaactcaaacgaaccgccgcaacactaacccgccgacgcc

SEQ ID NO: 23775 - DNA, 838 bp, Artificial Sequence
  chemically treated genomic DNA (Homo sapiens) CpG-island No: 23775
  misc_feature (240)..(240): n is either a, c, g or t
  misc_feature (299)..(299): n is either a, c, g or t
  misc_feature (546)..(546): n is either a, c, g or t
  misc_feature (581)..(581): n is either a, c, g or t
  misc_feature (636)..(636): n is either a, c, g or t
  misc_feature (647)..(647): n is either a, c, g or t
  misc_feature (649)..(649): n is either a, c, g or t
  misc_feature (790)..(790): n is either a, c, g or t
tttatttcggggttttttgaacgttttaataagttttttgggtttttaggcgttaggttaattttaggtttcggttggtttcgtttatttttcgcggtcggaagtggcggcgcggagtgaggtaaattgcgtgttcggaagcgcgatttcgggcggttggaggggttatcgggttttattagttcgtggcgggagtttcggaggattttcgacgggggagttgtcgagaaaaggtttcgncggtattttttttttttattgggttttttgaatttagtttggttgggattcgtttttanggggcgcggaggatttcgaggttttgaggcgcggtttttaattttcggaagtgggggtcgcgcgcgtcgttaagatgtgttcgacgttcggaatgtcggcgtcgggggtttcgttggttttgcgggtgtttttcgtggacgtgtatttcgatgtgatttcggtgtagttgtgggggttggtgggcgagcggcggggcgagtatttgcggttgagtcgggaaatttaggaagcggcggttatcgcggnttagtgggcgttgggtagcgtttcggtttcgtttnggcgagttgtgtttggtgtaggtcgggtttttgtggtatcgttgtcgcgtggttnagtcggtacgnantaggagagtcgtgtttttttgttggacgagggtcgtattattacggtcggagtaggttcgttggcgtttgggtagagagagttttttaatttgttttcggaagtgttgggttgcgtgttagcgggtttggtgtcggtacgntgcggcgcgggtttaggcgagtcgtcgtagtattggttcgtcgacgtt

SEQ ID NO: 23776 - DNA, 838 bp, Artificial Sequence
  chemically treated genomic DNA (Homo sapiens) CpG-island No: 23776
  misc_feature (49)..(49): n is either a, c, g or t
  misc_feature (190)..(190): n is either a, c, g or t
  misc_feature (192)..(192): n is either a, c, g or t
  misc_feature (203)..(203): n is either a, c, g or t
  misc_feature (258)..(258): n is either a, c, g or t
  misc_feature (293)..(293): n is either a, c, g or t
  misc_feature (540)..(540): n is either a, c, g or t
  misc_feature (599)..(599): n is either a, c, g or t
aacgtcgacgaaccaatactacgacgactcgcctaaacccgcgccgcancgtaccgacaccaaacccgctaacacgcaacccaacacttccgaaaacaaattaaaaaactctctctacccaaacgccaacgaacctactccgaccgtaataatacgaccctcgtccaacaaaaaaacacgactctcctantncgtaccgactnaaccacgcgacaacgataccacaaaaacccgacctacaccaaacacaactcgccnaaacgaaaccgaaacgctacccaacgcccactaanccgcgataaccgccgcttcctaaatttcccgactcaaccgcaaatactcgccccgccgctcgcccaccaacccccacaactacaccgaaatcacatcgaaatacacgtccacgaaaaacacccgcaaaaccaacgaaacccccgacgccgacattccgaacgtcgaacacatcttaacgacgcgcgcgacccccacttccgaaaattaaaaaccgcgcctcaaaacctcgaaatcctccgcgccccntaaaaacgaatcccaaccaaactaaattcaaaaaacccaataaaaaaaaaaaataccgncgaaaccttttctcgacaactcccccgtcgaaaatcctccgaaactcccgccacgaactaataaaacccgataacccctccaaccgcccgaaatcgcgcttccgaacacgcaatttacctcactccgcgccgccacttccgaccgcgaaaaataaacgaaaccaaccgaaacctaaaattaacctaacgcctaaaaacccaaaaaacttattaaaacgttcaaaaaaccccgaaataaa

SEQ ID NO: 23777 - DNA, 541 bp, Artificial Sequence
  chemically treated genomic DNA (Homo sapiens) CpG-island No: 23777
  misc_feature (116)..(116): n is either a, c, g or t
gtatgtaatttttcgtattttgtatttatcgttcgtttatcgtttcgcgttttaaattcgattcgatttatcgaatcgtatacgaattatttttcgatattaatttatcgtttttntttcgtttatcgattcggtatttttttttcgttttcgagcgcgattattatttttgagatgtttatatttttttttacgattatttgttttcgcgtatttgttttaacggttatattagttttgcgtttaattagttttttagatcgcgatttttttattttttatttcggttttcggcgattcgtttttttgtaaatcgcgatatggagtttttatttgcgttatcgtgaatttcgtattgtttttttcgatttttgtattcgatttgcgattttttattcgtttattattcgagttggatgcggattttaaatttaaacgtttttaatcgtaatatttttattgtattttttcgtattttttttaatgtttgtttcgaattaatcgtacgtatttatcgatataatcgcgaatttttttcgta

SEQ ID NO: 23778 - DNA, 541 bp, Artificial Sequence
  chemically treated genomic DNA (Homo sapiens) CpG-island No: 23778
  misc_feature (426)..(426): n is either a, c, g or t
tacgaaaaaaattcgcgattatatcgataaatacgtacgattaattcgaaacaaacattaaaaaaaatacgaaaaaatacaataaaaatattacgattaaaaacgtttaaatttaaaatccgcatccaactcgaataataaacgaataaaaaatcgcaaatcgaatacaaaaatcgaaaaaaacaatacgaaattcacgataacgcaaataaaaactccatatcgcgatttacaaaaaaacgaatcgccgaaaaccgaaataaaaaataaaaaaatcgcgatctaaaaaactaattaaacgcaaaactaatataaccgttaaaacaaatacgcgaaaacaaataatcgtaaaaaaaaatataaacatctcaaaaataataatcgcgctcgaaaacgaaaaaaaaataccgaatcgataaacgaaanaaaaacgataaattaatatcgaaaaataattcgtatacgattcgataaatcgaatcgaatttaaaacgcgaaacgataaacgaacgataaatacaaaatacgaaaaattacatac

SEQ ID NO: 23779 - DNA, 541 bp, Artificial Sequence
  chemically treated genomic DNA (Homo sapiens) CpG-island No: 23779
  misc_feature (426)..(426): n is either a, c, g or t
tacgaggagaattcgcggttgtgtcggtggatgcgtgcgattgattcgaagtaggtattagaaaagatgcgagagagtgtagtgggaatgttgcgattaggagcgtttgggtttgaggttcgtatttagttcgagtggtggacgggtgggaaatcgtaagtcgggtgtagaggtcgggaggagtaatacgaagtttacgatgacgtaagtagaagttttatatcgcggtttgtagagagacggatcgtcgagagtcgaaatgggaggtgagaagatcgcggtttgaggagttagttagacgtagagttgatatggtcgttggagtagatacgcggagataggtgatcgtgaaggagagtgtgagtattttaggagtggtagtcgcgttcggaggcggaaagaggatatcgagtcggtgagcgaagnggggacggtaggttggtatcgaggagtggttcgtatacggttcgataagtcgagtcggatttagagcgcgaggcgataagcgaacgatgggtgtagaatgcgaggaattgtatgt

SEQ ID NO: 23780 - DNA, 541 bp, Artificial Sequence
  chemically treated genomic DNA (Homo sapiens) CpG-island No: 23780
  misc_feature (116)..(116): n is either a, c, g or t
acatacaattcctcgcattctacacccatcgttcgcttatcgcctcgcgctctaaatccgactcgacttatcgaaccgtatacgaaccactcctcgataccaacctaccgtccccncttcgctcaccgactcgatatcctctttccgcctccgaacgcgactaccactcctaaaatactcacactctccttcacgatcacctatctccgcgtatctactccaacgaccatatcaactctacgtctaactaactcctcaaaccgcgatcttctcacctcccatttcgactctcgacgatccgtctctctacaaaccgcgatataaaacttctacttacgtcatcgtaaacttcgtattactcctcccgacctctacacccgacttacgatttcccacccgtccaccactcgaactaaatacgaacctcaaacccaaacgctcctaatcgcaacattcccactacactctctcgcatcttttctaatacctacttcgaatcaatcgcacgcatccaccgacacaaccgcgaattctcctcgta

SEQ ID NO: 23781 - DNA, 755 bp, Artificial Sequence
  chemically treated genomic DNA (Homo sapiens) CpG-island No: 23781
ttttggtcgaattcgatttttttatttttcgtatttcgtttcgaatttcgcgacggtttttttttatcgttcggatttggttatcgtttatttcgtttttttataattttatttttatattcggtgtttttattttacgtatatttttttcgtcgattttcgtttttttttcggatagtatttttttgtttagttttttcgttcgatgtcggtcgttcgcgcgtttttcgcgttttttttcgttttttttttcgcgttttaggttttcgtatttggattttttttttttttttttatttttgcgttcgatatttttttttttcgtattttttcgcgcgttttcgttcgttattgttttttttttttttttgtatttatttttcgtcggtcgtttcgtgcgtcgacgtttatcgcgtttcgttcgtcgttggattcgtgtttttttcgcggtcgtttatttttttttttcgttttttatttttttttcgttttatttgtttttttgtcgtcgttttcgttagttttttgttttttcgttcgcgttatcgtcgtttttacgtcgtttcggtttttttttttcgaattcggtatttcggtttatattttttttttttattgttcgtagattttatttttcgtacgtatttttgttttttttacgtttttatgattcgttggcgtcgttttttatatttcgtttttttgagttttcgttttattttattttgttattttttttcgtttcgttttttttt

SEQ ID NO: 23782 - DNA, 755 bp, Artificial Sequence
  chemically treated genomic DNA (Homo sapiens) CpG-island No: 23782
aaaaaaaaacgaaacgaaaaaaaataacaaaataaaataaaacgaaaactcaaaaaaacgaaatataaaaaacgacgccaacgaatcataaaaacgtaaaaaaaacaaaaatacgtacgaaaaataaaatctacgaacaataaaaaaaaaaaatataaaccgaaataccgaattcgaaaaaaaaaaaccgaaacgacgtaaaaacgacgataacgcgaacgaaaaaacaaaaaactaacgaaaacgacgacaaaaaaacaaataaaacgaaaaaaaaataaaaaacgaaaaaaaaaaataaacgaccgcgaaaaaaacacgaatccaacgacgaacgaaacgcgataaacgtcgacgcacgaaacgaccgacgaaaaataaatacaaaaaaaaaaaaaaaacaataacgaacgaaaacgcgcgaaaaaatacgaaaaaaaaaaatatcgaacgcaaaaataaaaaaaaaaaaaaaaaatccaaatacgaaaacctaaaacgcgaaaaaaaaaacgaaaaaaaacgcgaaaaacgcgcgaacgaccgacatcgaacgaaaaaactaaacaaaaaaatactatccgaaaaaaaaacgaaaatcgacgaaaaaaatatacgtaaaataaaaacaccgaatataaaaataaaattataaaaaaacgaaataaacgataaccaaatccgaacgataaaaaaaaaccgtcgcgaaattcgaaacgaaatacgaaaaataaaaaaatcgaattcgaccaaaa

SEQ ID NO: 23783 - DNA, 755 bp, Artificial Sequence
  chemically treated genomic DNA (Homo sapiens) CpG-island No: 23783
gggaggagacggagcgaggggaggtagtaggatagagtggagcgagggtttaaggaggcgaggtgtgagaggcggcgttagcgggttatgagagcgtgggagaggtagggatgcgtgcggggggtgagatttgcgggtagtgagggagaggggtgtagatcgaggtatcggattcgagagaggaaggtcggagcggcgtagaggcggcggtggcgcgggcgggaggatagagggttggcggggacggcggtagggaggtaaatagggcgaaggaggagtggggagcgagggaaggggatgggcggtcgcgagaggagtacgggtttagcggcgggcgaggcgcggtaggcgtcggcgtacgaaacgatcggcgagaggtaggtgtagggaagggaggggggtagtagcgagcggaggcgcgcgaggagatgcgggggagaggaatgtcgggcgtaggggtgggagagagggggggaggtttagatgcgggagtttggagcgcggaggagggggcgggagagagcgcgagggacgcgcgagcggtcggtatcgggcgggagaattaagtaggggaatgttgttcgaaaaaggagcgagggtcggcgaaaaggatgtacgtgaggtaagagtatcgggtatgagagtgaggttataggagggcgaggtaggcgatgattaagttcgagcgatagaggggagtcgtcgcgaaattcgagacggggtacgggaagtagaagggtcgggttcggttaggg

SEQ ID NO: 23784 - DNA, 755 bp, Artificial Sequence
  chemically treated genomic DNA (Homo sapiens) CpG-island No: 23784
ccctaaccgaacccgacccttctacttcccgtaccccgtctcgaatttcgcgacgactcccctctatcgctcgaacttaatcatcgcctacctcgccctcctataacctcactctcatacccgatactcttacctcacgtacatccttttcgccgaccctcgctcctttttcgaacaacattcccctacttaattctcccgcccgataccgaccgctcgcgcgtccctcgcgctctctcccgccccctcctccgcgctccaaactcccgcatctaaacctccccccctctctcccacccctacgcccgacattcctctcccccgcatctcctcgcgcgcctccgctcgctactacccccctcccttccctacacctacctctcgccgatcgtttcgtacgccgacgcctaccgcgcctcgcccgccgctaaacccgtactcctctcgcgaccgcccatccccttccctcgctccccactcctccttcgccctatttacctccctaccgccgtccccgccaaccctctatcctcccgcccgcgccaccgccgcctctacgccgctccgaccttcctctctcgaatccgatacctcgatctacacccctctccctcactacccgcaaatctcaccccccgcacgcatccctacctctcccacgctctcataacccgctaacgccgcctctcacacctcgcctccttaaaccctcgctccactctatcctactacctcccctcgctccgtctcctccc

SEQ ID NO: 23785 - DNA, 785 bp, Artificial Sequence
  chemically treated genomic DNA (Homo sapiens) CpG-island No: 23785
ttcgcgttgtcgtcgttcgttttttgcgttttttcgcggagtttgggttcgggagggggaaggtaggggcggcggggggcgggagagtttggcgagcggacgttagttttgaggaaatttattaattcgtgagtttcggagttcggggtgtatatcggtttagtcgtagcgtcggcggcggcggcggtagtagtacgaaggggtttagtcggggtaggcgggggcggtgtcggtgtcgcgggggcgggttcgatcgtttcgtttagaagttgtagggtttggtttttcgcgattttgtttttttttttttcgtttttttgatttagttgcgcggtttcggttcgggagttgtcgaattcgcgttttttttgggtgaggaggatacgtttgttttcgtcgagaaaattttttttgtcgatttagttggggcggcggtggtaggaagtgcgggtagcgatttttttttcgtttgtttcgcgcgttttgtcggaggtcggcgttgagtttgcgattaagtttgtgggggtttttttttttagttgtcggcgagtttcgtttcgagaggggcgttcgatttcggggagggcggtaggttagggcgaaggttaagggcgtgtggtggcgtcggagattaggtgcggagtaaggcggggattcgtattcgtattcgagagcgcggaggtcgcgtagttcgggagaagggagttttcggcggttgttttttagagtttatagtgcgttgttttttttggttgaggagagtgttttggtttcgagtttatcga

SEQ ID NO: 23786 - DNA, 785 bp, Artificial Sequence
  chemically treated genomic DNA (Homo sapiens) CpG-island No: 23786
tcgataaactcgaaaccaaaacactctcctcaaccaaaaaaaacaacgcactataaactctaaaaaacaaccgccgaaaactcccttctcccgaactacgcgacctccgcgctctcgaatacgaatacgaatccccgccttactccgcacctaatctccgacgccaccacacgcccttaaccttcgccctaacctaccgccctccccgaaatcgaacgcccctctcgaaacgaaactcgccgacaactaaaaaaaaaaacccccacaaacttaatcgcaaactcaacgccgacctccgacaaaacgcgcgaaacaaacgaaaaaaaaatcgctacccgcacttcctaccaccgccgccccaactaaatcgacaaaaaaaattttctcgacgaaaacaaacgtatcctcctcacccaaaaaaaacgcgaattcgacaactcccgaaccgaaaccgcgcaactaaatcaaaaaaacgaaaaaaaaaaaaacaaaatcgcgaaaaaccaaaccctacaacttctaaacgaaacgatcgaacccgcccccgcgacaccgacaccgcccccgcctaccccgactaaaccccttcgtactactaccgccgccgccgccgacgctacgactaaaccgatatacaccccgaactccgaaactcacgaattaataaatttcctcaaaactaacgtccgctcgccaaactctcccgccccccgccgcccctaccttccccctcccgaacccaaactccgcgaaaaaacgcaaaaaacgaacgacgacaacgcgaa

SEQ ID NO: 23787 - DNA, 785 bp, Artificial Sequence
  chemically treated genomic DNA (Homo sapiens) CpG-island No: 23787
tcgatagattcggggttaggatattttttttagttaaaggagatagcgtattgtggattttaggaagtagtcgtcggaggtttttttttttcgggttgcgcgattttcgcgttttcggatgcgggtgcgagttttcgttttgtttcgtatttagttttcggcgttattatacgtttttggttttcgttttggtttgtcgtttttttcggggtcgggcgtttttttcgaggcgagattcgtcggtaattgggaaggggggtttttataaatttgatcgtaagtttagcgtcgattttcggtagggcgcgcggggtaggcggaggagaggtcgttgttcgtattttttgttatcgtcgttttaattgagtcggtaggaaaagttttttcgacgagggtaggcgtgttttttttatttaggggaggcgcgggttcggtagttttcgggtcggggtcgcgtagttaggttagagaagcggaggggaaaggaataagatcgcgaggagttaagttttataatttttgggcgggacggtcgggttcgttttcgcggtatcggtatcgttttcgtttatttcgattgagttttttcgtgttgttgtcgtcgtcgtcgtcgacgttgcggttgggtcgatgtgtatttcggatttcggggtttacggattgatgagtttttttagagttagcgttcgttcgttagattttttcgtttttcgtcgtttttattttttttttttcggatttaggtttcgcggggaggcgtagggggcgggcggcggtaacgcgga

SEQ ID NO: 23788 - DNA, 785 bp, Artificial Sequence
  chemically treated genomic DNA (Homo sapiens) CpG-island No: 23788
tccgcgttaccgccgcccgccccctacgcctccccgcgaaacctaaatccgaaaaaaaaaaaataaaaacgacgaaaaacgaaaaaatctaacgaacgaacgctaactctaaaaaaactcatcaatccgtaaaccccgaaatccgaaatacacatcgacccaaccgcaacgtcgacgacgacgacgacaacaacacgaaaaaactcaatcgaaataaacgaaaacgataccgataccgcgaaaacgaacccgaccgtcccgcccaaaaattataaaacttaactcctcgcgatcttattcctttcccctccgcttctctaacctaactacgcgaccccgacccgaaaactaccgaacccgcgcctcccctaaataaaaaaaacacgcctaccctcgtcgaaaaaacttttcctaccgactcaattaaaacgacgataacaaaaaatacgaacaacgacctctcctccgcctaccccgcgcgccctaccgaaaatcgacgctaaacttacgatcaaatttataaaaaccccccttcccaattaccgacgaatctcgcctcgaaaaaaacgcccgaccccgaaaaaaacgacaaaccaaaacgaaaaccaaaaacgtataataacgccgaaaactaaatacgaaacaaaacgaaaactcgcacccgcatccgaaaacgcgaaaatcgcgcaacccgaaaaaaaaaaacctccgacgactacttcctaaaatccacaatacgctatctcctttaactaaaaaaaatatcctaaccccgaatctatcga

SEQ ID NO: 23789 - DNA, 834 bp, Artificial Sequence
  chemically treated genomic DNA (Homo sapiens) CpG-island No: 23789
  misc_feature (808)..(808): n is either a, c, g or t
taatttgtttttttaaggttcgttagtatcgattttatattgcgcgttagttcgttttgcgtggtgttgatcgtttttttttacgtatcgtattgtgtttcgtttcggttgtcgttcggggtgataacggtagttaggtcgtttgcggcgttgtatttatatcgcgttttacggttttgtgcgttttttatcgaggttaatcggttacggttgttatagcggcggtaaaggttgatgtttttttcgcggtggatcgtcgttatttggtcgaagcggtcgtatttataacgggtttggtagttcgagtagtcggtgaacgttagtaattgttcgtagcggttttaggttatttgtcgggtgttgttcgtcgtattcgttgtcgtcgtcggtaatttattgtgcgcgttatcgtagcggtagcgtattgttttttcgttgcgcgatgttttcgatattagtttgttcggtttattatattttcggcggttttttagttcgttcggggatattatcgtcgttagttggttttcgtcgttatagtaaaatttcgtttttcgttcgttcggtgtggtgatgttcgtgatatcggcggatattatatttagacggattttgttttcgtttcgtcgcgtcgtttgttcgtgagttttttgtcgggtatttcgttgcgcgtgatttgtcgtcgttagttttttttatattcggttatcgggttcgtttttggtgtagattttagcgggttaggttgcgggacgggagcggtttgttttaattagagagattttttttttattattattttacgtantatttttaaaggaacgataaggagga

SEQ ID NO: 23790 - DNA, 834 bp, Artificial Sequence
  chemically treated genomic DNA (Homo sapiens) CpG-island No: 23790
  misc_feature (27)..(27): n is either a, c, g or t
tcctccttatcgttcctttaaaaatantacgtaaaataataataaaaaaaaaatctctctaattaaaacaaaccgctcccgtcccgcaacctaacccgctaaaatctacaccaaaaacgaacccgataaccgaatataaaaaaaactaacgacgacaaatcacgcgcaacgaaatacccgacaaaaaactcacgaacaaacgacgcgacgaaacgaaaacaaaatccgtctaaatataatatccgccgatatcacgaacatcaccacaccgaacgaacgaaaaacgaaattttactataacgacgaaaaccaactaacgacgataatatccccgaacgaactaaaaaaccgccgaaaatataataaaccgaacaaactaatatcgaaaacatcgcgcaacgaaaaaacaatacgctaccgctacgataacgcgcacaataaattaccgacgacgacaacgaatacgacgaacaacacccgacaaataacctaaaaccgctacgaacaattactaacgttcaccgactactcgaactaccaaacccgttataaatacgaccgcttcgaccaaataacgacgatccaccgcgaaaaaaacatcaacctttaccgccgctataacaaccgtaaccgattaacctcgataaaaaacgcacaaaaccgtaaaacgcgatataaatacaacgccgcaaacgacctaactaccgttatcaccccgaacgacaaccgaaacgaaacacaatacgatacgtaaaaaaaaacgatcaacaccacgcaaaacgaactaacgcgcaatataaaatcgatactaacgaaccttaaaaaaacaaatta

SEQ ID NO: 23791 - DNA, 834 bp, Artificial Sequence
  chemically treated genomic DNA (Homo sapiens) CpG-island No: 23791
  misc_feature (27)..(27): n is either a, c, g or t
ttttttttatcgtttttttaagaatantgcgtgagataatagtgagaagggagtttttttgattgaaataggtcgttttcgtttcgtagtttgattcgttgaggtttgtattagaagcgggttcggtgatcgggtgtgaaaaagattggcgacggtaggttacgcgtagcgggatattcggtagaaggtttacgggtaaacgacgcggcgggacgagaatagagttcgtttgaatgtggtgttcgtcgatattacggatattattatatcggacgggcgggagacgaaattttattataacgacgggaattagttgacggcggtggtgttttcggacgggttggagagtcgtcgggaatatgatgaatcgggtaggttggtatcggagatatcgcgtagcggggagatagtacgttatcgttacgatgacgcgtatagtgagttatcggcgacgataacggatgcgacgggtagtattcggtagatgatttggagtcgttacgggtagttgttggcgtttatcgattgttcgggttattagattcgttatgaatacgatcgtttcggttagatgacggcggtttatcgcgaggaaggtattagtttttatcgtcgttatgataatcgtggtcggttaatttcggtgaaagacgtatagggtcgtgaaacgcggtatgaatataacgtcgtaggcgatttgattgtcgttattatttcggacggtaatcggagcgagatatagtacgatgcgtggggaaaggcggttagtattacgtagggcgggttgacgcgtagtatggagtcgatgttggcggattttagaggaatagattg

SEQ ID NO: 23792 - DNA, 834 bp, Artificial Sequence
  chemically treated genomic DNA (Homo sapiens) CpG-island No: 23792
  misc_feature (808)..(808): n is either a, c, g or t
caatctattcctctaaaatccgccaacatcgactccatactacgcgtcaacccgccctacgtaatactaaccgcctttccccacgcatcgtactatatctcgctccgattaccgtccgaaataataacgacaatcaaatcgcctacgacgttatattcataccgcgtttcacgaccctatacgtctttcaccgaaattaaccgaccacgattatcataacgacgataaaaactaataccttcctcgcgataaaccgccgtcatctaaccgaaacgatcgtattcataacgaatctaataacccgaacaatcgataaacgccaacaactacccgtaacgactccaaatcatctaccgaatactacccgtcgcatccgttatcgtcgccgataactcactatacgcgtcatcgtaacgataacgtactatctccccgctacgcgatatctccgataccaacctacccgattcatcatattcccgacgactctccaacccgtccgaaaacaccaccgccgtcaactaattcccgtcgttataataaaatttcgtctcccgcccgtccgatataataatatccgtaatatcgacgaacaccacattcaaacgaactctattctcgtcccgccgcgtcgtttacccgtaaaccttctaccgaatatcccgctacgcgtaacctaccgtcgccaatctttttcacacccgatcaccgaacccgcttctaatacaaacctcaacgaatcaaactacgaaacgaaaacgacctatttcaatcaaaaaaactcccttctcactattatctcacgcantattcttaaaaaaacgataaaaaaaa

SEQ ID NO: 23793 - DNA, 587 bp, Artificial Sequence
  chemically treated genomic DNA (Homo sapiens) CpG-island No: 23793
cgtcgtaatttggtgggtgtcgaagtggcgatgattttttaggattcgatgattagttttaattcgtgttatatcgtgggtttttagattatggaagcgattaaggtgtattagggcggtaataaaagtattcgtcgttagcgagcgattgatttgttgaattaggtcggtattttcgattcggtatcgcgtttggatgtttattcgtattagtttttcggcggtatgagttagcgcgtgatgatcgttatggcgattgtttgtcggttaaaattgttgattgtcgatgaatcgattatcgcgttggacggggattattttagcgttaattatcgaattattgttggagttataatagaaagagaatatggcgttggggtttattatttatgatttggcgttggtggcggtagcggtatattaaattattgggatgtatgtaagttagggggtggaaacggtgatgcgtacgtattttttatgcgcgcgttattcgtataattaggtattgttggtgcggttgtagaatttgttaagataaagaacgttggggtgggttgatggttattttttaagcgacgacgcgt

SEQ ID NO: 23794 - DNA, 587 bp, Artificial Sequence
  chemically treated genomic DNA (Homo sapiens) CpG-island No: 23794
acgcgtcgtcgcttaaaaaataaccatcaacccaccccaacgttctttatcttaacaaattctacaaccgcaccaacaatacctaattatacgaataacgcgcgcataaaaaatacgtacgcatcaccgtttccaccccctaacttacatacatcccaataatttaatataccgctaccgccaccaacgccaaatcataaataataaaccccaacgccatattctctttctattataactccaacaataattcgataattaacgctaaaataatccccgtccaacgcgataatcgattcatcgacaatcaacaattttaaccgacaaacaatcgccataacgatcatcacgcgctaactcataccgccgaaaaactaatacgaataaacatccaaacgcgataccgaatcgaaaataccgacctaattcaacaaatcaatcgctcgctaacgacgaatacttttattaccgccctaatacaccttaatcgcttccataatctaaaaacccacgatataacacgaattaaaactaatcatcgaatcctaaaaaatcatcgccacttcgacacccaccaaattacgacg

SEQ ID NO: 23795 - DNA, 587 bp, Artificial Sequence
  chemically treated genomic DNA (Homo sapiens) CpG-island No: 23795
acgcgtcgtcgtttaaaggatagttattagtttattttagcgttttttgttttaataaattttgtagtcgtattaataatgtttgattatacgggtaacgcgcgtatggaagatgcgtgcgtattatcgtttttattttttggtttgtatatattttaatgatttaatgtgtcgttatcgttattagcgttaggttatgggtaataaattttagcgttatgttttttttttgttgtagttttagtagtagttcgatgattggcgttagaatggttttcgtttagcgcggtggtcggtttatcggtaattagtagttttggtcgataggtaatcgttatggcgattattacgcgttggtttatgtcgtcggaaagttgatgcgggtaaatatttagacgcgatgtcggatcgggaatatcgatttgatttagtaggttaatcgttcgttgacggcgggtatttttgttgtcgttttgatgtattttaatcgtttttataatttggaaatttacggtgtagtacgggttaaggttggttatcgggttttggaagattatcgttatttcggtatttattaggttgcggcg

SEQ ID NO: 23796 - DNA, 587 bp, Artificial Sequence
  chemically treated genomic DNA (Homo sapiens) CpG-island No: 23796
cgccgcaacctaataaataccgaaataacgataatcttccaaaacccgataaccaaccttaacccgtactacaccgtaaatttccaaattataaaaacgattaaaatacatcaaaacgacaacaaaaatacccgccgtcaacgaacgattaacctactaaatcaaatcgatattcccgatccgacatcgcgtctaaatatttacccgcatcaactttccgacgacataaaccaacgcgtaataatcgccataacgattacctatcgaccaaaactactaattaccgataaaccgaccaccgcgctaaacgaaaaccattctaacgccaatcatcgaactactactaaaactacaacaaaaaaaaaacataacgctaaaatttattacccataacctaacgctaataacgataacgacacattaaatcattaaaatatatacaaaccaaaaaataaaaacgataatacgcacgcatcttccatacgcgcgttacccgtataatcaaacattattaatacgactacaaaatttattaaaacaaaaaacgctaaaataaactaataactatcctttaaacgacgacgcgt

SEQ ID NO: 23797 - DNA, 520 bp, Artificial Sequence
  chemically treated genomic DNA (Homo sapiens) CpG-island No: 23797
tattatgtttttttgatttatagttgcggaaaacgtattggtgtaaaacgtagggttatgattattagtttaacgacgtatagcgtatgaaatgtttagtttattaggtaattgtcgttgatattacgtagtacgttagaaaattacggggtaagttcggcgatgataaaatcgattttttgtataaacgttattagtttgttagtaatagtcgggtgtatagagtgatcgagcgttagtagtaaataaacggaaacgcgtcgtttagattttatttatatattatcgtttataatatcggcgaattgtatcggtagttaaataaagtcgtagaattttttcgattgtaatattagcgttagtattaatagtttgcgtcgattttgatggcgagttattataggtattaggtaaagttttgcgggttgttaaacgttattaatgttagtaggaatcgtgtattgtcgttggtttaatttaatatttaatgcgtaaaagtttattgttatttgtggtttat

SEQ ID NO: 23798 - DNA, 520 bp, Artificial Sequence
  chemically treated genomic DNA (Homo sapiens) CpG-island No: 23798
ataaaccacaaataacaataaacttttacgcattaaatattaaattaaaccaacgacaatacacgattcctactaacattaataacgtttaacaacccgcaaaactttacctaatacctataataactcgccatcaaaatcgacgcaaactattaatactaacgctaatattacaatcgaaaaaattctacgactttatttaactaccgatacaattcgccgatattataaacgataatatataaataaaatctaaacgacgcgtttccgtttatttactactaacgctcgatcactctatacacccgactattactaacaaactaataacgtttatacaaaaaatcgattttatcatcgccgaacttaccccgtaattttctaacgtactacgtaatatcaacgacaattacctaataaactaaacatttcatacgctatacgtcgttaaactaataatcataaccctacgttttacaccaatacgttttccgcaactataaatcaaaaaaacataata

SEQ ID NO: 23799 - DNA, 520 bp, Artificial Sequence
  chemically treated genomic DNA (Homo sapiens) CpG-island No: 23799
atgggttataagtggtaatgggtttttgcgtattgaatattagattgggttagcggtagtatacggtttttattggtattgatgacgtttggtaattcgtagagttttgtttgatgtttgtaatggttcgttattaggatcggcgtaaattgttaatgttggcgttggtgttataatcgggggggttttgcggttttatttggttgtcgatgtaattcgtcggtattgtgggcgatggtgtgtgggtaaggtttgggcggcgcgttttcgtttgtttgttgttggcgttcgattattttgtgtattcggttattgttggtaagttggtggcgtttatgtagggaatcggttttattatcgtcgggtttgtttcgtggttttttggcgtgttgcgtagtattagcggtaattatttgatggattgggtattttatgcgttgtgcgtcgttgggttgatgattataattttgcgttttgtattagtacgtttttcgtagttgtgggttaaagaggtatgatg

SEQ ID NO: 23800 - DNA, 520 bp, Artificial Sequence
  chemically treated genomic DNA (Homo sapiens) CpG-island No: 23800
catcatacctctttaacccacaactacgaaaaacgtactaatacaaaacgcaaaattataatcatcaacccaacgacgcacaacgcataaaatacccaatccatcaaataattaccgctaatactacgcaacacgccaaaaaaccacgaaacaaacccgacgataataaaaccgattccctacataaacgccaccaacttaccaacaataaccgaatacacaaaataatcgaacgccaacaacaaacaaacgaaaacgcgccgcccaaaccttacccacacaccatcgcccacaataccgacgaattacatcgacaaccaaataaaaccgcaaaacccccccgattataacaccaacgccaacattaacaatttacgccgatcctaataacgaaccattacaaacatcaaacaaaactctacgaattaccaaacgtcatcaataccaataaaaaccgtatactaccgctaacccaatctaatattcaatacgcaaaaacccattaccacttataacccat

SEQ ID NO: 23801 - DNA, 806 bp, Artificial Sequence
  chemically treated genomic DNA (Homo sapiens) CpG-island No: 23801
  misc_feature (739)..(739): n is either a, c, g or t
gtggcggcgcgaagcgaatatgcgttggtgattgtatcgatcggtttcgggaaaacgttggtagtatttttttacgttttcgatcggttttttcgcgaaggcggcgaagatattcgcgaggcgtataagcgtaaaattttacgtattttttatattttatcgataaaagttttgggtatcgacgtttagcgtaatttgtagatttcgttgaagggtattgtcgatgaacggcggcggcgcggcgaaacggaagttaattttcgcgtagggattcgtattggcgatacgtttgtataggaacgtagtaaatttattcgtaattcgtcggatattttgattattatattcgaattattttatttgatgttgatttttcgcgcgcgcgaaacgttacgcggcgtcgaaacggtaattattgatgaagtttacgcggtagcgggtagtaaacgtggtgcgtatttggcgttaagtttggagcggttcgatgcgttgttttatattttagtatagcgaattggtttttttgttattgtgcgtttagttagcgatgtggtagtattttttggtggcgatcgttcggttacggtagttaattcgttcgtaatgcgttattcgtagatacgaattgtcgtatcggtcgttaatatggatgatgttttatcggtcgttagcggtatcggcgaagatagttatgtcggtcgcgaaggttttatttggttatatattgaaacggtatttntgatgagtgttgcgtatcgttcgatattgttttattattcgcggggttggcgaaaattgtagtttat

SEQ ID NO: 23802 - DNA, 806 bp, Artificial Sequence
  chemically treated genomic DNA (Homo sapiens) CpG-island No: 23802
  misc_feature (68)..(68): n is either a, c, g or t
ataaactacaattttcgccaaccccgcgaataataaaacaatatcgaacgatacgcaacactcatcanaaataccgtttcaatatataaccaaataaaaccttcgcgaccgacataactatcttcgccgataccgctaacgaccgataaaacatcatccatattaacgaccgatacgacaattcgtatctacgaataacgcattacgaacgaattaactaccgtaaccgaacgatcgccaccaaaaaatactaccacatcgctaactaaacgcacaataacaaaaaaaccaattcgctatactaaaatataaaacaacgcatcgaaccgctccaaacttaacgccaaatacgcaccacgtttactacccgctaccgcgtaaacttcatcaataattaccgtttcgacgccgcgtaacgtttcgcgcgcgcgaaaaatcaacatcaaataaaataattcgaatataataatcaaaatatccgacgaattacgaataaatttactacgttcctatacaaacgtatcgccaatacgaatccctacgcgaaaattaacttccgtttcgccgcgccgccgccgttcatcgacaatacccttcaacgaaatctacaaattacgctaaacgtcgatacccaaaacttttatcgataaaatataaaaaatacgtaaaattttacgcttatacgcctcgcgaatatcttcgccgccttcgcgaaaaaaccgatcgaaaacgtaaaaaaatactaccaacgttttcccgaaaccgatcgatacaatcaccaacgcatattcgcttcgcgccgccac

SEQ ID NO: 23803 - DNA, 806 bp, Artificial Sequence
  chemically treated genomic DNA (Homo sapiens) CpG-island No: 23803
  misc_feature (68)..(68): n is either a, c, g or t
atgggttgtagttttcgttagtttcgcgaatagtaagataatgtcgagcgatgcgtaatatttattanggatatcgttttaatatatggttagatggagttttcgcggtcggtatggttgttttcgtcggtgtcgttggcgatcgatgagatattatttatattggcgatcggtacgataattcgtatttgcggatggcgtattgcgggcgggttgattatcgtaatcgggcgatcgttattaagaaatgttgttatatcgttggttgagcgtatagtggtagaaaggttaattcgttgtgttgaggtgtggagtagcgtatcgagtcgttttagatttaacgttagatgcgtattacgtttattgttcgttatcgcgtggattttattaataattatcgtttcgacgtcgcgtagcgtttcgcgcgcgcgggaggttagtattagatagagtgattcgggtgtggtgattagaatattcggcggattacgggtgagtttgttgcgtttttgtgtaggcgtatcgttagtacggatttttacgcgaagattgattttcgtttcgtcgcgtcgtcgtcgtttatcggtaatattttttaacgggatttgtaagttgcgttgaacgtcggtgtttagggtttttatcggtgaaatatagaggatgcgtgaggttttacgtttatgcgtttcgcgggtattttcgtcgttttcgcggaagagtcgatcgagggcgtagagaaatgttgttagcgttttttcggagtcggtcggtgtaattattagcgtatgttcgtttcgcgtcgttat

SEQ ID NO: 23804 - DNA, 806 bp, Artificial Sequence
  chemically treated genomic DNA (Homo sapiens) CpG-island No: 23804
  misc_feature (739)..(739): n is either a, c, g or t
ataacgacgcgaaacgaacatacgctaataattacaccgaccgactccgaaaaaacgctaacaacatttctctacgccctcgatcgactcttccgcgaaaacgacgaaaatacccgcgaaacgcataaacgtaaaacctcacgcatcctctatatttcaccgataaaaaccctaaacaccgacgttcaacgcaacttacaaatcccgttaaaaaatattaccgataaacgacgacgacgcgacgaaacgaaaatcaatcttcgcgtaaaaatccgtactaacgatacgcctacacaaaaacgcaacaaactcacccgtaatccgccgaatattctaatcaccacacccgaatcactctatctaatactaacctcccgcgcgcgcgaaacgctacgcgacgtcgaaacgataattattaataaaatccacgcgataacgaacaataaacgtaatacgcatctaacgttaaatctaaaacgactcgatacgctactccacacctcaacacaacgaattaacctttctaccactatacgctcaaccaacgatataacaacatttcttaataacgatcgcccgattacgataatcaacccgcccgcaatacgccatccgcaaatacgaattatcgtaccgatcgccaatataaataatatctcatcgatcgccaacgacaccgacgaaaacaaccataccgaccgcgaaaactccatctaaccatatattaaaacgatatccntaataaatattacgcatcgctcgacattatcttactattcgcgaaactaacgaaaactacaacccat

SEQ ID NO: 23805 - DNA, 663 bp, Artificial Sequence
  chemically treated genomic DNA (Homo sapiens) CpG-island No: 23805
ttgggttttgtcgttagggtgttgtttattatattatagaagttgcgagtgcgttttatgagagtgcgttttaaagtggtagcgatcggtaacggtatagtttttcgcgaaattgagcgtttttatttcgatgtgtagaagtagttttcgaaagtgatcgcgtagaaagtaatcgttagcgaagtaggcgcgtcggtttattcggttttcgagttggttgtataggagttttcggatttcgacgtttcgttgcgtggcgcggtgtttatcgttcgtcgtttgtaggattcgttggcggagttggtgaaaatcgattcgaaatttatcggcgtaggttagtattagtatgacgttagttagacgtaattggttcgtaaattggacgtagtagtagaagattgcgtaaacgtcgttggcgtcgattttaatattgtttttgtttcgttgttaattcgcgtggcgggtttgacgcgtatgatggcgtaaaatatcgttgtttggcgcgatgagaacggttagttttagaatcgttagtaattgttaaaagtgagtcgtttggggtcgttttcgttgaggatttttcgtaatattttagagttgtcgaatttttatgtttttagttgagaaattgaagttatttattcgttatcgattttattaaat

SEQ ID NO: 23806 - DNA, 663 bp, Artificial Sequence
  chemically treated genomic DNA (Homo sapiens) CpG-island No: 23806
atttaataaaatcgataacgaataaataacttcaatttctcaactaaaaacataaaaattcgacaactctaaaatattacgaaaaatcctcaacgaaaacgaccccaaacgactcacttttaacaattactaacgattctaaaactaaccgttctcatcgcgccaaacaacgatattttacgccatcatacgcgtcaaacccgccacgcgaattaacaacgaaacaaaaacaatattaaaatcgacgccaacgacgtttacgcaatcttctactactacgtccaatttacgaaccaattacgtctaactaacgtcatactaatactaacctacgccgataaatttcgaatcgattttcaccaactccgccaacgaatcctacaaacgacgaacgataaacaccgcgccacgcaacgaaacgtcgaaatccgaaaactcctatacaaccaactcgaaaaccgaataaaccgacgcgcctacttcgctaacgattactttctacgcgatcactttcgaaaactacttctacacatcgaaataaaaacgctcaatttcgcgaaaaactataccgttaccgatcgctaccactttaaaacgcactctcataaaacgcactcgcaacttctataatataataaacaacaccctaacgacaaaacccaa

SEQ ID NO: 23807 - DNA, 663 bp, Artificial Sequence
  chemically treated genomic DNA (Homo sapiens) CpG-island No: 23807
atttgatgagatcgatagcgagtaaatggttttagttttttagttgagagtatggaagttcggtagttttagggtgttgcgagaagtttttagcgggggcggttttagacggtttatttttaatagttgttgacggttttggaattgatcgtttttatcgcgttaggtaacgatgttttgcgttattatgcgcgttaggttcgttacgcgggttaatagcggaatagaagtagtgttgagatcgacgttaacggcgtttacgtagttttttattattgcgtttagtttgcgggttagttgcgtttggttgacgttatgttgatattgatttacgtcgatagatttcggatcgatttttattagtttcgttagcggattttgtaaacggcgggcgatagatatcgcgttacgtagcgaaacgtcgagattcgggaatttttgtgtagttagttcggaagtcgagtaaatcgacgcgtttgtttcgttgacgattattttttgcgcggttattttcgggaattgtttttgtatatcgagatagaaacgtttagtttcgcgggaagttgtatcgttatcgatcgttattattttagagcgtatttttatagagcgtattcgtaatttttgtgatgtggtaagtaatattttgacggtagaatttag

SEQ ID NO: 23808 - DNA, 663 bp, Artificial Sequence
  chemically treated genomic DNA (Homo sapiens) CpG-island No: 23808
ctaaattctaccgtcaaaatattacttaccacatcacaaaaattacgaatacgctctataaaaatacgctctaaaataataacgatcgataacgatacaacttcccgcgaaactaaacgtttctatctcgatatacaaaaacaattcccgaaaataaccgcgcaaaaaataatcgtcaacgaaacaaacgcgtcgatttactcgacttccgaactaactacacaaaaattcccgaatctcgacgtttcgctacgtaacgcgatatctatcgcccgccgtttacaaaatccgctaacgaaactaataaaaatcgatccgaaatctatcgacgtaaatcaatatcaacataacgtcaaccaaacgcaactaacccgcaaactaaacgcaataataaaaaactacgtaaacgccgttaacgtcgatctcaacactacttctattccgctattaacccgcgtaacgaacctaacgcgcataataacgcaaaacatcgttacctaacgcgataaaaacgatcaattccaaaaccgtcaacaactattaaaaataaaccgtctaaaaccgcccccgctaaaaacttctcgcaacaccctaaaactaccgaacttccatactctcaactaaaaaactaaaaccatttactcgctatcgatctcatcaaat

SEQ ID NO: 23809 - DNA, 515 bp, Artificial Sequence
  chemically treated genomic DNA (Homo sapiens) CpG-island No: 23809
tggtattacgatggcgtggcgtgacgggttatatagcgttgagaagtacggcgtattttttaggttaacgtcgttataaatttttgatagtagtatattattaaaacgtttcgttagcgcgtttagacgttgatttttagagtcgttaggttggtttaaacgttcgatttttttatcgacggcgtttttgcgcgcgtttattttatcgcgtttaataatcgtttttcgtttacgttttagtaattgttgtagatattcggtgacgttttggttggaggtaaatttttcgtcgtattgttcgtttaattggttgagattgttttgcgttgttagttaaatcggcgtacgttgtattaaattttgaatgcgagattgtagttgtttttgtttttggcgtagtgttatgcgttttttacgggcgttagatacgttatcggaaagagaggtaatgcgtgtttttagtttttgatgtagggtttttagttcgtcgatattaaaatttttgttttgacgta

SEQ ID NO: 23810 - DNA, 515 bp, Artificial Sequence
  chemically treated genomic DNA (Homo sapiens) CpG-island No: 23810
tacgtcaaaacaaaaattttaatatcgacgaactaaaaaccctacatcaaaaactaaaaacacgcattacctctctttccgataacgtatctaacgcccgtaaaaaacgcataacactacgccaaaaacaaaaacaactacaatctcgcattcaaaatttaatacaacgtacgccgatttaactaacaacgcaaaacaatctcaaccaattaaacgaacaatacgacgaaaaatttacctccaaccaaaacgtcaccgaatatctacaacaattactaaaacgtaaacgaaaaacgattattaaacgcgataaaataaacgcgcgcaaaaacgccgtcgataaaaaaatcgaacgtttaaaccaacctaacgactctaaaaatcaacgtctaaacgcgctaacgaaacgttttaataatatactactatcaaaaatttataacgacgttaacctaaaaaatacgccgtacttctcaacgctatataacccgtcacgccacgccatcgtaatacca

SEQ ID NO: 23811 - DNA, 515 bp, Artificial Sequence
  chemically treated genomic DNA (Homo sapiens) CpG-island No: 23811
tacgttagggtaagaattttgatatcgacgaattggaagttttgtattaggaattggaagtacgtattgttttttttttcgatagcgtgtttaacgttcgtgaagagcgtatggtattgcgttaggagtaggaatagttgtagtttcgtatttagagtttgatgtagcgtgcgtcggtttggttggtagcgtaaaatagttttaattagttgagcgaatagtgcggcgaagagtttatttttagttaggacgttatcgaatatttgtaatagttgttggagcgtgagcgagaggcgattgttgaacgcgatgaagtgggcgcgcgtaaaaacgtcgtcgatgaagagatcgaacgtttaagttagtttggcggttttgaagattagcgtttgaacgcgttggcggagcgttttggtggtgtgttgttgttagaaatttatgacgacgttagtttggaagatgcgtcgtattttttagcgttgtatggttcgttacgttacgttatcgtggtgtta

SEQ ID NO: 23812 - DNA, 515 bp, Artificial Sequence
  chemically treated genomic DNA (Homo sapiens) CpG-island No: 23812
taacaccacgataacgtaacgtaacgaaccatacaacgctaaaaaatacgacgcatcttccaaactaacgtcgtcataaatttctaacaacaacacaccaccaaaacgctccgccaacgcgttcaaacgctaatcttcaaaaccgccaaactaacttaaacgttcgatctcttcatcgacgacgtttttacgcgcgcccacttcatcgcgttcaacaatcgcctctcgctcacgctccaacaactattacaaatattcgataacgtcctaactaaaaataaactcttcgccgcactattcgctcaactaattaaaactattttacgctaccaaccaaaccgacgcacgctacatcaaactctaaatacgaaactacaactattcctactcctaacgcaataccatacgctcttcacgaacgttaaacacgctatcgaaaaaaaaaacaatacgtacttccaattcctaatacaaaacttccaattcgtcgatatcaaaattcttaccctaacgta

SEQ ID NO: 23813 - DNA, 724 bp, Artificial Sequence
  chemically treated genomic DNA (Homo sapiens) CpG-island No: 23813
  misc_feature (121)..(122): n is either a, c, g or t
  misc_feature (127)..(127): n is either a, c, g or t
  misc_feature (183)..(185): n is either a, c, g or t
  misc_feature (189)..(189): n is either a, c, g or t
  misc_feature (198)..(198): n is either a, c, g or t
gtgtggggagggtatttgttaaggcgaattttgcgtttgcgcgttgtcgattgttgtacgttgtacgttacgacgttcggtaatttatggataatttttattttcggaagtaattattggnnttcgnatgtatacggcgtgggttcgtattggcggagtatcgtacgatttgtcgcgtttttnnnattntttgttgtntaagtttttcgattggatgtcgaaacgtttggcgttttacgagaaagcggcgttgtaaaatattattttgaaaggtcgtttttagggcgttgtcgtttatggcgcgaaagaggcgttggagtggggtattattggcgcgggtttgcgtgttatcgggatcgatttcgacgtgcgtaaggcgcgtttttattttggttatgaaaatttcgattttgaaatttcggtgggtggtggcgtttttgattgttatattcgcgtaatgtttaaagtggaagagttgcgttagagtttgcgtatttttgagtagtgttttaataatatgtcggaaggttcgtttaaagcggattattcgttggatacgtcgtcgtcgaaagagcgtacgttgtaatatatcgaaattttgattatttattttttgtaagtgtcgcggggttcggtgatgtttggtaatgaatttttttagatgattgagcggatataaggattaatagttattatttgattagcgacggcgtattatgagtta

SEQ ID NO: 23814 - DNA, 724 bp, Artificial Sequence
  chemically treated genomic DNA (Homo sapiens) CpG-island No: 23814
  misc_feature (527)..(527): n is either a, c, g or t
  misc_feature (536)..(536): n is either a, c, g or t
  misc_feature (540)..(542): n is either a, c, g or t
  misc_feature (598)..(598): n is either a, c, g or t
  misc_feature (603)..(604): n is either a, c, g or t
taactcataatacgccgtcgctaatcaaataataactattaatccttatatccgctcaatcatctaaaaaaattcattaccaaacatcaccgaaccccgcgacacttacaaaaaataaataatcaaaatttcgatatattacaacgtacgctctttcgacgacgacgtatccaacgaataatccgctttaaacgaaccttccgacatattattaaaacactactcaaaaatacgcaaactctaacgcaactcttccactttaaacattacgcgaatataacaatcaaaaacgccaccacccaccgaaatttcaaaatcgaaattttcataaccaaaataaaaacgcgccttacgcacgtcgaaatcgatcccgataacacgcaaacccgcgccaataataccccactccaacgcctctttcgcgccataaacgacaacgccctaaaaacgacctttcaaaataatattttacaacgccgctttctcgtaaaacgccaaacgtttcgacatccaatcgaaaaacttanacaacaaanaatnnnaaaaacgcgacaaatcgtacgatactccgccaatacgaacccacgccgtatacatncgaannccaataattacttccgaaaataaaaattatccataaattaccgaacgtcgtaacgtacaacgtacaacaatcgacaacgcgcaaacgcaaaattcgccttaacaaataccctccccacac

SEQ ID NO: 23815 - DNA, 724 bp, Artificial Sequence
  chemically treated genomic DNA (Homo sapiens) CpG-island No: 23815
  misc_feature (527)..(527): n is either a, c, g or t
  misc_feature (536)..(536): n is either a, c, g or t
  misc_feature (540)..(542): n is either a, c, g or t
  misc_feature (598)..(598): n is either a, c, g or t
  misc_feature (603)..(604): n is either a, c, g or t
taatttatggtgcgtcgtcgttgattaggtagtaattgttgatttttatgttcgtttaattatttgaaaagatttattgttaggtattatcggatttcgcgatatttgtaggaagtgggtgattagggtttcgatatgttgtagcgtgcgttttttcggcggcggcgtgtttagcgggtgattcgttttgaacgggtttttcggtatgttgttgaggtattgtttaagaatgcgtagattttggcgtagtttttttattttaagtattacgcgggtgtagtagttagaaacgttattatttatcgggattttaaagtcgaagtttttatagttagaataaggacgcgttttacgtacgtcgaagtcgatttcggtagtacgtaggttcgcgttagtggtgttttattttagcgtttttttcgcgttataggcggtaacgttttgggaacgattttttagaatggtgttttgtagcgtcgttttttcgtaagacgttagacgtttcggtatttagtcgaggaatttangtagtaggngatnnnaggggcgcggtaggtcgtgcggtatttcgttaatacggatttacgtcgtgtgtatncggannttagtgattgttttcggaagtgaaagttgtttatagattgtcggacgtcgtgacgtataacgtgtagtagtcggtagcgcgtaggcgtagagttcgttttggtaggtgttttttttatat

SEQ ID NO: 23816 - DNA, 724 bp, Artificial Sequence
  chemically treated genomic DNA (Homo sapiens) CpG-island No: 23816
  misc_feature (121)..(122): n is either a, c, g or t
  misc_feature (127)..(127): n is either a, c, g or t
  misc_feature (183)..(185): n is either a, c, g or t
  misc_feature (189)..(189): n is either a, c, g or t
  misc_feature (198)..(198): n is either a, c, g or t
atataaaaaaaacacctaccaaaacgaactctacgcctacgcgctaccgactactacacgttatacgtcacgacgtccgacaatctataaacaactttcacttccgaaaacaatcactaanntccgnatacacacgacgtaaatccgtattaacgaaataccgcacgacctaccgcgcccctnnnatcncctactacntaaattcctcgactaaataccgaaacgtctaacgtcttacgaaaaaacgacgctacaaaacaccattctaaaaaatcgttcccaaaacgttaccgcctataacgcgaaaaaaacgctaaaataaaacaccactaacgcgaacctacgtactaccgaaatcgacttcgacgtacgtaaaacgcgtccttattctaactataaaaacttcgactttaaaatcccgataaataataacgtttctaactactacacccgcgtaatacttaaaataaaaaaactacgccaaaatctacgcattcttaaacaatacctcaacaacataccgaaaaacccgttcaaaacgaatcacccgctaaacacgccgccgccgaaaaaacgcacgctacaacatatcgaaaccctaatcacccacttcctacaaatatcgcgaaatccgataatacctaacaataaatcttttcaaataattaaacgaacataaaaatcaacaattactacctaatcaacgacgacgcaccataaatta

SEQ ID NO: 23817 - DNA, 540 bp, Artificial Sequence
  chemically treated genomic DNA (Homo sapiens) CpG-island No: 23817
ttgttatcgcgttttgtgttttaaagtcgttggattacgaggttttgtaggttttcgagtttcgcgtgggcgttatagatcgcggtttttcggcgttgagtagcgaggcgttggtgcgcgtgttggtgttggacgttaacgataattcgtttttcgtgttgtattcgttgtagaacggtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggcgtgtgggcgtataatggcgaggtgcgtatcgttaggttgttgagcgagcgcgacgtggttaagtataggttagtggtgttggttaaggataatggcgagttttcgcgttcggttatcgttacgttgtaagtgtttttggtggacggttttttttagttttatttgtcgtttttaagagcggtttcggtttaagtttaggtcgattcgtttattgttt

SEQ ID NO: 23818 - DNA, 540 bp, Artificial Sequence
  chemically treated genomic DNA (Homo sapiens) CpG-island No: 23818
aaacaataaacgaatcgacctaaacttaaaccgaaaccgctcttaaaaacgacaaataaaactaaaaaaaaccgtccaccaaaaacacttacaacgtaacgataaccgaacgcgaaaactcgccattatccttaaccaacaccactaacctatacttaaccacgtcgcgctcgctcaacaacctaacgatacgcacctcgccattatacgcccacacgccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccgttctacaacgaatacaacacgaaaaacgaattatcgttaacgtccaacaccaacacgcgcaccaacgcctcgctactcaacgccgaaaaaccgcgatctataacgcccacgcgaaactcgaaaacctacaaaacctcgtaatccaacgactttaaaacacaaaacgcgataacaa

SEQ ID NO: 23819 - DNA, 540 bp, Artificial Sequence
  chemically treated genomic DNA (Homo sapiens) CpG-island No: 23819
agatagtgagcgagtcggtttgggtttgggtcggggtcgtttttgggagcggtaggtagggttgagagaagtcgtttattaggagtatttgtagcgtggcggtggtcgagcgcggaggttcgttattgtttttgattagtattattagtttgtgtttggttacgtcgcgttcgtttagtagtttggcggtgcgtatttcgttattgtgcgtttatacgtcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagtcgttttgtagcgggtatagtacgaagggcgagttgtcgttggcgtttagtattagtacgcgtattagcgtttcgttgtttaacgtcgggaagtcgcggtttgtggcgtttacgcggaattcgaaagtttgtagggtttcgtagtttagcgattttagagtatagggcgcgatagtaa

SEQ ID NO: 23820 - DNA, 540 bp, Artificial Sequence
  chemically treated genomic DNA (Homo sapiens) CpG-island No: 23820
ttactatcgcgccctatactctaaaatcgctaaactacgaaaccctacaaactttcgaattccgcgtaaacgccacaaaccgcgacttcccgacgttaaacaacgaaacgctaatacgcgtactaatactaaacgccaacgacaactcgcccttcgtactatacccgctacaaaacgactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgacgtataaacgcacaataacgaaatacgcaccgccaaactactaaacgaacgcgacgtaaccaaacacaaactaataatactaatcaaaaacaataacgaacctccgcgctcgaccaccgccacgctacaaatactcctaataaacgacttctctcaaccctacctaccgctcccaaaaacgaccccgacccaaacccaaaccgactcgctcactatct

SEQ ID NO: 23821 - DNA, 576 bp, Artificial Sequence
  chemically treated genomic DNA (Homo sapiens) CpG-island No: 23821
ttatcgcgttgagtgtttgttgtattaacggtagattatcgtttgttagtatcgggatttcgttgtattgtaagttttttatttttagtcggaaattcgggttagcggttttttgcgtattgcgggagttggcgtatagcgttgtatcgttttggttatcgttacgtatggcgattatcggtttgataaaagcgattttattcggcgttgttataatgtatatcgtatcgatacgatcgttattattggtgaattggttatcggttggcgtggtttgtagcgttggattgttggtcgttatgtcggaatcggttgtcgttttgagagtaatcgggttattcgttaaagtaatattagaatcgtcgttaatattcgcgcgtaattcgttggtggaattaaattttgttgtagaacggtgtcggcgtttaggttttgttattttgcgttaacgtattgcgtcgtagacggttaatgaattgcgtggattagtattacggcgtttgttattttggttcgaatttgattttcggagggagttaattttttttttatagttaaagaaattaggtttaaaga

SEQ ID NO: 23822 - DNA, 576 bp, Artificial Sequence
  chemically treated genomic DNA (Homo sapiens) CpG-island No: 23822
tctttaaacctaatttctttaactataaaaaaaaaattaactccctccgaaaatcaaattcgaaccaaaataacaaacgccgtaatactaatccacgcaattcattaaccgtctacgacgcaatacgttaacgcaaaataacaaaacctaaacgccgacaccgttctacaacaaaatttaattccaccaacgaattacgcgcgaatattaacgacgattctaatattactttaacgaataacccgattactctcaaaacgacaaccgattccgacataacgaccaacaatccaacgctacaaaccacgccaaccgataaccaattcaccaataataacgatcgtatcgatacgatatacattataacaacgccgaataaaatcgcttttatcaaaccgataatcgccatacgtaacgataaccaaaacgatacaacgctatacgccaactcccgcaatacgcaaaaaaccgctaacccgaatttccgactaaaaataaaaaacttacaatacaacgaaatcccgatactaacaaacgataatctaccgttaatacaacaaacactcaacgcgataa

SEQ ID NO: 23823 - DNA, 576 bp, Artificial Sequence
  chemically treated genomic DNA (Homo sapiens) CpG-island No: 23823
tttttggatttggtttttttggttgtgaaaagagaattgatttttttcgggggttaaattcgggttagggtaataagcgtcgtggtgttgatttacgtagtttattggtcgtttgcgacgtaatgcgttggcgtagagtggtagaatttgggcgtcggtatcgttttgtaataaaatttggttttattagcgaattacgcgcgggtgttaacggcggttttggtattgttttaacgggtagttcgattatttttagagcgataatcgatttcggtatgacgattaataatttaacgttgtaaattacgttaatcgatgattagtttattaataatggcggtcgtgtcgatgcggtgtatattgtggtaacgtcgggtgaaatcgtttttattaaatcgatgatcgttatgcgtaacggtagttagagcggtgtaacgttgtacgttagttttcgtagtgcgtaagggatcgttggttcggattttcgattggagatggaaggtttgtagtatagcgaaatttcgatgttggtaggcggtaatttatcgttaatgtagtaggtatttagcgcggtga

SEQ ID NO: 23824 - DNA, 576 bp, Artificial Sequence
  chemically treated genomic DNA (Homo sapiens) CpG-island No: 23824
tcaccgcgctaaatacctactacattaacgataaattaccgcctaccaacatcgaaatttcgctatactacaaaccttccatctccaatcgaaaatccgaaccaacgatcccttacgcactacgaaaactaacgtacaacgttacaccgctctaactaccgttacgcataacgatcatcgatttaataaaaacgatttcacccgacgttaccacaatatacaccgcatcgacacgaccgccattattaataaactaatcatcgattaacgtaatttacaacgttaaattattaatcgtcataccgaaatcgattatcgctctaaaaataatcgaactacccgttaaaacaataccaaaaccgccgttaacacccgcgcgtaattcgctaataaaaccaaattttattacaaaacgataccgacgcccaaattctaccactctacgccaacgcattacgtcgcaaacgaccaataaactacgtaaatcaacaccacgacgcttattaccctaacccgaatttaacccccgaaaaaaatcaattctcttttcacaaccaaaaaaaccaaatccaaaaa

SEQ ID NO: 23825 - DNA, 995 bp, Artificial Sequence
  chemically treated genomic DNA (Homo sapiens) CpG-island No: 23825
gcgcgtttggttagttaatttggtcggtggtgagttggaaatagaatcgcgggtagttcggtaatttgtcgtaaagttcggtatttcgtaggttagataagtcgtttacgtcgtattcgatatttaacgttcgagtcggttgtttaatgcgacgttgtcgcgttttattaggtttataattgttgtcgatttgtaagtcggataaggtatttgtgtcgtattcggtaattaatgtttgatgcgacgttgtcgcgttttattaggtttataattattgtcgatttgtaggtcggataaggtatttgtgtcgtattcggtaattaatgtttgatgcgacgttgtcgcgttttattaggtttataattgttgtcgattcgtaggtcggataaggcgttcgcgtcgtattcggtagtgtttattcgcggcgatttaaaattttttttttataagttcgtacgttttttagttattcgttatttgttggcgtatcgtgacgttggtaatatattttttagatcgtttgttacggtaacgatttttgtttttttagtagtgttagacgcgtagtgtaatcgttcgtcgtttttagtttgcgtagtttagcggtaggttttagtaacgtacgtagtagggttttttttatattgcgtgtattaatgatttacgcggtaatgcggttgatagaggtatcgaagaagttaaggtcgatatgtattcggttaaatagatcgtgacgtataattttattggtaattgtttgggttttattatttagtagtattacgtgatcgttgttttagcgaatcggacggttgacgtgtagtagtaattgcggtatatatagtatggcggcggaaattttgtcggaaattattttagtcgggtggaagtgttcggcgtttagtatagcgtagcgtggtgcgtgtgtgtttattttttttgagtttttgggtatatttgtatgtatttgcgatttggaaggggaaattagtttt

SEQ ID NO: 23826 - DNA, 995 bp, Artificial Sequence
  chemically treated genomic DNA (Homo sapiens) CpG-island No: 23826
aaaactaatttccccttccaaatcgcaaatacatacaaatatacccaaaaactcaaaaaaaataaacacacacgcaccacgctacgctatactaaacgccgaacacttccacccgactaaaataatttccgacaaaatttccgccgccatactatatataccgcaattactactacacgtcaaccgtccgattcgctaaaacaacgatcacgtaatactactaaataataaaacccaaacaattaccaataaaattatacgtcacgatctatttaaccgaatacatatcgaccttaacttcttcgatacctctatcaaccgcattaccgcgtaaatcattaatacacgcaatataaaaaaaaccctactacgtacgttactaaaacctaccgctaaactacgcaaactaaaaacgacgaacgattacactacgcgtctaacactactaaaaaaacaaaaatcgttaccgtaacaaacgatctaaaaaatatattaccaacgtcacgatacgccaacaaataacgaataactaaaaaacgtacgaacttataaaaaaaaaattttaaatcgccgcgaataaacactaccgaatacgacgcgaacgccttatccgacctacgaatcgacaacaattataaacctaataaaacgcgacaacgtcgcatcaaacattaattaccgaatacgacacaaataccttatccgacctacaaatcgacaataattataaacctaataaaacgcgacaacgtcgcatcaaacattaattaccgaatacgacacaaataccttatccgacttacaaatcgacaacaattataaacctaataaaacgcgacaacgtcgcattaaacaaccgactcgaacgttaaatatcgaatacgacgtaaacgacttatctaacctacgaaataccgaactttacgacaaattaccgaactacccgcgattctatttccaactcaccaccgaccaaattaactaaccaaacgcgc

SEQ ID NO: 23827 - DNA, 995 bp, Artificial Sequence
  chemically treated genomic DNA (Homo sapiens) CpG-island No: 23827
aaagttgatttttttttttaagtcgtaaatgtatataaatatgtttagaggtttaaaagaaatgggtatatacgtattacgttgcgttgtgttggacgtcgggtatttttattcgattgaagtgattttcgataagattttcgtcgttatgttgtatgtgtcgtagttgttgttgtacgttagtcgttcggttcgttgggatagcgattacgtagtgttgttggatgatgaaatttaggtaattgttagtgagattgtgcgttacgatttgtttgatcgggtgtatatcggttttgattttttcgatgtttttattaatcgtattgtcgcgtgggttattggtatacgtaatatgaaaaaagttttgttgcgtgcgttgttggaatttatcgttgagttgcgtaagttggaagcggcgggcgattatattgcgcgtttggtattgttggaagagtagaaatcgttgtcgtggtaggcggtttgggaaatgtattgttaacgttacgatacgttagtaggtagcgaatggttggagagcgtgcgggtttatgagaaagaaattttgagtcgtcgcgggtaaatattgtcggatgcggcgcgagcgttttattcggtttacgggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtaatcggttcgggcgttggatgtcggatgcggcgtgaacggtttgtttgatttacggggtgtcggattttacggtaagttatcgaattattcgcggttttgtttttagtttattatcgattagattaattggttaggcgcgt

SEQ ID NO: 23828 - DNA, 995 bp, Artificial Sequence
  chemically treated genomic DNA (Homo sapiens) CpG-island No: 23828
acgcgcctaaccaattaatctaatcgataataaactaaaaacaaaaccgcgaataattcgataacttaccgtaaaatccgacaccccgtaaatcaaacaaaccgttcacgccgcatccgacatccaacgcccgaaccgattacctaatacgacgctatcgcgtcttatcaaacctacaactattaccgacctataaaccgaataaaacacttataccgcatccgacaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacccgtaaaccgaataaaacgctcgcgccgcatccgacaatatttacccgcgacgactcaaaatttctttctcataaacccgcacgctctccaaccattcgctacctactaacgtatcgtaacgttaacaatacatttcccaaaccgcctaccacgacaacgatttctactcttccaacaataccaaacgcgcaatataatcgcccgccgcttccaacttacgcaactcaacgataaattccaacaacgcacgcaacaaaacttttttcatattacgtataccaataacccacgcgacaatacgattaataaaaacatcgaaaaaatcaaaaccgatatacacccgatcaaacaaatcgtaacgcacaatctcactaacaattacctaaatttcatcatccaacaacactacgtaatcgctatcccaacgaaccgaacgactaacgtacaacaacaactacgacacatacaacataacgacgaaaatcttatcgaaaatcacttcaatcgaataaaaatacccgacgtccaacacaacgcaacgtaatacgtatatacccatttcttttaaacctctaaacatatttatatacatttacgacttaaaaaaaaaaatcaacttt

SEQ ID NO: 23829 - DNA, 543 bp, Artificial Sequence
  chemically treated genomic DNA (Homo sapiens) CpG-island No: 23829
ttttttttcggtaagcgtaggttcgtttatcgggatcgatagggttcgcgaagcgttggttggcgggttgacgagttggcgggttggcgggttgatttttcgacggcggcgacggtagtttttggttcggagtttttttttttttatttcggatttgtttttagaatcgaacgagttagtgaggtgagcgttttcgtgtttagagcggttttacgtgttttttattaaataatcggacggtattattttatttattcgattcgttcgattcgtttgttttttagagttattttagacgcgcgcgcgcgtttggttacgttcgtttttttttttttgcgcgtttttgcgatttcgtgcgtgttcgttttgtttgtgaggtcgcgggaagtagcgcgtaggagtagaagtaatagggtgtcgtcgaataggtggggagtggaggtttggaagtacgtttgcggaagatgggcggttgcggttatttcgcgtgattagttcgttcgtttaatatattatgatttttattttttatttagtttttta

SEQ ID NO: 23830 - DNA, 543 bp, Artificial Sequence
  chemically treated genomic DNA (Homo sapiens) CpG-island No: 23830
taaaaaactaaataaaaaataaaaatcataatatattaaacgaacgaactaatcacgcgaaataaccgcaaccgcccatcttccgcaaacgtacttccaaacctccactccccacctattcgacgacaccctattacttctactcctacgcgctacttcccgcgacctcacaaacaaaacgaacacgcacgaaatcgcaaaaacgcgcaaaaaaaaaaaaacgaacgtaaccaaacgcgcgcgcgcgtctaaaataactctaaaaaacaaacgaatcgaacgaatcgaataaataaaataataccgtccgattatttaataaaaaacacgtaaaaccgctctaaacacgaaaacgctcacctcactaactcgttcgattctaaaaacaaatccgaaataaaaaaaaaaaaactccgaaccaaaaactaccgtcgccgccgtcgaaaaatcaacccgccaacccgccaactcgtcaacccgccaaccaacgcttcgcgaaccctatcgatcccgataaacgaacctacgcttaccgaaaaaaaa

SEQ ID NO: 23831 - DNA, 543 bp, Artificial Sequence
  chemically treated genomic DNA (Homo sapiens) CpG-island No: 23831
tagaggattaaatggagagtaagaattatgatatattgagcgagcgaattaattacgcgagatgatcgtagtcgtttatttttcgtaagcgtgtttttaggtttttattttttatttattcggcggtattttgttatttttgtttttgcgcgttgtttttcgcgattttataggtagagcgaatacgtacggagtcgtaggggcgcgtaaagggggaggagcgggcgtgattaggcgcgcgcgcgcgtttggagtgattttagagagtaggcgagtcgggcggatcgggtgggtagagtggtgtcgttcggttgtttggtgggaggtacgtaagatcgttttgggtacgggggcgtttattttattggttcgttcggttttaggagtagattcggggtagagggaaaagagtttcgggttaggggttgtcgtcgtcgtcgtcggggagttagttcgttagttcgttagttcgttagttcgttagttagcgtttcgcgggttttgtcggtttcggtaagcgggtttgcgtttatcggaaagagg

SEQ ID NO: 23832 - DNA, 543 bp, Artificial Sequence
  chemically treated genomic DNA (Homo sapiens) CpG-island No: 23832
cctctttccgataaacgcaaacccgcttaccgaaaccgacaaaacccgcgaaacgctaactaacgaactaacgaactaacgaactaacgaactaactccccgacgacgacgacgacaacccctaacccgaaactcttttccctctaccccgaatctactcctaaaaccgaacgaaccaataaaataaacgcccccgtacccaaaacgatcttacgtacctcccaccaaacaaccgaacgacaccactctacccacccgatccgcccgactcgcctactctctaaaatcactccaaacgcgcgcgcgcgcctaatcacgcccgctcctccccctttacgcgcccctacgactccgtacgtattcgctctacctataaaatcgcgaaaaacaacgcgcaaaaacaaaaataacaaaataccgccgaataaataaaaaataaaaacctaaaaacacgcttacgaaaaataaacgactacgatcatctcgcgtaattaattcgctcgctcaatatatcataattcttactctccatttaatcctcta

SEQ ID NO: 23833 - DNA, 780 bp, Artificial Sequence
  chemically treated genomic DNA (Homo sapiens) CpG-island No: 23833
ggcgagtgggttggttggcgggggggtgggggggggggcggcggggcgggcggcggtgttgtcgggggtgttcggggttagggggttggtgggtgggggggcggcggggggggggggcggttgtgtcgtcgcgtgtgggggggggggtcgtcggcgggggggcgcggcgtcgcgggggaggtgacgttacgtgagtgatcggcgttcggttttgggggtaggtcgtttgtgggacgggtgtgtcgtgggttcgcgataggtggttatgtggttgttttgtggtgcgttcggatgggttcgggggattggtatagttgttttcggttgtcgggcgagtaagtgcggtttgcgtgggtttgacgatgtattggtgttttatgggggtgtgggtcgttcgttttgggcgttgaacgtgattatgtgttgggcggggcgagaggcgtggaagtatcggggtgttgcggttatatttgggttggtgtttattttatttttttatagagtgtttcgtagtggtttttgtgtcggtgacgtgatattgttggagcgagcgaggcggggaagtgcgtggttagattgcgtacgtattgtggttgtcggatagcggacggtgatagggtgatatttgtgacgagttgtagtgcgggcgtgcgtcgattgttgcgttcgtattgttttcgttttcgttggtggatgtagttggaggttcggcgtgttttttattggaggagttgtgtattaggtgttgtgagtgagaggtcgttgtggaaaggtgtgttt

SEQ ID NO: 23834 - DNA, 780 bp, Artificial Sequence
  chemically treated genomic DNA (Homo sapiens) CpG-island No: 23834
aaacacacctttccacaacgacctctcactcacaacacctaatacacaactcctccaataaaaaacacgccgaacctccaactacatccaccaacgaaaacgaaaacaatacgaacgcaacaatcgacgcacgcccgcactacaactcgtcacaaatatcaccctatcaccgtccgctatccgacaaccacaatacgtacgcaatctaaccacgcacttccccgcctcgctcgctccaacaatatcacgtcaccgacacaaaaaccactacgaaacactctataaaaaaataaaataaacaccaacccaaatataaccgcaacaccccgatacttccacgcctctcgccccgcccaacacataatcacgttcaacgcccaaaacgaacgacccacacccccataaaacaccaatacatcgtcaaacccacgcaaaccgcacttactcgcccgacaaccgaaaacaactataccaatcccccgaacccatccgaacgcaccacaaaacaaccacataaccacctatcgcgaacccacgacacacccgtcccacaaacgacctacccccaaaaccgaacgccgatcactcacgtaacgtcacctcccccgcgacgccgcgcccccccgccgacgacccccccccccacacgcgacgacacaaccgccccccccccccgccgcccccccacccaccaaccccctaaccccgaacacccccgacaacaccgccgcccgccccgccgcccccccccccacccccccgccaaccaacccactcgcc

SEQ ID NO: 23835 - DNA, 780 bp, Artificial Sequence
  chemically treated genomic DNA (Homo sapiens) CpG-island No: 23835
aggtatatttttttataacgattttttatttataatatttagtatataatttttttagtggaggatacgtcgagtttttaattatatttattaacggaaacgaggataatgcgagcgtaatagtcggcgtacgttcgtattgtaattcgttatagatgttattttgttatcgttcgttgttcgatagttatagtgcgtgcgtagtttaattacgtattttttcgtttcgttcgttttaatagtattacgttatcgatatagaaattattgcgaagtattttgtagggggatagggtgagtattaatttaagtgtggtcgtaatatttcggtatttttacgtttttcgtttcgtttaatatatggttacgtttaacgtttagagcgaacgatttatatttttataagatattagtgtatcgttaagtttacgtaaatcgtatttattcgttcgataatcggagatagttatattaatttttcgaatttattcgggcgtattatagggtaattatatagttatttgtcgcggatttacggtatattcgttttataagcggtttgtttttagaatcgaacgtcggttatttacgtggcgttatttttttcgcggcgtcgcgttttttcgtcgacgatttttttttttatacgcggcgatatagtcgtttttttttttcgtcgtttttttatttattagttttttgatttcgagtattttcggtagtatcgtcgttcgtttcgtcgtttttttttttattttttcgttaattaatttattcgtt

SEQ ID NO: 23836 - DNA, 780 bp, Artificial Sequence
  chemically treated genomic DNA (Homo sapiens) CpG-island No: 23836
aacgaataaattaattaacgaaaaaataaaaaaaaaaacgacgaaacgaacgacgatactaccgaaaatactcgaaatcaaaaaactaataaataaaaaaacgacgaaaaaaaaaaacgactatatcgccgcgtataaaaaaaaaaatcgtcgacgaaaaaacgcgacgccgcgaaaaaaataacgccacgtaaataaccgacgttcgattctaaaaacaaaccgcttataaaacgaatataccgtaaatccgcgacaaataactatataattaccctataatacgcccgaataaattcgaaaaattaatataactatctccgattatcgaacgaataaatacgatttacgtaaacttaacgatacactaatatcttataaaaatataaatcgttcgctctaaacgttaaacgtaaccatatattaaacgaaacgaaaaacgtaaaaataccgaaatattacgaccacacttaaattaatactcaccctatccccctacaaaatacttcgcaataatttctatatcgataacgtaatactattaaaacgaacgaaacgaaaaaatacgtaattaaactacgcacgcactataactatcgaacaacgaacgataacaaaataacatctataacgaattacaatacgaacgtacgccgactattacgctcgcattatcctcgtttccgttaataaatataattaaaaactcgacgtatcctccactaaaaaaattatatactaaatattataaataaaaaatcgttataaaaaaatatacct

SEQ ID NO: 23837 - DNA, 644 bp, Artificial Sequence
  chemically treated genomic DNA (Homo sapiens) CpG-island No: 23837
atgaggcgacggaggtttatatttttacgcggggcgtaattataatcgttatagtaatacgtaattatattttaacgagcgtagcgttatataatattatcgttcgtagacgagatttaggtaagatacgatagagtaggatagacgagtagtagtagagggtatatagaacgtaataattagtgggattatacgtggatatacgatcgaggatcgtatacgtagaggtcgtcgtatacgataggaatatagatttcgggatagatatattcgacgtttatacggacggttttagggcgtacgtatatcgatagatacgatagacggttatttacgcgaagttcgtattcggaaaagtgcgattataagagtattttaatatcgagatgtagatattatataaattatcgattagacggagaatcgtatagaagatacggtaattttacgatagcgtatagaaaagtattataggggagtatacgataattcgtatcgtacgataagaagattacgtgagttcgagaaataagtagataagtttattagcgaggaaaatagaaagcgcggtaatagagaatttataattggtagatatcgatatggacgtagcgatagtaaggagaaaacgaatacgatagaat

SEQ ID NO: 23838 - DNA, 644 bp, Artificial Sequence
  chemically treated genomic DNA (Homo sapiens) CpG-island No: 23838
attctatcgtattcgttttctccttactatcgctacgtccatatcgatatctaccaattataaattctctattaccgcgctttctattttcctcgctaataaacttatctacttatttctcgaactcacgtaatcttcttatcgtacgatacgaattatcgtatactcccctataatacttttctatacgctatcgtaaaattaccgtatcttctatacgattctccgtctaatcgataatttatataatatctacatctcgatattaaaatactcttataatcgcacttttccgaatacgaacttcgcgtaaataaccgtctatcgtatctatcgatatacgtacgccctaaaaccgtccgtataaacgtcgaatatatctatcccgaaatctatattcctatcgtatacgacgacctctacgtatacgatcctcgatcgtatatccacgtataatcccactaattattacgttctatataccctctactactactcgtctatcctactctatcgtatcttacctaaatctcgtctacgaacgataatattatataacgctacgctcgttaaaatataattacgtattactataacgattataattacgccccgcgtaaaaatataaacctccgtcgcctcat

SEQ ID NO: 23839 - DNA, 644 bp, Artificial Sequence
  chemically treated genomic DNA (Homo sapiens) CpG-island No: 23839
gttttgtcgtgttcgttttttttttgttgtcgttgcgtttatgtcggtgtttgttagttgtgggttttttgttgtcgcgttttttgtttttttcgttggtgggtttgtttgtttgtttttcgaatttacgtggtttttttgtcgtgcgatgcgggttgtcgtatgtttttttgtggtgtttttttgtgcgttgtcgtgggattgtcgtgttttttgtacggtttttcgtttggtcggtggtttgtgtggtgtttatatttcggtgttggggtgtttttgtggtcgtattttttcggatgcgagtttcgcgtggatagtcgtttgtcgtgtttatcggtgtgcgtgcgttttggagtcgttcgtgtgagcgtcgggtgtatttatttcgggatttatgtttttatcgtgtacggcggtttttgcgtgtgcggttttcggtcgtgtgtttacgtgtggttttattggttgttgcgttttgtgtgttttttgttgttgttcgtttgttttattttgtcgtgttttgtttgggtttcgtttgcgggcggtggtgttatgtggcgttgcgttcgttgagatgtggttgcgtgttgttgtggcggttgtgattgcgtttcgcgtgggagtgtgagttttcgtcgttttat

SEQ ID NO: 23840 - DNA, 644 bp, Artificial Sequence
  chemically treated genomic DNA (Homo sapiens) CpG-island No: 23840
ataaaacgacgaaaactcacactcccacgcgaaacgcaatcacaaccgccacaacaacacgcaaccacatctcaacgaacgcaacgccacataacaccaccgcccgcaaacgaaacccaaacaaaacacgacaaaataaaacaaacgaacaacaacaaaaaacacacaaaacgcaacaaccaataaaaccacacgtaaacacacgaccgaaaaccgcacacgcaaaaaccgccgtacacgataaaaacataaatcccgaaataaatacacccgacgctcacacgaacgactccaaaacgcacgcacaccgataaacacgacaaacgactatccacgcgaaactcgcatccgaaaaaatacgaccacaaaaacaccccaacaccgaaatataaacaccacacaaaccaccgaccaaacgaaaaaccgtacaaaaaacacgacaatcccacgacaacgcacaaaaaaacaccacaaaaaaacatacgacaacccgcatcgcacgacaaaaaaaccacgtaaattcgaaaaacaaacaaacaaacccaccaacgaaaaaaacaaaaaacgcgacaacaaaaaacccacaactaacaaacaccgacataaacgcaacgacaacaaaaaaaaaacgaacacgacaaaac

SEQ ID NO: 23841 - DNA, 1051 bp, Artificial Sequence
  chemically treated genomic DNA (Homo sapiens) CpG-island No: 23841
gtagtttcgaggtcggaatcgggtcgtaatttataatcgatgggttataataacgatcgttatcgaacgtatacgagcgcgcggtttaagatttaattttgggcgcggtttttatttattattagtatggtagttgcgttatcggaaatgtagaagatgtgttcgtcgttattatatcgtttattggattaaacgtcgacgtagcgtggcgagggtttttacggtggttttcgggcgaattatttttcgtaattaaattgttttaggacgtcgtcggtatcgtgattatcggtcggatgattttatttttaaatgcggtcgattgcgtggcggtttaggcgcggcgtgtgatcgcgcggtaaaggtattttgtattttacggttgatatcgtgatacgcgttagtatttttgtcgttaagtttattatgttcgtcgttttgggatattgcggtttaggtcggggtgaaaatcgacgtcgtgatttatcggttattgtttatatgttttacgtcgttaaatagatatgtttgcgtatcgtcgttatgattattcgtgttgcgttatgtagtgtttgtatggatgaattattaagcgatttaacggtaatcgtcgggatagagtgtggtatttttgttagagcgtcgcgttacgggcgatattaaaattttgttttagcgtttgttgtaataattttagtaaatatcgtcgagggtcgtcgtttttagcgtcgggttagcgttagtaggttacgtattaaatgagcggagagattttttgtacgtatttacgaaaagtatcgtttttcgaacggtttatcggggtgcgaatttgtacgataatgataatttgttttattgtgattttttaagtcgtttttaggttttaatcggacgggttggtttaatcggaggatagtacggttcgttatgatcgttttatttcgtagatttttcggtattttatatagcgggtcgaggtgcgatattgttgtgtttatttaggtatttgcgtttcgcgggtttttagttaggaagtcgtcgcgttgacgga

SEQ ID NO: 23842 - DNA, 1051 bp, Artificial Sequence
  chemically treated genomic DNA (Homo sapiens) CpG-island No: 23842
tccgtcaacgcgacgacttcctaactaaaaacccgcgaaacgcaaatacctaaataaacacaacaatatcgcacctcgacccgctatataaaataccgaaaaatctacgaaataaaacgatcataacgaaccgtactatcctccgattaaaccaacccgtccgattaaaacctaaaaacgacttaaaaaatcacaataaaacaaattatcattatcgtacaaattcgcaccccgataaaccgttcgaaaaacgatacttttcgtaaatacgtacaaaaaatctctccgctcatttaatacgtaacctactaacgctaacccgacgctaaaaacgacgaccctcgacgatatttactaaaattattacaacaaacgctaaaacaaaattttaatatcgcccgtaacgcgacgctctaacaaaaataccacactctatcccgacgattaccgttaaatcgcttaataattcatccatacaaacactacataacgcaacacgaataatcataacgacgatacgcaaacatatctatttaacgacgtaaaacatataaacaataaccgataaatcacgacgtcgattttcaccccgacctaaaccgcaatatcccaaaacgacgaacataataaacttaacgacaaaaatactaacgcgtatcacgatatcaaccgtaaaatacaaaatacctttaccgcgcgatcacacgccgcgcctaaaccgccacgcaatcgaccgcatttaaaaataaaatcatccgaccgataatcacgataccgacgacgtcctaaaacaatttaattacgaaaaataattcgcccgaaaaccaccgtaaaaaccctcgccacgctacgtcgacgtttaatccaataaacgatataataacgacgaacacatcttctacatttccgataacgcaactaccatactaataataaataaaaaccgcgcccaaaattaaatcttaaaccgcgcgctcgtatacgttcgataacgatcgttattataacccatcgattataaattacgacccgattccgacctcgaaactac

SEQ ID NO: 23843 - DNA, 1051 bp, Artificial Sequence
  chemically treated genomic DNA (Homo sapiens) CpG-island No: 23843
ttcgttaacgcggcggttttttggttgggaattcgcggagcgtaaatatttggataggtatagtaatatcgtatttcggttcgttgtatgaagtgtcggaaggtttgcggaataaagcggttataacgaatcgtattatttttcggttgagttagttcgttcggttgggatttgaaaacggtttaaggagttataatggaataggttgttattgtcgtgtaaattcgtatttcgatgggtcgttcgaagggcggtgtttttcgtaagtgcgtgtagaagattttttcgtttatttaatgcgtagtttgttggcgttaattcggcgttggaagcggcggttttcgacgatatttattggggttgttgtagtagacgttggagtagggttttaatatcgttcgtaacgcggcgttttggtagaagtattatattttgtttcggcggttatcgttaaatcgtttggtggtttatttatgtaggtattgtatgacgtagtacgaatgattatgacggcgatgcgtaggtatgtttgtttggcggcgtggagtatatgggtaatggtcgatgagttacggcgtcgatttttatttcggtttgagtcgtaatgttttaaagcggcgggtatgatgggtttaacggtagaaatgttggcgcgtattacggtattagtcgtgaaatgtaggatgtttttgtcgcgcggttatacgtcgcgtttgggtcgttacgtagtcggtcgtatttaaaaatgaaattattcgatcggtggttacgatgtcgacggcgttttgaagtagtttaattacgagaagtgattcgttcggaaattatcgtggaagttttcgttacgttgcgtcggcgtttgatttagtaaacggtatggtaacggcgggtatattttttgtattttcgatggcgtagttgttatgttggtgatgagtgaaagtcgcgtttagaattaggttttaagtcgcgcgttcgtgtgcgttcgatggcggtcgttgttgtgatttatcgattatgggttacggttcggtttcggtttcgaaattgt

SEQ ID NO: 23844 - DNA, 1051 bp, Artificial Sequence
  chemically treated genomic DNA (Homo sapiens) CpG-island No: 23844
acaatttcgaaaccgaaaccgaaccgtaacccataatcgataaatcacaacaacgaccgccatcgaacgcacacgaacgcgcgacttaaaacctaattctaaacgcgactttcactcatcaccaacataacaactacgccatcgaaaatacaaaaaatatacccgccgttaccataccgtttactaaatcaaacgccgacgcaacgtaacgaaaacttccacgataatttccgaacgaatcacttctcgtaattaaactacttcaaaacgccgtcgacatcgtaaccaccgatcgaataatttcatttttaaatacgaccgactacgtaacgacccaaacgcgacgtataaccgcgcgacaaaaacatcctacatttcacgactaataccgtaatacgcgccaacatttctaccgttaaacccatcatacccgccgctttaaaacattacgactcaaaccgaaataaaaatcgacgccgtaactcatcgaccattacccatatactccacgccgccaaacaaacatacctacgcatcgccgtcataatcattcgtactacgtcatacaatacctacataaataaaccaccaaacgatttaacgataaccgccgaaacaaaatataatacttctaccaaaacgccgcgttacgaacgatattaaaaccctactccaacgtctactacaacaaccccaataaatatcgtcgaaaaccgccgcttccaacgccgaattaacgccaacaaactacgcattaaataaacgaaaaaatcttctacacgcacttacgaaaaacaccgcccttcgaacgacccatcgaaatacgaatttacacgacaataacaacctattccattataactccttaaaccgttttcaaatcccaaccgaacgaactaactcaaccgaaaaataatacgattcgttataaccgctttattccgcaaaccttccgacacttcatacaacgaaccgaaatacgatattactatacctatccaaatatttacgctccgcgaattcccaaccaaaaaaccgccgcgttaacgaa

SEQ ID NO: 23845 - DNA, 703 bp, Artificial Sequence
  chemically treated genomic DNA (Homo sapiens) CpG-island No: 23845
attcgcgtattcgtcgttatgaaggagcgtacgttgaattttttttttttttttcgttggtcggtacgtttggcgttgattatatcgttttgttggcgttgattgcgtttattagttagtggtggttgtcgttgatttataggcgattgatttgtcgtcgcgtttgttttcgtcggatgcgagtattggttgggtatcgattatttaggtcgcgatattttttcgcggttatggtagcgattcgcgtgtcgttcggttcggtaatggtttgtttgttgcggtgttgatattagggttggttattggcggtagcgtcgggttgattggcggcgcgttgattaggttattatgcgcgtcgtcgatatgtttatgatttttcgatttcgattttgtcgttttttatggttggcgtgttcggtatcgggcgattaacgtaattatcgttatcgttttgtcgtattgggcgtggtatgtagtatggtgcgtagtttggtgattttattacgttaacgcgagtttgtgttgcgttacggtttttcggtgcgggttatgtgcgggtgtttgtcgattatcggtaggcgcggtgattttttcgttgttggtgttggtaacgttggatatcgttatatgatgttgtacgtcgcggggatgtttttttttggtttcggtgtatcgcgtcgatcgtcgaatggggcgtgatgat

SEQ ID NO: 23846 - DNA, 703 bp, Artificial Sequence
  chemically treated genomic DNA (Homo sapiens) CpG-island No: 23846
atcatcacgccccattcgacgatcgacgcgatacaccgaaaccaaaaaaaaacatccccgcgacgtacaacatcatataacgatatccaacgttaccaacaccaacaacgaaaaaatcaccgcgcctaccgataatcgacaaacacccgcacataacccgcaccgaaaaaccgtaacgcaacacaaactcgcgttaacgtaataaaatcaccaaactacgcaccatactacataccacgcccaatacgacaaaacgataacgataattacgttaatcgcccgataccgaacacgccaaccataaaaaacgacaaaatcgaaatcgaaaaatcataaacatatcgacgacgcgcataataacctaatcaacgcgccgccaatcaacccgacgctaccgccaataaccaaccctaatatcaacaccgcaacaaacaaaccattaccgaaccgaacgacacgcgaatcgctaccataaccgcgaaaaaatatcgcgacctaaataatcgatacccaaccaatactcgcatccgacgaaaacaaacgcgacgacaaatcaatcgcctataaatcaacgacaaccaccactaactaataaacgcaatcaacgccaacaaaacgatataatcaacgccaaacgtaccgaccaacgaaaaaaaaaaaaaaaattcaacgtacgctccttcataacgacgaatacgcgaat

SEQ ID NO: 23847 - DNA, 703 bp, Artificial Sequence
  chemically treated genomic DNA (Homo sapiens) CpG-island No: 23847
attattacgttttattcggcggtcggcgcggtatatcgaggttaaggaaagatattttcgcgacgtgtagtattatatggcgatatttagcgttgttagtattagtagcgaagggattatcgcgtttgtcgatgatcgataaatattcgtatatggttcgtatcggaaagtcgtgacgtagtataaattcgcgttggcgtagtgaaattattaggttgcgtattatgttgtatattacgtttagtgcgatagggcgatggcgataattacgttggtcgttcggtgtcgagtacgttaattataaagaacgatagaatcgaggtcggaaggttataaatatatcggcgacgcgtatggtggtttgattaacgcgtcgttaattaattcggcgttgtcgttaataattagttttaatgttagtatcgtagtaggtaggttattatcgaatcgagcgatacgcgggtcgttgttatagtcgcgagaaaatatcgcgatttaagtgatcggtgtttagttagtgttcgtattcggcgaaagtaggcgcgacggtaaattaatcgtttgtgggttaacggtagttattattggttggtgagcgtaattagcgttagtagggcgatatgattagcgttaggcgtatcgattagcgggaagagaggaaaaagtttagcgtgcgtttttttatgacgacgaatgcgcgggt

SEQ ID NO: 23848 - DNA, 703 bp, Artificial Sequence
  chemically treated genomic DNA (Homo sapiens) CpG-island No: 23848
acccgcgcattcgtcgtcataaaaaaacgcacgctaaactttttcctctcttcccgctaatcgatacgcctaacgctaatcatatcgccctactaacgctaattacgctcaccaaccaataataactaccgttaacccacaaacgattaatttaccgtcgcgcctactttcgccgaatacgaacactaactaaacaccgatcacttaaatcgcgatattttctcgcgactataacaacgacccgcgtatcgctcgattcgataataacctacctactacgatactaacattaaaactaattattaacgacaacgccgaattaattaacgacgcgttaatcaaaccaccatacgcgtcgccgatatatttataaccttccgacctcgattctatcgttctttataattaacgtactcgacaccgaacgaccaacgtaattatcgccatcgccctatcgcactaaacgtaatatacaacataatacgcaacctaataatttcactacgccaacgcgaatttatactacgtcacgactttccgatacgaaccatatacgaatatttatcgatcatcgacaaacgcgataatcccttcgctactaatactaacaacgctaaatatcgccatataatactacacgtcgcgaaaatatctttccttaacctcgatataccgcgccgaccgccgaataaaacgtaataat

SEQ ID NO: 23849 - DNA, 511 bp, Artificial Sequence
  chemically treated genomic DNA (Homo sapiens) CpG-island No: 23849
ttatttgattcgttcggatatgggtcgtcgtttgtgtgtagaagttgttgaagcgttgaaagcgtagtgtgttgttaattcggacgtataggtcgttatttttgatggtttgttaattgatgcgattatcgtgaattacgaagagattttgttatcgttgatggcgggtttgaaataggtcgggttgaaagtcggtatattattttttgttcgttatggtcgcgtgaagattgaagattagatcggtgagattttcggcgcgaaagtagtgattttgttggtgggcgaacgttcggggttgggttagttagaaagttttttttgttacgtcgtttattcgtcgcgtatggcgattatcgttgaggtcgatcgtatttgtatttataatatttattagggcggtacgtcgtcggttgaagtcgtagtcgttattgtggatttggcgaaacgtatgttggagtagaaagtatttcggtattaatatgattcgataaggaagtattatgttagt

SEQ ID NO: 23850 - DNA, 511 bp, Artificial Sequence
  chemically treated genomic DNA (Homo sapiens) CpG-island No: 23850
actaacataatacttccttatcgaatcatattaataccgaaatactttctactccaacatacgtttcgccaaatccacaataacgactacgacttcaaccgacgacgtaccgccctaataaatattataaatacaaatacgatcgacctcaacgataatcgccatacgcgacgaataaacgacgtaacaaaaaaaactttctaactaacccaaccccgaacgttcgcccaccaacaaaatcactactttcgcgccgaaaatctcaccgatctaatcttcaatcttcacgcgaccataacgaacaaaaaataatataccgactttcaacccgacctatttcaaacccgccatcaacgataacaaaatctcttcgtaattcacgataatcgcatcaattaacaaaccatcaaaaataacgacctatacgtccgaattaacaacacactacgctttcaacgcttcaacaacttctacacacaaacgacgacccatatccgaacgaatcaaataa

SEQ ID NO: 23851 - DNA, 511 bp, Artificial Sequence
  chemically treated genomic DNA (Homo sapiens) CpG-island No: 23851
gttggtatgatgtttttttatcgggttatgttgatgtcgaaatgttttttgttttagtatacgtttcgttaaatttataatgacggttgcggttttaatcggcggcgtgtcgttttggtgaatgttatagatataggtgcgatcggttttaacggtggtcgttatacgcggcgagtaaacggcgtagtaggagaggttttttgattgatttaatttcggacgttcgtttattagtaggattattattttcgcgtcgaggattttatcgatttgatttttaatttttacgcgattataacgaataaagaatggtgtatcgatttttagttcggtttgttttaggttcgttattagcggtggtaggattttttcgtagtttacggtgatcgtattagttgataggttattagaaataacgatttgtacgttcggattggtaatatattgcgtttttagcgttttaatagtttttgtatataggcggcggtttatattcgggcgagttaggtag

SEQ ID NO: 23852 - DNA, 511 bp, Artificial Sequence
  chemically treated genomic DNA (Homo sapiens) CpG-island No: 23852
ctacctaactcgcccgaatataaaccgccgcctatatacaaaaactattaaaacgctaaaaacgcaatatattaccaatccgaacgtacaaatcgttatttctaataacctatcaactaatacgatcaccgtaaactacgaaaaaatcctaccaccgctaataacgaacctaaaacaaaccgaactaaaaatcgatacaccattctttattcgttataatcgcgtaaaaattaaaaatcaaatcgataaaatcctcgacgcgaaaataataatcctactaataaacgaacgtccgaaattaaatcaatcaaaaaacctctcctactacgccgtttactcgccgcgtataacgaccaccgttaaaaccgatcgcacctatatctataacattcaccaaaacgacacgccgccgattaaaaccgcaaccgtcattataaatttaacgaaacgtatactaaaacaaaaaacatttcgacatcaacataacccgataaaaaaacatcataccaac

SEQ ID NO: 23853 - DNA, 569 bp, Artificial Sequence
  chemically treated genomic DNA (Homo sapiens) CpG-island No: 23853
  misc_feature (139)..(140): n is either a, c, g or t
gttttatattgttttttatgtagcgtttgtaatttatttcgtacgattttcgtaatatatgttgattgaaataggattacgttaattagcgcgcggattaatttgtcgatattggtgttttttgaggtattcgaatagnntattttagaggattttttttatcgtatagtcgaagttcgtttataggttagcgggatcgtattgaatcgtaattttattgaaggtagcgatgtgtaagtaggttagtttttgtattagatcgatttcgcgatttattaggtaaattatgatagcgcgaaaggcgaattggcgaaaagtgaagtcgtcgtcgttatcgcgtatttgacggtaaaacgttacgtttcgttcgtgggtacgaaatatattagttagtaggagtacgattaggttattgttgatgttcgttaggtcgatgtcgtcgtgattgtcgtaaaagttatagtcgaaagcgttcgtattaattttgtttatattaaagttattgcgttaattagcggacgtatcggtaaatcgattgtgatcgaaggcgtttttgttattaatgggta

SEQ ID NO: 23854 - DNA, 569 bp, Artificial Sequence
  chemically treated genomic DNA (Homo sapiens) CpG-island No: 23854
  misc_feature (430)..(431): n is either a, c, g or t
tacccattaataacaaaaacgccttcgatcacaatcgatttaccgatacgtccgctaattaacgcaataactttaatataaacaaaattaatacgaacgctttcgactataacttttacgacaatcacgacgacatcgacctaacgaacatcaacaataacctaatcgtactcctactaactaatatatttcgtacccacgaacgaaacgtaacgttttaccgtcaaatacgcgataacgacgacgacttcacttttcgccaattcgcctttcgcgctatcataatttacctaataaatcgcgaaatcgatctaatacaaaaactaacctacttacacatcgctaccttcaataaaattacgattcaatacgatcccgctaacctataaacgaacttcgactatacgataaaaaaaatcctctaaaatannctattcgaatacctcaaaaaacaccaatatcgacaaattaatccgcgcgctaattaacgtaatcctatttcaatcaacatatattacgaaaatcgtacgaaataaattacaaacgctacataaaaaacaatataaaac

SEQ ID NO: 23855 - DNA, 569 bp, Artificial Sequence
  chemically treated genomic DNA (Homo sapiens) CpG-island No: 23855
  misc_feature (430)..(431): n is either a, c, g or t
tgtttattagtgataagagcgttttcggttatagtcgatttgtcgatacgttcgttaattggcgtagtgattttggtataagtaagattgatgcgagcgttttcgattgtggtttttgcggtaattacggcggtatcggtttgacgagtattagtaatggtttggtcgtatttttgttggttgatgtatttcgtatttacgagcggaacgtaacgttttatcgttaaatgcgcgatggcggcggcggttttatttttcgttagttcgtttttcgcgttgttataatttgtttgataggtcgcgggatcgatttggtatagggattggtttgtttgtatatcgttgtttttagtgaaattgcgatttagtacgatttcgttaatttgtgggcgaatttcggttatacgataagggggattttttagagtgnnttgttcgagtgttttagaaggtattagtatcgataaattgattcgcgcgttggttggcgtgattttgttttagttagtatatgttgcggaagtcgtgcgaggtggattataggcgttgtataaagggtaatatgaagt

SEQ ID NO: 23856 - DNA, 569 bp, Artificial Sequence
  chemically treated genomic DNA (Homo sapiens) CpG-island No: 23856
  misc_feature (139)..(140): n is either a, c, g or t
acttcatattaccctttatacaacgcctataatccacctcgcacgacttccgcaacatatactaactaaaacaaaatcacgccaaccaacgcgcgaatcaatttatcgatactaataccttctaaaacactcgaacaanncactctaaaaaatcccccttatcgtataaccgaaattcgcccacaaattaacgaaatcgtactaaatcgcaatttcactaaaaacaacgatatacaaacaaaccaatccctataccaaatcgatcccgcgacctatcaaacaaattataacaacgcgaaaaacgaactaacgaaaaataaaaccgccgccgccatcgcgcatttaacgataaaacgttacgttccgctcgtaaatacgaaatacatcaaccaacaaaaatacgaccaaaccattactaatactcgtcaaaccgataccgccgtaattaccgcaaaaaccacaatcgaaaacgctcgcatcaatcttacttataccaaaatcactacgccaattaacgaacgtatcgacaaatcgactataaccgaaaacgctcttatcactaataaaca

SEQ ID NO: 23857 - DNA, 550 bp, Artificial Sequence
  chemically treated genomic DNA (Homo sapiens) CpG-island No: 23857
gtcgatgttagagggatttatttttatggcgcggtgcgcgtggaatattacgcggaacgtattttaaaaggcggtattaatcgcgaatcggagtttcgttttgaggaaatcgggtcgtgttcggtaattttatatgtcgataatgtcgtcggataggtcgcggcgaaaatgggtatggaatatgttattaaaatcgtttagtaaaatggcgttgcggtggtcggtattagtcggatgggttatagcggcgtaattttttattttgtgtagtaggtagttcgcgtcggatttattggtatttcgatgtgttaattcgatttaatggtggtgtcgtttggcggcgcggaaatttattacggtattaattttttggtttttgtcgcgtcgggagaaagcgattaaatttttatttttgatatggcgattatcgtataagtatggggaaaagtgttcgacgttcgttcgcgtaatatgtttatttcggatatttgtggggaattaataattttggacgtatttacgtaggaacgtcgaattttatttttcgaat

SEQ ID NO: 23858 - DNA, 550 bp, Artificial Sequence
  chemically treated genomic DNA (Homo sapiens) CpG-island No: 23858
attcgaaaaataaaattcgacgttcctacgtaaatacgtccaaaattattaattccccacaaatatccgaaataaacatattacgcgaacgaacgtcgaacacttttccccatacttatacgataatcgccatatcaaaaataaaaatttaatcgctttctcccgacgcgacaaaaaccaaaaaattaataccgtaataaatttccgcgccgccaaacgacaccaccattaaatcgaattaacacatcgaaataccaataaatccgacgcgaactacctactacacaaaataaaaaattacgccgctataacccatccgactaataccgaccaccgcaacgccattttactaaacgattttaataacatattccatacccattttcgccgcgacctatccgacgacattatcgacatataaaattaccgaacacgacccgatttcctcaaaacgaaactccgattcgcgattaataccgccttttaaaatacgttccgcgtaatattccacgcgcaccgcgccataaaaataaatccctctaacatcgac

SEQ ID NO: 23859 - DNA, 550 bp, Artificial Sequence
  chemically treated genomic DNA (Homo sapiens) CpG-island No: 23859
gttcggaaggtaaaattcgacgtttttacgtgggtacgtttagggttgttagttttttataggtattcgggatagatatattacgcgagcgggcgtcgagtatttttttttatgtttgtacggtagtcgttatattaaaggtaaggatttggtcgttttttttcggcgcggtaaaggttagggggttagtatcgtagtaaattttcgcgtcgttaaacggtattattattggatcggattggtatatcgaaatgttaatgaattcggcgcgggttgtttgttgtataaaataagagattgcgtcgttgtgatttattcggttgatatcgattatcgtaacgttattttgttgggcggttttgatggtatgttttatatttattttcgtcgcgatttgttcggcggtattgtcggtatgtaaaattgtcgagtacggttcggtttttttaagacgaaatttcggttcgcggttggtgtcgttttttgaaatgcgtttcgcgtagtattttacgcgtatcgcgttatgagagtggatttttttggtatcggt

SEQ ID NO: 23860 - DNA, 550 bp, Artificial Sequence
  chemically treated genomic DNA (Homo sapiens) CpG-island No: 23860
accgataccaaaaaaatccactctcataacgcgatacgcgtaaaatactacgcgaaacgcatttcaaaaaacgacaccaaccgcgaaccgaaatttcgtcttaaaaaaaccgaaccgtactcgacaattttacataccgacaataccgccgaacaaatcgcgacgaaaataaatataaaacataccatcaaaaccgcccaacaaaataacgttacgataatcgatatcaaccgaataaatcacaacgacgcaatctcttattttatacaacaaacaacccgcgccgaattcattaacatttcgatataccaatccgatccaataataataccgtttaacgacgcgaaaatttactacgatactaaccccctaacctttaccgcgccgaaaaaaaacgaccaaatccttacctttaatataacgactaccgtacaaacataaaaaaaaatactcgacgcccgctcgcgtaatatatctatcccgaatacctataaaaaactaacaaccctaaacgtacccacgtaaaaacgtcgaattttaccttccgaac

SEQ ID NO: 23861 - DNA, 768 bp, Artificial Sequence
  chemically treated genomic DNA (Homo sapiens) CpG-island No: 23861
cgttattttagttaggtattcgggcgatatgacgtagtatggcggtagtattgtttagggtttagtcggggtgcgtattggtgtttttatcggcgtggtttgttcggtgtgtttcggcggagtgacgttcggttattcggttaattttttgttcggtgtaaaggtttttttcggtgaaatcgatatcgttttgttcggttcgttgtcgtttattttttttcgtatttatagtagttatcggataaaaacgttcgcgtcggtggggagtttcggtttcggttggaaaatgtttgcggatattcgtttatagttgcgcgataatatattgatatttagtgataacggcggtagaagtttgtattttgagtatttgtttttcggtgaggacggttatagtcgtagcgagttattgtggttggtgcgcggcggcgtggcgaaattggatgaaggttatcggttggtcgtattttggtaggcgttgtcggaagaatttcgtttaagttcgtatcgttatttggcgataaatagttcgtaggggtcgtggtggttgttcggttggtgtgagcgggtgtcggaagcggatgaagtgttgtttgcgtttttgtcggcgtatcgggtattgaacgggttggtggatttaagagtatcgagtcgaagaatacggcggggcggagttcggagagtaacggaatagtttagagtttcgtgaaaacgataaagcgtgattatatgggtattatgtttaaattagacgggttagcggtagta

SEQ ID NO: 23862 - DNA, 768 bp, Artificial Sequence
  chemically treated genomic DNA (Homo sapiens) CpG-island No: 23862
tactaccgctaacccgtctaatttaaacataatacccatataatcacgctttatcgttttcacgaaactctaaactattccgttactctccgaactccgccccgccgtattcttcgactcgatactcttaaatccaccaacccgttcaatacccgatacgccgacaaaaacgcaaacaacacttcatccgcttccgacacccgctcacaccaaccgaacaaccaccacgacccctacgaactatttatcgccaaataacgatacgaacttaaacgaaattcttccgacaacgcctaccaaaatacgaccaaccgataaccttcatccaatttcgccacgccgccgcgcaccaaccacaataactcgctacgactataaccgtcctcaccgaaaaacaaatactcaaaatacaaacttctaccgccgttatcactaaatatcaatatattatcgcgcaactataaacgaatatccgcaaacattttccaaccgaaaccgaaactccccaccgacgcgaacgtttttatccgataactactataaatacgaaaaaaaataaacgacaacgaaccgaacaaaacgatatcgatttcaccgaaaaaaacctttacaccgaacaaaaaattaaccgaataaccgaacgtcactccgccgaaacacaccgaacaaaccacgccgataaaaacaccaatacgcaccccgactaaaccctaaacaatactaccgccatactacgtcatatcgcccgaatacctaactaaaataacg

SEQ ID NO: 23863 - DNA, 768 bp, Artificial Sequence
  chemically treated genomic DNA (Homo sapiens) CpG-island No: 23863
tgttgtcgttaattcgtttggtttgggtatgatatttatgtagttacgttttatcgtttttacgaagttttaagttatttcgttatttttcggatttcgtttcgtcgtgtttttcggttcggtatttttgggtttattagttcgtttagtattcggtacgtcggtaggggcgtaggtagtattttattcgttttcggtattcgtttatattaatcgagtagttattacggtttttgcggattgtttgtcgttagataacgatgcggatttaagcggagttttttcggtagcgtttgttagagtgcggttagtcggtgatttttatttagtttcgttacgtcgtcgcgtattagttatagtgattcgttgcggttgtaatcgtttttatcgggaaataggtgtttaaaatataggtttttgtcgtcgttattattgagtattagtgtgttatcgcgtagttgtaagcggatattcgtaggtattttttagtcggggtcgaggttttttatcggcgcgggcgtttttgttcggtaattgttgtaggtgcgggagaggatgaacggtagcgggtcgggtagggcgatgtcggttttatcgggaaggatttttgtatcgagtaggggattgatcggatggtcggacgttatttcgtcggggtatatcgaataggttacgtcggtgggggtattaatgcgtatttcggttgaattttgaataatgttatcgttatattgcgttatgtcgttcgggtatttagttagggtagcg

SEQ ID NO: 23864 - DNA, 768 bp, Artificial Sequence
  chemically treated genomic DNA (Homo sapiens) CpG-island No: 23864
cgctaccctaactaaatacccgaacgacataacgcaatataacgataacattattcaaaattcaaccgaaatacgcattaatacccccaccgacgtaacctattcgatataccccgacgaaataacgtccgaccatccgatcaatcccctactcgatacaaaaatccttcccgataaaaccgacatcgccctacccgacccgctaccgttcatcctctcccgcacctacaacaattaccgaacaaaaacgcccgcgccgataaaaaacctcgaccccgactaaaaaatacctacgaatatccgcttacaactacgcgataacacactaatactcaataataacgacgacaaaaacctatattttaaacacctatttcccgataaaaacgattacaaccgcaacgaatcactataactaatacgcgacgacgtaacgaaactaaataaaaatcaccgactaaccgcactctaacaaacgctaccgaaaaaactccgcttaaatccgcatcgttatctaacgacaaacaatccgcaaaaaccgtaataactactcgattaatataaacgaataccgaaaacgaataaaatactacctacgcccctaccgacgtaccgaatactaaacgaactaataaacccaaaaataccgaaccgaaaaacacgacgaaacgaaatccgaaaaataacgaaataacttaaaacttcgtaaaaacgataaaacgtaactacataaatatcatacccaaaccaaacgaattaacgacaaca

SEQ ID NO: 23865 - DNA, 735 bp, Artificial Sequence
  chemically treated genomic DNA (Homo sapiens) CpG-island No: 23865
  misc_feature (635)..(635): n is either a, c, g or t
  misc_feature (644)..(644): n is either a, c, g or t
  misc_feature (677)..(677): n is either a, c, g or t
acggttttcgattaattgaggatggaattcgtaatattttagcgtcgaggtttcgtcggtaatagtcgcgtttttatttagagcgcgtgttatatagttatgtaatagtttacgaaggaaaaattgcggggttagcgcgtgcgtataagtcgttgcgatcgtttggtatgagtaatggtatttttgtagagttcgtgtacgttttatagtatcgcgtaatggttcgtagagtatttttttcgtgcgcgtggattagtttaacgttattaatcgcgtaagtgttattattatgtaaataagtataatcggtgttatgtattaatatttattgtgcgtcgttatcggtttttagttttgttagtacggaatcggtacgtttattatcgttatgtatagcgttgatttgcggatgattcgttagaggaagttgtgtaaaacggttatcgttaggatttatggtaatgtcgatacgttttatcggggaatgcgttagtagcgtatgtatcgagtgtttaagaatggtttgattatcgattgagagatattgtttaggatatttcgtttgtattcgacggttatattcggtcgtcggaattacggcgtaaatatttaaatgagtggttgcggggagtttnttgcgtagngttttttagtggggtgatgtatttttttggcgnttttcgtttttttagtatttttatcggaggtatagtagggattttttgtttacgtggg

SEQ ID NO: 23866 - DNA, 735 bp, Artificial Sequence
  chemically treated genomic DNA (Homo sapiens) CpG-island No: 23866
  misc_feature (59)..(59): n is either a, c, g or t
  misc_feature (92)..(92): n is either a, c, g or t
  misc_feature (101)..(101): n is either a, c, g or t
cccacgtaaacaaaaaatccctactatacctccgataaaaatactaaaaaaacgaaaancgccaaaaaaatacatcaccccactaaaaaacnctacgcaanaaactccccgcaaccactcatttaaatatttacgccgtaattccgacgaccgaatataaccgtcgaatacaaacgaaatatcctaaacaatatctctcaatcgataatcaaaccattcttaaacactcgatacatacgctactaacgcattccccgataaaacgtatcgacattaccataaatcctaacgataaccgttttacacaacttcctctaacgaatcatccgcaaatcaacgctatacataacgataataaacgtaccgattccgtactaacaaaactaaaaaccgataacgacgcacaataaatattaatacataacaccgattatacttatttacataataataacacttacgcgattaataacgttaaactaatccacgcgcacgaaaaaaatactctacgaaccattacgcgatactataaaacgtacacgaactctacaaaaataccattactcataccaaacgatcgcaacgacttatacgcacgcgctaaccccgcaatttttccttcgtaaactattacataactatataacacgcgctctaaataaaaacgcgactattaccgacgaaacctcgacgctaaaatattacgaattccatcctcaattaatcgaaaaccgt

SEQ ID NO: 23867 - DNA, 735 bp, Artificial Sequence
  chemically treated genomic DNA (Homo sapiens) CpG-island No: 23867
  misc_feature (59)..(59): n is either a, c, g or t
  misc_feature (92)..(92): n is either a, c, g or t
  misc_feature (101)..(101): n is either a, c, g or t
tttacgtgggtagaaaatttttgttgtattttcgatggggatattaggaaagcgggggncgttaaaaaaatgtattattttattgagaagtnttacgtaanaggtttttcgtaattatttatttggatgtttgcgtcgtggtttcggcggtcggatgtggtcgtcgaatgtaaacggaatgttttaagtaatattttttaatcggtaattaaattatttttgagtattcggtgtatgcgttgttggcgtatttttcggtgaaacgtgtcggtattgttataagttttggcgatagtcgttttgtataattttttttggcgaattattcgtaaattaacgttgtatatggcggtgatgagcgtgtcgatttcgtgttggtagggttgaaagtcggtggcgacgtataatgggtattggtgtatgatatcgattgtgtttgtttgtatgatgatgatatttgcgcgattggtggcgttgagttaatttacgcgtacgggggggatgttttgcggattattgcgcgatattatgaaacgtgtacgaattttgtaaaaatgttattgtttatattagacgatcgtaacggtttatgcgtacgcgttgatttcgtaatttttttttcgtgagttgttatatgattgtgtgatacgcgttttaaatgaaggcgcgattattatcgacgaagtttcggcgttggaatattgcggattttatttttagttggtcgaaggtcgt

SEQ ID NO: 23868 - DNA, 735 bp, Artificial Sequence
  chemically treated genomic DNA (Homo sapiens) CpG-island No: 23868
  misc_feature (635)..(635): n is either a, c, g or t
  misc_feature (644)..(644): n is either a, c, g or t
  misc_feature (677)..(677): n is either a, c, g or t
acgaccttcgaccaactaaaaataaaatccgcaatattccaacgccgaaacttcgtcgataataatcgcgccttcatttaaaacgcgtatcacacaatcatataacaactcacgaaaaaaaaattacgaaatcaacgcgtacgcataaaccgttacgatcgtctaatataaacaataacatttttacaaaattcgtacacgtttcataatatcgcgcaataatccgcaaaacatcccccccgtacgcgtaaattaactcaacgccaccaatcgcgcaaatatcatcatcatacaaacaaacacaatcgatatcatacaccaatacccattatacgtcgccaccgactttcaaccctaccaacacgaaatcgacacgctcatcaccgccatatacaacgttaatttacgaataattcgccaaaaaaaattatacaaaacgactatcgccaaaacttataacaataccgacacgtttcaccgaaaaatacgccaacaacgcatacaccgaatactcaaaaataatttaattaccgattaaaaaatattacttaaaacattccgtttacattcgacgaccacatccgaccgccgaaaccacgacgcaaacatccaaataaataattacgaaaaacctnttacgtaanacttctcaataaaataatacatttttttaacgncccccgctttcctaatatccccatcgaaaatacaacaaaaattttctacccacgtaaa

SEQ ID NO: 23869 - DNA, 1114 bp, Artificial Sequence
  chemically treated genomic DNA (Homo sapiens) CpG-island No: 23869
  misc_feature (1028)..(1028): n is either a, c, g or t
gagatgcgcggtattacggttggtggcggtagcgcgtaaggagaattgcggggttcggggatgatcgcgttagtattcgtgatattgttaggtaaaatttatttattgagaggaggaataattatagtttgcggcgacggagtggattaagagggttgggtgcgggggatttagatgcgcgggcgttgttttaagacgatcgtattgggcggtgggtacgcggggaattcgaagggtcgcggatttttattaatgtttatgggaagaaatttgggaaacgggtagacggtacgagcgtttagggggtgtggttgggcgggatacgggcggcgttacggaaaaataagtatatgcgtattacgtcgcgaggacgaaggtaaagtcgtaaatagttcgcgtttcgtgtgttgggatagttgattatagcgacgggttttatcgcggtaataatagacggtgcgtcggcgaacgtttaaatgggttacgggtttgtttatggtatgtaatgtatggattgggttattagaagaaggaagaggatggcgcggggggtgcggggacggggagcgattggtgacgtttgcgagaagaggaaggagggacgtatagtgtaggtacgtagtgttaacggcgggatcgacggggcgcgaggggtgcggcggggcgaagggggttattaagcgaggaaggttatagtcggggcggatggtatcgggaattgggtacggggtagtggacgtcgcggaaggaggtatgcgacggaaattattgcgaagcggcgtagcggcgagtcgaacgtcgttagttagaggttaggggggagtgaggttaggggtgggtgcgggggcggtacggtagtgtgggagatgaagttattgagatcgttgtggaacgggtaataggggtgtgatagaagaaatcggattacggggcgcggcgcgcggggcggtgcggttgtgaatggcgcgtgggaaatattttttgggggaatttacgggggtgaaagattgcgatgcgcgtatacggtntgggttatttcggaagtagcggttaacgggaggggatttggggggatgggatagttataagttgggaaggtgaggtaggtgagggg

SEQ ID NO: 23870 - DNA, 1114 bp, Artificial Sequence
  chemically treated genomic DNA (Homo sapiens) CpG-island No: 23870
  misc_feature (87)..(87): n is either a, c, g or t
cccctcacctacctcaccttcccaacttataactatcccatccccccaaatcccctcccgttaaccgctacttccgaaataacccanaccgtatacgcgcatcgcaatctttcacccccgtaaattcccccaaaaaatatttcccacgcgccattcacaaccgcaccgccccgcgcgccgcgccccgtaatccgatttcttctatcacacccctattacccgttccacaacgatctcaataacttcatctcccacactaccgtaccgcccccgcacccacccctaacctcactcccccctaacctctaactaacgacgttcgactcgccgctacgccgcttcgcaataatttccgtcgcatacctccttccgcgacgtccactaccccgtacccaattcccgataccatccgccccgactataaccttcctcgcttaataacccccttcgccccgccgcacccctcgcgccccgtcgatcccgccgttaacactacgtacctacactatacgtccctccttcctcttctcgcaaacgtcaccaatcgctccccgtccccgcaccccccgcgccatcctcttccttcttctaataacccaatccatacattacataccataaacaaacccgtaacccatttaaacgttcgccgacgcaccgtctattattaccgcgataaaacccgtcgctataatcaactatcccaacacacgaaacgcgaactatttacgactttaccttcgtcctcgcgacgtaatacgcatatacttatttttccgtaacgccgcccgtatcccgcccaaccacaccccctaaacgctcgtaccgtctacccgtttcccaaatttcttcccataaacattaataaaaatccgcgacccttcgaattccccgcgtacccaccgcccaatacgatcgtcttaaaacaacgcccgcgcatctaaatcccccgcacccaaccctcttaatccactccgtcgccgcaaactataattattcctcctctcaataaataaattttacctaacaatatcacgaatactaacgcgatcatccccgaaccccgcaattctccttacgcgctaccgccaccaaccgtaataccgcgcatctc

SEQ ID NO: 23871 - DNA, 1114 bp, Artificial Sequence
  chemically treated genomic DNA (Homo sapiens) CpG-island No: 23871
  misc_feature (87)..(87): n is either a, c, g or t
ttttttatttgttttatttttttaatttgtggttattttatttttttaggttttttttcgttgatcgttattttcgaagtggtttanatcgtgtgcgcgtatcgtaattttttattttcgtgggtttttttaaaaaatattttttacgcgttatttatagtcgtatcgtttcgcgcgtcgcgtttcgtagttcggttttttttgttatatttttattgttcgttttataacggttttagtggttttattttttatattgtcgtgtcgttttcgtatttatttttagttttatttttttttagtttttaattagcggcgttcggttcgtcgttgcgtcgtttcgtagtggttttcgtcgtatattttttttcgcggcgtttattgtttcgtatttagttttcggtattattcgtttcgattatagtttttttcgtttagtaatttttttcgtttcgtcgtatttttcgcgtttcgtcggtttcgtcgttggtattacgtatttgtattgtacgtttttttttttttttttcgtaaacgttattaatcgtttttcgttttcgtatttttcgcgttattttttttttttttttagtggtttagtttatgtattgtatattataagtaaattcgtagtttatttaagcgttcgtcggcgtatcgtttgttgttatcgcggtaaaattcgtcgttatagttaattgttttagtatacggggcgcgggttatttacggttttattttcgttttcgcggcgtagtacgtatatgtttgttttttcgtagcgtcgttcgtatttcgtttagttatattttttaggcgttcgtgtcgtttattcgttttttaagtttttttttataaatattagtaggggttcgcggtttttcgggtttttcgcgtgtttatcgtttaatacggtcgttttagggtagcgttcgcgtatttggatttttcgtatttaatttttttggtttatttcgtcgtcgtaggttgtggttatttttttttttagtgggtaaattttatttagtagtattacgaatgttggcgcggttattttcgggtttcgtaattttttttgcgcgttatcgttattagtcgtagtatcgcgtatttt

SEQ ID NO: 23872 - DNA, 1114 bp, Artificial Sequence
  chemically treated genomic DNA (Homo sapiens) CpG-island No: 23872
  misc_feature (1028)..(1028): n is either a, c, g or t
aaaatacgcgatactacgactaataacgataacgcgcaaaaaaaattacgaaacccgaaaataaccgcgccaacattcgtaatactactaaataaaatttacccactaaaaaaaaaaataaccacaacctacgacgacgaaataaaccaaaaaaattaaatacgaaaaatccaaatacgcgaacgctaccctaaaacgaccgtattaaacgataaacacgcgaaaaacccgaaaaaccgcgaacccctactaatatttataaaaaaaaacttaaaaaacgaataaacgacacgaacgcctaaaaaatataactaaacgaaatacgaacgacgctacgaaaaaacaaacatatacgtactacgccgcgaaaacgaaaataaaaccgtaaataacccgcgccccgtatactaaaacaattaactataacgacgaattttaccgcgataacaacaaacgatacgccgacgaacgcttaaataaactacgaatttacttataatatacaatacataaactaaaccactaaaaaaaaaaaaaaaataacgcgaaaaatacgaaaacgaaaaacgattaataacgtttacgaaaaaaaaaaaaaaaaacgtacaatacaaatacgtaataccaacgacgaaaccgacgaaacgcgaaaaatacgacgaaacgaaaaaaattactaaacgaaaaaaactataatcgaaacgaataataccgaaaactaaatacgaaacaataaacgccgcgaaaaaaaatatacgacgaaaaccactacgaaacgacgcaacgacgaaccgaacgccgctaattaaaaactaaaaaaaaataaaactaaaaataaatacgaaaacgacacgacaatataaaaaataaaaccactaaaaccgttataaaacgaacaataaaaatataacaaaaaaaaccgaactacgaaacgcgacgcgcgaaacgatacgactataaataacgcgtaaaaaatattttttaaaaaaacccacgaaaataaaaaattacgatacgcgcacacgatntaaaccacttcgaaaataacgatcaacgaaaaaaaacctaaaaaaataaaataaccacaaattaaaaaaataaaacaaataaaaaa

SEQ ID NO: 23873 - DNA, 784 bp, Artificial Sequence
  chemically treated genomic DNA (Homo sapiens) CpG-island No: 23873
gtggcggagtcgggagataatcggttcggagtttttatcgttttttaggttgggttcgggttttttcgcggcgttttttttttcggtttagattcggttagttcgggttttttttttcggttttattttatgataatcgtatttttcggatgttttagacgtcgcggaattgatttgaaatgtagttttgttagcggattcgggtgggtatcgagggcgagggcgcgttttttatttcgtacgcggtttttttttcggtcgttttcgtttcggttggtcgttagcggggaggggcgggtttcggagtttcgcggttttatttacgttgttggttttcgtcgcgggttcggttttttacggcggggttatcggggtcgtcgggttgtttgtttcgtttcgtcgtcgtcggtcggagtttgttcgttcgttcgcgtttttttaggtgtcggagtcgcgatgtggagaggttggcgagggggacggacggtaggagggagggagcggagtcgtgagttggagaggaggacgagggaggagcgggaagggcggggaacggcggcggtttgcggcgcgcgagcggcgggcgcggaagtcggaaggaagcgcggaatttaaattgattagatttagcgtagcgagcgtttcgggaattcgagagatgggacgaatatcggattatacggtttttattgtataagcgggatattaaaaatcggataaggataatatacgtttatatttataaaagtacgcgtagtcgataattgaattttattttgatttt

SEQ ID NO: 23874 - DNA, 784 bp, Artificial Sequence
  chemically treated genomic DNA (Homo sapiens) CpG-island No: 23874
aaaatcaaaataaaattcaattatcgactacgcgtacttttataaatataaacgtatattatccttatccgatttttaatatcccgcttatacaataaaaaccgtataatccgatattcgtcccatctctcgaattcccgaaacgctcgctacgctaaatctaatcaatttaaattccgcgcttccttccgacttccgcgcccgccgctcgcgcgccgcaaaccgccgccgttccccgcccttcccgctcctccctcgtcctcctctccaactcacgactccgctccctccctcctaccgtccgtccccctcgccaacctctccacatcgcgactccgacacctaaaaaaacgcgaacgaacgaacaaactccgaccgacgacgacgaaacgaaacaaacaacccgacgaccccgataaccccgccgtaaaaaaccgaacccgcgacgaaaaccaacaacgtaaataaaaccgcgaaactccgaaacccgcccctccccgctaacgaccaaccgaaacgaaaacgaccgaaaaaaaaaccgcgtacgaaataaaaaacgcgccctcgccctcgatacccacccgaatccgctaacaaaactacatttcaaatcaattccgcgacgtctaaaacatccgaaaaatacgattatcataaaataaaaccgaaaaaaaaaacccgaactaaccgaatctaaaccgaaaaaaaaaacgccgcgaaaaaacccgaacccaacctaaaaaacgataaaaactccgaaccgattatctcccgactccgccac

SEQ ID NO: 23875 - DNA, 784 bp, Artificial Sequence
  chemically treated genomic DNA (Homo sapiens) CpG-island No: 23875
agaattagaatggggtttaattgtcggttgcgcgtgtttttgtgggtgtagacgtgtgttgtttttgttcggtttttaatgtttcgtttgtgtagtgggggtcgtgtggttcggtgttcgttttatttttcgggttttcgggacgttcgttgcgttgagtttgattagtttgggtttcgcgttttttttcggttttcgcgttcgtcgttcgcgcgtcgtaggtcgtcgtcgtttttcgtttttttcgtttttttttcgtttttttttttagtttacggtttcgtttttttttttttgtcgttcgtttttttcgttagtttttttatatcgcggtttcggtatttgaagggacgcgggcgggcgggtaagtttcgatcggcggcgacggggcgggatagatagttcggcggtttcgatggtttcgtcgtgagaggtcggattcgcggcggggattagtagcgtgagtggggtcgcggggtttcgggattcgttttttttcgttggcggttagtcggggcgggagcggtcggggagagggtcgcgtgcggggtggggggcgcgttttcgttttcggtgtttattcgggttcgttaataaagttatattttagattaatttcgcggcgtttggagtattcgaaggatacggttgttatgggatggggtcgagagaggaagttcgggttggtcgggtttgggtcggggaggggggcgtcgcgggaaagttcgagtttagtttgagggacggtgggggtttcgggtcgattgtttttcggtttcgttat

SEQ ID NO: 23876 - DNA, 784 bp, Artificial Sequence
  chemically treated genomic DNA (Homo sapiens) CpG-island No: 23876
ataacgaaaccgaaaaacaatcgacccgaaacccccaccgtccctcaaactaaactcgaactttcccgcgacgcccccctccccgacccaaacccgaccaacccgaacttcctctctcgaccccatcccataacaaccgtatccttcgaatactccaaacgccgcgaaattaatctaaaatataactttattaacgaacccgaataaacaccgaaaacgaaaacgcgccccccaccccgcacgcgaccctctccccgaccgctcccgccccgactaaccgccaacgaaaaaaaacgaatcccgaaaccccgcgaccccactcacgctactaatccccgccgcgaatccgacctctcacgacgaaaccatcgaaaccgccgaactatctatcccgccccgtcgccgccgatcgaaacttacccgcccgcccgcgtcccttcaaataccgaaaccgcgatataaaaaaactaacgaaaaaaacgaacgacaaaaaaaaaaaaacgaaaccgtaaactaaaaaaaaaaacgaaaaaaaaacgaaaaaaacgaaaaacgacgacgacctacgacgcgcgaacgacgaacgcgaaaaccgaaaaaaaacgcgaaacccaaactaatcaaactcaacgcaacgaacgtcccgaaaacccgaaaaataaaacgaacaccgaaccacacgacccccactacacaaacgaaacattaaaaaccgaacaaaaacaacacacgtctacacccacaaaaacacgcgcaaccgacaattaaaccccattctaattct

SEQ ID NO: 23877 - DNA, 847 bp, Artificial Sequence
  chemically treated genomic DNA (Homo sapiens) CpG-island No: 23877
gcgcggcggggttttagatggcgtcgagttttgtttggttcgcgggggcggttcgcggttgtgtttgtgttggttcgcgtgttgtggttgtttagtgagtagtaagttttgttgtcgtcgtcgggtatagtggcggcgagttcgagcgtagcgcgtcgtgcgtttacgtaggtttaggaaaggtgtgttttcggtcgttagcgtttcgttcgcgcgttcgcgtcgtcgttcgacgtcgaggttgagtcgtcgttcgagtcgtttttagcgatagcgagtttttcgtcgttcgtgcgcgttgcgtcgttagtcgttgaggcgcgagcggcgttagcgtcggggtttcgtcgacgttttgcggacgtatcgcgcgcgcgcggtcgcggcggcggcgggggcgcgtatttttggtggtttcgtattcgtcgttttcggggatgcggaaggggttggtaggtagttgtttaggttgtcgtcgagcgcgtaggtttcgcgtcgcggttcgggttcggcgcggggtaatagtagttgttatagttgcgttgtatgtttgcgtcggttcgggttcgggttcgggatagggtttaggatcggggggtgtagggttattagaacggatagatgttcggttagtcggtaattgatgggtgtcgtcgagaaatagatacggtgtgcgtcgagttggggtacgtgattttaaagttggtatttgcgtggttagcgagtagtggaagtttacgggcgagaggcgcggggttgtggttaggtttaatacgtatttgcggggagaggtagaggtatggttagggttagttcggttcggcgcgggggagggggggttgggggt

SEQ ID NO: 23878 - DNA, 847 bp, Artificial Sequence
  chemically treated genomic DNA (Homo sapiens) CpG-island No: 23878
acccccaaccccccctcccccgcgccgaaccgaactaaccctaaccatacctctacctctccccgcaaatacgtattaaacctaaccacaaccccgcgcctctcgcccgtaaacttccactactcgctaaccacgcaaataccaactttaaaatcacgtaccccaactcgacgcacaccgtatctatttctcgacgacacccatcaattaccgactaaccgaacatctatccgttctaataaccctacaccccccgatcctaaaccctatcccgaacccgaacccgaaccgacgcaaacatacaacgcaactataacaactactattaccccgcgccgaacccgaaccgcgacgcgaaacctacgcgctcgacgacaacctaaacaactacctaccaaccccttccgcatccccgaaaacgacgaatacgaaaccaccaaaaatacgcgcccccgccgccgccgcgaccgcgcgcgcgcgatacgtccgcaaaacgtcgacgaaaccccgacgctaacgccgctcgcgcctcaacgactaacgacgcaacgcgcacgaacgacgaaaaactcgctatcgctaaaaacgactcgaacgacgactcaacctcgacgtcgaacgacgacgcgaacgcgcgaacgaaacgctaacgaccgaaaacacacctttcctaaacctacgtaaacgcacgacgcgctacgctcgaactcgccgccactatacccgacgacgacaacaaaacttactactcactaaacaaccacaacacgcgaaccaacacaaacacaaccgcgaaccgcccccgcgaaccaaacaaaactcgacgccatctaaaaccccgccgcgc

SEQ ID NO: 23879 - DNA, 847 bp, Artificial Sequence
  chemically treated genomic DNA (Homo sapiens) CpG-island No: 23879
atttttaattttttttttttcgcgtcggatcgggttggttttggttatgtttttgttttttttcgtaagtacgtgttggatttgattatagtttcgcgtttttcgttcgtggatttttattattcgttggttacgtaggtgttaattttgagattacgtattttaattcggcgtatatcgtgtttatttttcggcggtatttattagttatcgattggtcgaatatttattcgttttagtaattttgtatttttcggttttggattttgtttcgggttcgggttcgggtcggcgtagatatgtagcgtagttatgatagttattattatttcgcgtcgggttcggatcgcggcgcgggatttgcgcgttcggcggtagtttggatagttgtttgttagtttttttcgtattttcgaggacgacgagtacgagattattaggagtgcgcgttttcgtcgtcgtcgcggtcgcgcgcgcgcggtgcgttcgtaggacgtcggcggggtttcggcgttggcgtcgttcgcgttttaacggttggcggcgtagcgcgtacgggcggcgagggattcgttgtcgttgagagcggttcgggcggcggtttagtttcggcgtcggacgacgacgcggacgcgcggacggggcgttggcggtcgagagtatattttttttgggtttgcgtgggcgtacgacgcgttgcgttcggattcgtcgttattgtgttcggcggcgatagtaggatttattatttattggatagttatagtacgcgggttagtatagatatagtcgcgggtcgttttcgcgggttaagtaggattcggcgttatttagggtttcgtcgcgt

SEQ ID NO: 23880 - DNA, 847 bp, Artificial Sequence
  chemically treated genomic DNA (Homo sapiens) CpG-island No: 23880
acgcgacgaaaccctaaataacgccgaatcctacttaacccgcgaaaacgacccgcgactatatctatactaacccgcgtactataactatccaataaataataaatcctactatcgccgccgaacacaataacgacgaatccgaacgcaacgcgtcgtacgcccacgcaaacccaaaaaaaatatactctcgaccgccaacgccccgtccgcgcgtccgcgtcgtcgtccgacgccgaaactaaaccgccgcccgaaccgctctcaacgacaacgaatccctcgccgcccgtacgcgctacgccgccaaccgttaaaacgcgaacgacgccaacgccgaaaccccgccgacgtcctacgaacgcaccgcgcgcgcgcgaccgcgacgacgacgaaaacgcgcactcctaataatctcgtactcgtcgtcctcgaaaatacgaaaaaaactaacaaacaactatccaaactaccgccgaacgcgcaaatcccgcgccgcgatccgaacccgacgcgaaataataataactatcataactacgctacatatctacgccgacccgaacccgaacccgaaacaaaatccaaaaccgaaaaatacaaaattactaaaacgaataaatattcgaccaatcgataactaataaataccgccgaaaaataaacacgatatacgccgaattaaaatacgtaatctcaaaattaacacctacgtaaccaacgaataataaaaatccacgaacgaaaaacgcgaaactataatcaaatccaacacgtacttacgaaaaaaaacaaaaacataaccaaaaccaacccgatccgacgcgaaaaaaaaaaaattaaaaat

SEQ ID NO: 23881 - DNA, 762 bp, Artificial Sequence
  chemically treated genomic DNA (Homo sapiens) CpG-island No: 23881
tatacgtttcgcggttcgagtcggtggagggggggcgagggtggagggcgcgggagggaagagttaaggttcgttgtttttttttttcggagggtgtgatcgttataagaaaggcgtcgcgttcgggtattgaggttgtaggcggcgggggcgagcgcggtagcggagagttgaggtcgttttatcgtttgggatttcgtgcgaatgtcggagtttaggaggaggggtcgcggtcgcggtaagaagtattcgaggggaggaagcgggagagggagttcgatttcggggagaaaggtagggattttcgcgcgtttagaaattcggtttttttgggagaaatttgtcgttttttattcgtttttagcgtagcgcgggtgagtttaggttgcgttagcggcgtcgcggtgataggtatcgagggcgcgcgtgtttgcgtgcgagcgggtttcgcggtcgggagagtaaggggttgcgtgttaggagttcgatagtggtttgcgcgttttttttcgggcggtcgcgtttttacgtaggggcgggtaagagcgttgtacgttcggtatcggtttgtaggcgagtagttttgagcgagcgggatggagtcgcggatatcgatagaaaggcggcggttgattagacgttgggttcggtttggtcgtcgagcgtttcgggagttgttattgtttttttttttcggagagatcggagttttcgggtttgtttttatttatgtgttatatttttttcgttttgttcggttat

SEQ ID NO: 23882 - DNA, 762 bp, Artificial Sequence
  chemically treated genomic DNA (Homo sapiens) CpG-island No: 23882
ataaccgaacaaaacgaaaaaaatataacacataaataaaaacaaacccgaaaactccgatctctccgaaaaaaaaaaacaataacaactcccgaaacgctcgacgaccaaaccgaacccaacgtctaatcaaccgccgcctttctatcgatatccgcgactccatcccgctcgctcaaaactactcgcctacaaaccgataccgaacgtacaacgctcttacccgcccctacgtaaaaacgcgaccgcccgaaaaaaaacgcgcaaaccactatcgaactcctaacacgcaaccccttactctcccgaccgcgaaacccgctcgcacgcaaacacgcgcgccctcgatacctatcaccgcgacgccgctaacgcaacctaaactcacccgcgctacgctaaaaacgaataaaaaacgacaaatttctcccaaaaaaaccgaatttctaaacgcgcgaaaatccctacctttctccccgaaatcgaactccctctcccgcttcctcccctcgaatacttcttaccgcgaccgcgacccctcctcctaaactccgacattcgcacgaaatcccaaacgataaaacgacctcaactctccgctaccgcgctcgcccccgccgcctacaacctcaatacccgaacgcgacgcctttcttataacgatcacaccctccgaaaaaaaaaaacaacgaaccttaactcttccctcccgcgccctccaccctcgccccccctccaccgactcgaaccgcgaaacgtata

SEQ ID NO: 23883 - DNA, 762 bp, Artificial Sequence
  chemically treated genomic DNA (Homo sapiens) CpG-island No: 23883
gtggtcgagtagaacggagggggtgtggtatatgggtaggggtaagttcgagggtttcgattttttcgagaagggaaggtagtgatagttttcggagcgttcggcggttaggtcgggtttagcgtttgattagtcgtcgtttttttgtcggtattcgcggttttatttcgttcgtttagggttgttcgtttgtaggtcggtatcgggcgtgtagcgtttttgttcgtttttgcgtggggacgcggtcgttcggggagaggcgcgtaagttattgtcgggtttttggtacgtagttttttgttttttcggtcgcgagattcgttcgtacgtaggtacgcgcgttttcggtgtttgttatcgcggcgtcgttagcgtagtttagatttattcgcgttgcgttgggggcgggtgaggggcggtaggttttttttagggaaatcgggtttttgggcgcgcggaggtttttattttttttttcgggatcgggttttttttttcgtttttttttttcgggtgttttttgtcgcggtcgcggtttttttttttggatttcgatattcgtacggggttttaggcggtgggacggttttagtttttcgttgtcgcgttcgttttcgtcgtttgtagttttagtgttcgagcgcggcgttttttttatggcggttatatttttcgggggaggggagtagcgagttttaatttttttttttcgcgttttttattttcgttttttttttatcggttcgggtcgcggggcgtgtg

SEQ ID NO: 23884 - DNA, 762 bp, Artificial Sequence
  chemically treated genomic DNA (Homo sapiens) CpG-island No: 23884
cacacgccccgcgacccgaaccgataaaaaaaaaacgaaaataaaaaacgcgaaaaaaaaaaattaaaactcgctactcccctcccccgaaaaatataaccgccataaaaaaaacgccgcgctcgaacactaaaactacaaacgacgaaaacgaacgcgacaacgaaaaactaaaaccgtcccaccgcctaaaaccccgtacgaatatcgaaatccaaaaaaaaaaaccgcgaccgcgacaaaaaacacccgaaaaaaaaaaacgaaaaaaaaaacccgatcccgaaaaaaaaaataaaaacctccgcgcgcccaaaaacccgatttccctaaaaaaaacctaccgcccctcacccgcccccaacgcaacgcgaataaatctaaactacgctaacgacgccgcgataacaaacaccgaaaacgcgcgtacctacgtacgaacgaatctcgcgaccgaaaaaacaaaaaactacgtaccaaaaacccgacaataacttacgcgcctctccccgaacgaccgcgtccccacgcaaaaacgaacaaaaacgctacacgcccgataccgacctacaaacgaacaaccctaaacgaacgaaataaaaccgcgaataccgacaaaaaaacgacgactaatcaaacgctaaacccgacctaaccgccgaacgctccgaaaactatcactaccttcccttctcgaaaaaatcgaaaccctcgaacttacccctacccatataccacaccccctccgttctactcgaccac

SEQ ID NO: 23885 - DNA, 571 bp, Artificial Sequence
  chemically treated genomic DNA (Homo sapiens) CpG-island No: 23885
  misc_feature (48)..(48): n is either a, c, g or t
  misc_feature (407)..(407): n is either a, c, g or t
gcgaatggcgtttttaggtcggggattttttagaatcgatcgtcgatntgtagtttaacgtttttttcgtttttttcggttgtcgtattttatttattcgacgcgcgttcgttacgattttttcgtatttgtttatcgtgtcgattttttattttcgatttttttcgggacgtaggttatcggtttttaacgtaatattcgttaagttaattttttttatttacgtagtttaaggattttattttatagtcgtattttttttatcgtttcgtgcgtacgttttttgtcgttttttacgtttttatcgcggtttgacgtatttttacgtattaaattttgggattatacggtattattatagttttaaggttttacgcgttttaaggtagggttgcgtgcgttttcgngtcgacgcgatttttttaggggttcggattttgtaaaatcgttttttttacgcggagggaagatattcggatttttagaagttttttttaagcgatttttttagtaatggttttttgtttttttcggatttttatcggggtaagagcgttttataaatttagat

SEQ ID NO: 23886 - DNA, 571 bp, Artificial Sequence
  chemically treated genomic DNA (Homo sapiens) CpG-island No: 23886
  misc_feature (165)..(165): n is either a, c, g or t
  misc_feature (524)..(524): n is either a, c, g or t
atctaaatttataaaacgctcttaccccgataaaaatccgaaaaaaacaaaaaaccattactaaaaaaatcgcttaaaaaaaacttctaaaaatccgaatatcttccctccgcgtaaaaaaaacgattttacaaaatccgaacccctaaaaaaatcgcgtcgacncgaaaacgcacgcaaccctaccttaaaacgcgtaaaaccttaaaactataataataccgtataatcccaaaatttaatacgtaaaaatacgtcaaaccgcgataaaaacgtaaaaaacgacaaaaaacgtacgcacgaaacgataaaaaaaatacgactataaaataaaatccttaaactacgtaaataaaaaaaattaacttaacgaatattacgttaaaaaccgataacctacgtcccgaaaaaaatcgaaaataaaaaatcgacacgataaacaaatacgaaaaaatcgtaacgaacgcgcgtcgaataaataaaatacgacaaccgaaaaaaacgaaaaaaacgttaaactacanatcgacgatcgattctaaaaaatccccgacctaaaaacgccattcgc

SEQ ID NO: 23887 - DNA, 571 bp, Artificial Sequence
  chemically treated genomic DNA (Homo sapiens) CpG-island No: 23887
  misc_feature (165)..(165): n is either a, c, g or t
  misc_feature (524)..(524): n is either a, c, g or t
atttgggtttgtaaggcgtttttatttcggtagaagttcggggagggtaggggattattgttggggaggtcgtttgaagaggatttttggaaattcgagtatttttttttcgcgtgggaggaacgattttgtagggttcgggtttttaagggggtcgcgtcggtncggggacgtacgtagttttgttttggggcgcgtgaggttttggagttgtggtagtatcgtatgattttaaagtttggtacgtgagggtacgttaggtcgcgataggggcgtgggaaacgataggaagcgtacgtacggaacggtggggagggtgcgattgtgaggtaagatttttaggttgcgtaggtgaagggagttaatttaacgaatgttgcgttagggatcggtagtttacgtttcggggggaatcgaaggtgaagggtcggtacggtaggtaagtacgaggaagtcgtagcggacgcgcgtcgggtaggtgaagtgcggtaatcgaagggagcgggagggacgttgaattatangtcgacggtcgattttagaggattttcgatttgaagacgttattcgt

SEQ ID NO: 23888 - DNA, 571 bp, Artificial Sequence
  chemically treated genomic DNA (Homo sapiens) CpG-island No: 23888
  misc_feature (48)..(48): n is either a, c, g or t
  misc_feature (407)..(407): n is either a, c, g or t
acgaataacgtcttcaaatcgaaaatcctctaaaatcgaccgtcgacntataattcaacgtccctcccgctcccttcgattaccgcacttcacctacccgacgcgcgtccgctacgacttcctcgtacttacctaccgtaccgacccttcaccttcgattccccccgaaacgtaaactaccgatccctaacgcaacattcgttaaattaactcccttcacctacgcaacctaaaaatcttacctcacaatcgcaccctccccaccgttccgtacgtacgcttcctatcgtttcccacgcccctatcgcgacctaacgtaccctcacgtaccaaactttaaaatcatacgatactaccacaactccaaaacctcacgcgccccaaaacaaaactacgtacgtccccgnaccgacgcgacccccttaaaaacccgaaccctacaaaatcgttcctcccacgcgaaaaaaaaatactcgaatttccaaaaatcctcttcaaacgacctccccaacaataatcccctaccctccccgaacttctaccgaaataaaaacgccttacaaacccaaat

SEQ ID NO: 23889 - DNA, 636 bp, Artificial Sequence
  chemically treated genomic DNA (Homo sapiens) CpG-island No: 23889
cggtcgaggggtacggggaaggggattcggggagggagagagggaggagcggcgaggttaaggtaggtggtacgtcgttcgttttttcggtcgttcgtatttcggaggttagttttagttggtagcgagtttttttttttttcgttgggtttggagcgcggcgcgggttcggtttttggggacgcgttaagagtaggtcggatagtagggcgggggtcgggtcgcgagttagcgcgcggcgagcggatttagtttcgaggttgatgacgtttttttttttggttcggcggcgtttggtttggtagggcgggtgacgttatcgtttcgttacgtgattattatttaataaatattttttttttttttgcgcgcgggtttggttcgtttcgttttttagaggtcgtatataaacgcgtttttcgggttaggttcgttgcgaaggatatttgggttgtgtgtgcgacgcgggtcggacgggtagtcgggggaatcgcgaagaagtcgagggattcggattttcgcgtgacgtttttttgttagtttaaaagcggtttttggttcggcgtagagagattcgggggtttagttttttttcgaaaagcgtcgttttgtttttggttagggtttttgttttat

SEQ ID NO: 23890 - DNA, 636 bp, Artificial Sequence
  chemically treated genomic DNA (Homo sapiens) CpG-island No: 23890
ataaaacaaaaaccctaaccaaaaacaaaacgacgcttttcgaaaaaaaactaaacccccgaatctctctacgccgaaccaaaaaccgcttttaaactaacaaaaaaacgtcacgcgaaaatccgaatccctcgacttcttcgcgattcccccgactacccgtccgacccgcgtcgcacacacaacccaaatatccttcgcaacgaacctaacccgaaaaacgcgtttatatacgacctctaaaaaacgaaacgaaccaaacccgcgcgcaaaaaaaaaaaaaatatttattaaataataatcacgtaacgaaacgataacgtcacccgccctaccaaaccaaacgccgccgaaccaaaaaaaaaaacgtcatcaacctcgaaactaaatccgctcgccgcgcgctaactcgcgacccgacccccgccctactatccgacctactcttaacgcgtccccaaaaaccgaacccgcgccgcgctccaaacccaacgaaaaaaaaaaaaactcgctaccaactaaaactaacctccgaaatacgaacgaccgaaaaaacgaacgacgtaccacctaccttaacctcgccgctcctccctctctccctccccgaatccccttccccgtacccctcgaccg

SEQ ID NO: 23891 - DNA, 636 bp, Artificial Sequence
  chemically treated genomic DNA (Homo sapiens) CpG-island No: 23891
gtgaagtaagaattttggttaagggtagggcggcgtttttcgaggaaaagttagattttcgggtttttttgcgtcgaattaaaagtcgtttttggattgatagaggagcgttacgcggggattcgggtttttcggttttttcgcggttttttcgattgttcgttcgattcgcgtcgtatatatagtttaaatgtttttcgtagcgagtttggttcggggagcgcgtttatatgcggtttttgggggacggggcgggttagattcgcgcgtagggggagggggggtgtttgttgaatggtgattacgtgacggggcggtgacgttattcgttttgttaggttaggcgtcgtcgagttagagggggagacgttattagtttcggagttgggttcgttcgtcgcgcgttggttcgcggttcggttttcgttttgttgttcggtttgtttttggcgcgtttttagggatcggattcgcgtcgcgttttaggtttagcggggaggaggagggttcgttgttagttgaggttgattttcgggatgcgagcggtcgggagaacgggcgacgtgttatttgttttggtttcgtcgttttttttttttttttttttcgagttttttttttcgtgtttttcggtcg

SEQ ID NO: 23892 - DNA, 636 bp, Artificial Sequence
  chemically treated genomic DNA (Homo sapiens) CpG-island No: 23892
cgaccgaaaaacacgaaaaaaaaaactcgaaaaaaaaaaaaaaaaaaaacgacgaaaccaaaacaaataacacgtcgcccgttctcccgaccgctcgcatcccgaaaatcaacctcaactaacaacgaaccctcctcctccccgctaaacctaaaacgcgacgcgaatccgatccctaaaaacgcgccaaaaacaaaccgaacaacaaaacgaaaaccgaaccgcgaaccaacgcgcgacgaacgaacccaactccgaaactaataacgtctccccctctaactcgacgacgcctaacctaacaaaacgaataacgtcaccgccccgtcacgtaatcaccattcaacaaacaccccccctccccctacgcgcgaatctaacccgccccgtcccccaaaaaccgcatataaacgcgctccccgaaccaaactcgctacgaaaaacatttaaactatatatacgacgcgaatcgaacgaacaatcgaaaaaaccgcgaaaaaaccgaaaaacccgaatccccgcgtaacgctcctctatcaatccaaaaacgacttttaattcgacgcaaaaaaacccgaaaatctaacttttcctcgaaaaacgccgccctacccttaaccaaaattcttacttcac

SEQ ID NO: 23893 - DNA, 1030 bp, Artificial Sequence
  chemically treated genomic DNA (Homo sapiens) CpG-island No: 23893
taatttcgtcggtttttttttcggtgtgttcgtttttgcgttttcgtattttttcgtttcgtttttcgtttaatgttgagtttagtttgcgtttcgttttttcgcgggcgttagggggttagtaagtagtagtcggcgttatcgtcgtagtcgttcgaggttttcgtcgtcgtttatcgtatgtacgcgcgttagatagtaagtagtttgcgtagttcggtttcgtcgcgtttcggcgggtttttcggtatttcgcgggttcggggatcggcgcgtcgagttatgtttcgggttgtcggcggcggttatggggcggtacggcggcggcggtggcgatagcggtaagatcgtgattaacgtgggcggcgtgcgttatgagacgtatcgttcgacgttgcgtattttgtcggggacgcggttggtcggtttgacggagttcgaggcggcggtacgtttcgattacgattcgggcgtcgacgagtttttttttgatcggtattcgggagttttcgcgtacgtgtttaattattatcgtatcggtaagttgtattgtttagtcgacgtgtgcgggtttttgtttgaggaggagttcggtttttggggtatcgacgagatcgacgtggaggtttgttgttggatgatttatcggtagtatcgcgacgttgaggaggcgttcgattttttcgaggcgttcgatttcgcgggcgtcgttaacgtcgttaacgtcgtaggcgtttacgacggaggtttggacgacgaggcgggcgcgggcggcggcggtttggacggagcgggcggcgagtttaagcgtttttgtttttaggacgcgggcggcggcgtcggggggtcgttagggggcgcgggcggcgcgggcggtatatggtggcgtcgttggtagtttcgcgtgtgggcgtttttcgaggatttttattcgtcgcgggttgttagggtgagcgcgttttcggggtttttatttattttattttcgtttttttaggcgtttttagttttttaggagcgttttagtttt

SEQ ID NO: 23894 - DNA, 1030 bp, Artificial Sequence
  chemically treated genomic DNA (Homo sapiens) CpG-island No: 23894
aaaactaaaacgctcctaaaaaactaaaaacgcctaaaaaaacgaaaataaaataaataaaaaccccgaaaacgcgctcaccctaacaacccgcgacgaataaaaatcctcgaaaaacgcccacacgcgaaactaccaacgacgccaccatataccgcccgcgccgcccgcgccccctaacgaccccccgacgccgccgcccgcgtcctaaaaacaaaaacgcttaaactcgccgcccgctccgtccaaaccgccgccgcccgcgcccgcctcgtcgtccaaacctccgtcgtaaacgcctacgacgttaacgacgttaacgacgcccgcgaaatcgaacgcctcgaaaaaatcgaacgcctcctcaacgtcgcgatactaccgataaatcatccaacaacaaacctccacgtcgatctcgtcgataccccaaaaaccgaactcctcctcaaacaaaaacccgcacacgtcgactaaacaatacaacttaccgatacgataataattaaacacgtacgcgaaaactcccgaataccgatcaaaaaaaaactcgtcgacgcccgaatcgtaatcgaaacgtaccgccgcctcgaactccgtcaaaccgaccaaccgcgtccccgacaaaatacgcaacgtcgaacgatacgtctcataacgcacgccgcccacgttaatcacgatcttaccgctatcgccaccgccgccgccgtaccgccccataaccgccgccgacaacccgaaacataactcgacgcgccgatccccgaacccgcgaaataccgaaaaacccgccgaaacgcgacgaaaccgaactacgcaaactacttactatctaacgcgcgtacatacgataaacgacgacgaaaacctcgaacgactacgacgataacgccgactactacttactaaccccctaacgcccgcgaaaaaacgaaacgcaaactaaactcaacattaaacgaaaaacgaaacgaaaaaatacgaaaacgcaaaaacgaacacaccgaaaaaaaaaccgacgaaatta

SEQ ID NO: 23895 - DNA, 1030 bp, Artificial Sequence
  chemically treated genomic DNA (Homo sapiens) CpG-island No: 23895
ggagttggggcgtttttgggagattgggggcgtttggagaggcgggggtggggtggatgggggtttcgagagcgcgtttattttggtagttcgcgacgagtaggggttttcgaagagcgtttatacgcggggttgttagcggcgttattatgtgtcgttcgcgtcgttcgcgttttttggcggtttttcggcgtcgtcgttcgcgttttggaagtagaggcgtttgagttcgtcgttcgtttcgtttaggtcgtcgtcgttcgcgttcgtttcgtcgtttaggttttcgtcgtgggcgtttgcggcgttggcggcgttggcggcgttcgcggggtcgggcgtttcgaaggagtcgagcgtttttttagcgtcgcgatgttgtcggtaggttatttagtagtaggtttttacgtcggtttcgtcgatgttttagaagtcgagtttttttttaaataggggttcgtatacgtcggttgggtagtgtagtttgtcggtgcggtagtagttgagtacgtacgcgaagattttcgggtgtcggttaaagaagaattcgtcggcgttcgggtcgtagtcgaagcgtgtcgtcgtttcgggtttcgttaggtcggttagtcgcgttttcggtagggtgcgtagcgtcgagcggtacgttttatggcgtacgtcgtttacgttgattacgattttgtcgttgtcgttatcgtcgtcgtcgtgtcgttttatggtcgtcgtcggtagttcggggtatggttcggcgcgtcggttttcgggttcgcggggtgtcggggggttcgtcgggacgcggcggggtcgggttgcgtaggttgtttgttgtttagcgcgcgtgtatgcggtaggcggcggcggggatttcgggcggttgcggcggtggcgtcggttgttgtttgttggttttttggcgttcgcggaaggacgagacgtagattgagtttagtattggacggggggcggggcgggagggtgcggagacgtaagggcgggtatatcgggggagagatcgacgggattg

SEQ ID NO: 23896 - DNA, 1030 bp, Artificial Sequence
  chemically treated genomic DNA (Homo sapiens) CpG-island No: 23896
caatcccgtcgatctctcccccgatatacccgcccttacgtctccgcaccctcccgccccgccccccgtccaatactaaactcaatctacgtctcgtccttccgcgaacgccaaaaaaccaacaaacaacaaccgacgccaccgccgcaaccgcccgaaatccccgccgccgcctaccgcatacacgcgcgctaaacaacaaacaacctacgcaacccgaccccgccgcgtcccgacgaaccccccgacaccccgcgaacccgaaaaccgacgcgccgaaccataccccgaactaccgacgacgaccataaaacgacacgacgacgacgataacgacaacgacaaaatcgtaatcaacgtaaacgacgtacgccataaaacgtaccgctcgacgctacgcaccctaccgaaaacgcgactaaccgacctaacgaaacccgaaacgacgacacgcttcgactacgacccgaacgccgacgaattcttctttaaccgacacccgaaaatcttcgcgtacgtactcaactactaccgcaccgacaaactacactacccaaccgacgtatacgaacccctatttaaaaaaaaactcgacttctaaaacatcgacgaaaccgacgtaaaaacctactactaaataacctaccgacaacatcgcgacgctaaaaaaacgctcgactccttcgaaacgcccgaccccgcgaacgccgccaacgccgccaacgccgcaaacgcccacgacgaaaacctaaacgacgaaacgaacgcgaacgacgacgacctaaacgaaacgaacgacgaactcaaacgcctctacttccaaaacgcgaacgacgacgccgaaaaaccgccaaaaaacgcgaacgacgcgaacgacacataataacgccgctaacaaccccgcgtataaacgctcttcgaaaacccctactcgtcgcgaactaccaaaataaacgcgctctcgaaacccccatccaccccacccccgcctctccaaacgcccccaatctcccaaaaacgccccaactcc

SEQ ID NO: 23897 - DNA, 595 bp, Artificial Sequence
  chemically treated genomic DNA (Homo sapiens) CpG-island No: 23897
gtcggaattaagtttggacgtttggagttgagagtcgaatgtttagagcgtttgttcgtcggggagagattttcggaggatagtcggggtcggaattaagtttggacgtttggagttgagagtcgaatgtttagagcgtttgttcgtcggggagagattttcggaggatagtcggggtcggaattaagtttggacgtttggagttgagagtcgaatgtttagagcgtttgttcgtcggggagagattttcggaggacggtcggggtcggaattaagtttggacgtttggagttgagagtcgaatgtttagagcgtttgttcgtcggggagagattttcggaggacggtcggggtcggaattaagtttggacgtttggagttgagagtcgaatgtttagagcgtttgttcgtcggggagagattttcggaggacggtcggggtcggaattaagtttggacgtttggagttgagagtcgaatgtttagagcgtttgttcgtcggggagagattttcggaggatagtcggggtcggaattaagtttggaggtttggaggtgagagtcgaatgttgtttagtatgattaattagtttaa

SEQ ID NO: 23898 - DNA, 595 bp, Artificial Sequence
  chemically treated genomic DNA (Homo sapiens) CpG-island No: 23898
ttaaactaattaatcatactaaacaacattcgactctcacctccaaacctccaaacttaattccgaccccgactatcctccgaaaatctctccccgacgaacaaacgctctaaacattcgactctcaactccaaacgtccaaacttaattccgaccccgaccgtcctccgaaaatctctccccgacgaacaaacgctctaaacattcgactctcaactccaaacgtccaaacttaattccgaccccgaccgtcctccgaaaatctctccccgacgaacaaacgctctaaacattcgactctcaactccaaacgtccaaacttaattccgaccccgaccgtcctccgaaaatctctccccgacgaacaaacgctctaaacattcgactctcaactccaaacgtccaaacttaattccgaccccgactatcctccgaaaatctctccccgacgaacaaacgctctaaacattcgactctcaactccaaacgtccaaacttaattccgaccccgactatcctccgaaaatctctccccgacgaacaaacgctctaaacattcgactctcaactccaaacgtccaaacttaattccgac

SEQ ID NO: 23899 - DNA, 595 bp, Artificial Sequence
  chemically treated genomic DNA (Homo sapiens) CpG-island No: 23899
ttgagttaattagttatgttaagtagtattcggtttttatttttaaatttttaggtttggtttcggtttcggttgtttttcgagagttttttttcggcgggtaggcgttttgggtattcggtttttagttttaaacgtttaggtttggtttcggtttcggtcgtttttcgagagttttttttcggcgggtaggcgttttgggtattcggtttttagttttaaacgtttaggtttggtttcggtttcggtcgtttttcgagagttttttttcggcgggtaggcgttttgggtattcggtttttagttttaaacgtttaggtttggtttcggtttcggtcgtttttcgagagttttttttcggcgggtaggcgttttgggtattcggtttttagttttaaacgtttaggtttggtttcggtttcggttgtttttcgagagttttttttcggcgggtaggcgttttgggtattcggtttttagttttaaacgtttaggtttggtttcggtttcggttgtttttcgagagttttttttcggcgggtaggcgttttgggtattcggtttttagttttaaacgtttaggtttggtttcggt

SEQ ID NO: 23900 - DNA, 595 bp, Artificial Sequence
  chemically treated genomic DNA (Homo sapiens) CpG-island No: 23900
accgaaaccaaacctaaacgtttaaaactaaaaaccgaatacccaaaacgcctacccgccgaaaaaaaactctcgaaaaacaaccgaaaccgaaaccaaacctaaacgtttaaaactaaaaaccgaatacccaaaacgcctacccgccgaaaaaaaactctcgaaaaacaaccgaaaccgaaaccaaacctaaacgtttaaaactaaaaaccgaatacccaaaacgcctacccgccgaaaaaaaactctcgaaaaacgaccgaaaccgaaaccaaacctaaacgtttaaaactaaaaaccgaatacccaaaacgcctacccgccgaaaaaaaactctcgaaaaacgaccgaaaccgaaaccaaacctaaacgtttaaaactaaaaaccgaatacccaaaacgcctacccgccgaaaaaaaactctcgaaaaacgaccgaaaccgaaaccaaacctaaacgtttaaaactaaaaaccgaatacccaaaacgcctacccgccgaaaaaaaactctcgaaaaacaaccgaaaccgaaaccaaacctaaaaatttaaaaataaaaaccgaatactacttaacataactaattaactcaa

SEQ ID NO: 23901 - DNA, 708 bp, Artificial Sequence
  chemically treated genomic DNA (Homo sapiens) CpG-island No: 23901
gcgacggagagaaatagtgagttcgaggggcgcgggtatagaattgtttagtttcgagaattggggttcgttagtcggcggggaaagtagttgagcgcggaggcgagtgagcggacgcgtttcggggtttttgtagttttcgtcggttttaaggtatcgattttcggttagttgggcgcggtagggcgggaggggcgcgttatggaggcgtcgggtcgcgttagtatgttttaggttaagtgaagcggttcggttggggtcggcgggattcgcgggttatgtacggcgatatatttaacgttacgggcggtttcgaggcggcggtaggtagcgcgttggttttaggagttacggttaaggtagaaggcgttttgtcgttggagttggttattgcgcgcggtatgagggacggcgcggttataaagttcgatttgtttatttatttgttgtttttttttttgttgttgttttcggtggcgttcgtcgttttttttatcggttgttagttgcgttattcggttttcgtcgcgttgttttacgatcgttcgttgcgcgacgttcgcgcgttttggaagacgcggtcggtgtagtttgggattgagttacggtcgtcgggcgtttcgtttcgatttagttaagagtagttagtttgagtttggtagggagggtacgatatcggggatcgttggtttttgggaatacggtgtt

SEQ ID NO: 23902 - DNA, 708 bp, Artificial Sequence
  chemically treated genomic DNA (Homo sapiens) CpG-island No: 23902
aacaccgtattcccaaaaaccaacgatccccgatatcgtaccctccctaccaaactcaaactaactactcttaactaaatcgaaacgaaacgcccgacgaccgtaactcaatcccaaactacaccgaccgcgtcttccaaaacgcgcgaacgtcgcgcaacgaacgatcgtaaaacaacgcgacgaaaaccgaataacgcaactaacaaccgataaaaaaaacgacgaacgccaccgaaaacaacaacaaaaaaaaaaacaacaaataaataaacaaatcgaactttataaccgcgccgtccctcataccgcgcgcaataaccaactccaacgacaaaacgccttctaccttaaccgtaactcctaaaaccaacgcgctacctaccgccgcctcgaaaccgcccgtaacgttaaatatatcgccgtacataacccgcgaatcccgccgaccccaaccgaaccgcttcacttaacctaaaacatactaacgcgacccgacgcctccataacgcgcccctcccgccctaccgcgcccaactaaccgaaaatcgataccttaaaaccgacgaaaactacaaaaaccccgaaacgcgtccgctcactcgcctccgcgctcaactactttccccgccgactaacgaaccccaattctcgaaactaaacaattctatacccgcgcccctcgaactcactatttctctccgtcgc

SEQ ID NO: 23903 - DNA, 708 bp, Artificial Sequence
  chemically treated genomic DNA (Homo sapiens) CpG-island No: 23903
ggtatcgtgtttttaggggttagcgattttcggtgtcgtgttttttttattaggtttaagttggttgtttttggttaggtcgggacggggcgttcggcggtcgtggtttagttttaagttatatcggtcgcgttttttagggcgcgcgggcgtcgcgtagcgagcggtcgtggggtagcgcggcgaaggtcgaatggcgtagttggtaatcgatgaagaggacgacgagcgttatcgagagtagtagtaggaagaagagtagtaggtaggtgggtaggtcgggttttgtggtcgcgtcgttttttatatcgcgcgtagtggttagttttagcggtaaagcgttttttgttttgatcgtggtttttggggttagcgcgttgtttatcgtcgtttcggggtcgttcgtggcgttgaatatgtcgtcgtatatggttcgcgggtttcgtcgattttagtcggatcgttttatttggtttggagtatattggcgcgattcggcgtttttatggcgcgtttttttcgttttgtcgcgtttaattgatcgagagtcggtgttttggggtcggcggggattgtaaagatttcgggacgcgttcgtttattcgttttcgcgtttagttgtttttttcgtcggttggcggattttagttttcggagttggatagttttgtgttcgcgtttttcgggtttattgttttttttcgtcgt

SEQ ID NO: 23904 - DNA, 708 bp, Artificial Sequence
  chemically treated genomic DNA (Homo sapiens) CpG-island No: 23904
acgacgaaaaaaaacaataaacccgaaaaacgcgaacacaaaactatccaactccgaaaactaaaatccgccaaccgacgaaaaaaacaactaaacgcgaaaacgaataaacgaacgcgtcccgaaatctttacaatccccgccgaccccaaaacaccgactctcgatcaattaaacgcgacaaaacgaaaaaaacgcgccataaaaacgccgaatcgcgccaatatactccaaaccaaataaaacgatccgactaaaatcgacgaaacccgcgaaccatatacgacgacatattcaacgccacgaacgaccccgaaacgacgataaacaacgcgctaaccccaaaaaccacgatcaaaacaaaaaacgctttaccgctaaaactaaccactacgcgcgatataaaaaacgacgcgaccacaaaacccgacctacccacctacctactactcttcttcctactactactctcgataacgctcgtcgtcctcttcatcgattaccaactacgccattcgaccttcgccgcgctaccccacgaccgctcgctacgcgacgcccgcgcgccctaaaaaacgcgaccgatataacttaaaactaaaccacgaccgccgaacgccccgtcccgacctaaccaaaaacaaccaacttaaacctaataaaaaaaacacgacaccgaaaatcgctaacccctaaaaacacgatacc

SEQ ID NO: 23905 - DNA, 578 bp, Artificial Sequence
  chemically treated genomic DNA (Homo sapiens) CpG-island No: 23905
gggttgtataagcgtatcgcgatttgcgcgatggcgattattacgttacgttgaatacggcgtagaagaaagcggttgataacgtattgcgcgattttgaattttttggtataggtttgtcgaaagagaaatagtagcgttacggcgaaattgcgattcgtttttttgaattgggtaattagtatagtaataacgttttcgatgcgataatgggttggattaaattcgttatcgacgaagcggagttggcggggatgttagaaagcgcgttggttgcggtaaaagtttaggtcgaagcgaaagagttggaaggttatttgttgacgttggatattttaagttatttgtcggtaatgatttattgcgataattaggttttgcgtgaagagatgtatcgcgtttatagtattcgcgttttcgattaaggtttaaacgtcggtaaatgggataatagtaaggtgatggaagagattttcgcgttgcgttacgaattggcgtaattgttgggttttgaaaattacgtttttaaattttttgttattaaaatggtagaaaattcgtagtaggtgttggatttt

SEQ ID NO: 23906 - DNA, 578 bp, Artificial Sequence
  chemically treated genomic DNA (Homo sapiens) CpG-island No: 23906
aaaatccaacacctactacgaattttctaccattttaataacaaaaaatttaaaaacgtaattttcaaaacccaacaattacgccaattcgtaacgcaacgcgaaaatctcttccatcaccttactattatcccatttaccgacgtttaaaccttaatcgaaaacgcgaatactataaacgcgatacatctcttcacgcaaaacctaattatcgcaataaatcattaccgacaaataacttaaaatatccaacgtcaacaaataaccttccaactctttcgcttcgacctaaacttttaccgcaaccaacgcgctttctaacatccccgccaactccgcttcgtcgataacgaatttaatccaacccattatcgcatcgaaaacgttattactatactaattacccaattcaaaaaaacgaatcgcaatttcgccgtaacgctactatttctctttcgacaaacctataccaaaaaattcaaaatcgcgcaatacgttatcaaccgctttcttctacgccgtattcaacgtaacgtaataatcgccatcgcgcaaatcgcgatacgcttatacaaccc

SEQ ID NO: 23907 - DNA, 578 bp, Artificial Sequence
  chemically treated genomic DNA (Homo sapiens) CpG-island No: 23907
gaaatttagtatttgttgcgggttttttgttattttagtggtaagggatttaaaggcgtagtttttaaagtttagtagttgcgttagttcgtgacgtagcgcgaggattttttttattattttgttgttattttatttatcggcgtttgggttttgatcggaggcgcgggtgttgtaagcgcgatatatttttttacgtagagtttggttgtcgtagtaggttattatcggtaagtagtttgggatatttagcgttagtaaataattttttagttttttcgtttcggtttgggtttttgtcgtagttagcgcgttttttggtattttcgttagtttcgtttcgtcggtaacgagtttggtttagtttattgtcgtatcgaggacgttgttgttgtattggttgtttagtttagaaagacgggtcgtaatttcgtcgtaacgttgttgtttttttttcggtagatttatgttagagagtttaaagtcgcgtagtgcgttattaatcgtttttttttgcgtcgtgtttagcgtggcgtaatgatcgttatcgcgtaggtcgcgatacgtttatatagttt

SEQ ID NO: 23908 - DNA, 578 bp, Artificial Sequence
  chemically treated genomic DNA (Homo sapiens) CpG-island No: 23908
aaactatataaacgtatcgcgacctacgcgataacgatcattacgccacgctaaacacgacgcaaaaaaaaacgattaataacgcactacgcgactttaaactctctaacataaatctaccgaaaaaaaaacaacaacgttacgacgaaattacgacccgtctttctaaactaaacaaccaatacaacaacaacgtcctcgatacgacaataaactaaaccaaactcgttaccgacgaaacgaaactaacgaaaataccaaaaaacgcgctaactacgacaaaaacccaaaccgaaacgaaaaaactaaaaaattatttactaacgctaaatatcccaaactacttaccgataataacctactacgacaaccaaactctacgtaaaaaaatatatcgcgcttacaacacccgcgcctccgatcaaaacccaaacgccgataaataaaataacaacaaaataataaaaaaaatcctcgcgctacgtcacgaactaacgcaactactaaactttaaaaactacgcctttaaatcccttaccactaaaataacaaaaaacccgcaacaaatactaaatttc

SEQ ID NO: 23909 - DNA, 937 bp, Artificial Sequence
  chemically treated genomic DNA (Homo sapiens) CpG-island No: 23909
aattagtcgttgcgtgagggtttgtcggtttggttagtgtcgtttcgtcggaaggatggttatgcgcgagtattatcgtcgtcgtttgaagtgtagagtacgtttgattatttttcggggatgtatttcggtgcgttaatcgtgtcggtgaagagcgttttatgggtaattaattgattttggtgtttagatataatattcggaatttttttcgtttaagcgcggttatatgagtcgtagttatttacgtacggcgtgggtagaggtgaaggttacgtcggtttatgtaggtggcggtttagagttttgagcgttcgttgaatgagacgcggttttgtggcgttatttcgtcgggtaaaaaggaaagttgttttatttgtgttttttcggttagtcgataatacgtagaatggcgtgagtttttggatttgtatggtatattttcgtaggcggtaatagtgtgcggttatcgcgttaattttgtacggtaggtatggtggttatacgtaattaggtagatagtaattttgttgtttttgtatttatttgggtatcgttatcgtttaggtagttaatagacgttatgttttatcgtcgttaggttcgggggatattaatgcgtcgtattgttgagggtgtagaacgattagatatcgacgttgtagtttttataagcggtttatttaggcgaaatattcggattaggagttgttatcgggggatacgttaaagtttgtgggtcgaaatgaatatcggttatcgcggattagcgagggtaatttattcggatggttacggtttagaatacgttttagattacggatttatcgtaaaaatatcggatggtgattggcgaatcgcgtcggaggtaaaattagtcggttttatcggtagtgtagtatatattttttgcgtatttttatattgtaattagtat

SEQ ID NO: 23910 - DNA, 937 bp, Artificial Sequence
  chemically treated genomic DNA (Homo sapiens) CpG-island No: 23910
atactaattacaatataaaaatacgcaaaaaatatatactacactaccgataaaaccgactaattttacctccgacgcgattcgccaatcaccatccgatatttttacgataaatccgtaatctaaaacgtattctaaaccgtaaccatccgaataaattaccctcgctaatccgcgataaccgatattcatttcgacccacaaactttaacgtatcccccgataacaactcctaatccgaatatttcgcctaaataaaccgcttataaaaactacaacgtcgatatctaatcgttctacaccctcaacaatacgacgcattaatatcccccgaacctaacgacgataaaacataacgtctattaactacctaaacgataacgatacccaaataaatacaaaaacaacaaaattactatctacctaattacgtataaccaccatacctaccgtacaaaattaacgcgataaccgcacactattaccgcctacgaaaatataccatacaaatccaaaaactcacgccattctacgtattatcgactaaccgaaaaaacacaaataaaacaactttcctttttacccgacgaaataacgccacaaaaccgcgtctcattcaacgaacgctcaaaactctaaaccgccacctacataaaccgacgtaaccttcacctctacccacgccgtacgtaaataactacgactcatataaccgcgcttaaacgaaaaaaattccgaatattatatctaaacaccaaaatcaattaattacccataaaacgctcttcaccgacacgattaacgcaccgaaatacatccccgaaaaataatcaaacgtactctacacttcaaacgacgacgataatactcgcgcataaccatccttccgacgaaacgacactaaccaaaccgacaaaccctcacgcaacgactaatt

SEQ ID NO: 23911 - DNA, 937 bp, Artificial Sequence
  chemically treated genomic DNA (Homo sapiens) CpG-island No: 23911
atattggttataatataagagtacgtagagagtatatattatattgtcggtaggatcggttgattttattttcggcgcggttcgttagttattattcggtgtttttgcggtgaattcgtgatttgaggcgtgttttggatcgtgattattcgagtggattgttttcgttggttcgcgataatcggtatttatttcggtttatagattttggcgtatttttcggtggtaatttttggttcggatatttcgtttggatggatcgtttgtgagggttatagcgtcggtatttggtcgttttatatttttagtaatgcggcgtattgatgtttttcgagtttgacgacgatgagatatggcgtttgttaattgtttgaacggtaacgatgtttaaatgagtgtagaagtagtaggattgttgtttgtttgattgcgtatagttattatgtttgtcgtatagaattgacgcgatgatcgtatattattatcgtttgcgggagtatgttatgtaaatttagaggtttacgttattttgcgtattatcgattgatcgaaggagtatagatgaaatagtttttttttttattcggcgagatgacgttataggatcgcgttttatttagcgggcgtttagggttttggatcgttatttgtatgagtcggcgtagtttttatttttatttacgtcgtacgtgaatggttgcgatttatatggtcgcgtttgagcgggaagagtttcgggtgttgtatttggatattagaattagttgattgtttatgaaacgttttttatcggtacgattaacgtatcgaggtgtattttcgggaggtggttaaacgtgttttgtattttaagcggcggcggtgatattcgcgtataattattttttcggcgagacgatattagttaggtcgataaatttttacgtagcgattggtt

SEQ ID NO: 23912 - DNA, 937 bp, Artificial Sequence
  chemically treated genomic DNA (Homo sapiens) CpG-island No: 23912
aaccaatcgctacgtaaaaatttatcgacctaactaatatcgtctcgccgaaaaaataattatacgcgaatatcaccgccgccgcttaaaatacaaaacacgtttaaccacctcccgaaaatacacctcgatacgttaatcgtaccgataaaaaacgtttcataaacaatcaactaattctaatatccaaatacaacacccgaaactcttcccgctcaaacgcgaccatataaatcgcaaccattcacgtacgacgtaaataaaaataaaaactacgccgactcatacaaataacgatccaaaaccctaaacgcccgctaaataaaacgcgatcctataacgtcatctcgccgaataaaaaaaaaaactatttcatctatactccttcgatcaatcgataatacgcaaaataacgtaaacctctaaatttacataacatactcccgcaaacgataataatatacgatcatcgcgtcaattctatacgacaaacataataactatacgcaatcaaacaaacaacaatcctactacttctacactcatttaaacatcgttaccgttcaaacaattaacaaacgccatatctcatcgtcgtcaaactcgaaaaacatcaatacgccgcattactaaaaatataaaacgaccaaataccgacgctataaccctcacaaacgatccatccaaacgaaatatccgaaccaaaaattaccaccgaaaaatacgccaaaatctataaaccgaaataaataccgattatcgcgaaccaacgaaaacaatccactcgaataatcacgatccaaaacacgcctcaaatcacgaattcaccgcaaaaacaccgaataataactaacgaaccgcgccgaaaataaaatcaaccgatcctaccgacaatataatatatactctctacgtactcttatattataaccaatat

SEQ ID NO: 23913 - DNA, 578 bp, Artificial Sequence
  chemically treated genomic DNA (Homo sapiens) CpG-island No: 23913
gtgattcgcggtgcgggagatatcgttagtggtgtggcgttacgtttgattatgcgggttttaaagtgattatgttggaagtggaaaaatcgatagtattcgttgtatcgtggcgtttgtttaggtcgtgttcgatggcgaaatgaggtcgaaggcgttattgttcgtttggtaattagttttgcggaagcgatgaatttatcgaacgcggatttatttttgtgatggtagatttcgtttgtttttgtttgatgaattgaaatcgttttgcgtggtggacgttattttggcgaatagaatttgggaacgcgggtagatatggtattagtaataatcgcgtttggtcgggttttattgttgggaaggattgttatgcggtaattgaaataaacgcgggtattggttcggttaggtgatttattttggttgtgcgtaggagatatcggtgtttttggtaatattatggggtatattattcgacgggtgatcgtgtttttgttgtaggtattatgcgatttaacgtgaaattaggcgatttgtgaaagagggcgatgtgattgtttggattggtgagtatg

SEQ ID NO: 23914 - DNA, 578 bp, Artificial Sequence
  chemically treated genomic DNA (Homo sapiens) CpG-island No: 23914
catactcaccaatccaaacaatcacatcgccctctttcacaaatcgcctaatttcacgttaaatcgcataatacctacaacaaaaacacgatcacccgtcgaataatataccccataatattaccaaaaacaccgatatctcctacgcacaaccaaaataaatcacctaaccgaaccaatacccgcgtttatttcaattaccgcataacaatccttcccaacaataaaacccgaccaaacgcgattattactaataccatatctacccgcgttcccaaattctattcgccaaaataacgtccaccacgcaaaacgatttcaattcatcaaacaaaaacaaacgaaatctaccatcacaaaaataaatccgcgttcgataaattcatcgcttccgcaaaactaattaccaaacgaacaataacgccttcgacctcatttcgccatcgaacacgacctaaacaaacgccacgatacaacgaatactatcgatttttccacttccaacataatcactttaaaacccgcataatcaaacgtaacgccacaccactaacgatatctcccgcaccgcgaatcac

SEQ ID NO: 23915 - DNA, 578 bp, Artificial Sequence
  chemically treated genomic DNA (Homo sapiens) CpG-island No: 23915
tatgtttattaatttaggtaattatatcgtttttttttatagatcgtttaattttacgttggatcgtataatgtttgtagtaggagtacgattattcgtcgggtggtatgttttataatattgttaggaatatcggtattttttgcgtataattagagtaaattatttgatcgagttagtgttcgcgtttgttttaattatcgtatgataattttttttagtagtaaagttcggttaagcgcgattgttattggtgttatatttgttcgcgtttttaaattttgttcgttagaatagcgtttattacgtaaagcggttttagtttattaagtaagaataggcgggatttattattataggaatgaattcgcgttcggtaagtttatcgttttcgtagagttggttgttaggcgagtagtgacgttttcgattttatttcgttatcgaatacggtttgggtaaacgttacggtataacgaatattgtcggtttttttatttttagtatgattattttaaaattcgtatgattagacgtagcgttatattattggcgatatttttcgtatcgcgaattat

SEQ ID NO: 23916 - DNA, 578 bp, Artificial Sequence
  chemically treated genomic DNA (Homo sapiens) CpG-island No: 23916
ataattcgcgatacgaaaaatatcgccaataatataacgctacgtctaatcatacgaattttaaaataatcatactaaaaataaaaaaaccgacaatattcgttataccgtaacgtttacccaaaccgtattcgataacgaaataaaatcgaaaacgtcactactcgcctaacaaccaactctacgaaaacgataaacttaccgaacgcgaattcattcctataataataaatcccgcctattcttacttaataaactaaaaccgctttacgtaataaacgctattctaacgaacaaaatttaaaaacgcgaacaaatataacaccaataacaatcgcgcttaaccgaactttactactaaaaaaaattatcatacgataattaaaacaaacgcgaacactaactcgatcaaataatttactctaattatacgcaaaaaataccgatattcctaacaatattataaaacataccacccgacgaataatcgtactcctactacaaacattatacgatccaacgtaaaattaaacgatctataaaaaaaaacgatataattacctaaattaataaacata

SEQ ID NO: 23917 - DNA, 502 bp, Artificial Sequence
  chemically treated genomic DNA (Homo sapiens) CpG-island No: 23917
atggcggaatttcgacgggcgatcggtttgttcgtcgcgattaatatgatcgttattaattggcgcgaaatgggttatgcggtgatgtttaatgcggtagatattttatttgtcgattcgtatttttggacgtttttcggtgtagttcgtgtggcgtagttttgcgacgattgggggttgatttggggcgttatatttttgtcgatgtggttttttatcgtttgaaataagggtcgattcgtattttttcggtttgtggttttttggtggtggtggcgttttattttatcgtttagatggtgggcgtaggtaaattgatcgagttgttgtttggttttaattattatattgcggtggtgttggtcggcgtgttgatgatgatgtacgttttgttcggcggtatgttggcgattatttgggtgtaaattattaaagtcgtgttgttgttgttcggtgttagttttatggtttttatggtgatgaaatacgtcggttttagttt

SEQ ID NO: 23918 - DNA, 502 bp, Artificial Sequence
  chemically treated genomic DNA (Homo sapiens) CpG-island No: 23918
aaactaaaaccgacgtatttcatcaccataaaaaccataaaactaacaccgaacaacaacaacacgactttaataatttacacccaaataatcgccaacataccgccgaacaaaacgtacatcatcatcaacacgccgaccaacaccaccgcaatataataattaaaaccaaacaacaactcgatcaatttacctacgcccaccatctaaacgataaaataaaacgccaccaccaccaaaaaaccacaaaccgaaaaaatacgaatcgacccttatttcaaacgataaaaaaccacatcgacaaaaatataacgccccaaatcaacccccaatcgtcgcaaaactacgccacacgaactacaccgaaaaacgtccaaaaatacgaatcgacaaataaaatatctaccgcattaaacatcaccgcataacccatttcgcgccaattaataacgatcatattaatcgcgacgaacaaaccgatcgcccgtcgaaattccgccat

SEQ ID NO: 23919 - DNA, 502 bp, Artificial Sequence
  chemically treated genomic DNA (Homo sapiens) CpG-island No: 23919
aagttaaagtcgacgtgttttattattataaaggttataaagttggtatcgaatagtaatagtacggttttgataatttgtatttaggtggtcgttagtatgtcgtcgaataggacgtatattattattagtacgtcgattagtattatcgtaatgtgatagttaaggttaaatagtagttcgattagtttatttgcgtttattatttgggcgataaggtaaagcgttattattattagagaattataggtcgaaagaatacgaatcggtttttgttttagacggtaagaggttatatcggtaaaggtgtagcgttttaggttagtttttagtcgtcgtaaagttgcgttatacggattgtatcggaaagcgtttagaagtgcggatcggtaagtggaatatttatcgtattgagtattatcgtatgatttatttcgcgttagttggtggcgattatgttagtcgcgacgggtaagtcggtcgttcgtcgaaatttcgttat

SEQ ID NO: 23920 - DNA, 502 bp, Artificial Sequence
  chemically treated genomic DNA (Homo sapiens) CpG-island No: 23920
ataacgaaatttcgacgaacgaccgacttacccgtcgcgactaacataatcgccaccaactaacgcgaaataaatcatacgataatactcaatacgataaatattccacttaccgatccgcacttctaaacgctttccgatacaatccgtataacgcaactttacgacgactaaaaactaacctaaaacgctacacctttaccgatataacctcttaccgtctaaaacaaaaaccgattcgtattctttcgacctataattctctaataataataacgctttaccttatcgcccaaataataaacgcaaataaactaatcgaactactatttaaccttaactatcacattacgataatactaatcgacgtactaataataatatacgtcctattcgacgacatactaacgaccacctaaatacaaattatcaaaaccgtactattactattcgataccaactttataacctttataataataaaacacgtcgactttaactt

SEQ ID NO: 23921 - DNA, 662 bp, Artificial Sequence
  chemically treated genomic DNA (Homo sapiens) CpG-island No: 23921
gcggtgtagttttttttttattagtattgttattattgttcggagttataatgtcgcgaaattgtcgtatcggcgtacgtttggtttgattaataagttgatatagcgtttttattagcggttgtataaagttttgatagcgatattgtttttcgttgatttgcgttagtatcgatttttagtgcgcggttatgttcggtcgcgtcgttattttcggtagcgaatggaatagcgttttttcggcgtcggtggagtggatatagcgtttttttttggttaggaaattacgtttgaataatagtttaataatttcggtacgcgttgtttttgtttttagattatcggtcgtacggaggattttttttagatttttattttgtataaagcgcgcgatttcggttatcgtcgaaagtagtgttgtatcggtaaaatggcgcggcggttgggtttgtcgttttattattttattttttttatatagtaatttatcgtttttcgttattataggtagtggcgtgtcgtcgttttttttatcgcgttttttgttgtttaatagcgtgcgttagtttgttttagtaagaaaacgcgttttagcgataaatttgtttttggtaatgtttagttcgataatatatttgcggaatatcgtattcgggtagaat

SEQ ID NO: 23922 - DNA, 662 bp, Artificial Sequence
  chemically treated genomic DNA (Homo sapiens) CpG-island No: 23922
attctacccgaatacgatattccgcaaatatattatcgaactaaacattaccaaaaacaaatttatcgctaaaacgcgttttcttactaaaacaaactaacgcacgctattaaacaacaaaaaacgcgataaaaaaaacgacgacacgccactacctataataacgaaaaacgataaattactatataaaaaaaataaaataataaaacgacaaacccaaccgccgcgccattttaccgatacaacactactttcgacgataaccgaaatcgcgcgctttatacaaaataaaaatctaaaaaaaatcctccgtacgaccgataatctaaaaacaaaaacaacgcgtaccgaaattattaaactattattcaaacgtaatttcctaaccaaaaaaaaacgctatatccactccaccgacgccgaaaaaacgctattccattcgctaccgaaaataacgacgcgaccgaacataaccgcgcactaaaaatcgatactaacgcaaatcaacgaaaaacaatatcgctatcaaaactttatacaaccgctaataaaaacgctatatcaacttattaatcaaaccaaacgtacgccgatacgacaatttcgcgacattataactccgaacaataataacaatactaataaaaaaaaaactacaccgc

SEQ ID NO: 23923 - DNA, 662 bp, Artificial Sequence
  chemically treated genomic DNA (Homo sapiens) CpG-island No: 23923
attttgttcggatgcggtgtttcgtaagtgtgttatcgaattggatattgttaaaggtaaatttgtcgttaaagcgcgtttttttgttgaagtaggttggcgtacgttgttaggtagtaaagagcgcgatgaagaaaacgacggtacgttattgtttgtggtggcgaaaggcgatgagttgttgtgtgaaaaaggtgaagtggtagagcggtaaatttagtcgtcgcgttattttatcgatgtaatattgttttcggcgatgatcgggatcgcgcgttttgtgtaggataaagatttgaaaaagatttttcgtgcgatcgatggtttggggatagaggtaacgcgtgtcgggattattgaattgttgtttaagcgtggttttttgattaaaaaagggcgttatatttattttatcgacgtcggaaaagcgttattttattcgttgtcggagatggcgacgcgatcggatatgatcgcgtattgggaatcggtgttgacgtaaattagcgaaaagtagtgtcgttattaggattttatgtagtcgttggtggggacgttatattagtttattgattaagttaaacgtacgtcggtgcggtagtttcgcggtattgtggtttcgggtagtggtggtagtgttgataagaaaaaggttgtatcgt

SEQ ID NO: 23924 - DNA, 662 bp, Artificial Sequence
  chemically treated genomic DNA (Homo sapiens) CpG-island No: 23924
acgatacaacctttttcttatcaacactaccaccactacccgaaaccacaataccgcgaaactaccgcaccgacgtacgtttaacttaatcaataaactaatataacgtccccaccaacgactacataaaatcctaataacgacactacttttcgctaatttacgtcaacaccgattcccaatacgcgatcatatccgatcgcgtcgccatctccgacaacgaataaaataacgcttttccgacgtcgataaaataaatataacgcccttttttaatcaaaaaaccacgcttaaacaacaattcaataatcccgacacgcgttacctctatccccaaaccatcgatcgcacgaaaaatctttttcaaatctttatcctacacaaaacgcgcgatcccgatcatcgccgaaaacaatattacatcgataaaataacgcgacgactaaatttaccgctctaccacttcacctttttcacacaacaactcatcgcctttcgccaccacaaacaataacgtaccgtcgttttcttcatcgcgctctttactacctaacaacgtacgccaacctacttcaacaaaaaaacgcgctttaacgacaaatttacctttaacaatatccaattcgataacacacttacgaaacaccgcatccgaacaaaat

SEQ ID NO: 23925 - DNA, 643 bp, Artificial Sequence
  chemically treated genomic DNA (Homo sapiens) CpG-island No: 23925
agttggtgttgcgtacgtcgtgtatttttagtatatttagcgataacggatgcgtttttggtaatatgtttagcgttattaaagttatggtggtaggtagttgcgtttttttcgttagtttacgtattcgtgcgggcgtattgattatatcgtcgtttagataaagtatcgggcgtttggtagcgttaattatcgtcgttgcgttacgaatgtttttttcgttaaaggcgggggcggcggttttttttgttatagcgggttgtgttttaattttaaaaattgtcgtttgtatatttttaggaatgtttatttatatcgggtttgggcggtttgattgcgtaatgcggaaggtatcgtttatgatttgcgggagtttttcgatatgtttgattagatagttgtgtttggtgatggggatagagatgtcgtaggtgtttattttttggaaggcgtcggtgtcgattatcgaggcgggaatttgattagtgatgtaaattagcgggatggagtttagtcgcgtatcggtaatggcggttattaggttagtcgtattcggtttttacggtagtttacgttataaataagtaatagttattggatgattaatgtttagttattgggcgattttagtatcgataattat

SEQ ID NO: 23926 - DNA, 643 bp, Artificial Sequence
  chemically treated genomic DNA (Homo sapiens) CpG-island No: 23926
ataattatcgatactaaaatcgcccaataactaaacattaatcatccaataactattacttatttataacgtaaactaccgtaaaaaccgaatacgactaacctaataaccgccattaccgatacgcgactaaactccatcccgctaatttacatcactaatcaaattcccgcctcgataatcgacaccgacgccttccaaaaaataaacacctacgacatctctatccccatcaccaaacacaactatctaatcaaacatatcgaaaaactcccgcaaatcataaacgataccttccgcattacgcaatcaaaccgcccaaacccgatataaataaacattcctaaaaatatacaaacgacaatttttaaaattaaaacacaacccgctataacaaaaaaaaccgccgcccccgcctttaacgaaaaaaacattcgtaacgcaacgacgataattaacgctaccaaacgcccgatactttatctaaacgacgatataatcaatacgcccgcacgaatacgtaaactaacgaaaaaaacgcaactacctaccaccataactttaataacgctaaacatattaccaaaaacgcatccgttatcgctaaatatactaaaaatacacgacgtacgcaacaccaact

SEQ ID NO: 23927 - DNA, 643 bp, Artificial Sequence
  chemically treated genomic DNA (Homo sapiens) CpG-island No: 23927
gtagttatcgatattgaaatcgtttagtaattgggtattggttatttagtgattgttgtttgtttgtggcgtaaattgtcgtagagatcgggtgcgattaatttggtgatcgttattgtcgatgcgcggttggattttatttcgttgatttgtattattggttaggttttcgtttcgatgatcggtatcgacgttttttaggaagtggatatttacggtatttttatttttattattaaatataattatttggttagatatatcgaagaattttcgtaggttatgagcgatgtttttcgtattgcgtaattaggtcgtttaggttcggtgtggatagatatttttaaggatgtgtaaacggtagtttttgagattgaaatatagttcgttatggtagaaaaagtcgtcgttttcgtttttagcgaagaaagtattcgtgacgtagcggcgatgattaacgttgttaaacgttcggtgttttatttgggcggcggtgtgattaatgcgttcgtacgggtgcgtgaattggcggagaaagcgtaattgtttattattatgattttaatggcgttgggtatgttgttaaaagcgtattcgttgtcgttgggtatgttggggatgtacggcgtgcgtagtattaatt

SEQ ID NO: 23928 - DNA, 643 bp, Artificial Sequence
  chemically treated genomic DNA (Homo sapiens) CpG-island No: 23928
aattaatactacgcacgccgtacatccccaacatacccaacgacaacgaatacgcttttaacaacatacccaacgccattaaaatcataataataaacaattacgctttctccgccaattcacgcacccgtacgaacgcattaatcacaccgccgcccaaataaaacaccgaacgtttaacaacgttaatcatcgccgctacgtcacgaatactttcttcgctaaaaacgaaaacgacgactttttctaccataacgaactatatttcaatctcaaaaactaccgtttacacatccttaaaaatatctatccacaccgaacctaaacgacctaattacgcaatacgaaaaacatcgctcataacctacgaaaattcttcgatatatctaaccaaataattatatttaataataaaaataaaaataccgtaaatatccacttcctaaaaaacgtcgataccgatcatcgaaacgaaaacctaaccaataatacaaatcaacgaaataaaatccaaccgcgcatcgacaataacgatcaccaaattaatcgcacccgatctctacgacaatttacgccacaaacaaacaacaatcactaaataaccaatacccaattactaaacgatttcaatatcgataactac

SEQ ID NO: 23929 - DNA, 698 bp, Artificial Sequence
  chemically treated genomic DNA (Homo sapiens) CpG-island No: 23929
aattacgatcgtcggaatgtttttcggtgcgttggtgggcggtattattggcgataaaatcggtcgtagaaatgcgtttattttttatgaggttatttatattgtttcgatggttgtcggtgtttttttatcgaatatggcgtttattggtggaaattattgtcgtcgttggatagattttttcgttcgtcgtagtgttggcgatcgtcgtttcggtgatcggttttggtttgtaattagcgattatcgttttgattttttacggtgtgttgttcgttttgtaggcgatatttgtcgggttgggagcgattgatgttagcgtgatagaagttgcgaaaggtatgggaatgagtcgtggttagcgagtgcgtaaggtcgagttatcgttggcggtttcggtgattttggcgggcgtgcgaatttcggtgattattaatattggtacggcgacgatcgttttaacggtaggggttagtacgttgggtacgtttattattatcgggtttagcggatttaatatcgcgtatgtgatttagggggcgttattggtggtattggcggcgattatcgtagatcgtttgtttgaaaggttggtgtaggcgtttagttagtacgtaaaataaaggtataatttgcgagtatgacgttattaatttcgtttaacgttataaataggaatagggcgatgattttaattt

SEQ ID NO: 23930 - DNA, 698 bp, Artificial Sequence
  chemically treated genomic DNA (Homo sapiens) CpG-island No: 23930
aaattaaaatcatcgccctattcctatttataacgttaaacgaaattaataacgtcatactcgcaaattatacctttattttacgtactaactaaacgcctacaccaacctttcaaacaaacgatctacgataatcgccgccaataccaccaataacgccccctaaatcacatacgcgatattaaatccgctaaacccgataataataaacgtacccaacgtactaacccctaccgttaaaacgatcgtcgccgtaccaatattaataatcaccgaaattcgcacgcccgccaaaatcaccgaaaccgccaacgataactcgaccttacgcactcgctaaccacgactcattcccatacctttcgcaacttctatcacgctaacatcaatcgctcccaacccgacaaatatcgcctacaaaacgaacaacacaccgtaaaaaatcaaaacgataatcgctaattacaaaccaaaaccgatcaccgaaacgacgatcgccaacactacgacgaacgaaaaaatctatccaacgacgacaataatttccaccaataaacgccatattcgataaaaaaacaccgacaaccatcgaaacaatataaataacctcataaaaaataaacgcatttctacgaccgattttatcgccaataataccgcccaccaacgcaccgaaaaacattccgacgatcgtaatt

SEQ ID NO: 23931 - DNA, 698 bp, Artificial Sequence
  chemically treated genomic DNA (Homo sapiens) CpG-island No: 23931
aaattggggttatcgttttgtttttgtttatggcgttaggcggaattggtggcgttatgttcgtaggttatatttttattttgcgtgttggttaagcgtttgtattagttttttaaataggcggtttgcgatgatcgtcgttagtgttattagtaacgttttttggattatatacgcggtattaaattcgttaagttcgatgatgatgggcgtatttagcgtgttggtttttatcgttgaggcgatcgtcgtcgtattaatgttgataattatcgaagttcgtacgttcgttagaattatcggagtcgttagcggtagttcgattttacgtattcgttgattacgatttatttttatatttttcgtaatttttgttacgttggtattaatcgtttttagttcggtaagtgtcgtttgtaggacgggtagtatatcgtaaaggattaaggcgataatcgttggttgtagattaaagtcgattatcggaacggcgatcgttagtattgcgacgggcggaaaagtttgtttaacggcggtaatagtttttattagtgggcgttatattcggtgagaaagtatcgataattatcgaggtaatatgaatggttttatagaggatgaacgtatttttgcgatcggttttgtcgttaatgatgtcgtttattagcgtatcgagaaatatttcggcggtcgtgatt

SEQ ID NO: 23932 - DNA, 698 bp, Artificial Sequence
  chemically treated genomic DNA (Homo sapiens) CpG-island No: 23932
aatcacgaccgccgaaatatttctcgatacgctaataaacgacatcattaacgacaaaaccgatcgcaaaaatacgttcatcctctataaaaccattcatattacctcgataattatcgatactttctcaccgaatataacgcccactaataaaaactattaccgccgttaaacaaacttttccgcccgtcgcaatactaacgatcgccgttccgataatcgactttaatctacaaccaacgattatcgccttaatcctttacgatatactacccgtcctacaaacgacacttaccgaactaaaaacgattaataccaacgtaacaaaaattacgaaaaatataaaaataaatcgtaatcaacgaatacgtaaaatcgaactaccgctaacgactccgataattctaacgaacgtacgaacttcgataattatcaacattaatacgacgacgatcgcctcaacgataaaaaccaacacgctaaatacgcccatcatcatcgaacttaacgaatttaataccgcgtatataatccaaaaaacgttactaataacactaacgacgatcatcgcaaaccgcctatttaaaaaactaatacaaacgcttaaccaacacgcaaaataaaaatataacctacgaacataacgccaccaattccgcctaacgccataaacaaaaacaaaacgataaccccaattt

SEQ ID NO: 23933 - DNA, 1146 bp, Artificial Sequence
  chemically treated genomic DNA (Homo sapiens) CpG-island No: 23933
agtcggatgaagtgtataatttgggcgtaatgagttacgttgcggttttttttgagttattagaatatatcgttgacgtcgacgcgatgggtacgttgcgtttgttggaggcgattcgttttttcggtttggaaaagaaaattcgtttttattaggtttttatttttgaattgtatggtttggtgtaggaaatttcgtagaaagagattacgtcgttttattcgcgattttcgtatgcggtcgttaaattgtacgtttattggattatcgttaattatcgtgaattttacggtatgtacgtttgtaacggaattttttttaattatgaattttcgcgtcgcggcgaaattttcgttattcgtaaaattattcgcgtaatcgttaatatcgtttaggggttggagtcgtgtttgtatttcggtaatatggattttttgcgtgattgggcgcgtagaaaaacgtatcggtttggtattgttcggtaagggtaatatcggttttcggtggttggaattgttcgttcgtgagtagagtacgttttcggtacgtatcggttttgagtttgtgttggtaggtgtggtggatagtcgtcgtagtttgttgagttatgacgggttggacgttagtcgcgcgttagttttttttaacgatgaagcggttgagtaggatgaagagtcgttgtttttgtggatgcgcgtttattcgtatgatgatttagtggtgttggacgttatcgttagttagtagtttgttgattagtattttgatttcgttagttacggtttttacgttattagcgttaataaattggcgggagttagcgatagtaataaatatcgttagatttacgacgttttcgaaaaaatcgggcgttattggttgtataatgttatcgtcggtgcgggtttgtcgattaattatatcgtgcgcgatttgatcgatagcggcgatattattttgtcgattagcgggatttttttcggtacgtttttttggttgtttttgtaattcgacggtagcgtgtcgtttatcgagttggtggattaggcgtggtagtagggtttaatcgaatttaagcgttagtattgttagtttgtaggatgaaaagtatgtcggtttttagtttatggtcgaggatattttgta

SEQ ID NO: 23934 - DNA, 1146 bp, Artificial Sequence
  chemically treated genomic DNA (Homo sapiens) CpG-island No: 23934
tacaaaatatcctcgaccataaactaaaaaccgacatacttttcatcctacaaactaacaatactaacgcttaaattcgattaaaccctactaccacgcctaatccaccaactcgataaacgacacgctaccgtcgaattacaaaaacaaccaaaaaaacgtaccgaaaaaaatcccgctaatcgacaaaataatatcgccgctatcgatcaaatcgcgcacgatataattaatcgacaaacccgcaccgacgataacattatacaaccaataacgcccgattttttcgaaaacgtcgtaaatctaacgatatttattactatcgctaactcccgccaatttattaacgctaataacgtaaaaaccgtaactaacgaaatcaaaatactaatcaacaaactactaactaacgataacgtccaacaccactaaatcatcatacgaataaacgcgcatccacaaaaacaacgactcttcatcctactcaaccgcttcatcgttaaaaaaaactaacgcgcgactaacgtccaacccgtcataactcaacaaactacgacgactatccaccacacctaccaacacaaactcaaaaccgatacgtaccgaaaacgtactctactcacgaacgaacaattccaaccaccgaaaaccgatattacccttaccgaacaataccaaaccgatacgtttttctacgcgcccaatcacgcaaaaaatccatattaccgaaatacaaacacgactccaacccctaaacgatattaacgattacgcgaataattttacgaataacgaaaatttcgccgcgacgcgaaaattcataattaaaaaaaattccgttacaaacgtacataccgtaaaattcacgataattaacgataatccaataaacgtacaatttaacgaccgcatacgaaaatcgcgaataaaacgacgtaatctctttctacgaaatttcctacaccaaaccatacaattcaaaaataaaaacctaataaaaacgaattttcttttccaaaccgaaaaaacgaatcgcctccaacaaacgcaacgtacccatcgcgtcgacgtcaacgatatattctaataactcaaaaaaaaccgcaacgtaactcattacgcccaaattatacacttcatccgact

SEQ ID NO: 23935 - DNA, 1146 bp, Artificial Sequence
  chemically treated genomic DNA (Homo sapiens) CpG-island No: 23935
tgtaaaatattttcgattatggattgaaaatcgatatgttttttattttgtaaattgataatgttggcgtttaggttcggttaagttttgttgttacgtttgatttattagttcggtaaacggtacgttatcgtcgaattgtaggaatagttaggagagcgtgtcggagaagatttcgttgatcgataaaatagtatcgtcgttgtcgattagatcgcgtacggtgtggttgatcggtaagttcgtatcgacggtggtattgtatagttagtgacgttcggttttttcgaaggcgtcgtggatttggcgatatttattgttgtcgttggttttcgttagtttgttggcgttgataacgtggaaatcgtggttggcgaaattaagatattgattagtaagttgttggttggcggtaacgtttagtattattaaattattatacggatgggcgcgtatttataggaataacgattttttattttgtttaatcgttttatcgttgaagaaggttaacgcgcggttggcgtttagttcgttatagtttaataggttgcggcggttgtttattatatttgttagtataaatttaaagtcggtacgtgtcgaaagcgtgttttgtttacgggcgaatagttttagttatcgggaatcgatattgtttttatcgaataatattaggtcgatgcgtttttttgcgcgtttagttacgtagggaatttatattgtcgaggtataggtacgattttagtttttgggcgatgttggcgattgcgcgggtgattttgcgggtaacgaaggtttcgtcgcggcgcggggatttatggttgaagagaatttcgttataggcgtatatgtcgtaggatttacggtagttaacggtgatttagtaggcgtatagtttggcgatcgtatacggagatcgcgggtagaacggcgtggtttttttttgcggaattttttgtattagattatatagtttagaggtggaagtttgatagaaacgagtttttttttttagatcgaggaagcggatcgtttttagtaggcgtagcgtatttatcgcgtcgacgttagcggtatattttggtgatttaaaagagatcgtaacgtggtttattgcgtttaggttgtatattttattcggtt

SEQ ID NO: 23936 - DNA, 1146 bp, Artificial Sequence
  chemically treated genomic DNA (Homo sapiens) CpG-island No: 23936
aaccgaataaaatatacaacctaaacgcaataaaccacgttacgatctcttttaaatcaccaaaatataccgctaacgtcgacgcgataaatacgctacgcctactaaaaacgatccgcttcctcgatctaaaaaaaaaaactcgtttctatcaaacttccacctctaaactatataatctaatacaaaaaattccgcaaaaaaaaaccacgccgttctacccgcgatctccgtatacgatcgccaaactatacgcctactaaatcaccgttaactaccgtaaatcctacgacatatacgcctataacgaaattctcttcaaccataaatccccgcgccgcgacgaaaccttcgttacccgcaaaatcacccgcgcaatcgccaacatcgcccaaaaactaaaatcgtacctatacctcgacaatataaattccctacgtaactaaacgcgcaaaaaaacgcatcgacctaatattattcgataaaaacaatatcgattcccgataactaaaactattcgcccgtaaacaaaacacgctttcgacacgtaccgactttaaatttatactaacaaatataataaacaaccgccgcaacctattaaactataacgaactaaacgccaaccgcgcgttaaccttcttcaacgataaaacgattaaacaaaataaaaaatcgttattcctataaatacgcgcccatccgtataataatttaataatactaaacgttaccgccaaccaacaacttactaatcaatatcttaatttcgccaaccacgatttccacgttatcaacgccaacaaactaacgaaaaccaacgacaacaataaatatcgccaaatccacgacgccttcgaaaaaaccgaacgtcactaactatacaataccaccgtcgatacgaacttaccgatcaaccacaccgtacgcgatctaatcgacaacgacgatactattttatcgatcaacgaaatcttctccgacacgctctcctaactattcctacaattcgacgataacgtaccgtttaccgaactaataaatcaaacgtaacaacaaaacttaaccgaacctaaacgccaacattatcaatttacaaaataaaaaacatatcgattttcaatccataatcgaaaatattttaca

SEQ ID NO: 23937 - DNA, 879 bp, Artificial Sequence
  chemically treated genomic DNA (Homo sapiens) CpG-island No: 23937
gttttagaattggtcgttggtatgtagtgcggtggtagcgatgcgttttttggtgtaacggtaaattcggcggttggttatgcgtttgatttattggtgcgttgcggcgtaacggtgatgtttttagaagtaacggaagtgcgtgacgcgatttatttgttgatattacgcgtagtgaacgaagaggtcggtaaacggttgttggaggagatggagtggtacgataattattttaatatgggaaaaatcgatcgtagcgttaatttttcgtcgggtaataagaaaggcggtttggtaaacgtggtagagaaggtattcggttttattgttaaatcgggtaaaagcgtaattgttgaagtgttgtcgttcggttaacgttcgattaaacgcggattaatttacgtcgcgacgttagttagcgattttgtttgtggtacgtaataggtggtttcgggtattatagtgtaagtgtttacgatcggtcgtggtacgtcgtacggtttgatggcggtattcgttattaaaatggtaattcgtatcgagttggcgaaaatgttcgttgtcgatggtgtcggttatgcgtaaatgatcgcgtagttagcgtattagcggtttgtcgttaatgtttgatttatttttatgggcgagcgttatttttacgtcggtaaatagtaggaaggtatcgaagatatataggatttagtcgaattgcgaaattagttagttgttagtgaagattatgatggtacgtagaataatcgtttcgagtacgttatatattagtacgcggcgttgtaatgtcgtcggaatagagaaatagttgaataatattagttagataaagacgttatcgatcgttagcgattttttaattagata

SEQ ID NO: 23938 - DNA, 879 bp, Artificial Sequence
  chemically treated genomic DNA (Homo sapiens) CpG-island No: 23938
tatctaattaaaaaatcgctaacgatcgataacgtctttatctaactaatattattcaactatttctctattccgacgacattacaacgccgcgtactaatatataacgtactcgaaacgattattctacgtaccatcataatcttcactaacaactaactaatttcgcaattcgactaaatcctatatatcttcgataccttcctactatttaccgacgtaaaaataacgctcgcccataaaaataaatcaaacattaacgacaaaccgctaatacgctaactacgcgatcatttacgcataaccgacaccatcgacaacgaacattttcgccaactcgatacgaattaccattttaataacgaataccgccatcaaaccgtacgacgtaccacgaccgatcgtaaacacttacactataatacccgaaaccacctattacgtaccacaaacaaaatcgctaactaacgtcgcgacgtaaattaatccgcgtttaatcgaacgttaaccgaacgacaacacttcaacaattacgcttttacccgatttaacaataaaaccgaataccttctctaccacgtttaccaaaccgcctttcttattacccgacgaaaaattaacgctacgatcgatttttcccatattaaaataattatcgtaccactccatctcctccaacaaccgtttaccgacctcttcgttcactacgcgtaatatcaacaaataaatcgcgtcacgcacttccgttacttctaaaaacatcaccgttacgccgcaacgcaccaataaatcaaacgcataaccaaccgccgaatttaccgttacaccaaaaaacgcatcgctaccaccgcactacataccaacgaccaattctaaaac

SEQ ID NO: 23939 - DNA, 879 bp, Artificial Sequence
  chemically treated genomic DNA (Homo sapiens) CpG-island No: 23939
tatttgattgagaaatcgttggcggtcgataacgtttttgtttggttgatgttgtttagttatttttttgtttcggcggtattataacgtcgcgtgttggtgtatggcgtgttcggggcgattgttttgcgtattattatgatttttattggtagttggttaatttcgtagttcgattggattttgtatattttcggtgtttttttgttgtttatcggcgtgaagatggcgttcgtttatgaagatgaattaggtattggcgataagtcgttggtgcgttggttacgcggttatttgcgtatgatcgatattatcgataacgagtattttcgttagttcggtgcgggttgttattttaatgacgggtatcgttattaggtcgtacggcgtattacgatcggtcgtaaatatttgtattgtgatattcgaagttatttgttgcgtgttatagataaaatcgttggttggcgtcgcggcgtaaattaattcgcgtttagtcgggcgttgatcgggcgatagtattttaataattgcgtttttattcgatttagtaatggagtcgagtgttttttttattacgtttgttagatcgttttttttgttgttcggcgaagggttggcgttgcggtcggttttttttatattgagatagttatcgtattattttattttttttagtagtcgtttgtcgattttttcgtttattgcgcgtggtgttagtagatggatcgcgttacgtattttcgttatttttgaaaatattatcgttgcgtcgtagcgtattagtagattagacgtatagttaatcgtcgggtttgtcgttatattagaaaacgtatcgttgttatcgtattgtatattaacgattagttttgaagt

SEQ ID NO: 23940 - DNA, 879 bp, Artificial Sequence
  chemically treated genomic DNA (Homo sapiens) CpG-island No: 23940
acttcaaaactaatcgttaatatacaatacgataacaacgatacgttttctaatataacgacaaacccgacgattaactatacgtctaatctactaatacgctacgacgcaacgataatattttcaaaaataacgaaaatacgtaacgcgatccatctactaacaccacgcgcaataaacgaaaaaatcgacaaacgactactaaaaaaaataaaataatacgataactatctcaatataaaaaaaaccgaccgcaacgccaacccttcgccgaacaacaaaaaaaacgatctaacaaacgtaataaaaaaaacactcgactccattactaaatcgaataaaaacgcaattattaaaatactatcgcccgatcaacgcccgactaaacgcgaattaatttacgccgcgacgccaaccaacgattttatctataacacgcaacaaataacttcgaatatcacaatacaaatatttacgaccgatcgtaatacgccgtacgacctaataacgatacccgtcattaaaataacaacccgcaccgaactaacgaaaatactcgttatcgataatatcgatcatacgcaaataaccgcgtaaccaacgcaccaacgacttatcgccaatacctaattcatcttcataaacgaacgccatcttcacgccgataaacaacaaaaaaacaccgaaaatatacaaaatccaatcgaactacgaaattaaccaactaccaataaaaatcataataatacgcaaaacaatcgccccgaacacgccatacaccaacacgcgacgttataataccgccgaaacaaaaaaataactaaacaacatcaaccaaacaaaaacgttatcgaccgccaacgatttctcaatcaaata

SEQ ID NO: 23941 - DNA, 825 bp, Artificial Sequence
  chemically treated genomic DNA (Homo sapiens) CpG-island No: 23941
tgtgtgtacgtggttgatttatttacgtattatcgtgcgtcgtagtttttagggcgtagttttttatgttgattatcgaaggcgtaaattacgcgttgtaataacgttgttaaataagtaattcgttaaataatttcgattattcgagtggtcgatttcggtattttttatggttcgcgattatgtttatttttaagttttcgagtatgttcgagatgtttttatattgtgtcgttgatgttcgggcgcgattacgttgatattgcgtcggtagttttttaggaaattgtggattaggtcgtgttggaagttcgtgcgttacgttataagtttaagttggaggatattagttttacgttacgtcgtggcgaagtgttcggtattgttggtttgttgggggtagggcgtagtgaattgttgaaggcgattgttgggttggaggagtatgaatagggcgaaattgttattaacggcgagaaaattacgcgtttcgattacggcgatatgttgaaacgcggtattggttatacgttagaaaatcgtaaagaagcggggattattttttggttgggcgttgacgaaaatatagtgttgattaatcggtaaaaaattagcgttaacggtgtgttgtaatggtttattattcgtcgtttgatcgaagaggtgatgtagcggatgacggttaaggtcgttagtagcgaaatatttatcggtacgttttttggtggtaattagtaaaaagtggtgatcggtcgttgggtttatgttgttagttagatttattttgcgttcgaataatagattgttagatatgtaggtaataat

SEQ ID NO: 23942 - DNA, 825 bp, Artificial Sequence
  chemically treated genomic DNA (Homo sapiens) CpG-island No: 23942
attattacctacatatctaacaatctattattcgaacgcaaaataaatctaactaacaacataaacccaacgaccgatcaccactttttactaattaccaccaaaaaacgtaccgataaatatttcgctactaacgaccttaaccgtcatccgctacatcacctcttcgatcaaacgacgaataataaaccattacaacacaccgttaacgctaattttttaccgattaatcaacactatattttcgtcaacgcccaaccaaaaaataatccccgcttctttacgattttctaacgtataaccaataccgcgtttcaacatatcgccgtaatcgaaacgcgtaattttctcgccgttaataacaatttcgccctattcatactcctccaacccaacaatcgccttcaacaattcactacgccctacccccaacaaaccaacaataccgaacacttcgccacgacgtaacgtaaaactaatatcctccaacttaaacttataacgtaacgcacgaacttccaacacgacctaatccacaatttcctaaaaaactaccgacgcaatatcaacgtaatcgcgcccgaacatcaacgacacaatataaaaacatctcgaacatactcgaaaacttaaaaataaacataatcgcgaaccataaaaaataccgaaatcgaccactcgaataatcgaaattatttaacgaattacttatttaacaacgttattacaacgcgtaatttacgccttcgataatcaacataaaaaactacgccctaaaaactacgacgcacgataatacgtaaataaatcaaccacgtacacaca

SEQ ID NO: 23943 - DNA, 825 bp, Artificial Sequence
  chemically treated genomic DNA (Homo sapiens) CpG-island No: 23943
attgttgtttgtatatttgataatttgttattcgggcgtagggtgaatttggttggtagtatagatttaacgatcgattattattttttgttgattgttattagaaagcgtgtcgatgggtgtttcgttattggcggttttgatcgttattcgttgtattattttttcggttaggcggcggatggtggattattgtagtatatcgttggcgttgattttttgtcgattggttagtattgtattttcgttaacgtttaattagggaatgattttcgtttttttgcggttttttggcgtatagttaatgtcgcgttttagtatgtcgtcgtaatcggggcgcgtgattttttcgtcgttgataataatttcgttttgtttatatttttttagtttaataatcgtttttagtaatttattgcgttttgtttttagtagattagtaatgtcgagtatttcgttacgacgtagcgtaaaattgatattttttagtttgggtttatggcgtaacgtacggatttttagtacggtttgatttataattttttgaggggttatcggcgtaatattaacgtgatcgcgttcgagtattagcgatataatataggggtatttcggatatgttcgggaatttggggataggtatgatcgcgagttatggaaagtatcgaagtcgattattcgggtggtcggggttatttggcgagttgtttgtttggtaacgttgttgtaacgcgtggtttgcgttttcggtggttagtatgggaaattacgttttgagaattgcggcgtacggtggtacgtggataagttaattacgtgtatata

SEQ ID NO: 23944 - DNA, 825 bp, Artificial Sequence
  chemically treated genomic DNA (Homo sapiens) CpG-island No: 23944
tatatacacgtaattaacttatccacgtaccaccgtacgccgcaattctcaaaacgtaatttcccatactaaccaccgaaaacgcaaaccacgcgttacaacaacgttaccaaacaaacaactcgccaaataaccccgaccacccgaataatcgacttcgatactttccataactcgcgatcatacctatccccaaattcccgaacatatccgaaatacccctatattatatcgctaatactcgaacgcgatcacgttaatattacgccgataacccctcaaaaaattataaatcaaaccgtactaaaaatccgtacgttacgccataaacccaaactaaaaaatatcaattttacgctacgtcgtaacgaaatactcgacattactaatctactaaaaacaaaacgcaataaattactaaaaacgattattaaactaaaaaaatataaacaaaacgaaattattatcaacgacgaaaaaatcacgcgccccgattacgacgacatactaaaacgcgacattaactatacgccaaaaaaccgcaaaaaaacgaaaatcattccctaattaaacgttaacgaaaatacaatactaaccaatcgacaaaaaatcaacgccaacgatatactacaataatccaccatccgccgcctaaccgaaaaaataatacaacgaataacgatcaaaaccgccaataacgaaacacccatcgacacgctttctaataacaatcaacaaaaaataataatcgatcgttaaatctatactaccaaccaaattcaccctacgcccgaataacaaattatcaaatatacaaacaacaat

SEQ ID NO: 23945 - DNA, 682 bp, Artificial Sequence
  chemically treated genomic DNA (Homo sapiens) CpG-island No: 23945
tcgaaggtcggcgttattacgtttattacgatgtggtcggcgttttggatcgttgcgaagggtatattggtattcgtatttttcgcggttatcgatttttttttaagagtgtgttatttgtttaggttattttttaaggtcgtattatcggtaaaagcggtgaatcgttgattcgtaaaggtgtggatatggcgatgcgtttgatgggtgagtagttcgttattggcgaaattatcgcggaagcgttagttaatgttcgtaagttggaagagaaaggttttcgttatttttacgatatgttgggcgaagtcgcgttgatcgtcgtagatgtataggcgtatatggttttttattagtaggcgatttacgttatcggtaaagcgtttaacggtcgtggtatttatgaagggtcgggtattttaattaaattgtcggcgttgtattcgcgttatagtcgcgtttagtatgatcgggtaatggaagagttttattcgcgtttgaaattatttattttgttggcgcgttagtacgatattggtattaatattgacgtcgaagagttcgatcgtttggagatttttttcgatttgttggaaaaattttgtttcgagtcggaattggtaggttggaacggtatcggttttgttatttaggtttattaaaaacgttgttcgttggtgat

SEQ ID NO: 23946 - DNA, 682 bp, Artificial Sequence
  chemically treated genomic DNA (Homo sapiens) CpG-island No: 23946
atcaccaacgaacaacgtttttaataaacctaaataacaaaaccgataccgttccaacctaccaattccgactcgaaacaaaatttttccaacaaatcgaaaaaaatctccaaacgatcgaactcttcgacgtcaatattaataccaatatcgtactaacgcgccaacaaaataaataatttcaaacgcgaataaaactcttccattacccgatcatactaaacgcgactataacgcgaatacaacgccgacaatttaattaaaatacccgacccttcataaataccacgaccgttaaacgctttaccgataacgtaaatcgcctactaataaaaaaccatatacgcctatacatctacgacgatcaacgcgacttcgcccaacatatcgtaaaaataacgaaaacctttctcttccaacttacgaacattaactaacgcttccgcgataatttcgccaataacgaactactcacccatcaaacgcatcgccatatccacacctttacgaatcaacgattcaccgcttttaccgataatacgaccttaaaaaataacctaaacaaataacacactcttaaaaaaaaatcgataaccgcgaaaaatacgaataccaatatacccttcgcaacgatccaaaacgccgaccacatcgtaataaacgtaataacgccgaccttcga

SEQ ID NO: 23947 - DNA, 682 bp, Artificial Sequence
  chemically treated genomic DNA (Homo sapiens) CpG-island No: 23947
attattaacgggtagcgtttttgataagtttgaataataaaatcgatgtcgttttagtttgttagtttcggttcgaaatagagtttttttagtagatcgagggagatttttaggcgatcggatttttcggcgttaatgttgatattaatatcgtattgacgcgttagtagggtgagtgattttagacgcgggtaaagtttttttattattcggttatattgggcgcggttataacgcggatgtagcgtcgatagtttgattgaaatgttcggttttttatagatgttacgatcgttagacgttttatcgatggcgtgaatcgtttgttgataggaaattatatacgtttgtgtatttgcggcggttagcgcggtttcgtttagtatatcgtaagagtaacggaaattttttttttttagtttgcgggtattggttaacgttttcgcgatggtttcgttagtgacgaattgtttatttattaggcgtatcgttatatttatatttttgcggattagcggtttatcgtttttatcgataatgcggttttggaggatggtttaagtaggtggtatatttttgggggaaaatcggtgatcgcggggaatgcgggtattagtgtgtttttcgtaacggtttaggacgtcgattatatcgtgataggcgtaataacgtcgattttcga

SEQ ID NO: 23948 - DNA, 682 bp, Artificial Sequence
  chemically treated genomic DNA (Homo sapiens) CpG-island No: 23948
tcgaaaatcgacgttattacgcctatcacgatataatcgacgtcctaaaccgttacgaaaaacacactaatacccgcattccccgcgatcaccgattttcccccaaaaatataccacctacttaaaccatcctccaaaaccgcattatcgataaaaacgataaaccgctaatccgcaaaaatataaatataacgatacgcctaataaataaacaattcgtcactaacgaaaccatcgcgaaaacgttaaccaatacccgcaaactaaaaaaaaaaaatttccgttactcttacgatatactaaacgaaaccgcgctaaccgccgcaaatacacaaacgtatataatttcctatcaacaaacgattcacgccatcgataaaacgtctaacgatcgtaacatctataaaaaaccgaacatttcaatcaaactatcgacgctacatccgcgttataaccgcgcccaatataaccgaataataaaaaaactttacccgcgtctaaaatcactcaccctactaacgcgtcaatacgatattaatatcaacattaacgccgaaaaatccgatcgcctaaaaatctccctcgatctactaaaaaaactctatttcgaaccgaaactaacaaactaaaacgacatcgattttattattcaaacttatcaaaaacgctacccgttaataat

SEQ ID NO: 23949 - DNA, 672 bp, Artificial Sequence
  chemically treated genomic DNA (Homo sapiens) CpG-island No: 23949
acgcgttagcgttttatagcgtatgtattcgttcggtaatcgttatcgtttagggtttatgtattcgttttttatagggagagtgtaaaataatacgttagttattaattttattacggtatcgttcgaggattagatggcgatttttcggaacgatgttcgtcgcgttgcgttgttttttaattaatttttgaatattggcgatcgtatttttttttgttagttacgggggaatagtttcggaaaagaacgcgttattcgttagtaaatgaagaaaatcgtcgattatttcgtttaatttagtcggacgttcgttatttttattacgttagaaggggagtcgggtagaacgattcggagtaggagttataattatttgatcgcgggtgatttgttggattcgttatgaggtagcgtcgagagtgataatgtcgtttattcgcgatttatatattatttttttatttagttgatttattcgtcgcgaatcggtttttttttaattttcgggtaataatacgttagtatatgttacgatgtcggaatggtgtacgtcgttggtaatcgttaataattgagcgttaggtcgggcggttaatatttcggtttttttgttttagattagtttggggtagaaaagtagaaaaatcgttagagggatagcgttcggaa

SEQ ID NO: 23950 - DNA, 672 bp, Artificial Sequence
  chemically treated genomic DNA (Homo sapiens) CpG-island No: 23950
ttccgaacgctatccctctaacgatttttctacttttctaccccaaactaatctaaaacaaaaaaaccgaaatattaaccgcccgacctaacgctcaattattaacgattaccaacgacgtacaccattccgacatcgtaacatatactaacgtattattacccgaaaattaaaaaaaaaccgattcgcgacgaataaatcaactaaataaaaaaataatatataaatcgcgaataaacgacattatcactctcgacgctacctcataacgaatccaacaaatcacccgcgatcaaataattataactcctactccgaatcgttctacccgactccccttctaacgtaataaaaataacgaacgtccgactaaattaaacgaaataatcgacgattttcttcatttactaacgaataacgcgttcttttccgaaactattcccccgtaactaacaaaaaaaaatacgatcgccaatattcaaaaattaattaaaaaacaacgcaacgcgacgaacatcgttccgaaaaatcgccatctaatcctcgaacgataccgtaataaaattaataactaacgtattattttacactctccctataaaaaacgaatacataaaccctaaacgataacgattaccgaacgaatacatacgctataaaacgctaacgcgt

SEQ ID NO: 23951 - DNA, 672 bp, Artificial Sequence
  chemically treated genomic DNA (Homo sapiens) CpG-island No: 23951
tttcgggcgttatttttttggcgatttttttgtttttttgttttaaattggtttggaatagggagatcgggatattgatcgttcgatttggcgtttaattgttggcggttattagcggcgtgtattatttcggtatcgtggtatgtattagcgtgttattattcgaaggttaagaaaaggtcggttcgcggcgggtgggttaattggatgaggagatggtatatgagtcgcgggtgaacgatattattattttcggcgttattttatggcggatttagtaaattattcgcgattaggtgattgtgatttttgtttcgggtcgttttgttcggttttttttttggcgtggtgaaggtaacggacgttcggttgaattaggcgagatgatcggcgattttttttatttgttggcggatggcgcgttttttttcgggattattttttcgtggttggtagaagaaaatacgatcgttaatatttaggggttgattgaggagtagcgtaacgcgacgggtatcgtttcggggagtcgttatttggttttcgaacggtgtcgtgatgaaattggtgattggcgtattattttgtattttttttatggaagacgggtgtatgaattttgggcggtggcgattgtcgggcgaatatatgcgttatggggcgttgacgcgt

SEQ ID NO: 23952 - DNA, 672 bp, Artificial Sequence
  chemically treated genomic DNA (Homo sapiens) CpG-island No: 23952
acgcgtcaacgccccataacgcatatattcgcccgacaatcgccaccgcccaaaattcatacacccgtcttccataaaaaaaatacaaaataatacgccaatcaccaatttcatcacgacaccgttcgaaaaccaaataacgactccccgaaacgatacccgtcgcgttacgctactcctcaatcaacccctaaatattaacgatcgtattttcttctaccaaccacgaaaaaataatcccgaaaaaaaacgcgccatccgccaacaaataaaaaaaatcgccgatcatctcgcctaattcaaccgaacgtccgttaccttcaccacgccaaaaaaaaaaccgaacaaaacgacccgaaacaaaaatcacaatcacctaatcgcgaataatttactaaatccgccataaaataacgccgaaaataataatatcgttcacccgcgactcatataccatctcctcatccaattaacccacccgccgcgaaccgaccttttcttaaccttcgaataataacacgctaatacataccacgataccgaaataatacacgccgctaataaccgccaacaattaaacgccaaatcgaacgatcaatatcccgatctccctattccaaaccaatttaaaacaaaaaaacaaaaaaatcgccaaaaaaataacgcccgaaa

SEQ ID NO: 23953 - DNA, 560 bp, Artificial Sequence
  chemically treated genomic DNA (Homo sapiens) CpG-island No: 23953
  misc_feature (284)..(284): n is either a, c, g or t
  misc_feature (312)..(312): n is either a, c, g or t
  misc_feature (318)..(319): n is either a, c, g or t
  misc_feature (329)..(331): n is either a, c, g or t
  misc_feature (345)..(346): n is either a, c, g or t
  misc_feature (359)..(359): n is either a, c, g or t
  misc_feature (407)..(408): n is either a, c, g or t
tatcgtaacgttgatgacgacgtattttttttagttgtgttgttagtcgggttgttagtttcggtagcgttttttgcgtcgtaatgtgaatatttaacggtaaaacgttgagtacgggttcggtagtcgttagcgtcgtcgagtttagtcgacgtataaagataaattcggcggcgtagtttatacgattgtataatcgttttagttataaggttgttagcgtaagggttaaatcggtacgttgtatatttgaaagttgcgtagttagttggcggaattttttngtcggtaaattttagttttaggcgtagnaatatnnttgtcgaggnnncgttgcgtttcggnntaaaggtgtcggnagaaagtgacgcgggcggcggtagttgaacgaacgttgttttttgggnntatagaatgtcgtatttacgttgttaggtttcgttttcgcggtattgttggtatttttttattatattaggcgaaagggcgttaaatggcgaagtaggcgttggttcgtacgtagttatgtgtagtaaatattcgggtcgaattttgggcga

SEQ ID NO: 23954 - DNA, 560 bp, Artificial Sequence
  chemically treated genomic DNA (Homo sapiens) CpG-island No: 23954
  misc_feature (153)..(154): n is either a, c, g or t
  misc_feature (202)..(202): n is either a, c, g or t
  misc_feature (215)..(216): n is either a, c, g or t
  misc_feature (230)..(232): n is either a, c, g or t
  misc_feature (242)..(243): n is either a, c, g or t
  misc_feature (249)..(249): n is either a, c, g or t
  misc_feature (277)..(277): n is either a, c, g or t
tcgcccaaaattcgacccgaatatttactacacataactacgtacgaaccaacgcctacttcgccatttaacgccctttcgcctaatataataaaaaaataccaacaataccgcgaaaacgaaacctaacaacgtaaatacgacattctatanncccaaaaaacaacgttcgttcaactaccgccgcccgcgtcactttctnccgacacctttannccgaaacgcaacgnnncctcgacaannatattnctacgcctaaaactaaaatttaccgacnaaaaaattccgccaactaactacgcaactttcaaatatacaacgtaccgatttaacccttacgctaacaaccttataactaaaacgattatacaatcgtataaactacgccgccgaatttatctttatacgtcgactaaactcgacgacgctaacgactaccgaacccgtactcaacgttttaccgttaaatattcacattacgacgcaaaaaacgctaccgaaactaacaacccgactaacaacacaactaaaaaaaatacgtcgtcatcaacgttacgata

SEQ ID NO: 23955 - DNA, 560 bp, Artificial Sequence
  chemically treated genomic DNA (Homo sapiens) CpG-island No: 23955
  misc_feature (153)..(154): n is either a, c, g or t
  misc_feature (202)..(202): n is either a, c, g or t
  misc_feature (215)..(216): n is either a, c, g or t
  misc_feature (230)..(232): n is either a, c, g or t
  misc_feature (242)..(243): n is either a, c, g or t
  misc_feature (249)..(249): n is either a, c, g or t
  misc_feature (277)..(277): n is either a, c, g or t
tcgtttaggattcggttcgaatatttattgtatatggttgcgtgcgaattaacgtttgtttcgttatttaacgttttttcgtttgatgtagtggaagagtattagtaatatcgcgaaagcgaagtttggtagcgtgaatgcggtattttgtgnntttaaggaatagcgttcgtttaattgtcgtcgttcgcgttattttttntcggtatttttanntcggggcgtagcgnnntttcggtagnnatattnttgcgtttgaaattggaatttatcgatnggggaatttcgttagttggttacgtaatttttaggtgtgtagcgtatcgatttagtttttgcgttggtagttttgtggttggggcgattgtgtaatcgtatggattacgtcgtcggatttatttttatgcgtcgattgggttcggcggcgttgacggttatcggattcgtgtttaacgttttgtcgttgggtatttatattgcggcgtaagaaacgttgtcggaattggtaattcgattggtagtataattgaaaaaaatgcgtcgttattaacgttacgatg

SEQ ID NO: 23956 - DNA, 560 bp, Artificial Sequence
  chemically treated genomic DNA (Homo sapiens) CpG-island No: 23956
  misc_feature (284)..(284): n is either a, c, g or t
  misc_feature (312)..(312): n is either a, c, g or t
  misc_feature (318)..(319): n is either a, c, g or t
  misc_feature (329)..(331): n is either a, c, g or t
  misc_feature (345)..(346): n is either a, c, g or t
  misc_feature (359)..(359): n is either a, c, g or t
  misc_feature (407)..(408): n is either a, c, g or t
catcgtaacgttaataacgacgcatttttttcaattatactaccaatcgaattaccaattccgacaacgtttcttacgccgcaatataaatacccaacgacaaaacgttaaacacgaatccgataaccgtcaacgccgccgaacccaatcgacgcataaaaataaatccgacgacgtaatccatacgattacacaatcgccccaaccacaaaactaccaacgcaaaaactaaatcgatacgctacacacctaaaaattacgtaaccaactaacgaaattccccnatcgataaattccaatttcaaacgcaanaatatnnctaccgaaannncgctacgccccganntaaaaataccganaaaaaataacgcgaacgacgacaattaaacgaacgctattccttaaanncacaaaataccgcattcacgctaccaaacttcgctttcgcgatattactaatactcttccactacatcaaacgaaaaaacgttaaataacgaaacaaacgttaattcgcacgcaaccatatacaataaatattcgaaccgaatcctaaacga

SEQ ID NO: 23957 - DNA, 894 bp, Artificial Sequence
  chemically treated genomic DNA (Homo sapiens) CpG-island No: 23957
tttgatttgtttttttaggttgaatacggttcggatttataggtgattttattgacgttcgttgttgatatggcgcgtcgcgttgtcgaggtcgtcgaacgttaattggtagaattgtcgcgtgtcgaaatcgttcgttaggtattgaacgttagtcgtttgatcgtgattaaagatttagcgtagtgcgtggagatttttaattagtacggttcggagtatttgattatttagattcgtaacgttcgtgaattggtcgatagtattattagcgtcggttcggtattttttggtgattggttatcggaatcggtaggtgattacgttttcggtatataattacgttttatcgatttacggttatatcgttatttgttttagtttcgggttggtagatttttagaagcgtatgatcgtataggaattgtcgaaagaggggtttttcgcgttggttttaattatagaaatattggtcgtcgtcgagcgtttgatcgtttataaaaatgtcgcgatttcgcgtgttaacgtttttatagatttagtatgattatcgcgatttatatcgattatcgcgataaatcgttagatatcgacgtcgtatacgtttcgtttttttgttttttacgcggagattgattgacgtacgaatttttacgttacgttttatataatacgtaacgataatcgttttttattttatttcgatttcgacgatattttttttattatttttaatttttatttttttagtatatatttttaaagggattttagttatcgtttacgtttttttttttcgttttatacgcgttttattcgttattcgtaatcgttatttttttcgatttcgatacgtttttagcgatacgtttttttcgacgtttttacgttttt

SEQ ID NO: 23958 - DNA, 894 bp, Artificial Sequence
  chemically treated genomic DNA (Homo sapiens) CpG-island No: 23958
aaaaacgtaaaaacgtcgaaaaaaacgtatcgctaaaaacgtatcgaaatcgaaaaaaataacgattacgaataacgaataaaacgcgtataaaacgaaaaaaaaaaacgtaaacgataactaaaatccctttaaaaatatatactaaaaaaataaaaattaaaaataataaaaaaaatatcgtcgaaatcgaaataaaataaaaaacgattatcgttacgtattatataaaacgtaacgtaaaaattcgtacgtcaatcaatctccgcgtaaaaaacaaaaaaacgaaacgtatacgacgtcgatatctaacgatttatcgcgataatcgatataaatcgcgataatcatactaaatctataaaaacgttaacacgcgaaatcgcgacatttttataaacgatcaaacgctcgacgacgaccaatatttctataattaaaaccaacgcgaaaaacccctctttcgacaattcctatacgatcatacgcttctaaaaatctaccaacccgaaactaaaacaaataacgatataaccgtaaatcgataaaacgtaattatataccgaaaacgtaatcacctaccgattccgataaccaatcaccaaaaaataccgaaccgacgctaataatactatcgaccaattcacgaacgttacgaatctaaataatcaaatactccgaaccgtactaattaaaaatctccacgcactacgctaaatctttaatcacgatcaaacgactaacgttcaatacctaacgaacgatttcgacacgcgacaattctaccaattaacgttcgacgacctcgacaacgcgacgcgccatatcaacaacgaacgtcaataaaatcacctataaatccgaaccgtattcaacctaaaaaaacaaatcaaa

SEQ ID NO: 23959 - DNA, 894 bp, Artificial Sequence
  chemically treated genomic DNA (Homo sapiens) CpG-island No: 23959
gggggcgtaggggcgtcggggggggcgtgtcgttggggacgtgtcggggtcggggggggtggcggttgcgggtagcgggtggggcgcgtgtggggcgggggaggggggcgtgggcggtggttggggtttttttgggggtgtgtgttgggggggtgggggttgggggtgatgggggaggtgtcgtcggggtcggggtgaggtggggagcggttgtcgttgcgtgttgtgtggggcgtggcgtggggattcgtgcgttagttagttttcgcgtggggggtagagaggcggggcgtgtgcggcgtcggtgtttgacggtttatcgcggtgatcggtatgagtcgcggtggttatgttgggtttgtaggggcgttagtacgcgaggtcgcggtatttttgtgggcggttaggcgttcggcggcggttagtgtttttatggttgaagttagcgcggagaatttttttttcgatagtttttgtacggttatgcgtttttggaaatttgttagttcgaggttggaataggtggcggtgtaatcgtaagtcggtagaacgtggttgtgtgtcggaggcgtaattatttgtcgatttcggtgattagttattaagaaatatcgaatcggcgttggtgatgttatcgattagtttacgggcgttgcgggtttgaatgattaggtgtttcgggtcgtattggttggagatttttacgtattgcgttaaatttttagttacgattaggcggttggcgtttagtgtttggcgggcggtttcggtacgcggtagttttgttagttggcgttcgacggtttcggtaacgcgacgcgttatattagtagcgggcgttagtaaaattatttgtgagttcgggtcgtgtttagtttgagagagtaaattaga

SEQ ID NO: 23960 - DNA, 894 bp, Artificial Sequence
  chemically treated genomic DNA (Homo sapiens) CpG-island No: 23960
tctaatttactctctcaaactaaacacgacccgaactcacaaataattttactaacgcccgctactaatataacgcgtcgcgttaccgaaaccgtcgaacgccaactaacaaaactaccgcgtaccgaaaccgcccgccaaacactaaacgccaaccgcctaatcgtaactaaaaatttaacgcaatacgtaaaaatctccaaccaatacgacccgaaacacctaatcattcaaacccgcaacgcccgtaaactaatcgataacatcaccaacgccgattcgatatttcttaataactaatcaccgaaatcgacaaataattacgcctccgacacacaaccacgttctaccgacttacgattacaccgccacctattccaacctcgaactaacaaatttccaaaaacgcataaccgtacaaaaactatcgaaaaaaaaattctccgcgctaacttcaaccataaaaacactaaccgccgccgaacgcctaaccgcccacaaaaataccgcgacctcgcgtactaacgcccctacaaacccaacataaccaccgcgactcataccgatcaccgcgataaaccgtcaaacaccgacgccgcacacgccccgcctctctaccccccacgcgaaaactaactaacgcacgaatccccacgccacgccccacacaacacgcaacgacaaccgctccccacctcaccccgaccccgacgacacctcccccatcacccccaacccccacccccccaacacacacccccaaaaaaaccccaaccaccgcccacgcccccctcccccgccccacacgcgccccacccgctacccgcaaccgccaccccccccgaccccgacacgtccccaacgacacgccccccccgacgcccctacgccccc

SEQ ID NO: 23961 - DNA, 644 bp, Artificial Sequence
  chemically treated genomic DNA (Homo sapiens) CpG-island No: 23961
tcgatggcgaattttgggcgtaaagtatgttcgtttggttagtgttgatttcgttgattagtcgttagtaattttttttcgtcgtgtatgtgttgatcgacgttatcgatattacgtatcgcgtttacgaattgtcgtgtaatgcggatttttggttcgtagtatagtaagagttattatttttggtgaaagttattgttttttttagcgatcgtgtcgatcgtatcgtggttgtcgggtagagttttggtgggtttttcgcgttgtatgtcggattgtattggtttgaacgttttggttgtgtattaagttagttaggatcgtattggtggtcgtatcggggcgggtagtaagagggcgtgttatttgaaaagttaaaagttggtgaagttagcgtcgaaggtttgcgtattgtgttggaagcgggtattcgcgagtcgatgattatgcgggttaattaggcgttgtatgcgtaattatattttataaaagaatttattttttggcgttaggttgacggcggatatgatgcgtttgttggcgcggtggtttgatgtaggggttaatcgatttttggtaattatttttttatgataggagttgaatatggtatttagtaattttttcgatgattcgtagggagt

SEQ ID NO: 23962 - DNA, 644 bp, Artificial Sequence
  chemically treated genomic DNA (Homo sapiens) CpG-island No: 23962
actccctacgaatcatcgaaaaaattactaaataccatattcaactcctatcataaaaaaataattaccaaaaatcgattaacccctacatcaaaccaccgcgccaacaaacgcatcatatccgccgtcaacctaacgccaaaaaataaattcttttataaaatataattacgcatacaacgcctaattaacccgcataatcatcgactcgcgaatacccgcttccaacacaatacgcaaaccttcgacgctaacttcaccaacttttaacttttcaaataacacgccctcttactacccgccccgatacgaccaccaatacgatcctaactaacttaatacacaaccaaaacgttcaaaccaatacaatccgacatacaacgcgaaaaacccaccaaaactctacccgacaaccacgatacgatcgacacgatcgctaaaaaaaacaataactttcaccaaaaataataactcttactatactacgaaccaaaaatccgcattacacgacaattcgtaaacgcgatacgtaatatcgataacgtcgatcaacacatacacgacgaaaaaaaattactaacgactaatcaacgaaatcaacactaaccaaacgaacatactttacgcccaaaattcgccatcga

SEQ ID NO: 23963 - DNA, 644 bp, Artificial Sequence
  chemically treated genomic DNA (Homo sapiens) CpG-island No: 23963
gttttttgcggattatcgaagggattattgaatgttatatttaatttttgttatggaaaagtggttgttagaggtcgattagtttttgtattaagttatcgcgttaataagcgtattatgttcgtcgttaatttgacgttagaaaatggatttttttatggggtgtaattgcgtatatagcgtttgattggttcgtatgattatcggttcgcgaatattcgtttttagtataatgcgtagattttcggcgttaattttattagtttttagttttttaagtaatacgtttttttgttgttcgtttcgatgcggttattagtacgattttgattggtttaatatatagttaaagcgtttaggttagtgtagttcggtatatagcgcggaaagtttattaaaattttgttcggtaattacggtgcgatcggtacgatcgttaaaaggggtaatagtttttattaggggtaataatttttgttgtattgcgagttagaaattcgtattatacggtagttcgtgggcgcggtgcgtggtgtcgatagcgtcgattaatatatatacggcgggaggaagttgttgacgattggttagcgaagttagtattggttagacgggtatattttgcgtttaaaattcgttatcga

SEQ ID NO: 23964 - DNA, 644 bp, Artificial Sequence
  chemically treated genomic DNA (Homo sapiens) CpG-island No: 23964
tcgataacgaattttaaacgcaaaatatacccgtctaaccaatactaacttcgctaaccaatcgtcaacaacttcctcccgccgtatatatattaatcgacgctatcgacaccacgcaccgcgcccacgaactaccgtataatacgaatttctaactcgcaatacaacaaaaattattacccctaataaaaactattaccccttttaacgatcgtaccgatcgcaccgtaattaccgaacaaaattttaataaactttccgcgctatataccgaactacactaacctaaacgctttaactatatattaaaccaatcaaaatcgtactaataaccgcatcgaaacgaacaacaaaaaaacgtattacttaaaaaactaaaaactaataaaattaacgccgaaaatctacgcattatactaaaaacgaatattcgcgaaccgataatcatacgaaccaatcaaacgctatatacgcaattacaccccataaaaaaatccattttctaacgtcaaattaacgacgaacataatacgcttattaacgcgataacttaatacaaaaactaatcgacctctaacaaccacttttccataacaaaaattaaatataacattcaataatcccttcgataatccgcaaaaaac

SEQ ID NO: 23965 - DNA, 571 bp, Artificial Sequence
  chemically treated genomic DNA (Homo sapiens) CpG-island No: 23965
ttcgagtaggtggcggaaatttatgatggtggtgcgattcggtagggcgttatttagggataatcgggtaaataggcgtatggaggcgatttcgtatagggtattttttatggtatcgtcgtttaggttgtattaatgttgtatgtagtgaatacgtagtatggtttttagcggatagggtcgtcggttattgttcgttttgggataaaacggttcgatgatagcggttatattttgttatggtagaatttgttttatgcgggagaggaaaattttttttcgggtttgacggcgtttagtgttgaatttattatcggcgaaggtgagttgatggtttatgatgtttttttgggatgcgtttcggatgatttgatgatttttattagattggtcgttttttttagggaaaagtcgattgttatcgaattagcggttttagaatttttggttgggatcggtgattatttcgtttttggtgatagtttaagttcgtttaggtttaagtatcggacgaatcgtattaaatgtaattcgagattcgggattattgaacgcgattttaaaattttcg

SEQ ID NO: 23966 - DNA, 571 bp, Artificial Sequence
  chemically treated genomic DNA (Homo sapiens) CpG-island No: 23966
cgaaaattttaaaatcgcgttcaataatcccgaatctcgaattacatttaatacgattcgtccgatacttaaacctaaacgaacttaaactatcaccaaaaacgaaataatcaccgatcccaaccaaaaattctaaaaccgctaattcgataacaatcgacttttccctaaaaaaaacgaccaatctaataaaaatcatcaaatcatccgaaacgcatcccaaaaaaacatcataaaccatcaactcaccttcgccgataataaattcaacactaaacgccgtcaaacccgaaaaaaaattttcctctcccgcataaaacaaattctaccataacaaaatataaccgctatcatcgaaccgttttatcccaaaacgaacaataaccgacgaccctatccgctaaaaaccatactacgtattcactacatacaacattaatacaacctaaacgacgataccataaaaaataccctatacgaaatcgcctccatacgcctatttacccgattatccctaaataacgccctaccgaatcgcaccaccatcataaatttccgccacctactcgaa

SEQ ID NO: 23967 - DNA, 571 bp, Artificial Sequence
  chemically treated genomic DNA (Homo sapiens) CpG-island No: 23967
cgaaggttttggagtcgcgtttaatggtttcggatttcgggttatatttggtacgattcgttcggtatttgggtttaaacgggtttaaattattattaggaacggggtaattatcggttttagttaaaggttttggggtcgttaattcggtagtagtcggtttttttttgggaagggcgattagtttgatagagattattaaattattcggagcgtattttagagggatattatgagttattaatttattttcgtcgatagtgaatttagtattaagcgtcgttagattcgaaaagagatttttttttttcgtatggagtagattttgttatggtagaatatgatcgttgttatcgagtcgttttattttaaggcgggtaatggtcgacggttttattcgttggagattatgttgcgtatttattgtatgtagtattggtataatttgagcgacggtgttatggaagatgttttgtacgaaatcgtttttatgcgtttgtttgttcgattatttttggatagcgttttgtcggatcgtattattattatgaattttcgttatttgttcgag

SEQ ID NO: 23968 - DNA, 571 bp, Artificial Sequence
  chemically treated genomic DNA (Homo sapiens) CpG-island No: 23968
ctcgaacaaataacgaaaattcataataataatacgatccgacaaaacgctatccaaaaataatcgaacaaacaaacgcataaaaacgatttcgtacaaaacatcttccataacaccgtcgctcaaattataccaatactacatacaataaatacgcaacataatctccaacgaataaaaccgtcgaccattacccgccttaaaataaaacgactcgataacaacgatcatattctaccataacaaaatctactccatacgaaaaaaaaaaatctcttttcgaatctaacgacgcttaatactaaattcactatcgacgaaaataaattaataactcataatatccctctaaaatacgctccgaataatttaataatctctatcaaactaatcgcccttcccaaaaaaaaaccgactactaccgaattaacgaccccaaaacctttaactaaaaccgataattaccccgttcctaataataatttaaacccgtttaaacccaaataccgaacgaatcgtaccaaatataacccgaaatccgaaaccattaaacgcgactccaaaaccttcg

SEQ ID NO: 23969 - DNA, 640 bp, Artificial Sequence
  chemically treated genomic DNA (Homo sapiens) CpG-island No: 23969
agaaacgcgttcgtatttatttgattttagcggagcgtgaaaagaagacggtaagaaaaagtcgtcgttttggacgcgtattgcgttgattttttcgttatcggcgtggcgttttcgtacggcgcgaacgatggttagaaagtattggtttggttatgttggtattgattggcgtcgcgttagtaggtttttggtgaatatgaatgttattggttacgaaattattcgtattcgtgatgtattaataacgtcgaagtttattttgagtagtattttgcgtagtttaaacggattagtaaatatagttgatcgtttttcgttaatatattcgtaattttatttcgttagtataatggtgatgaagaagttgtcgttttgggcgcgattattcgttttacgtcgttggattaggtataacgtttttttcgttagtattcggaatattcgatttacgtatttgggggttgaatgtttttgattcgtcgtagggtaattatttttatttcgtttggaatggcgacgttgtggcggtaaagttacgcgcggttgacgttatttagcgaaagttttttttagtacgatgcgatttagtaaaagaatttatcgttatattggtgagtattaagtttttgtttgggtt

SEQ ID NO: 23970 - DNA, 640 bp, Artificial Sequence
  chemically treated genomic DNA (Homo sapiens) CpG-island No: 23970
aacccaaacaaaaacttaatactcaccaatataacgataaattcttttactaaatcgcatcgtactaaaaaaaactttcgctaaataacgtcaaccgcgcgtaactttaccgccacaacgtcgccattccaaacgaaataaaaataattaccctacgacgaatcaaaaacattcaacccccaaatacgtaaatcgaatattccgaatactaacgaaaaaaacgttatacctaatccaacgacgtaaaacgaataatcgcgcccaaaacgacaacttcttcatcaccattatactaacgaaataaaattacgaatatattaacgaaaaacgatcaactatatttactaatccgtttaaactacgcaaaatactactcaaaataaacttcgacgttattaatacatcacgaatacgaataatttcgtaaccaataacattcatattcaccaaaaacctactaacgcgacgccaatcaataccaacataaccaaaccaatactttctaaccatcgttcgcgccgtacgaaaacgccacgccgataacgaaaaaatcaacgcaatacgcgtccaaaacgacgactttttcttaccgtcttcttttcacgctccgctaaaatcaaataaatacgaacgcgtttct

SEQ ID NO: 23971 - DNA, 640 bp, Artificial Sequence
  chemically treated genomic DNA (Homo sapiens) CpG-island No: 23971
aatttaggtaagggtttgatatttattagtgtggcgataaatttttttgttgaatcgtatcgtgttgaagggagttttcgttgaatagcgttagtcgcgcgtggttttatcgttatagcgtcgttattttaggcggggtaaaagtaattgttttgcgacgggttaaaagtatttagtttttaaatgcgtaagtcgggtgtttcgggtgttggcgaagaaaacgttgtgtttggtttaacgacgtaaagcgggtaatcgcgtttaggacgatagtttttttattattattatattggcggagtagaattgcgggtatgttaacggggggcggttagttatatttgttggttcgtttgagttgcgtaggatgttgtttaaagtaagtttcgacgttgttgatgtattacgggtacgggtgatttcgtagttagtggtatttatgtttattagaagtttgttggcgcgacgttaattaatattaatataattagattaatgttttttgattatcgttcgcgtcgtgcgaaaacgttacgtcgatagcggaaggattagcgtaatacgcgtttagaacggcggtttttttttgtcgttttttttttacgtttcgttggggttaggtggatacgggcgcgttttt

SEQ ID NO: 23972 - DNA, 640 bp, Artificial Sequence
  chemically treated genomic DNA (Homo sapiens) CpG-island No: 23972
aaaaacgcgcccgtatccacctaaccccaacgaaacgtaaaaaaaaaacgacaaaaaaaaaccgccgttctaaacgcgtattacgctaatccttccgctatcgacgtaacgttttcgcacgacgcgaacgataatcaaaaaacattaatctaattatattaatattaattaacgtcgcgccaacaaacttctaataaacataaataccactaactacgaaatcacccgtacccgtaatacatcaacaacgtcgaaacttactttaaacaacatcctacgcaactcaaacgaaccaacaaatataactaaccgccccccgttaacatacccgcaattctactccgccaatataataataataaaaaaactatcgtcctaaacgcgattacccgctttacgtcgttaaaccaaacacaacgttttcttcgccaacacccgaaacacccgacttacgcatttaaaaactaaatacttttaacccgtcgcaaaacaattacttttaccccgcctaaaataacgacgctataacgataaaaccacgcgcgactaacgctattcaacgaaaactcccttcaacacgatacgattcaacaaaaaaatttatcgccacactaataaatatcaaacccttacctaaatt

SEQ ID NO: 23973 - DNA, 610 bp, Artificial Sequence
  chemically treated genomic DNA (Homo sapiens) CpG-island No: 23973
  misc_feature (549)..(549): n is either a, c, g or t
acgtttcgtagaaatttgcgtttgtcgttcgcgtcgtttacgataatgaattggtggaagcgttaaacgtttttaggtatggtaaggattgggggtagatggtgttattgttcggtaatacgtgattggttaaacgtaacgttcgtttagcgtgttgggtgttggtttttaatatttagcgattgcgtttgttgttaatagagtttttatcgggattatggttaatatttcggtttattcgttggtttattattagacggtaattaggtgttggattcgcgagttattgtcggtcgtttcgatcgaaaacgtcgatgatgagtagtgtttttaataacgtagtggtaaattcgcgtggaacgtatttttaattttggtacgtaaagatattttgttaaaagtggtaacgattcgggatatttcgaaagttatggttatacggtgatgcgcggtggaatagtagagaagcgattgatttatggtaggttgattggtttataatacggtttcgaatttatcgtttcgtttttagtaggttttaggtttatngaattcgtatgggcggtaggtatcgattttgggaggggtttggggattttagaatattttg

SEQ ID NO: 23974 - DNA, 610 bp, Artificial Sequence
  chemically treated genomic DNA (Homo sapiens) CpG-island No: 23974
  misc_feature (62)..(62): n is either a, c, g or t
caaaatattctaaaatccccaaacccctcccaaaatcgatacctaccgcccatacgaattcnataaacctaaaacctactaaaaacgaaacgataaattcgaaaccgtattataaaccaatcaacctaccataaatcaatcgcttctctactattccaccgcgcatcaccgtataaccataactttcgaaatatcccgaatcgttaccacttttaacaaaatatctttacgtaccaaaattaaaaatacgttccacgcgaatttaccactacgttattaaaaacactactcatcatcgacgttttcgatcgaaacgaccgacaataactcgcgaatccaacacctaattaccgtctaataataaaccaacgaataaaccgaaatattaaccataatcccgataaaaactctattaacaacaaacgcaatcgctaaatattaaaaaccaacacccaacacgctaaacgaacgttacgtttaaccaatcacgtattaccgaacaataacaccatctacccccaatccttaccatacctaaaaacgtttaacgcttccaccaattcattatcgtaaacgacgcgaacgacaaacgcaaatttctacgaaacgt

SEQ ID NO: 23975 - DNA, 610 bp, Artificial Sequence
  chemically treated genomic DNA (Homo sapiens) CpG-island No: 23975
  misc_feature (62)..(62): n is either a, c, g or t
tagaatattttagagtttttagattttttttaaagtcggtatttatcgtttatgcgagtttngtgggtttggagtttgttggaagcggaacggtaaattcgaggtcgtgttgtagattagttaatttgttatgggttaatcgtttttttgttgttttatcgcgtattatcgtatagttatggttttcgagatatttcggatcgttgttatttttggtagaatatttttgcgtgttagagttggaggtacgttttacgcgggtttattattacgttgttaagggtattgtttattatcggcgttttcgatcggggcgatcgataatgattcgcgaatttagtatttgattgtcgtttgatagtagattagcgaataggtcggaatgttaattatgatttcggtaaaagttttgttggtagtaagcgtaatcgttggatgttgagagttaatatttagtacgttgggcgggcgttacgtttaattagttacgtgttgtcgggtaatagtattatttgtttttaatttttgttatgtttgaaaacgtttaacgtttttattagtttattatcgtaggcggcgcgaacggtaggcgtaggtttttacgagacgt

SEQ ID NO: 23976 - DNA, 610 bp, Artificial Sequence
  chemically treated genomic DNA (Homo sapiens) CpG-island No: 23976
  misc_feature (549)..(549): n is either a, c, g or t
acgtctcgtaaaaacctacgcctaccgttcgcgccgcctacgataataaactaataaaaacgttaaacgttttcaaacataacaaaaattaaaaacaaataatactattacccgacaacacgtaactaattaaacgtaacgcccgcccaacgtactaaatattaactctcaacatccaacgattacgcttactaccaacaaaacttttaccgaaatcataattaacattccgacctattcgctaatctactatcaaacgacaatcaaatactaaattcgcgaatcattatcgatcgccccgatcgaaaacgccgataataaacaatacccttaacaacgtaataataaacccgcgtaaaacgtacctccaactctaacacgcaaaaatattctaccaaaaataacaacgatccgaaatatctcgaaaaccataactatacgataatacgcgataaaacaacaaaaaaacgattaacccataacaaattaactaatctacaacacgacctcgaatttaccgttccgcttccaacaaactccaaacccacnaaactcgcataaacgataaataccgactttaaaaaaaatctaaaaactctaaaatattcta

SEQ ID NO: 23977 - DNA, 690 bp, Artificial Sequence
  chemically treated genomic DNA (Homo sapiens) CpG-island No: 23977
ttcggagcgttagaggtcgtttcggacgttaaggttgagtgggagtgagttttcgattggagttagaggttagcgttgggtttgggggttcggagcggcgtgagggatttgtggacggggttgggggcgttgttttggtgtagcgggtcgcggtggtcggcgttcgggtttcggttttttcggggaacgtaggaggaggaaagatagacggacggtttgaggttaatcggtttcgttatacgcgtatcgtttcgtttttcgaggagtcgattaattggtaaggtacgagtttcgagacgttatgggttatcggtagattttattcggttttagggttttttttttttacgtatttcgaatggtttttaaggcgttatttgggcgttttttaattggcggggaagggattggtcgcgggggaattggtttttcgggaatttttcggcgggaattggttcggtaggggggttacgtcggggtttcgggggaagcgggtggtaggacgggtcgaggtgagggagggatgcgtgggtgttggggtgcgggagggggcgggagtgtttagaagcgtgtagtatacggaggattttgagttagcgggggattgggagatgtgcggagttacgggagtagggagattaaagagggtttcgaagggtaatgttagtaattaaaataatatttttatgg

SEQ ID NO: 23978 - DNA, 690 bp, Artificial Sequence
  chemically treated genomic DNA (Homo sapiens) CpG-island No: 23978
ccataaaaatattattttaattactaacattacccttcgaaaccctctttaatctccctactcccgtaactccgcacatctcccaatcccccgctaactcaaaatcctccgtatactacacgcttctaaacactcccgccccctcccgcaccccaacacccacgcatccctccctcacctcgacccgtcctaccacccgcttcccccgaaaccccgacgtaacccccctaccgaaccaattcccgccgaaaaattcccgaaaaaccaattcccccgcgaccaatcccttccccgccaattaaaaaacgcccaaataacgccttaaaaaccattcgaaatacgtaaaaaaaaaaaaccctaaaaccgaataaaatctaccgataacccataacgtctcgaaactcgtaccttaccaattaatcgactcctcgaaaaacgaaacgatacgcgtataacgaaaccgattaacctcaaaccgtccgtctatctttcctcctcctacgttccccgaaaaaaccgaaacccgaacgccgaccaccgcgacccgctacaccaaaacaacgcccccaaccccgtccacaaatccctcacgccgctccgaacccccaaacccaacgctaacctctaactccaatcgaaaactcactcccactcaaccttaacgtccgaaacgacctctaacgctccgaa

SEQ ID NO: 23979 - DNA, 690 bp, Artificial Sequence
  chemically treated genomic DNA (Homo sapiens) CpG-island No: 23979
ttataaaagtattattttgattattaatattatttttcggagttttttttggtttttttgttttcgtggtttcgtatattttttagtttttcgttggtttagaatttttcgtatgttgtacgtttttgagtattttcgttttttttcgtattttagtatttacgtattttttttttatttcgattcgttttgttattcgtttttttcgaaatttcggcgtggtttttttgtcgggttaattttcgtcggaaggttttcgggaagttaattttttcgcggttaatttttttttcgttagttggaggacgtttaggtggcgttttggaagttattcggagtacgtaagggaggagggttttagggtcgggtgaagtttgtcggtgatttatgacgtttcgaggttcgtgttttgttagttggtcggtttttcgaggggcggggcggtacgcgtgtggcggagtcggttgattttagatcgttcgtttgttttttttttttttgcgtttttcgaggaaatcggggttcgagcgtcggttatcgcggttcgttgtattaggatagcgtttttaatttcgtttataggttttttacgtcgtttcggatttttaggtttagcgttgatttttgattttagtcgagagtttatttttatttagttttgacgttcgaggcgatttttgacgtttcgga

SEQ ID NO: 23980 - DNA, 690 bp, Artificial Sequence
  chemically treated genomic DNA (Homo sapiens) CpG-island No: 23980
tccgaaacgtcaaaaatcgcctcgaacgtcaaaactaaataaaaataaactctcgactaaaatcaaaaatcaacgctaaacctaaaaatccgaaacgacgtaaaaaacctataaacgaaattaaaaacgctatcctaatacaacgaaccgcgataaccgacgctcgaaccccgatttcctcgaaaaacgcaaaaaaaaaaaaaacaaacgaacgatctaaaatcaaccgactccgccacacgcgtaccgccccgcccctcgaaaaaccgaccaactaacaaaacacgaacctcgaaacgtcataaatcaccgacaaacttcacccgaccctaaaaccctcctcccttacgtactccgaataacttccaaaacgccacctaaacgtcctccaactaacgaaaaaaaaattaaccgcgaaaaaattaacttcccgaaaaccttccgacgaaaattaacccgacaaaaaaaccacgccgaaatttcgaaaaaaacgaataacaaaacgaatcgaaataaaaaaaaaatacgtaaatactaaaatacgaaaaaaaacgaaaatactcaaaaacgtacaacatacgaaaaattctaaaccaacgaaaaactaaaaaatatacgaaaccacgaaaacaaaaaaaccaaaaaaaactccgaaaaataatattaataatcaaaataatacttttataa

SEQ ID NO: 23981 - DNA, 810 bp, Artificial Sequence
  chemically treated genomic DNA (Homo sapiens) CpG-island No: 23981
  misc_feature (498)..(498): n is either a, c, g or t
tcgtcggaataatcgttcggcgaaaatcgtgtttcgtcgttttagagatcgtttttgatcgttgggtatcgggcggattttttttgttagttcgatttattaaatattattagattttgcggtagcggtttgtcgcgtaggttggaattatcgttagtagtaacgttaagtcggtattggtttcggttatttttagtcgtcgattacgtttataaatatattttgatcggttatttgtagattacgtgacggtgtaatatagttagtaggattgttagacggttttgttttagtttattgttacgcggcgtgggttcgttattatcgagtgatcgattagcgttgaatttttattagtagtggacgcgtttttttttatattattattattagttatcggaggttattttatcgtcgcgatttaagaaaattgtcgaaggttgttgattttacgtagtttttgttcggttatcgcgaagacgtttagttagtgtttantcgcggtcgaagcgggtttttatggttgcgtaaggtgcgaaacgggagtttcggtatcgttatttaaaagtatcgaatagtcgatataggttttagtatttcgttagttagcgatattttgtattgtttatatgatatgttatatcgcgcgttttggcgaagcgtgttaaataagtcgtcgttttattatttgcgttacgttattaggcgatgattgtatattcgttatatgtatttttggatcgagttaattattattagtttcggttgttttttttcggtatcgtagattgttcgatgttgttttcgata

SEQ ID NO: 23982 - DNA, 810 bp, Artificial Sequence
  chemically treated genomic DNA (Homo sapiens) CpG-island No: 23982
  misc_feature (313)..(313): n is either a, c, g or t
tatcgaaaacaacatcgaacaatctacgataccgaaaaaaaacaaccgaaactaataataattaactcgatccaaaaatacatataacgaatatacaatcatcgcctaataacgtaacgcaaataataaaacgacgacttatttaacacgcttcgccaaaacgcgcgatataacatatcatataaacaatacaaaatatcgctaactaacgaaatactaaaacctatatcgactattcgatacttttaaataacgataccgaaactcccgtttcgcaccttacgcaaccataaaaacccgcttcgaccgcgantaaacactaactaaacgtcttcgcgataaccgaacaaaaactacgtaaaatcaacaaccttcgacaattttcttaaatcgcgacgataaaataacctccgataactaataataataatataaaaaaaaacgcgtccactactaataaaaattcaacgctaatcgatcactcgataataacgaacccacgccgcgtaacaataaactaaaacaaaaccgtctaacaatcctactaactatattacaccgtcacgtaatctacaaataaccgatcaaaatatatttataaacgtaatcgacgactaaaaataaccgaaaccaataccgacttaacgttactactaacgataattccaacctacgcgacaaaccgctaccgcaaaatctaataatatttaataaatcgaactaacaaaaaaaatccgcccgatacccaacgatcaaaaacgatctctaaaacgacgaaacacgattttcgccgaacgattattccgacga

SEQ ID NO: 23983 - DNA, 810 bp, Artificial Sequence
  chemically treated genomic DNA (Homo sapiens) CpG-island No: 23983
  misc_feature (313)..(313): n is either a, c, g or t
tgtcggaaatagtatcgaatagtttgcgatgtcgaagaagagtaatcgaagttgatggtaattgattcgatttagggatgtatatggcggatgtatagttatcgtttggtagcgtggcgtaggtggtgaaacggcggtttatttgatacgtttcgttaaaacgcgcggtgtggtatgttatgtgggtagtataagatgtcgttggttggcgaagtgttggaatttgtatcgattgttcggtgtttttggatggcgatgtcggaattttcgtttcgtattttgcgtagttataaaaattcgtttcggtcgcggntggatattagttgggcgttttcgcgatgatcgaataggggttgcgtgaagttagtaattttcggtaatttttttaagtcgcggcgatgaagtgattttcggtagttagtgatggtggtatgggaaggaacgcgtttattgttggtggagatttagcgttggtcgattattcgatgatggcgaatttacgtcgcgtggtagtgggttggaataaaatcgtttggtaattttgttggttgtgttgtatcgttacgtggtttgtaaatggtcgattaggatgtgtttgtgaacgtggtcggcggttgaaggtaatcgaaattagtgtcgatttagcgttattgttggcgatggttttagtttgcgcgatagatcgttgtcgtaggatttggtggtgtttggtgagtcgggttggtaggggagattcgttcggtgtttagcggttaggaacgatttttgaagcggcgaaatacggttttcgtcgggcgattgtttcggcgg

SEQ ID NO: 23984 - DNA, 810 bp, Artificial Sequence
  chemically treated genomic DNA (Homo sapiens) CpG-island No: 23984
  misc_feature (498)..(498): n is either a, c, g or t
ccgccgaaacaatcgcccgacgaaaaccgtatttcgccgcttcaaaaatcgttcctaaccgctaaacaccgaacgaatctcccctaccaacccgactcaccaaacaccaccaaatcctacgacaacgatctatcgcgcaaactaaaaccatcgccaacaataacgctaaatcgacactaatttcgattaccttcaaccgccgaccacgttcacaaacacatcctaatcgaccatttacaaaccacgtaacgatacaacacaaccaacaaaattaccaaacgattttattccaacccactaccacgcgacgtaaattcgccatcatcgaataatcgaccaacgctaaatctccaccaacaataaacgcgttccttcccataccaccatcactaactaccgaaaatcacttcatcgccgcgacttaaaaaaattaccgaaaattactaacttcacgcaacccctattcgatcatcgcgaaaacgcccaactaatatccanccgcgaccgaaacgaatttttataactacgcaaaatacgaaacgaaaattccgacatcgccatccaaaaacaccgaacaatcgatacaaattccaacacttcgccaaccaacgacatcttatactacccacataacataccacaccgcgcgttttaacgaaacgtatcaaataaaccgccgtttcaccacctacgccacgctaccaaacgataactatacatccgccatatacatccctaaatcgaatcaattaccatcaacttcgattactcttcttcgacatcgcaaactattcgatactatttccgaca

SEQ ID NO: 23985 - DNA, 1643 bp, Artificial Sequence
  chemically treated genomic DNA (Homo sapiens) CpG-island No: 23985
  misc_feature (115)..(115): n is either a, c, g or t
ggcggttaaggcgatgagcgcgtattgttatttgttgtagcgatttttcgtcgtgatatatagcgtttttatttgttgggttagtttgtatagcgtttgtaagtagcgtggggtntaggtttattatttttatttacgaagggttcggtttcggcgcggatttcgttttcggcgagtttatttcgacgggtacgattacgtttttttcggcgacggtaaagacgatcgttcgattatttaaaagggaaagagcgtttcgtcgagtcgttcgcgtcgttttttcgcgcgagcgcgtcggcgtgaaggtttatttcgaagacgtcgacgtatttttaaagagttgaacgcgtttatgacgatgtcgagcgtcggcgagtcgcgaagttttcgtttcgcgcgtttatagttacgcgttgggcgttttttcggttcgcgcgtttatcgagtattacgttttcgattcgcgtttgcgttcgtgttcggcgcgtaagtaggcgattacgggttttcgttttcgaaagtttcgcggttatttacgcgttcgtgtaagcgtattatttcggcggcggttttattcgcgcggcgggggcgcgtcgttgtcgcgcgcgtttattcgttcgtgaagcgcgtcggcggcgcgattaaggtgcgtatcgaggtgtcgaagattttatcgagaacgggcgcgttatcggcgttcgtttcgtcgacggtatcgggttcgcgcgcgtattgtgatttcgaacgtcgatttcgtcgttacgttcgtcggttcgtcggttacgagtatttttcgtcgttcgagcgtattcgtttgcgcgggcgaagtggtcggtttcggttattagtttgtttatggcgacggtttcgatttgcgcgcgttcgggttcgatagcggtaattattggtatttcgaaacggcgacgtcgaggggatttacgcgataggtttcgaagtttggggtcgagcgtaggttcgattttcggcggtttcgttattgcgattacgtttaagattcgagtaagtattacggcggaaagtatacgttcgagtcgttcgcgtcgtcggatacgacgtttttaaggcgtgggcggattcgaagacgggcgtcgttcggaaggttacgtcgcgatgaagtaggagtttatgggtcggatgtcgagatggcggggtacgtcgtgtcgggtttcgagaagtacgtcgcgttttcgagttcgggagttcgtttacgaacgtcgattattgcgcgtcgacgcgggtaatttttacggtatcgataagagtttgttttaatcggttcgttcgttagtcgttgaagacgtcgatcggcgggttttatatgtgcggcgcgagtagtttagttacggcgttatggcgcgtcggtattatttattatttttcgatgggttttattacgcgtaaagatagcgttaatttcggcgttaaatagtgatatttttttagtagacgtatcgttttcgttattatatttagcgtatttcgttcgtttttagtattttttgttcggttttaataatggtagataacgttcgatgtagcgtaatttttgttgtagatttatttgcgcgcggttaatttatttgcgttattatgaattgtaatgattgttttgtttatagtat

SEQ ID NO: 23986 - DNA, 1643 bp, Artificial Sequence
  chemically treated genomic DNA (Homo sapiens) CpG-island No: 23986
  misc_feature (1529)..(1529): n is either a, c, g or t
atactataaacaaaacaatcattacaattcataataacgcaaataaattaaccgcgcgcaaataaatctacaacaaaaattacgctacatcgaacgttatctaccattattaaaaccgaacaaaaaatactaaaaacgaacgaaatacgctaaatataataacgaaaacgatacgtctactaaaaaaatatcactatttaacgccgaaattaacgctatctttacgcgtaataaaacccatcgaaaaataataaataataccgacgcgccataacgccgtaactaaactactcgcgccgcacatataaaacccgccgatcgacgtcttcaacgactaacgaacgaaccgattaaaacaaactcttatcgataccgtaaaaattacccgcgtcgacgcgcaataatcgacgttcgtaaacgaactcccgaactcgaaaacgcgacgtacttctcgaaacccgacacgacgtaccccgccatctcgacatccgacccataaactcctacttcatcgcgacgtaaccttccgaacgacgcccgtcttcgaatccgcccacgccttaaaaacgtcgtatccgacgacgcgaacgactcgaacgtatactttccgccgtaatacttactcgaatcttaaacgtaatcgcaataacgaaaccgccgaaaatcgaacctacgctcgaccccaaacttcgaaacctatcgcgtaaatcccctcgacgtcgccgtttcgaaataccaataattaccgctatcgaacccgaacgcgcgcaaatcgaaaccgtcgccataaacaaactaataaccgaaaccgaccacttcgcccgcgcaaacgaatacgctcgaacgacgaaaaatactcgtaaccgacgaaccgacgaacgtaacgacgaaatcgacgttcgaaatcacaatacgcgcgcgaacccgataccgtcgacgaaacgaacgccgataacgcgcccgttctcgataaaatcttcgacacctcgatacgcaccttaatcgcgccgccgacgcgcttcacgaacgaataaacgcgcgcgacaacgacgcgcccccgccgcgcgaataaaaccgccgccgaaataatacgcttacacgaacgcgtaaataaccgcgaaactttcgaaaacgaaaacccgtaatcgcctacttacgcgccgaacacgaacgcaaacgcgaatcgaaaacgtaatactcgataaacgcgcgaaccgaaaaaacgcccaacgcgtaactataaacgcgcgaaacgaaaacttcgcgactcgccgacgctcgacatcgtcataaacgcgttcaactctttaaaaatacgtcgacgtcttcgaaataaaccttcacgccgacgcgctcgcgcgaaaaaacgacgcgaacgactcgacgaaacgctctttcccttttaaataatcgaacgatcgtctttaccgtcgccgaaaaaaacgtaatcgtacccgtcgaaataaactcgccgaaaacgaaatccgcgccgaaaccgaacccttcgtaaataaaaataataaacctanaccccacgctacttacaaacgctatacaaactaacccaacaaataaaaacgctatatatcacgacgaaaaatcgctacaacaaataacaatacgcgctcatcgccttaaccgcc

SEQ ID NO: 23987 - DNA, 1643 bp, Artificial Sequence
  chemically treated genomic DNA (Homo sapiens) CpG-island No: 23987
  misc_feature (1529)..(1529): n is either a, c, g or t
atattatgggtaaagtagttattgtaatttatggtggcgtaggtgaattagtcgcgcgtagatgagtttgtaataggaattacgttatatcgagcgttgtttgttattgttgaaatcgggtagaaaatgttggaagcgggcgaagtgcgttggatgtggtgacggaagcggtgcgtttgttggaagagtgttattgtttaacgtcggaattggcgttgtttttacgcgtgatgaaatttatcggggagtgatgagtggtatcggcgcgttatgacgtcgtggttgagttgttcgcgtcgtatatgtagagttcgtcgatcgacgtttttagcggttggcgaacggatcgattggaataggtttttgtcggtgtcgtagaggttgttcgcgtcgacgcgtagtagtcgacgttcgtgagcgggttttcgagttcgggaacgcgacgtgtttttcgaggttcggtacggcgtgtttcgttatttcggtattcggtttatgagtttttgttttatcgcggcgtagtttttcgggcggcgttcgttttcgagttcgtttacgttttgaaagcgtcgtattcgacgacgcgaacgattcgagcgtgtgtttttcgtcgtagtgtttgttcgggttttgagcgtggtcgtagtgacgaagtcgtcggggatcgggtttgcgttcggttttaggtttcgaggtttgtcgcgtaggttttttcgacgtcgtcgtttcgaagtattagtagttgtcgttgtcgagttcgagcgcgcgtaaatcgaggtcgtcgttatgaataggttgatggtcgaaatcgattatttcgttcgcgtaggcgaatgcgttcgaacggcgagaggtgttcgtggtcgacgagtcggcgagcgtgacggcgggatcggcgttcgagattatagtgcgcgcgcggattcggtgtcgtcggcgaggcggacgtcgatggcgcgttcgttttcgatgagattttcgatatttcggtgcgtattttgatcgcgtcgtcggcgcgttttacgagcggatgaacgcgcgcggtagcgacgcgttttcgtcgcgcgggtagagtcgtcgtcgaagtagtgcgtttgtacggacgcgtggatgatcgcggggttttcgagggcgggagttcgtgatcgtttgtttgcgcgtcgagtacgggcgtaggcgcggatcggagacgtggtgttcgatgagcgcgcgggtcgagggagcgtttagcgcgtgattgtgggcgcgcgaaacgggagtttcgcgattcgtcgacgttcgatatcgttatgagcgcgtttagttttttggagatgcgtcgacgttttcgaagtaggtttttacgtcggcgcgttcgcgcgggaaggcgacgcgagcgattcgacgaggcgtttttttttttttgggtagtcgaacgatcgtttttgtcgtcgtcgaggaggacgtgatcgtattcgtcggggtgagttcgtcgaaaacgagattcgcgtcgaggtcgagtttttcgtagatggaaataatgagtttgnattttacgttgtttgtaaacgttgtgtaaattggtttagtagatgaaaacgttgtatgttacggcgaagagtcgttgtaataggtggtaatgcgcgtttatcgttttggtcgtt

SEQ ID NO: 23988 - DNA, 1643 bp, Artificial Sequence
  chemically treated genomic DNA (Homo sapiens) CpG-island No: 23988
  misc_feature (115)..(115): n is either a, c, g or t
aacgaccaaaacgataaacgcgcattaccacctattacaacgactcttcgccgtaacatacaacgttttcatctactaaaccaatttacacaacgtttacaaacaacgtaaaatncaaactcattatttccatctacgaaaaactcgacctcgacgcgaatctcgttttcgacgaactcaccccgacgaatacgatcacgtcctcctcgacgacgacaaaaacgatcgttcgactacccaaaaaaaaaaaaacgcctcgtcgaatcgctcgcgtcgccttcccgcgcgaacgcgccgacgtaaaaacctacttcgaaaacgtcgacgcatctccaaaaaactaaacgcgctcataacgatatcgaacgtcgacgaatcgcgaaactcccgtttcgcgcgcccacaatcacgcgctaaacgctccctcgacccgcgcgctcatcgaacaccacgtctccgatccgcgcctacgcccgtactcgacgcgcaaacaaacgatcacgaactcccgccctcgaaaaccccgcgatcatccacgcgtccgtacaaacgcactacttcgacgacgactctacccgcgcgacgaaaacgcgtcgctaccgcgcgcgttcatccgctcgtaaaacgcgccgacgacgcgatcaaaatacgcaccgaaatatcgaaaatctcatcgaaaacgaacgcgccatcgacgtccgcctcgccgacgacaccgaatccgcgcgcgcactataatctcgaacgccgatcccgccgtcacgctcgccgactcgtcgaccacgaacacctctcgccgttcgaacgcattcgcctacgcgaacgaaataatcgatttcgaccatcaacctattcataacgacgacctcgatttacgcgcgctcgaactcgacaacgacaactactaatacttcgaaacgacgacgtcgaaaaaacctacgcgacaaacctcgaaacctaaaaccgaacgcaaacccgatccccgacgacttcgtcactacgaccacgctcaaaacccgaacaaacactacgacgaaaaacacacgctcgaatcgttcgcgtcgtcgaatacgacgctttcaaaacgtaaacgaactcgaaaacgaacgccgcccgaaaaactacgccgcgataaaacaaaaactcataaaccgaataccgaaataacgaaacacgccgtaccgaacctcgaaaaacacgtcgcgttcccgaactcgaaaacccgctcacgaacgtcgactactacgcgtcgacgcgaacaacctctacgacaccgacaaaaacctattccaatcgatccgttcgccaaccgctaaaaacgtcgatcgacgaactctacatatacgacgcgaacaactcaaccacgacgtcataacgcgccgataccactcatcactccccgataaatttcatcacgcgtaaaaacaacgccaattccgacgttaaacaataacactcttccaacaaacgcaccgcttccgtcaccacatccaacgcacttcgcccgcttccaacattttctacccgatttcaacaataacaaacaacgctcgatataacgtaattcctattacaaactcatctacgcgcgactaattcacctacgccaccataaattacaataactactttacccataatat

SEQ ID NO: 23989 - DNA, 888 bp, Artificial Sequence
  chemically treated genomic DNA (Homo sapiens) CpG-island No: 23989
ttattttattgtcgtttaggaaacgttgttattggtatagtgttttggtcgtattttggtagcgatgtcgtttcgtcgtttgatgtttcggggtttgataatttcgtaaggacggttacgcggtgcgtttagtcgatattgttttcgggtaatcgttgtcgttgtcggtaaattttttgtcggttagttatattatggtgaatggtcgcgggtatttgtattcgtattatgatcggtgcgtcggtgtcggaaggttcgaagcggtggtgatgtaggagtagattgaataaatggataatggcgtggttttattgttgaagtgcgtagcgggtaaaatattcgtcgtcgcggtgagatatttttgtaggtgcggttgttttttcggcgggaattcgtttgattacgtagagttgttagtaattgttttattggggattggcgaagtttcggtgttcgtatagtgcgtgtagcgtttttttttatcggtgatgaattttagttttcggttagacggtgggcgaagggtaaatttacgatattaaacgttttgcgtttatttgatgtttgattagtttggattagtaatattcggtagacgtggcgatattaagtttttacggacgtcgatgttgaaaatcgagaatgcgcgttcgacgagttggattttatcgatgttcgcgatcgtgatatggtgtcggtggtttacgatttgtaaaagcgatagttgaaaaagtgtagttaaaatcgggtattagcgtggtattttcgggtagttcgagttattggagcgcgttaattataagtttaaatttaggtgtcgatgacgttgatgattattttcgtgttgttgtatttggcgttcgtcgggtgggcgaagcgttgttgatt

SEQ ID NO: 23990 - DNA, 888 bp, Artificial Sequence
  chemically treated genomic DNA (Homo sapiens) CpG-island No: 23990
aatcaacaacgcttcgcccacccgacgaacgccaaatacaacaacacgaaaataatcatcaacgtcatcgacacctaaatttaaacttataattaacgcgctccaataactcgaactacccgaaaataccacgctaatacccgattttaactacactttttcaactatcgcttttacaaatcgtaaaccaccgacaccatatcacgatcgcgaacatcgataaaatccaactcgtcgaacgcgcattctcgattttcaacatcgacgtccgtaaaaacttaatatcgccacgtctaccgaatattactaatccaaactaatcaaacatcaaataaacgcaaaacgtttaatatcgtaaatttacccttcgcccaccgtctaaccgaaaactaaaattcatcaccgataaaaaaaaacgctacacgcactatacgaacaccgaaacttcgccaatccccaataaaacaattactaacaactctacgtaatcaaacgaattcccgccgaaaaaacaaccgcacctacaaaaatatctcaccgcgacgacgaatattttacccgctacgcacttcaacaataaaaccacgccattatccatttattcaatctactcctacatcaccaccgcttcgaaccttccgacaccgacgcaccgatcataatacgaatacaaatacccgcgaccattcaccataatataactaaccgacaaaaaatttaccgacaacgacaacgattacccgaaaacaatatcgactaaacgcaccgcgtaaccgtccttacgaaattatcaaaccccgaaacatcaaacgacgaaacgacatcgctaccaaaatacgaccaaaacactataccaataacaacgtttcctaaacgacaataaaataa

SEQ ID NO: 23991 - DNA, 888 bp, Artificial Sequence
  chemically treated genomic DNA (Homo sapiens) CpG-island No: 23991
aattagtaacgtttcgtttattcgacgaacgttagatataatagtacgaagataattattaacgttatcggtatttgagtttaagtttatggttggcgcgttttagtagttcgaattgttcggaaatgttacgttggtgttcggttttaattgtatttttttagttatcgtttttgtaaatcgtgaattatcgatattatgttacgatcgcgggtatcgataaaatttagttcgtcgggcgcgtattttcggtttttagtatcgacgttcgtagagatttaatgtcgttacgtttgtcgggtattgttggtttaggttagttaaatattaggtgaacgtaagacgtttggtatcgtagatttgtttttcgtttatcgtttgatcgggaattggagtttattatcggtagaaaaaagcgttatacgtattgtacgaatatcggaatttcgttaatttttagtgaagtaattattggtagttttgcgtagttaggcgagttttcgtcgggaaaataatcgtatttgtagagatattttatcgcgacggcgaatattttgttcgttacgtattttagtagtaaaattacgttattgtttatttgtttagtttgtttttgtattattatcgtttcgagtttttcggtatcggcgtatcggttataatacgaatgtaggtattcgcggttatttattatggtatggttgatcggtaaaggatttatcggtaacggtagcggttgttcggaggtaatatcggttaaacgtatcgcgtagtcgtttttgcggagttattaaatttcggaatattaagcggcgaaacgatatcgttgttagaatacgattaaaatattgtattagtggtagcgttttttgggcggtagtggggtga

SEQ ID NO: 23992 - DNA, 888 bp, Artificial Sequence
  chemically treated genomic DNA (Homo sapiens) CpG-island No: 23992
tcaccccactaccgcccaaaaaacgctaccactaatacaatattttaatcgtattctaacaacgatatcgtttcgccgcttaatattccgaaatttaataactccgcaaaaacgactacgcgatacgtttaaccgatattacctccgaacaaccgctaccgttaccgataaatcctttaccgatcaaccataccataataaataaccgcgaatacctacattcgtattataaccgatacgccgataccgaaaaactcgaaacgataataatacaaaaacaaactaaacaaataaacaataacgtaattttactactaaaatacgtaacgaacaaaatattcgccgtcgcgataaaatatctctacaaatacgattattttcccgacgaaaactcgcctaactacgcaaaactaccaataattacttcactaaaaattaacgaaattccgatattcgtacaatacgtataacgcttttttctaccgataataaactccaattcccgatcaaacgataaacgaaaaacaaatctacgataccaaacgtcttacgttcacctaatatttaactaacctaaaccaacaatacccgacaaacgtaacgacattaaatctctacgaacgtcgatactaaaaaccgaaaatacgcgcccgacgaactaaattttatcgatacccgcgatcgtaacataatatcgataattcacgatttacaaaaacgataactaaaaaaatacaattaaaaccgaacaccaacgtaacatttccgaacaattcgaactactaaaacgcgccaaccataaacttaaactcaaataccgataacgttaataattatcttcgtactattatatctaacgttcgtcgaataaacgaaacgttactaatt

SEQ ID NO: 23993 - DNA, 548 bp, Artificial Sequence
  chemically treated genomic DNA (Homo sapiens) CpG-island No: 23993
tacgtttcgttcgttgtcgttgggaggcgtttaaggacggggcggtttcggtttcgtagttttcgtttattttttttcgggttcgtattttttgtttttcgatttttttattatagataggagaaggcggcggcggtcgcggcggcggtggtgtacggcgttgtgttcgttcgtttttgggcgtttattcgttgttgttcggcggcgcggggattagcgggcgggaggttcgggcgttagcgttttaggaaagacgttttgttgcggatttgcgggcgcggtttcgggcgtcgcgagattttgaagcgttatgagttatttatacgggcgagaagttttattagtgtttcgtgtgtgggaagcgtttcgcgaatttttttatttgagtaagtattacgtggtgtatacgcgcgacggttttataagtgcgagttttgcggtaaggttttcggttattcgtagattttattcgttatcgttaggtgtatcggttttagttgttttgcgttttgtcggggtagtcggttttttttttatttaaggtatat

SEQ ID NO: 23994 - DNA, 548 bp, Artificial Sequence
  chemically treated genomic DNA (Homo sapiens) CpG-island No: 23994
atataccttaaataaaaaaaaaaccgactaccccgacaaaacgcaaaacaactaaaaccgatacacctaacgataacgaataaaatctacgaataaccgaaaaccttaccgcaaaactcgcacttataaaaccgtcgcgcgtatacaccacgtaatacttactcaaataaaaaaattcgcgaaacgcttcccacacacgaaacactaataaaacttctcgcccgtataaataactcataacgcttcaaaatctcgcgacgcccgaaaccgcgcccgcaaatccgcaacaaaacgtctttcctaaaacgctaacgcccgaacctcccgcccgctaatccccgcgccgccgaacaacaacgaataaacgcccaaaaacgaacgaacacaacgccgtacaccaccgccgccgcgaccgccgccgccttctcctatctataataaaaaaatcgaaaaacaaaaaatacgaacccgaaaaaaaataaacgaaaactacgaaaccgaaaccgccccgtccttaaacgcctcccaacgacaacgaacgaaacgta

SEQ ID NO: 23995 - DNA, 548 bp, Artificial Sequence
  chemically treated genomic DNA (Homo sapiens) CpG-island No: 23995
gtgtgttttgggtggaggggaggtcggttgtttcggtagggcgtagggtagttggagtcggtgtatttggcggtggcgggtgaggtttgcgggtagtcgaagattttgtcgtagagttcgtatttgtagggtcgtcgcgcgtgtgtattacgtgatgtttgtttaagtggaaggattcgcggagcgttttttatatacggggtattggtggggtttttcgttcgtgtggatggtttatggcgttttagggtttcgcggcgttcgaagtcgcgttcgtagattcgtagtagaacgttttttttgggacgttggcgttcgagtttttcgttcgttggttttcgcgtcgtcgagtagtagcgggtgggcgtttaggagcgggcgggtatagcgtcgtatattatcgtcgtcgcggtcgtcgtcgtttttttttgtttgtggtgggagggtcggggggtaggaggtacgggttcggggggaggtgggcgggggttgcggggtcgaggtcgtttcgtttttgggcgttttttagcggtagcgggcggggcgtg

SEQ ID NO: 23996 - DNA, 548 bp, Artificial Sequence
  chemically treated genomic DNA (Homo sapiens) CpG-island No: 23996
cacgccccgcccgctaccgctaaaaaacgcccaaaaacgaaacgacctcgaccccgcaacccccgcccacctccccccgaacccgtacctcctaccccccgaccctcccaccacaaacaaaaaaaaacgacgacgaccgcgacgacgataatatacgacgctatacccgcccgctcctaaacgcccacccgctactactcgacgacgcgaaaaccaacgaacgaaaaactcgaacgccaacgtcccaaaaaaaacgttctactacgaatctacgaacgcgacttcgaacgccgcgaaaccctaaaacgccataaaccatccacacgaacgaaaaaccccaccaataccccgtatataaaaaacgctccgcgaatccttccacttaaacaaacatcacgtaatacacacgcgcgacgaccctacaaatacgaactctacgacaaaatcttcgactacccgcaaacctcacccgccaccgccaaatacaccgactccaactaccctacgccctaccgaaacaaccgacctcccctccacccaaaacacac

SEQ ID NO: 23997 - DNA, 519 bp, Artificial Sequence
  chemically treated genomic DNA (Homo sapiens) CpG-island No: 23997
ttggatttcggtttttatatttgtttagtcggcggaatattttttttttcgttttttatttcggtgggtggttacggtcgagaggtagcgacggtttagtggaaagaggataaatttttgtgggttttaggcgaagacgtaattttgtttagtttcggtttattggtcgattttttgttagcggcggaatcgtttcgttcgggaggtgggaggggagcggggtcgtcggggcgggcgtttttagtggattttacgttttcggtttttttttcgtaggggtttcgtagaggcgaggggtgggagcgtcggttttaggcggcggaatttcgtattgggttcgcgcgttttcggtcggcgtttttttttagggatttcgtaatttttcgtattttcgcgtttttagttttcgcgttttcggcgtcgtcgttcggagttgttcggaagtttcggtttcgtttgtcggcgttttgttaggtgaagttttggggtttgttcgggatttttggttttgtttttttt

SEQ ID NO: 23998 - DNA, 519 bp, Artificial Sequence
  chemically treated genomic DNA (Homo sapiens) CpG-island No: 23998
aaaaaaaacaaaaccaaaaatcccgaacaaaccccaaaacttcacctaacaaaacgccgacaaacgaaaccgaaacttccgaacaactccgaacgacgacgccgaaaacgcgaaaactaaaaacgcgaaaatacgaaaaattacgaaatccctaaaaaaaaacgccgaccgaaaacgcgcgaacccaatacgaaattccgccgcctaaaaccgacgctcccacccctcgcctctacgaaacccctacgaaaaaaaaaccgaaaacgtaaaatccactaaaaacgcccgccccgacgaccccgctcccctcccacctcccgaacgaaacgattccgccgctaacaaaaaatcgaccaataaaccgaaactaaacaaaattacgtcttcgcctaaaacccacaaaaatttatcctctttccactaaaccgtcgctacctctcgaccgtaaccacccaccgaaataaaaaacgaaaaaaaaaatattccgccgactaaacaaatataaaaaccgaaatccaa

SEQ ID NO: 23999 - DNA, 519 bp, Artificial Sequence
  chemically treated genomic DNA (Homo sapiens) CpG-island No: 23999
aggaggaatagggttagaggtttcgggtaggttttagggttttatttggtagagcgtcggtaggcggaatcgagattttcgggtagtttcgggcggcggcgtcggggacgcggggattgggggcgcgggggtgcgaggggttgcggagtttttgggaaaaggcgtcggtcggaagcgcgcgagtttagtgcgaggtttcgtcgtttggagtcggcgtttttatttttcgtttttgcggagtttttgcggggaggggatcggaggcgtggggtttattgaagacgttcgtttcggcggtttcgttttttttttatttttcgaacggaacgatttcgtcgttgataagagatcggttaataaatcgagattaagtaaagttacgttttcgtttaaggtttataagggtttgttttttttttattgggtcgtcgttgtttttcggtcgtggttatttatcgaggtagagggcgggagaagggatgtttcgtcggttgagtaaatgtggagatcgaggtttag

SEQ ID NO: 24000 - DNA, 519 bp, Artificial Sequence
  chemically treated genomic DNA (Homo sapiens) CpG-island No: 24000
ctaaacctcgatctccacatttactcaaccgacgaaacatcccttctcccgccctctacctcgataaataaccacgaccgaaaaacaacgacgacccaataaaaaaaaaacaaacccttataaaccttaaacgaaaacgtaactttacttaatctcgatttattaaccgatctcttatcaacgacgaaatcgttccgttcgaaaaataaaaaaaaaacgaaaccgccgaaacgaacgtcttcaataaaccccacgcctccgatcccctccccgcaaaaactccgcaaaaacgaaaaataaaaacgccgactccaaacgacgaaacctcgcactaaactcgcgcgcttccgaccgacgccttttcccaaaaactccgcaacccctcgcacccccgcgcccccaatccccgcgtccccgacgccgccgcccgaaactacccgaaaatctcgattccgcctaccgacgctctaccaaataaaaccctaaaacctacccgaaacctctaaccctattcctcct

SEQ ID NO: 24001 - DNA, 577 bp, Artificial Sequence
  chemically treated genomic DNA (Homo sapiens) CpG-island No: 24001
cgtgttaagttcggggggttgtttttcgagggcggtggggaggcgtttgtatttgggcggtcgtcgagttttcggaagatattttgtattagtgcgattgcgggttttttttgcgtcggtcgcggttttggttagttatttggaggtttattcggttcggttatttacggttgcggttattgcggggttttgtacgcggcgcggtcgttttggaggagtatcggcgggttagttacggtgagggcggcgggaggaggcggcgatcgtcgttcgggaaagggaatcggcgttcggggaatttcgtttggtttcggtcgcggtaagaagattttcggttgtttcgagtgcggaagttgtttcgtttatcgcgagatttggagcggtacgtgttggtgtatttggcgagaagtcgttttcgtgtttggagtgcggtaagttttttcgttagagtgttattttaagcgttatcggttgttgtacggtatcgagcggtttttttttgttatatttgcggtaagggttttattacgtttagtaattttttcggtatttgaagttgtatcggggtatggattga

SEQ ID NO: 24002 - DNA, 577 bp, Artificial Sequence
  chemically treated genomic DNA (Homo sapiens) CpG-island No: 24002
tcaatccataccccgatacaacttcaaataccgaaaaaattactaaacgtaataaaacccttaccgcaaatataacaaaaaaaaaccgctcgataccgtacaacaaccgataacgcttaaaataacactctaacgaaaaaacttaccgcactccaaacacgaaaacgacttctcgccaaatacaccaacacgtaccgctccaaatctcgcgataaacgaaacaacttccgcactcgaaacaaccgaaaatcttcttaccgcgaccgaaaccaaacgaaattccccgaacgccgattccctttcccgaacgacgatcgccgcctcctcccgccgccctcaccgtaactaacccgccgatactcctccaaaacgaccgcgccgcgtacaaaaccccgcaataaccgcaaccgtaaataaccgaaccgaataaacctccaaataactaaccaaaaccgcgaccgacgcaaaaaaaacccgcaatcgcactaatacaaaatatcttccgaaaactcgacgaccgcccaaatacaaacgcctccccaccgccctcgaaaaacaaccccccgaacttaacacg

SEQ ID NO: 24003 - DNA, 577 bp, Artificial Sequence
  chemically treated genomic DNA (Homo sapiens) CpG-island No: 24003
ttagtttatgtttcggtgtagttttaggtgtcggagaggttgttgagcgtgatgaagtttttgtcgtagatgtggtaagggagggtcgttcggtgtcgtgtagtagtcggtggcgtttgaggtagtattttggcggaagaatttgtcgtattttaggtacgggaacggtttttcgttaggtgtattagtacgtgtcgttttaggtttcgcggtgagcggaatagttttcgtattcggagtagtcgaagatttttttgtcgcggtcggagttagacggggtttttcggacgtcggttttttttttcgggcggcggtcgtcgttttttttcgtcgtttttatcgtggttgattcgtcggtgtttttttaaggcggtcgcgtcgcgtatagagtttcgtagtggtcgtagtcgtaggtggtcgggtcgagtgggtttttaggtgattggttagggtcgcggtcgacgtaaagaaggttcgtagtcgtattggtatagggtgtttttcgagggttcggcggtcgtttaggtgtaggcgtttttttatcgttttcggggagtagtttttcgagtttggtacg

SEQ ID NO: 24004 - DNA, 577 bp, Artificial Sequence
  chemically treated genomic DNA (Homo sapiens) CpG-island No: 24004
cgtaccaaactcgaaaaactactccccgaaaacgataaaaaaacgcctacacctaaacgaccgccgaaccctcgaaaaacaccctataccaatacgactacgaaccttctttacgtcgaccgcgaccctaaccaatcacctaaaaacccactcgacccgaccacctacgactacgaccactacgaaactctatacgcgacgcgaccgccttaaaaaaacaccgacgaatcaaccacgataaaaacgacgaaaaaaaacgacgaccgccgcccgaaaaaaaaaaccgacgtccgaaaaaccccgtctaactccgaccgcgacaaaaaaatcttcgactactccgaatacgaaaactattccgctcaccgcgaaacctaaaacgacacgtactaatacacctaacgaaaaaccgttcccgtacctaaaatacgacaaattcttccgccaaaatactacctcaaacgccaccgactactacacgacaccgaacgaccctcccttaccacatctacgacaaaaacttcatcacgctcaacaacctctccgacacctaaaactacaccgaaacataaactaa

SEQ ID NO: 24005 - DNA, 1208 bp, Artificial Sequence
  chemically treated genomic DNA (Homo sapiens) CpG-island No: 24005
cgagaattaggatttcgttttttttttatttttttttttgatttatttcgtttttgtttttttttttttttcgttttcgaagtcggaaggagtcgaggtatttacggaaaaagtcgagttgttttcggagagtgaggtttttacgaagcggtggcggaaggagttaagttttttgatcggaggcgtgagtaagtggtattttcggaaagagtcgaatacggattcgagtttaattttaggaggggttcgagggcgagattcggaattttcggaaagagtcgaaggtcgggacggttaggattgtcggaagtgtcgattgtttggatagggtcggcggagaagatcggagtaagttcgtggagaagttaaagattgggacggattgaattgttggaagaattcgaattcgcgaggggattgggcgtagtggtatacgaggatatacggaaattttcgaatttgaggagataatttcggaaaagttacggaaatttgggaagtcggcgaattttacgttcgggtgttttcggaagtagtcgaagcggtcgtttgtttcgtttcgtttagtattcggagatagtcgaggcgtttcggagttaggttcgggggaggggtaagttcgcgggcgggcgggcgggtgagggggcggagttcggcggggcggggagggttgtcggaggtttgattaggtaggaggtggcgaacgtcggcggcggtcggaagtagtcgaagttagcggcggaagtagtcgaacggttggagcgggcggtaaggcgaggcgaaagttgtatagggttttacgggtcgttttagtatgtcggatttcgacgagttcgagcggtagtttaacggaataaataaggtgagggtatcggggtcgcggggcggaggtgtgggcggttttcgcgtcgttttttgttttttcgttattttttttttcgttttttttattttacggtcgcgcggcgttttttaattttggtttcgtggcgcgcgttcgtttacgtgacgtttttagcgtttcgtcgcgcgttaggcgaggggaaggggcggcggggcgcgggttcgtgacgtatgcgtacggcggttgtttttggttttacgtggttttggcggaggtggcgcgggggacgcggtacgagcgtttagatgtttcgacgtgaatttttgttttttaaaatttttttggttttttgaaaaggagatta

SEQ ID NO: 24006 - DNA, 1208 bp, Artificial Sequence
  chemically treated genomic DNA (Homo sapiens) CpG-island No: 24006
taatctccttttcaaaaaaccaaaaaaattttaaaaaacaaaaattcacgtcgaaacatctaaacgctcgtaccgcgtcccccgcgccacctccgccaaaaccacgtaaaaccaaaaacaaccgccgtacgcatacgtcacgaacccgcgccccgccgccccttcccctcgcctaacgcgcgacgaaacgctaaaaacgtcacgtaaacgaacgcgcgccacgaaaccaaaattaaaaaacgccgcgcgaccgtaaaataaaaaaaacgaaaaaaaaaataacgaaaaaacaaaaaacgacgcgaaaaccgcccacacctccgccccgcgaccccgataccctcaccttatttattccgttaaactaccgctcgaactcgtcgaaatccgacatactaaaacgacccgtaaaaccctatacaactttcgcctcgccttaccgcccgctccaaccgttcgactacttccgccgctaacttcgactacttccgaccgccgccgacgttcgccacctcctacctaatcaaacctccgacaaccctccccgccccgccgaactccgccccctcacccgcccgcccgcccgcgaacttacccctcccccgaacctaactccgaaacgcctcgactatctccgaatactaaacgaaacgaaacaaacgaccgcttcgactacttccgaaaacacccgaacgtaaaattcgccgacttcccaaatttccgtaacttttccgaaattatctcctcaaattcgaaaatttccgtatatcctcgtataccactacgcccaatcccctcgcgaattcgaattcttccaacaattcaatccgtcccaatctttaacttctccacgaacttactccgatcttctccgccgaccctatccaaacaatcgacacttccgacaatcctaaccgtcccgaccttcgactctttccgaaaattccgaatctcgccctcgaacccctcctaaaattaaactcgaatccgtattcgactctttccgaaaataccacttactcacgcctccgatcaaaaaacttaactccttccgccaccgcttcgtaaaaacctcactctccgaaaacaactcgactttttccgtaaatacctcgactccttccgacttcgaaaacgaaaaaaaaaaaaaaacaaaaacgaaataaatcaaaaaaaaaaataaaaaaaaaacgaaatcctaattctcg

SEQ ID NO: 24007 - DNA, 1208 bp, Artificial Sequence
  chemically treated genomic DNA (Homo sapiens) CpG-island No: 24007
taattttttttttaagaaattaaaaagattttaaaaaataaaagtttacgtcgaggtatttgggcgttcgtgtcgcgtttttcgcgttattttcgttaggattacgtggggttagggatagtcgtcgtgcgtatgcgttacgggttcgcgtttcgtcgtttttttttttcgtttagcgcgcggcggaacgttggggacgttacgtgaacgggcgcgcgttacggaattagggttggggggcgtcgcgcggtcgtgaagtgggggaagcgagggagaaaatggcgggggggtaaagagcgacgcgaggatcgtttatattttcgtttcgcgatttcggtgtttttattttgtttatttcgttgagttgtcgttcgaattcgtcgaagttcgatatgttgaggcggttcgtagggttttgtgtagttttcgtttcgttttgtcgttcgttttagtcgttcggttattttcgtcgttggtttcggttattttcggtcgtcgtcggcgttcgttattttttatttaattaagttttcggtagtttttttcgtttcgtcgggtttcgtttttttattcgttcgttcgttcgcgagtttgtttttttttcgagtttggtttcgaagcgtttcggttattttcggatattggacgaagcgaagtaggcggtcgtttcggttgttttcgaaaatattcgaacgtagggttcgtcgattttttaggttttcgtaattttttcgagattatttttttaagttcggaggttttcgtgtgttttcgtgtgttattgcgtttagttttttcgcgagttcgggtttttttaataatttaattcgttttagtttttggtttttttacggatttgtttcgatttttttcgtcggttttgtttaagtaatcggtattttcgataattttaatcgtttcggttttcggtttttttcggagatttcggatttcgttttcgggttttttttgggattaagttcgagttcgtgttcggtttttttcggagatgttatttgtttacgttttcgattagagaatttggtttttttcgttatcgtttcgtgaaggttttatttttcggggatagttcgatttttttcgtgggtatttcggtttttttcggtttcgggaacggaaagggaaggagaatagagacgagatggattaggggaagggatagagaagggacgaggttttagttttcg

SEQ ID NO: 24008 - DNA, 1208 bp, Artificial Sequence
  chemically treated genomic DNA (Homo sapiens) CpG-island No: 24008
cgaaaactaaaacctcgtcccttctctatcccttcccctaatccatctcgtctctattctccttccctttccgttcccgaaaccgaaaaaaaccgaaatacccacgaaaaaaatcgaactatccccgaaaaataaaaccttcacgaaacgataacgaaaaaaaccaaattctctaatcgaaaacgtaaacaaataacatctccgaaaaaaaccgaacacgaactcgaacttaatcccaaaaaaaacccgaaaacgaaatccgaaatctccgaaaaaaaccgaaaaccgaaacgattaaaattatcgaaaataccgattacttaaacaaaaccgacgaaaaaaatcgaaacaaatccgtaaaaaaaccaaaaactaaaacgaattaaattattaaaaaaacccgaactcgcgaaaaaactaaacgcaataacacacgaaaacacacgaaaacctccgaacttaaaaaaataatctcgaaaaaattacgaaaacctaaaaaatcgacgaaccctacgttcgaatattttcgaaaacaaccgaaacgaccgcctacttcgcttcgtccaatatccgaaaataaccgaaacgcttcgaaaccaaactcgaaaaaaaaacaaactcgcgaacgaacgaacgaataaaaaaacgaaacccgacgaaacgaaaaaaactaccgaaaacttaattaaataaaaaataacgaacgccgacgacgaccgaaaataaccgaaaccaacgacgaaaataaccgaacgactaaaacgaacgacaaaacgaaacgaaaactacacaaaaccctacgaaccgcctcaacatatcgaacttcgacgaattcgaacgacaactcaacgaaataaacaaaataaaaacaccgaaatcgcgaaacgaaaatataaacgatcctcgcgtcgctctttacccccccgccattttctccctcgcttcccccacttcacgaccgcgcgacgccccccaaccctaattccgtaacgcgcgcccgttcacgtaacgtccccaacgttccgccgcgcgctaaacgaaaaaaaaaaacgacgaaacgcgaacccgtaacgcatacgcacgacgactatccctaaccccacgtaatcctaacgaaaataacgcgaaaaacgcgacacgaacgcccaaatacctcgacgtaaacttttattttttaaaatctttttaatttcttaaaaaaaaaatta

SEQ ID NO: 24009 - DNA, 563 bp, Artificial Sequence
  chemically treated genomic DNA (Homo sapiens) CpG-island No: 24009
ttgtcgtaaacggcgggttttatttggattcgggattttttaacgaggggcgttagtttggttcgattgggcgagttttcgcgttttgttcgtttcgtcgtttagttttacgatacgtttttttgtcgtttttttgttcgcgggtgggtgggcgtttttttcggtttttcgtgatattttgagacgtttttcggcgtcgggtatgggcgtcgtcgtcgtcggttttcgagcggatttcgcgagcgggtgggtgagcgcggggggtttcggtttttcggattcgggtattcgcgggcgggggatggtggtcgcgtttgtattttcgtttagtgtatgttttcgttggaatcgttttacgatcgtttttttttttatttcgggataaagggcgggggcggggggggcgtatttttacgcgtgatttttttcgtattgcgtacgcgtttagtttttattatcgggggacggttcgtttttatacgcgagtgcgggggaggggtgtgggggtttacgaaggtagaggagtagcgcgtatagggttgatttttttttatattgggaag

SEQ ID NO: 24010 - DNA, 563 bp, Artificial Sequence
  chemically treated genomic DNA (Homo sapiens) CpG-island No: 24010
cttcccaatataaaaaaaaatcaaccctatacgcgctactcctctaccttcgtaaacccccacacccctcccccgcactcgcgtataaaaacgaaccgtcccccgataataaaaactaaacgcgtacgcaatacgaaaaaaatcacgcgtaaaaatacgccccccccgcccccgccctttatcccgaaataaaaaaaaaaacgatcgtaaaacgattccaacgaaaacatacactaaacgaaaatacaaacgcgaccaccatcccccgcccgcgaatacccgaatccgaaaaaccgaaaccccccgcgctcacccacccgctcgcgaaatccgctcgaaaaccgacgacgacgacgcccatacccgacgccgaaaaacgtctcaaaatatcacgaaaaaccgaaaaaaacgcccacccacccgcgaacaaaaaaacgacaaaaaaacgtatcgtaaaactaaacgacgaaacgaacaaaacgcgaaaactcgcccaatcgaaccaaactaacgcccctcgttaaaaaatcccgaatccaaataaaacccgccgtttacgacaa

SEQ ID NO: 24011 - DNA, 563 bp, Artificial Sequence
  chemically treated genomic DNA (Homo sapiens) CpG-island No: 24011
ttttttagtgtaggaggaggttagttttgtgcgcgttgtttttttattttcgtgggtttttatatttttttttcgtattcgcgtgtgggggcggatcgtttttcggtggtgggggttgggcgcgtgcgtagtacgggaaaggttacgcgtgggggtgcgtttttttcgttttcgttttttgtttcggggtgggagggggagcggtcgtggaacgattttagcgggaatatgtattgggcgggggtgtaaacgcggttattatttttcgttcgcgggtgttcgggttcgaggggtcgaggtttttcgcgtttatttattcgttcgcggaattcgttcggggatcgacggcggcggcgtttatgttcggcgtcggggagcgttttaaagtgttacggggagtcgagggaagcgtttatttattcgcgaataggggggcggtaggggagcgtgtcgtggaattgagcgacggaacgggtagggcgcggggattcgtttagtcgggttaggttagcgtttttcgttgaagagtttcgggtttaggtgaggttcgtcgtttgcggtag

SEQ ID NO: 24012 - DNA, 563 bp, Artificial Sequence
  chemically treated genomic DNA (Homo sapiens) CpG-island No: 24012
ctaccgcaaacgacgaacctcacctaaacccgaaactcttcaacgaaaaacgctaacctaacccgactaaacgaatccccgcgccctacccgttccgtcgctcaattccacgacacgctcccctaccgcccccctattcgcgaataaataaacgcttccctcgactccccgtaacactttaaaacgctccccgacgccgaacataaacgccgccgccgtcgatccccgaacgaattccgcgaacgaataaataaacgcgaaaaacctcgacccctcgaacccgaacacccgcgaacgaaaaataataaccgcgtttacacccccgcccaatacatattcccgctaaaatcgttccacgaccgctccccctcccaccccgaaacaaaaaacgaaaacgaaaaaaacgcacccccacgcgtaacctttcccgtactacgcacgcgcccaacccccaccaccgaaaaacgatccgcccccacacgcgaatacgaaaaaaaaatataaaaacccacgaaaataaaaaaacaacgcgcacaaaactaacctcctcctacactaaaaaa

SEQ ID NO: 24013 - DNA, 692 bp, Artificial Sequence
  chemically treated genomic DNA (Homo sapiens) CpG-island No: 24013
attcgtgtgtgtgcgcgtatatgtttgttaatgtgtagttagggtggaaggttacgtaggcgtcgcgggcgggcgtcgtttgggtttttttttttcgtatttttttttttttttcgtttgttggagtgtcgttgtaatatgttttttttcggtttttggttcggtcgagtagtatatcgatggatcggtttagttttgttcggtttcggggggggtgaggtgggcgtgtcgatgtgtgggggtgttattgcgtcgtggggtgggagtttttttgggtggtaatgcgtggttgttgggggtttgggtgggtatttcggcgtgggtgtatttcggcgtgggagcggtgttttgggggggtgcgtatatttgtgggacgtcggcggtgggtgttattggttgtgcggcggtagggtttgaagggttggtgagtgggtgtaatttaggtgggcgcgtggtcgggttggagcggcggcggggtaggggtttggggggggggttatgtgttgtgggtagtcgacgagtaggtgttagtagtggtcggtaagcggtttcggttggtgttatttttttgggtcgttggttaagttttgtcgcgaggtcgcgagtggggttaaggtgtaagaaggggttagatgggagaagggtatattaggggtgtgtggttgttttgtttgcgatgtattgtataatag

SEQ ID NO: 24014 - DNA, 692 bp, Artificial Sequence
  chemically treated genomic DNA (Homo sapiens) CpG-island No: 24014
ctattatacaatacatcgcaaacaaaacaaccacacacccctaatatacccttctcccatctaaccccttcttacaccttaaccccactcgcgacctcgcgacaaaacttaaccaacgacccaaaaaaataacaccaaccgaaaccgcttaccgaccactactaacacctactcgtcgactacccacaacacataaccccccccccaaacccctaccccgccgccgctccaacccgaccacgcgcccacctaaattacacccactcaccaacccttcaaaccctaccgccgcacaaccaataacacccaccgccgacgtcccacaaatatacgcacccccccaaaacaccgctcccacgccgaaatacacccacgccgaaatacccacccaaacccccaacaaccacgcattaccacccaaaaaaactcccaccccacgacgcaataacacccccacacatcgacacgcccacctcaccccccccgaaaccgaacaaaactaaaccgatccatcgatatactactcgaccgaaccaaaaaccgaaaaaaaacatattacaacgacactccaacaaacgaaaaaaaaaaaaaaatacgaaaaaaaaaaacccaaacgacgcccgcccgcgacgcctacgtaaccttccaccctaactacacattaacaaacatatacgcgcacacacacgaat

SEQ ID NO: 24015 - DNA, 692 bp, Artificial Sequence
  chemically treated genomic DNA (Homo sapiens) CpG-island No: 24015
ttattatataatatatcgtagataagataattatatatttttagtatgttttttttttatttggtttttttttgtattttagttttattcgcgatttcgcggtaaggtttaattagcgatttagaaaaatagtattaatcgaggtcgtttatcgattattattgatatttgttcgtcggttatttataatatatagttttttttttaagtttttgtttcgtcgtcgttttaattcgattacgcgtttatttgggttatatttatttattaattttttaagttttgtcgtcgtataattagtaatatttatcgtcggcgttttataggtgtgcgtatttttttaaaatatcgtttttacgtcgggatgtatttacgtcggggtgtttatttaagtttttaatagttacgtattgttatttagggagatttttattttacgacgtagtaatatttttatatatcgatacgtttattttatttttttcggaatcgggtaggattaaatcgatttatcgatgtattgttcggtcgagttagaggtcgagagagaatatgttgtaacggtattttaataggcggggagagaggagaagtgcgaggagagaaggtttaggcggcgttcgttcgcggcgtttgcgtgattttttattttggttatatattgataggtatatgcgcgtatatatacggat

SEQ ID NO: 24016 - DNA, 692 bp, Artificial Sequence
  chemically treated genomic DNA (Homo sapiens) CpG-island No: 24016
atccgtatatatacgcgcatatacctatcaatatataaccaaaataaaaaatcacgcaaacgccgcgaacgaacgccgcctaaaccttctctcctcgcacttctcctctctccccgcctattaaaataccgttacaacatattctctctcgacctctaactcgaccgaacaatacatcgataaatcgatttaatcctacccgattccgaaaaaaataaaataaacgtatcgatatataaaaatattactacgtcgtaaaataaaaatctccctaaataacaatacgtaactattaaaaacttaaataaacaccccgacgtaaatacatcccgacgtaaaaacgatattttaaaaaaatacgcacacctataaaacgccgacgataaatattactaattatacgacgacaaaacttaaaaaattaataaataaatataacccaaataaacgcgtaatcgaattaaaacgacgacgaaacaaaaacttaaaaaaaaaactatatattataaataaccgacgaacaaatatcaataataatcgataaacgacctcgattaatactatttttctaaatcgctaattaaaccttaccgcgaaatcgcgaataaaactaaaatacaaaaaaaaaccaaataaaaaaaaaacatactaaaaatatataattatcttatctacgatatattatataataa

SEQ ID NO: 24017 - DNA, 720 bp, Artificial Sequence
  chemically treated genomic DNA (Homo sapiens) CpG-island No: 24017
tttttttcgtattatttagcgatttatatttttaaacgtttgcggacgttaatattgtagtacggggtttttttttaggtattggggttacgaatattttttttatatgttagagaacggattacgttcgttttattcggtttttagcgtttttttttttatagtcgttttcgtttcgcgttataaaataaggattagtaagtatttgtatcggtcgtttttggtttttcgataagtttcgggagcgggtttggaagggggtcgcgggcggaagtgacgttagacgcgcgcggtggggcggggcggcgttcgtttcgggtcgtagtaatcgttttaagtttttcggagggcgggttgggaggaatcgagttgtgattttgcgagggtcgggaagcgattttttttatttttagagaaggagtaacggggaaggggatttggggaagaacgggagcggaagtcggtaggagacgggcggcggttggggattagcgcgagttttcgttttacgttttttcgttgttgagtatttgagcgtcgggcggcgacgttagcgcgtggatttttattcgtgtcgggttttcgcgggaggagtcggttacgtttagtattttggcgttcgattttttatttttagggattttattttatttacggggcgttcggggtcgtagaatttttcgtataaggatttttttattttttatacgaggggggtag

SEQ ID NO: 24018 - DNA, 720 bp, Artificial Sequence
  chemically treated genomic DNA (Homo sapiens) CpG-island No: 24018
ctacccccctcgtataaaaaataaaaaaatccttatacgaaaaattctacgaccccgaacgccccgtaaataaaataaaatccctaaaaataaaaaatcgaacgccaaaatactaaacgtaaccgactcctcccgcgaaaacccgacacgaataaaaatccacgcgctaacgtcgccgcccgacgctcaaatactcaacaacgaaaaaacgtaaaacgaaaactcgcgctaatccccaaccgccgcccgtctcctaccgacttccgctcccgttcttccccaaatccccttccccgttactccttctctaaaaataaaaaaaatcgcttcccgaccctcgcaaaatcacaactcgattcctcccaacccgccctccgaaaaacttaaaacgattactacgacccgaaacgaacgccgccccgccccaccgcgcgcgtctaacgtcacttccgcccgcgacccccttccaaacccgctcccgaaacttatcgaaaaaccaaaaacgaccgatacaaatacttactaatccttattttataacgcgaaacgaaaacgactataaaaaaaaaaacgctaaaaaccgaataaaacgaacgtaatccgttctctaacatataaaaaaaatattcgtaaccccaatacctaaaaaaaaaccccgtactacaatattaacgtccgcaaacgtttaaaaatataaatcgctaaataatacgaaaaaaa

SEQ ID NO: 24019 - DNA, 720 bp, Artificial Sequence
  chemically treated genomic DNA (Homo sapiens) CpG-island No: 24019
ttgtttttttcgtgtgagaagtagggggatttttatgcggaaggttttgcgatttcgggcgtttcgtgggtggagtggggtttttggggatggggagtcgggcgttaggatgttgagcgtggtcggtttttttcgcgaaggttcggtacggatgagaatttacgcgttggcgtcgtcgttcggcgtttaggtgtttagtaacgagggaacgtggggcgggagttcgcgttggtttttagtcgtcgttcgttttttgtcggttttcgttttcgtttttttttaggttttttttttcgttgttttttttttagggataggagaggtcgtttttcggttttcgtagggttatagttcggttttttttagttcgtttttcggggagtttagaacggttgttacggttcggagcgggcgtcgtttcgttttatcgcgcgcgtttgacgttattttcgttcgcgatttttttttagattcgttttcgaaatttgtcgaaggattaaaggcgatcggtgtaggtgtttgttggtttttgttttgtggcgcgggacggggacgattgtgggggagggggcgttggggatcgggtggagcgagcgtggttcgttttttggtatgtggggagggtgttcgtgattttagtgtttgggagggagtttcgtgttgtagtgttggcgttcgtaggcgtttgggagtgtagatcgttgaataatacgggggagg

SEQ ID NO: 24020 - DNA, 720 bp, Artificial Sequence
  chemically treated genomic DNA (Homo sapiens) CpG-island No: 24020
cctcccccgtattattcaacgatctacactcccaaacgcctacgaacgccaacactacaacacgaaactccctcccaaacactaaaatcacgaacaccctccccacataccaaaaaacgaaccacgctcgctccacccgatccccaacgccccctcccccacaatcgtccccgtcccgcgccacaaaacaaaaaccaacaaacacctacaccgatcgcctttaatccttcgacaaatttcgaaaacgaatctaaaaaaaaatcgcgaacgaaaataacgtcaaacgcgcgcgataaaacgaaacgacgcccgctccgaaccgtaacaaccgttctaaactccccgaaaaacgaactaaaaaaaaccgaactataaccctacgaaaaccgaaaaacgacctctcctatccctaaaaaaaaaacaacgaaaaaaaaaacctaaaaaaaaacgaaaacgaaaaccgacaaaaaacgaacgacgactaaaaaccaacgcgaactcccgccccacgttccctcgttactaaacacctaaacgccgaacgacgacgccaacgcgtaaattctcatccgtaccgaaccttcgcgaaaaaaaccgaccacgctcaacatcctaacgcccgactccccatccccaaaaaccccactccacccacgaaacgcccgaaatcgcaaaaccttccgcataaaaatccccctacttctcacacgaaaaaaacaa

SEQ ID NO: 24021 - DNA, 764 bp, Artificial Sequence
  chemically treated genomic DNA (Homo sapiens) CpG-island No: 24021
ttgttcgtgtggtttcgtaggtggtagcgtagttcggaggagtttttgaagatttgtcgtattcggtatatttgtagggtcgtttcgtagaagcgggggcgacgggggtggcggcgggacgggggcggtaggcgttagcggtttttggggtaggttattttcgtagttttagtttgcgggggcgggcgttcggtcgcgttttttttacgtggtattgttgatgcgttaggaggttggttagttgcggaaggagtcgtcgtagttgtcgtagcggaacgtttgttcgtcggtagttcgtggttgtgttggtggcgggagagtttagttatcgttcggaaggatttgcgtagggtagataggtaaagttaggcgcgggggcggcggcgggaggaggggttgcggtagaggggacggtggttggtcggttttgggcgtttcggcggtgttttttggggttggggcgtcgtatcgggttcggggtacggttggtgtttaggagtagtttttcgttgttgaattttgttcgtagttatcgtagcggaattaggtttatcgtgttttcgcgtcgttaaaaggagtttggttttcggcgggggcggtgtcggggtgggaagttcgggggtagtggtttgaggatttttggttggtttattaagaatttcgggttcggattggggaggtcgcggggttcggcggtgggtttttttttatgttatacgggtgagtggtggtagtttgaggacgagaggagttttatatatttt

SEQ ID NO: 24022 - DNA, 764 bp, Artificial Sequence
  chemically treated genomic DNA (Homo sapiens) CpG-island No: 24022
aaaatatataaaactcctctcgtcctcaaactaccaccactcacccgtataacataaaaaaaaacccaccgccgaaccccgcgacctccccaatccgaacccgaaattcttaataaaccaaccaaaaatcctcaaaccactacccccgaacttcccaccccgacaccgcccccgccgaaaaccaaactccttttaacgacgcgaaaacacgataaacctaattccgctacgataactacgaacaaaattcaacaacgaaaaactactcctaaacaccaaccgtaccccgaacccgatacgacgccccaaccccaaaaaacaccgccgaaacgcccaaaaccgaccaaccaccgtcccctctaccgcaacccctcctcccgccgccgcccccgcgcctaactttacctatctaccctacgcaaatccttccgaacgataactaaactctcccgccaccaacacaaccacgaactaccgacgaacaaacgttccgctacgacaactacgacgactccttccgcaactaaccaacctcctaacgcatcaacaataccacgtaaaaaaaacgcgaccgaacgcccgcccccgcaaactaaaactacgaaaataacctaccccaaaaaccgctaacgcctaccgcccccgtcccgccgccacccccgtcgcccccgcttctacgaaacgaccctacaaatataccgaatacgacaaatcttcaaaaactcctccgaactacgctaccacctacgaaaccacacgaacaa

SEQ ID NO: 24023 - DNA, 764 bp, Artificial Sequence
  chemically treated genomic DNA (Homo sapiens) CpG-island No: 24023
ggagtgtgtggggtttttttcgtttttaagttattattatttattcgtgtgatatgaaaaggggtttatcgtcgggtttcgcggtttttttaattcggattcgaagtttttggtagattaattagggatttttaagttattgttttcgggttttttatttcggtatcgttttcgtcgggggttagattttttttggcggcgcggagatacggtggatttggtttcgttgcgatggttgcgagtaggatttagtagcgaggagttgtttttgggtattagtcgtgtttcgggttcgatgcggcgttttagttttaggaggtatcgtcgaggcgtttaaggtcgattagttatcgttttttttgtcgtagttttttttttcgtcgtcgttttcgcgtttggttttgtttgtttgttttgcgtaagttttttcggacggtggttgggttttttcgttattagtatagttacgggttgtcggcgggtaagcgtttcgttgcggtagttgcgacggtttttttcgtagttggttagttttttggcgtattagtagtgttacgtggaagaggcgcggtcgggcgttcgttttcgtaggttgaggttgcggaggtgatttgttttaggaatcgttggcgtttgtcgttttcgtttcgtcgttattttcgtcgttttcgtttttgcggagcggttttataaatgtgtcgagtgcggtaagtttttaagggttttttcgggttgcgttattatttgcgggattatacgggtag

SEQ ID NO: 24024 - DNA, 764 bp, Artificial Sequence
  chemically treated genomic DNA (Homo sapiens) CpG-island No: 24024
ctacccgtataatcccgcaaataataacgcaacccgaaaaaacccttaaaaacttaccgcactcgacacatttataaaaccgctccgcaaaaacgaaaacgacgaaaataacgacgaaacgaaaacgacaaacgccaacgattcctaaaacaaatcacctccgcaacctcaacctacgaaaacgaacgcccgaccgcgcctcttccacgtaacactactaatacgccaaaaaactaaccaactacgaaaaaaaccgtcgcaactaccgcaacgaaacgcttacccgccgacaacccgtaactatactaataacgaaaaaacccaaccaccgtccgaaaaaacttacgcaaaacaaacaaacaaaaccaaacgcgaaaacgacgacgaaaaaaaaaactacgacaaaaaaaacgataactaatcgaccttaaacgcctcgacgatacctcctaaaactaaaacgccgcatcgaacccgaaacacgactaatacccaaaaacaactcctcgctactaaatcctactcgcaaccatcgcaacgaaaccaaatccaccgtatctccgcgccgccaaaaaaaatctaacccccgacgaaaacgataccgaaataaaaaacccgaaaacaataacttaaaaatccctaattaatctaccaaaaacttcgaatccgaattaaaaaaaccgcgaaacccgacgataaaccccttttcatatcacacgaataaataataataacttaaaaacgaaaaaaaccccacacactcc

SEQ ID NO: 24025 - DNA, 774 bp, Artificial Sequence
  chemically treated genomic DNA (Homo sapiens) CpG-island No: 24025
ttagacgcgagttcgcgcgcgtcgcggtttagttcgaatattcggagtaggcgggttagcgtttttcgcgtttcgtttcgttttatttcggtttttttacgtcgggttttggggggttatggcggttagtttttgtttcgttcggtttcggtgtcgcgggacgtgcgtcgggttacggggtacgtacgaacgtaaggagggtcgtacgtcgacggtttcgtcgtttcgcgtttagaaggggcgcggagagtcgggcgggggaggggagtcgtcgagggacgggaagtaatagaaggaggcgacggatcggaagcggaaattgtcgttttttcgttttttcgtgtcgtatttcgttttggtaggagtcgttttcgcgttaagttaatttggaaggtattattttcggcgcgttgggtttcgttgtaggcgtttttacgttattttcgttcgttgtagcgggggattcgcgcggttttacggaacgtcgagagttagttttagttcgtttggcggtaatcgcgggtttttggtatatttacgttacgttcgtttcggttcgttcggttattatttttttgtcggcggggtgggagagtattcgggaattttacgtttttcgggttgtgtttgtgtcgatttcgagaagggtatcgcgtaagtagggaaggttcgaggttgtcggcgtcggtagtaggggcgttttagttaggggttcgtatttgttaagggaatttttattcgagtttagaatcgaggaagagggtcggtatattg

SEQ ID NO: 24026 - DNA, 774 bp, Artificial Sequence
  chemically treated genomic DNA (Homo sapiens) CpG-island No: 24026
caatataccgaccctcttcctcgattctaaactcgaataaaaattcccttaacaaatacgaacccctaactaaaacgcccctactaccgacgccgacaacctcgaaccttccctacttacgcgatacccttctcgaaatcgacacaaacacaacccgaaaaacgtaaaattcccgaatactctcccaccccgccgacaaaaaaataataaccgaacgaaccgaaacgaacgtaacgtaaatataccaaaaacccgcgattaccgccaaacgaactaaaactaactctcgacgttccgtaaaaccgcgcgaatcccccgctacaacgaacgaaaataacgtaaaaacgcctacaacgaaacccaacgcgccgaaaataataccttccaaattaacttaacgcgaaaacgactcctaccaaaacgaaatacgacacgaaaaaacgaaaaaacgacaatttccgcttccgatccgtcgcctccttctattacttcccgtccctcgacgactcccctcccccgcccgactctccgcgccccttctaaacgcgaaacgacgaaaccgtcgacgtacgaccctccttacgttcgtacgtaccccgtaacccgacgcacgtcccgcgacaccgaaaccgaacgaaacaaaaactaaccgccataaccccccaaaacccgacgtaaaaaaaccgaaataaaacgaaacgaaacgcgaaaaacgctaacccgcctactccgaatattcgaactaaaccgcgacgcgcgcgaactcgcgtctaa

SEQ ID NO: 24027 - DNA, 774 bp, Artificial Sequence
  chemically treated genomic DNA (Homo sapiens) CpG-island No: 24027
tagtatgtcgattttttttttcggttttgggttcgggtgggggtttttttggtaaatgcgggtttttggttgggacgtttttgttgtcggcgtcggtagtttcgagttttttttgtttgcgcggtgtttttttcggggtcggtataggtatagttcgggggacgtgaggttttcgagtgtttttttatttcgtcgataggaggatggtggtcgagcgggtcggggcgggcgtggcgtgggtgtgttaggagttcgcggttgtcgttaagcgagttggagttgattttcggcgtttcgtgagatcgcgcggatttttcgttgtagcgggcggaagtgacgtagaggcgtttgtaacggggtttagcgcgtcggaagtgatgttttttaggttggtttggcgcggaagcgatttttgttagggcggggtgcggtacgggagggcggggaggcggtaattttcgttttcggttcgtcgtttttttttgttgtttttcgtttttcggcggtttttttttttcgttcggtttttcgcgttttttttgggcgcggggcggcggagtcgtcggcgtgcggttttttttgcgttcgtgcgtgtttcgtggttcggcgtacgtttcgcgatatcgaggtcgagcggggtaggggttgatcgttatgattttttagagttcggcgtgagggggtcgaggtgaggcggggcggagcgcgggggacgttggttcgtttgtttcgggtgttcgggttgggtcgcggcgcgcgcgggttcgcgtttgg

SEQ ID NO: 24028 - DNA, 774 bp, Artificial Sequence
  chemically treated genomic DNA (Homo sapiens) CpG-island No: 24028
ccaaacgcgaacccgcgcgcgccgcgacccaacccgaacacccgaaacaaacgaaccaacgtcccccgcgctccgccccgcctcacctcgaccccctcacgccgaactctaaaaaatcataacgatcaacccctaccccgctcgacctcgatatcgcgaaacgtacgccgaaccacgaaacacgcacgaacgcaaaaaaaaccgcacgccgacgactccgccgccccgcgcccaaaaaaaacgcgaaaaaccgaacgaaaaaaaaaaaccgccgaaaaacgaaaaacaacaaaaaaaaacgacgaaccgaaaacgaaaattaccgcctccccgccctcccgtaccgcaccccgccctaacaaaaatcgcttccgcgccaaaccaacctaaaaaacatcacttccgacgcgctaaaccccgttacaaacgcctctacgtcacttccgcccgctacaacgaaaaatccgcgcgatctcacgaaacgccgaaaatcaactccaactcgcttaacgacaaccgcgaactcctaacacacccacgccacgcccgccccgacccgctcgaccaccatcctcctatcgacgaaataaaaaaacactcgaaaacctcacgtcccccgaactatacctataccgaccccgaaaaaaacaccgcgcaaacaaaaaaaactcgaaactaccgacgccgacaacaaaaacgtcccaaccaaaaacccgcatttaccaaaaaaacccccacccgaacccaaaaccgaaaaaaaaaatcgacatacta

SEQ ID NO: 24029 - DNA, 760 bp, Artificial Sequence
  chemically treated genomic DNA (Homo sapiens) CpG-island No: 24029
ttgcgcgcgtattatagtttgttacgggggagcggttttatcgttgcgcgttttgttttcgcgtttttaagttttggcgtttttgtttcggtattagtatcggtacggggtggagtcgggatttttcggaggttttcggatatagcggtcgttgtagaatagaggttcgggtggtttcggagagggcggaggtggtgatggcggcggcggcggcgggttagcggtggggaagttttttgtttgtaggttttgcgttaagttttttcgcgttttttagatatgcgagattacgagcgcgtgtatattggcgagcggtatattattgcggtatttgcggtaagggttttatttagttttcggtgtttgcggttacgttcgtatttatattggcgaagcgttcgtttcgtttgtacgtttgcgatcgtatttttaataatttttttaattttcgtaagtattagcgatttatttttacgggtcggggtcggggttgggagattttggaggttagcgggttcgtcggcggttgaggggtcggggagcgggtgtggggtaggggatttgcggaggaggggcggggggagatcgcgaaggtgaaggtggaggtcgatagtaggttgtagattagggatatgggttagttaaggcggaggtacgagtcgattcggggagggggacggggtggggaaacggaggtaggggatagaaaggggagattgggggagagatgatagttgtagggatggttgtgagtcgtagt

SEQ ID NO: 24030 - DNA, 760 bp, Artificial Sequence
  chemically treated genomic DNA (Homo sapiens) CpG-island No: 24030
actacgactcacaaccatccctacaactatcatctctcccccaatctcccctttctatcccctacctccgtttccccaccccgtccccctccccgaatcgactcgtacctccgccttaactaacccatatccctaatctacaacctactatcgacctccaccttcaccttcgcgatctccccccgcccctcctccgcaaatcccctaccccacacccgctccccgacccctcaaccgccgacgaacccgctaacctccaaaatctcccaaccccgaccccgacccgtaaaaataaatcgctaatacttacgaaaattaaaaaaattattaaaaatacgatcgcaaacgtacaaacgaaacgaacgcttcgccaatataaatacgaacgtaaccgcaaacaccgaaaactaaataaaacccttaccgcaaataccgcaataatataccgctcgccaatatacacgcgctcgtaatctcgcatatctaaaaaacgcgaaaaaacttaacgcaaaacctacaaacaaaaaacttccccaccgctaacccgccgccgccgccgccatcaccacctccgccctctccgaaaccacccgaacctctattctacaacgaccgctatatccgaaaacctccgaaaaatcccgactccaccccgtaccgatactaataccgaaacaaaaacgccaaaacttaaaaacgcgaaaacaaaacgcgcaacgataaaaccgctcccccgtaacaaactataatacgcgcgcaa

SEQ ID NO: 24031 - DNA, 760 bp, Artificial Sequence
  chemically treated genomic DNA (Homo sapiens) CpG-island No: 24031
attgcggtttataattatttttgtagttgttattttttttttaattttttttttttgttttttgttttcgtttttttatttcgttttttttttcgggtcggttcgtattttcgttttaattaatttatgtttttggtttgtagtttattgtcggtttttatttttattttcgcggttttttttcgtttttttttcgtaggttttttattttatattcgtttttcgattttttagtcgtcgacgagttcgttggtttttagagttttttagtttcggtttcggttcgtggaagtgggtcgttggtgtttgcggaagttggaggagttgttgaaggtgcggtcgtagacgtgtaagcggaacgggcgtttcgttagtgtggatgcgggcgtggtcgtaagtatcgaggattgggtgaagtttttgtcgtagatgtcgtaatggtatgtcgttcgttagtgtgtacgcgttcgtggtttcgtatgtttgaggagcgcggaagggtttggcgtagaatttgtaggtaaaaggtttttttatcgttggttcgtcgtcgtcgtcgttattattattttcgtttttttcggggttattcgggtttttgttttgtaacggtcgttgtgttcggaggttttcgagaggtttcggttttatttcgtgtcggtgttggtgtcggagtaggggcgttaaggtttgaaggcgcgggggtagagcgcgtagcggtagggtcgttttttcgtggtaagttgtagtgcgcgcgtag

SEQ ID NO: 24032 - DNA, 760 bp, Artificial Sequence
  chemically treated genomic DNA (Homo sapiens) CpG-island No: 24032
ctacgcgcgcactacaacttaccacgaaaaaacgaccctaccgctacgcgctctacccccgcgccttcaaaccttaacgcccctactccgacaccaacaccgacacgaaataaaaccgaaacctctcgaaaacctccgaacacaacgaccgttacaaaacaaaaacccgaataaccccgaaaaaaacgaaaataataataacgacgacgacgacgaaccaacgataaaaaaaccttttacctacaaattctacgccaaacccttccgcgctcctcaaacatacgaaaccacgaacgcgtacacactaacgaacgacataccattacgacatctacgacaaaaacttcacccaatcctcgatacttacgaccacgcccgcatccacactaacgaaacgcccgttccgcttacacgtctacgaccgcaccttcaacaactcctccaacttccgcaaacaccaacgacccacttccacgaaccgaaaccgaaactaaaaaactctaaaaaccaacgaactcgtcgacgactaaaaaatcgaaaaacgaatataaaataaaaaacctacgaaaaaaaaacgaaaaaaaaccgcgaaaataaaaataaaaaccgacaataaactacaaaccaaaaacataaattaattaaaacgaaaatacgaaccgacccgaaaaaaaaaacgaaataaaaaaacgaaaacaaaaaacaaaaaaaaaaaattaaaaaaaaaataacaactacaaaaataattataaaccgcaat

SEQ ID NO: 24033 - DNA, 515 bp, Artificial Sequence
  chemically treated genomic DNA (Homo sapiens) CpG-island No: 24033
atacggcgtaatgtatcgttgttgtaacgattgacgtcgtgggcgatatcgcggttttcgaggttgtaaatgcggatgattttattacgcgagaaattgttagttacgtttttaatgtttttcggtaatagggagttgtcgcgttttagaatggcggtagttgtttttttatttatcgtgattttattcgtcggcggcgtatcgaaaatttagcgtttacggtttttaagcggagtcgtttgggtatggaatagcgtatcgacggaaatgttttttattatattattaataacgttcggtttgttgttcgcggtaataatggtgtcgatattcgtacggtaagttacgttagcggtttgtaatttggtatttatgtcgttagtttcgaggtttgaaacgttgttatcggtaatcgcgcgtagtgcgttattaatgtcgtaaatatttttaattagttttgtttgcggattgttgcgcgggttagcggtatataaatttttttgatcggttagtag

SEQ ID NO: 24034 - DNA, 515 bp, Artificial Sequence
  chemically treated genomic DNA (Homo sapiens) CpG-island No: 24034
ctactaaccgatcaaaaaaatttatataccgctaacccgcgcaacaatccgcaaacaaaactaattaaaaatatttacgacattaataacgcactacgcgcgattaccgataacaacgtttcaaacctcgaaactaacgacataaataccaaattacaaaccgctaacgtaacttaccgtacgaatatcgacaccattattaccgcgaacaacaaaccgaacgttattaataatataataaaaaacatttccgtcgatacgctattccatacccaaacgactccgcttaaaaaccgtaaacgctaaattttcgatacgccgccgacgaataaaatcacgataaataaaaaaacaactaccgccattctaaaacgcgacaactccctattaccgaaaaacattaaaaacgtaactaacaatttctcgcgtaataaaatcatccgcatttacaacctcgaaaaccgcgatatcgcccacgacgtcaatcgttacaacaacgatacattacgccgtat

SEQ ID NO: 24035 - DNA, 515 bp, Artificial Sequence
  chemically treated genomic DNA (Homo sapiens) CpG-island No: 24035
ttgttgatcgattaaaaaggtttgtatatcgttgattcgcgtagtaattcgtaggtagaattgattaaagatgtttacggtattgatgacgtattgcgcgcgattgtcggtgatagcgttttaggtttcggaattggcggtatgagtattaaattgtaggtcgttgacgtggtttgtcgtgcgggtatcgatattattattgtcgcgggtagtaagtcgggcgttattggtgatgtgatggaaggtattttcgtcggtacgttgttttatgtttaggcgatttcgtttgaaaatcgtaaacgttggattttcggtgcgtcgtcggcgggtgaaattacggtagatgaaggggtaattgtcgttattttggaacgcggtagttttttgttgtcgaaaggtattaaaagcgtgattggtaatttttcgcgtggtgaagttattcgtatttgtaatttcgaaggtcgcgatatcgtttacggcgttagtcgttataatagcgatgtattacgtcgtat

SEQ ID NO: 24036 - DNA, 515 bp, Artificial Sequence
  chemically treated genomic DNA (Homo sapiens) CpG-island No: 24036
atacgacgtaatacatcgctattataacgactaacgccgtaaacgatatcgcgaccttcgaaattacaaatacgaataacttcaccacgcgaaaaattaccaatcacgcttttaatacctttcgacaacaaaaaactaccgcgttccaaaataacgacaattaccccttcatctaccgtaatttcacccgccgacgacgcaccgaaaatccaacgtttacgattttcaaacgaaatcgcctaaacataaaacaacgtaccgacgaaaataccttccatcacatcaccaataacgcccgacttactacccgcgacaataataatatcgatacccgcacgacaaaccacgtcaacgacctacaatttaatactcataccgccaattccgaaacctaaaacgctatcaccgacaatcgcgcgcaatacgtcatcaataccgtaaacatctttaatcaattctacctacgaattactacgcgaatcaacgatatacaaacctttttaatcgatcaacaa

SEQ ID NO: 24037 - DNA, 519 bp, Artificial Sequence
  chemically treated genomic DNA (Homo sapiens) CpG-island No: 24037
tgtcgtggagtttaggtcgcgttagaatcggattcgggaagttgcgcgttatgagtagttttttgcggtcgggttttagtcgttggcggcgggcggttagtatcgttttggcggttggttggtcgcgttcggagatcgttatttcgtcgtcgcgttcgtcgtcggtcgagggttttcggttgttgttgttgtagcgtttttcgtattaaggttttatgtcgggcgcgtacgtttttttcggcggagtgttggatgcggtcgatcgttcggcggattggttgggttttttcgcgtcgtattacgggtcgtcgcgtttcggtttgggttcggcgttatttagtcgtatcgttttttcgtcgttgttcgatatcgatgattataagatcgataatattgggacgttgtttgaggacgtagtttttcgtatttgcgtcgtgcgggaggtttttgaggaggcgggcgtgttgttgttgcggtttaggatttttttattaggtttagtattcgggtttggtttcg

SEQ ID NO: 24038 - DNA, 519 bp, Artificial Sequence
  chemically treated genomic DNA (Homo sapiens) CpG-island No: 24038
cgaaaccaaacccgaatactaaacctaataaaaaaatcctaaaccgcaacaacaacacgcccgcctcctcaaaaacctcccgcacgacgcaaatacgaaaaactacgtcctcaaacaacgtcccaatattatcgatcttataatcatcgatatcgaacaacgacgaaaaaacgatacgactaaataacgccgaacccaaaccgaaacgcgacgacccgtaatacgacgcgaaaaaacccaaccaatccgccgaacgatcgaccgcatccaacactccgccgaaaaaaacgtacgcgcccgacataaaaccttaatacgaaaaacgctacaacaacaacaaccgaaaaccctcgaccgacgacgaacgcgacgacgaaataacgatctccgaacgcgaccaaccaaccgccaaaacgatactaaccgcccgccgccaacgactaaaacccgaccgcaaaaaactactcataacgcgcaacttcccgaatccgattctaacgcgacctaaactccacgaca

SEQ ID NO: 24039 - DNA, 519 bp, Artificial Sequence
  chemically treated genomic DNA (Homo sapiens) CpG-island No: 24039
cgaggttaggttcgggtgttgggtttggtggggaagttttgggtcgtagtagtagtacgttcgtttttttaaaggtttttcgtacggcgtagatgcggaaggttacgtttttaggtagcgttttagtgttgtcggttttgtggttatcggtgtcgggtagcgacgggaaagcggtgcggttgaatggcgtcgggtttaggtcgaagcgcggcggttcgtggtgcggcgcgaagaggtttagttagttcgtcgagcggtcggtcgtatttagtatttcgtcggagaagacgtgcgcgttcggtatgaagttttggtgcggggagcgttgtagtagtagtagtcggaagttttcggtcggcggcgggcgcgacggcggggtggcggttttcgggcgcgattagttagtcgttaggacgatgttggtcgttcgtcgttagcggttggggttcggtcgtagggagttgtttatggcgcgtagtttttcggattcgattttggcgcggtttgagttttacggta

SEQ ID NO: 24040 - DNA, 519 bp, Artificial Sequence
  chemically treated genomic DNA (Homo sapiens) CpG-island No: 24040
taccgtaaaactcaaaccgcgccaaaatcgaatccgaaaaactacgcgccataaacaactccctacgaccgaaccccaaccgctaacgacgaacgaccaacatcgtcctaacgactaactaatcgcgcccgaaaaccgccaccccgccgtcgcgcccgccgccgaccgaaaacttccgactactactactacaacgctccccgcaccaaaacttcataccgaacgcgcacgtcttctccgacgaaatactaaatacgaccgaccgctcgacgaactaactaaacctcttcgcgccgcaccacgaaccgccgcgcttcgacctaaacccgacgccattcaaccgcaccgctttcccgtcgctacccgacaccgataaccacaaaaccgacaacactaaaacgctacctaaaaacgtaaccttccgcatctacgccgtacgaaaaacctttaaaaaaacgaacgtactactactacgacccaaaacttccccaccaaacccaacacccgaacctaacctcg

SEQ ID NO: 24041 - DNA, 505 bp, Artificial Sequence
  chemically treated genomic DNA (Homo sapiens) CpG-island No: 24041
agtagtgattggtaattcgaggggttgggcgtcgtcggggttaggtgtttttgtcgcgttgcgtttacgttggtcggtgtttttaagcgttaattttatttttagtgttagttcggtttttagtttcgttttttacgttttgggtacgcgtagttgcgggcgtggggcggggttagttggagtaggaagcgtagggagtcgtttgagtttcgttttcggttgggttggattttatgattgttttgcgtatacgttattttgggaaacgacggttttttattgggttagttgtggcgcggtttcgttttacggcggagtaaggggtgggttatagggttagatcgtcgcgcgagggtggtgggtatcgaggttttagtagcggacgagggaggtgtcgtcgtcgtttaggatgggttgggaatgaagcgatgtagttttttaagtaagtgttttcgcgttggtttttttttgcgttttttttttcgcgggatggttgcgtttcggg

SEQ ID NO: 24042 - DNA, 505 bp, Artificial Sequence
  chemically treated genomic DNA (Homo sapiens) CpG-island No: 24042
cccgaaacgcaaccatcccgcgaaaaaaaaaacgcaaaaaaaaaccaacgcgaaaacacttacttaaaaaactacatcgcttcattcccaacccatcctaaacgacgacgacacctccctcgtccgctactaaaacctcgatacccaccaccctcgcgcgacgatctaaccctataacccaccccttactccgccgtaaaacgaaaccgcgccacaactaacccaataaaaaaccgtcgtttcccaaaataacgtatacgcaaaacaatcataaaatccaacccaaccgaaaacgaaactcaaacgactccctacgcttcctactccaactaaccccgccccacgcccgcaactacgcgtacccaaaacgtaaaaaacgaaactaaaaaccgaactaacactaaaaataaaattaacgcttaaaaacaccgaccaacgtaaacgcaacgcgacaaaaacacctaaccccgacgacgcccaacccctcgaattaccaatcactact

SEQ ID NO: 24043 - DNA, 505 bp, Artificial Sequence
  chemically treated genomic DNA (Homo sapiens) CpG-island No: 24043
ttcgaggcgtagttatttcgcgggaggggaggcgtaggaggaggttagcgcgaggatatttatttaaaaggttatatcgttttatttttagtttattttgggcgacggcggtatttttttcgttcgttgttgggatttcgatgtttattattttcgcgcggcgatttggttttatagtttattttttatttcgtcgtggggcggagtcgcgttatagttgatttaatgagaaatcgtcgttttttagagtgacgtgtacgtagagtaattatggagtttagtttagtcgggggcggggtttaggcggttttttacgttttttattttagttggtttcgttttacgttcgtaattgcgcgtgtttagaacgtgaggggcggggttgggagtcgggttgatattagaggtggggttagcgtttggaagtatcgattaacgtgagcgtaacgcggtagggatatttgatttcggcggcgtttagtttttcggattgttagttattgtt

SEQ ID NO: 24044 - DNA, 505 bp, Artificial Sequence
  chemically treated genomic DNA (Homo sapiens) CpG-island No: 24044
aacaataactaacaatccgaaaaactaaacgccgccgaaatcaaatatccctaccgcgttacgctcacgttaatcgatacttccaaacgctaaccccacctctaatatcaacccgactcccaaccccgcccctcacgttctaaacacgcgcaattacgaacgtaaaacgaaaccaactaaaataaaaaacgtaaaaaaccgcctaaaccccgcccccgactaaactaaactccataattactctacgtacacgtcactctaaaaaacgacgatttctcattaaatcaactataacgcgactccgccccacgacgaaataaaaaataaactataaaaccaaatcgccgcgcgaaaataataaacatcgaaatcccaacaacgaacgaaaaaaataccgccgtcgcccaaaataaactaaaaataaaacgatataaccttttaaataaatatcctcgcgctaacctcctcctacgcctcccctcccgcgaaataactacgcctcgaa

SEQ ID NO: 24045 - DNA, 578 bp, Artificial Sequence
  chemically treated genomic DNA (Homo sapiens) CpG-island No: 24045
atttttatgtcgtagttatggtcgtgttgagcgtagtaaaacgttgttcgttaaaatttcggtaggggtggatattggagatcgtattcgttttgcgggcgaaggtgaagcgggcgagtatggcgtatcggtaggcgatttgtacgtttaggtttaggttaaatagtattcgattttcgagcgtgaaggtaataatttgtattgcgaagtttcgattaatttcgttatggcggcgttgggtggcgaaatcgaagtatcgatttttgatggtcgcgttaaattgaaagtgtttggcgaaatttagatcggtaagttatttcgtatgcgcggtaaaggcgttaagtttgttcgcggtggcgtatagggtgatttgttgtgtcgcgttgtcgtcgaaatatcggtaggtttgaacgaaaggtagaaatagttgttgtaagagttgtaagaaagtttcggtggtttaatcggcgagtataatagttcgcgtttaaagagtttttttgatggtgtgaagaagttttttgacgatttgattcgttaatttttttaaaagtttgttcgtgggtaggtttgggtaa

SEQ ID NO: 24046 - DNA, 578 bp, Artificial Sequence
  chemically treated genomic DNA (Homo sapiens) CpG-island No: 24046
ttacccaaacctacccacgaacaaacttttaaaaaaattaacgaatcaaatcgtcaaaaaacttcttcacaccatcaaaaaaactctttaaacgcgaactattatactcgccgattaaaccaccgaaactttcttacaactcttacaacaactatttctacctttcgttcaaacctaccgatatttcgacgacaacgcgacacaacaaatcaccctatacgccaccgcgaacaaacttaacgcctttaccgcgcatacgaaataacttaccgatctaaatttcgccaaacactttcaatttaacgcgaccatcaaaaatcgatacttcgatttcgccacccaacgccgccataacgaaattaatcgaaacttcgcaatacaaattattaccttcacgctcgaaaatcgaatactatttaacctaaacctaaacgtacaaatcgcctaccgatacgccatactcgcccgcttcaccttcgcccgcaaaacgaatacgatctccaatatccacccctaccgaaattttaacgaacaacgttttactacgctcaacacgaccataactacgacataaaaat

SEQ ID NO: 24047 - DNA, 578 bp, Artificial Sequence
  chemically treated genomic DNA (Homo sapiens) CpG-island No: 24047
ttatttaggtttgtttacgggtaggtttttggggaggttagcgggttaggtcgttaaaaaatttttttatattattaaagaagttttttgagcgcgggttgttgtgttcgtcggttgggttatcgaagtttttttgtagtttttgtagtagttgtttttgtttttcgtttaggtttatcggtgtttcgacgataacgcggtatagtaaattattttgtgcgttatcgcggatagatttgacgtttttatcgcgtatacggaatagtttatcggtttgggtttcgttaggtatttttagtttgacgcgattattaagggtcggtatttcgatttcgttatttagcgtcgttatagcgaagttgatcgggatttcgtaatataggttgttgtttttacgttcgaaaatcgggtgttgtttaatttgaatttgaacgtatagatcgtttgtcggtgcgttatgttcgttcgttttattttcgttcgtaagacggatgcggtttttagtgtttatttttgtcgggattttaacggatagcgttttgttgcgtttaatacgattatgattgcggtatgggagt

SEQ ID NO: 24048 - DNA, 578 bp, Artificial Sequence
  chemically treated genomic DNA (Homo sapiens) CpG-island No: 24048
actcccataccgcaatcataatcgtattaaacgcaacaaaacgctatccgttaaaatcccgacaaaaataaacactaaaaaccgcatccgtcttacgaacgaaaataaaacgaacgaacataacgcaccgacaaacgatctatacgttcaaattcaaattaaacaacacccgattttcgaacgtaaaaacaacaacctatattacgaaatcccgatcaacttcgctataacgacgctaaataacgaaatcgaaataccgacccttaataatcgcgtcaaactaaaaatacctaacgaaacccaaaccgataaactattccgtatacgcgataaaaacgtcaaatctatccgcgataacgcacaaaataatttactataccgcgttatcgtcgaaacaccgataaacctaaacgaaaaacaaaaacaactactacaaaaactacaaaaaaacttcgataacccaaccgacgaacacaacaacccgcgctcaaaaaacttctttaataatataaaaaaattttttaacgacctaacccgctaacctccccaaaaacctacccgtaaacaaacctaaataa

SEQ ID NO: 24049 - DNA, 618 bp, Artificial Sequence
  chemically treated genomic DNA (Homo sapiens) CpG-island No: 24049
cgcgcgtggtaagttatagtgaggcggttttgggcggtttttaggtttacgggtcggtggttgttgcggtaggatagcgtttgtagtaggcggttttcgcgttcgtttaggttttcgtatatttgtacgtagtcgttatagtttagtcgtagttttagttgtagtagtattcgtcgggagttttgtgtgtttattagttacgtgtagtgaatgtttgagggttcgcgagcggcgtcgaataggtttggggaggtaaaggagtcgtagaagttgtttagtcgtcggtcgtacgttaagtcggggtagttcgttttattcgagtcgtcgtcgtagttttgtaagtcgttatatgcgtcgttttataggtaggtagcgcgtggagcgcgtttcgttgtatgggaaggttttttcggggtatatgttgtttggaggttcggaggcgggcgtcgagtagttgtttttattatagtcgtttttatatttcgttatcgtgttgtattgttacgggtcggggtaggtatttgtcggttgttatagcggaatttatttttttggtagggtgttggtttaacgcgggggcgagttttttgttgatagcgattttagaggatttttttg

SEQ ID NO: 24050 - DNA, 618 bp, Artificial Sequence
  chemically treated genomic DNA (Homo sapiens) CpG-island No: 24050
caaaaaaatcctctaaaatcgctatcaacaaaaaactcgcccccgcgttaaaccaacaccctaccaaaaaaataaattccgctataacaaccgacaaatacctaccccgacccgtaacaatacaacacgataacgaaatataaaaacgactataataaaaacaactactcgacgcccgcctccgaacctccaaacaacatataccccgaaaaaaccttcccatacaacgaaacgcgctccacgcgctacctacctataaaacgacgcatataacgacttacaaaactacgacgacgactcgaataaaacgaactaccccgacttaacgtacgaccgacgactaaacaacttctacgactcctttacctccccaaacctattcgacgccgctcgcgaaccctcaaacattcactacacgtaactaataaacacacaaaactcccgacgaatactactacaactaaaactacgactaaactataacgactacgtacaaatatacgaaaacctaaacgaacgcgaaaaccgcctactacaaacgctatcctaccgcaacaaccaccgacccgtaaacctaaaaaccgcccaaaaccgcctcactataacttaccacgcgcg

SEQ ID NO: 24051 - DNA, 618 bp, Artificial Sequence
  chemically treated genomic DNA (Homo sapiens) CpG-island No: 24051
tagggggattttttagagtcgttgttagtaaaaagttcgttttcgcgttgggttagtattttgttaggaagatgagtttcgttgtgataatcggtaagtgtttgtttcggttcgtggtagtgtaatacggtgacgaagtgtggagacggttgtgatgagggtaattgttcggcgttcgttttcgagtttttaggtagtatgtgtttcggggggatttttttatgtagcggggcgcgttttacgcgttgtttgtttgtggagcggcgtatgtgacggtttgtaggattgcggcgacggttcggatgaggcgggttgtttcgatttggcgtgcggtcggcggttgggtagtttttacggtttttttgtttttttagatttgttcggcgtcgttcgcgggtttttagatatttattgtacgtggttggtggatatataggattttcggcgggtgttgttgtagttggaattgcggttgggttatgacgattacgtgtaggtatacgagggtttgggcgagcgcggggatcgtttgttgtagacgttgttttatcgtagtaattatcggttcgtgagtttggaggtcgtttagggtcgttttattgtggtttattacgcgcg

SEQ ID NO: 24052 - DNA, 618 bp, Artificial Sequence
  chemically treated genomic DNA (Homo sapiens) CpG-island No: 24052
cgcgcgtaataaaccacaataaaacgaccctaaacgacctccaaactcacgaaccgataattactacgataaaacaacgtctacaacaaacgatccccgcgctcgcccaaaccctcgtatacctacacgtaatcgtcataacccaaccgcaattccaactacaacaacacccgccgaaaatcctatatatccaccaaccacgtacaataaatatctaaaaacccgcgaacgacgccgaacaaatctaaaaaaacaaaaaaaccgtaaaaactacccaaccgccgaccgcacgccaaatcgaaacaacccgcctcatccgaaccgtcgccgcaatcctacaaaccgtcacatacgccgctccacaaacaaacaacgcgtaaaacgcgccccgctacataaaaaaatccccccgaaacacatactacctaaaaactcgaaaacgaacgccgaacaattaccctcatcacaaccgtctccacacttcgtcaccgtattacactaccacgaaccgaaacaaacacttaccgattatcacaacgaaactcatcttcctaacaaaatactaacccaacgcgaaaacgaactttttactaacaacgactctaaaaaatcccccta

SEQ ID NO: 24053 - DNA, 1245 bp, Artificial Sequence
  chemically treated genomic DNA (Homo sapiens) CpG-island No: 24053
ggtcgttttggtttttttttgttgtcggttgtgttggaataggtcggttaggaattcgtcgttgaaggcggtcgggtcgatgtaggcgttgatgtcgatggacgtttcgtgttcgtagatgtcgtttagcggtttcggggcggtaggtggggcgggatgttgcgcggggttcgcgtttcggggaaagtcgaaggcggcgttgttgggcgcgtgcggggggttttgtaggtggttgtttatcgggggtcgttgtttcgtttcgtagaagtcggtcgattttatgggggagttagagttttttcgggtatggcgagtttcggcggtttttagtttgcgcggggcgtcgtttttatttattcggagattttgtttgttcgcgttcgcgtattttcgggtcgcgaatggttcggttcgcgtcggtttaatttttatattcggtaggtcgttttcgttattttataagttcggaggcggtttttttttttcggagttgatacggtttcggtttttttttggggttttagcgcgcggtcgggatgtgggtggcgaaatatgggcggtatatggttcgcgtttattaggtaagtttcggtttaatgtttaagttttttattgcggttaattatagtttcggtttttgttttaattttcggttcgcggtaggtcgtttttttttcggtaaagttgtcgggcgtttagtgtcgtcggtttgtcgggttttggtagcgcgtttaaggggttgggcgtcgcgtatttcgattttcgcgcgagtggcggtagcggcgcgggtaaggttaagaagtcggtggataagaatagtaacgagtatcgggtgcggcgcgagcgtaataatatcgcggtgcgtaagagtcgcgataaggttaagtagcgtaacgtggagacgtagtagaaggtgttggagttgattagtgataatgatcgtttgcgtaagcgggtggaatagttgagtcgcgaattggatacgttgcggggtatttttcgttagttgttagagagttttttggttaaggttatgggtaattgcgcgtgaggcgcgcggttgtgggatcgttttgggttagttttcggcgggggatttagggagtggtttggggtcgtcggatttcgaggtttgttcgagtcgtgcgagttaggattaggagatttcggtgttttttgaaagtttggtttgtttcgcgtgttttttttttttttttgcgtcgggattggtgcgtttaagatgag

SEQ ID NO: 24054 - DNA, 1245 bp, Artificial Sequence
  chemically treated genomic DNA (Homo sapiens) CpG-island No: 24054
ctcatcttaaacgcaccaatcccgacgcaaaaaaaaaaaaaaaacacgcgaaacaaaccaaactttcaaaaaacaccgaaatctcctaatcctaactcgcacgactcgaacaaacctcgaaatccgacgaccccaaaccactccctaaatcccccgccgaaaactaacccaaaacgatcccacaaccgcgcgcctcacgcgcaattacccataaccttaaccaaaaaactctctaacaactaacgaaaaataccccgcaacgtatccaattcgcgactcaactattccacccgcttacgcaaacgatcattatcactaatcaactccaacaccttctactacgtctccacgttacgctacttaaccttatcgcgactcttacgcaccgcgatattattacgctcgcgccgcacccgatactcgttactattcttatccaccgacttcttaaccttacccgcgccgctaccgccactcgcgcgaaaatcgaaatacgcgacgcccaaccccttaaacgcgctaccaaaacccgacaaaccgacgacactaaacgcccgacaactttaccgaaaaaaaaacgacctaccgcgaaccgaaaattaaaacaaaaaccgaaactataattaaccgcaataaaaaacttaaacattaaaccgaaacttacctaataaacgcgaaccatataccgcccatatttcgccacccacatcccgaccgcgcgctaaaaccccaaaaaaaaaccgaaaccgtatcaactccgaaaaaaaaaaaccgcctccgaacttataaaataacgaaaacgacctaccgaatataaaaattaaaccgacgcgaaccgaaccattcgcgacccgaaaatacgcgaacgcgaacaaacaaaatctccgaataaataaaaacgacgccccgcgcaaactaaaaaccgccgaaactcgccatacccgaaaaaactctaactcccccataaaatcgaccgacttctacgaaacgaaacaacgacccccgataaacaaccacctacaaaaccccccgcacgcgcccaacaacgccgccttcgactttccccgaaacgcgaaccccgcgcaacatcccgccccacctaccgccccgaaaccgctaaacgacatctacgaacacgaaacgtccatcgacatcaacgcctacatcgacccgaccgccttcaacgacgaattcctaaccgacctattccaacacaaccgacaacaaaaaaaaaccaaaacgacc

SEQ ID NO: 24055 - DNA, 1245 bp, Artificial Sequence
  chemically treated genomic DNA (Homo sapiens) CpG-island No: 24055
tttattttagacgtattaatttcggcgtagaggaagggaggggatacgcggagtaggttaggtttttaggaggtatcggaattttttagttttggttcgtacggttcgggtaagtttcgagattcggcgattttaaattattttttgggtttttcgtcggaggttggtttagggcggttttatagtcgcgcgttttacgcgtagttgtttatggttttgattaaggagttttttggtagttggcggaagatgtttcgtagcgtgtttagttcgcggtttagttgttttattcgtttgcgtaggcggttattgttattggttagttttagtattttttgttgcgtttttacgttgcgttgtttggttttgtcgcggtttttgcgtatcgcgatgttgttgcgttcgcgtcgtattcggtattcgttgttgtttttgtttatcgattttttggttttgttcgcgtcgttgtcgttattcgcgcggaggtcggggtgcgcggcgtttagttttttgagcgcgttgttagggttcggtaggtcggcggtattgagcgttcgataattttgtcgaaggggaaacggtttgtcgcggatcgaagattaaaataagagtcggggttatgattggtcgtaatggagaatttgggtattgagtcgaggtttgtttggtaagcgcgggttatgtgtcgtttatgtttcgttatttatatttcggtcgcgcgttaggattttagaagggggtcggggtcgtgttagtttcggaaaaagaaggtcgttttcgggtttataggatggcgaaagcggtttgtcgggtataaaagttgggtcggcgcgggtcgggttattcgcgattcggaggtgcgcgggcgcgggtaagtagggttttcgggtgggtggaggcgacgtttcgcgtaggttggaggtcgtcgaggttcgttatgttcgggagaattttaatttttttatggagtcggtcgatttttacgaggcggagtagcggttttcgatgagtagttatttgtagagtttttcgtacgcgtttagtagcgtcgttttcggtttttttcggggcgcgggtttcgcgtagtatttcgttttatttgtcgtttcggagtcgttgggcggtatttgcgagtacgagacgtttatcgatattagcgtttatatcgattcggtcgtttttaacgacgagtttttggtcgatttgttttagtatagtcggtagtaggagaaggttaaggcggtt

SEQ ID NO: 24056 - DNA, 1245 bp, Artificial Sequence
  chemically treated genomic DNA (Homo sapiens) CpG-island No: 24056
aaccgccttaaccttctcctactaccgactatactaaaacaaatcgaccaaaaactcgtcgttaaaaacgaccgaatcgatataaacgctaatatcgataaacgtctcgtactcgcaaataccgcccaacgactccgaaacgacaaataaaacgaaatactacgcgaaacccgcgccccgaaaaaaaccgaaaacgacgctactaaacgcgtacgaaaaactctacaaataactactcatcgaaaaccgctactccgcctcgtaaaaatcgaccgactccataaaaaaattaaaattctcccgaacataacgaacctcgacgacctccaacctacgcgaaacgtcgcctccacccacccgaaaaccctacttacccgcgcccgcgcacctccgaatcgcgaataacccgacccgcgccgacccaacttttatacccgacaaaccgctttcgccatcctataaacccgaaaacgaccttctttttccgaaactaacacgaccccgacccccttctaaaatcctaacgcgcgaccgaaatataaataacgaaacataaacgacacataacccgcgcttaccaaacaaacctcgactcaatacccaaattctccattacgaccaatcataaccccgactcttattttaatcttcgatccgcgacaaaccgtttccccttcgacaaaattatcgaacgctcaataccgccgacctaccgaaccctaacaacgcgctcaaaaaactaaacgccgcgcaccccgacctccgcgcgaataacgacaacgacgcgaacaaaaccaaaaaatcgataaacaaaaacaacaacgaataccgaatacgacgcgaacgcaacaacatcgcgatacgcaaaaaccgcgacaaaaccaaacaacgcaacgtaaaaacgcaacaaaaaatactaaaactaaccaataacaataaccgcctacgcaaacgaataaaacaactaaaccgcgaactaaacacgctacgaaacatcttccgccaactaccaaaaaactccttaatcaaaaccataaacaactacgcgtaaaacgcgcgactataaaaccgccctaaaccaacctccgacgaaaaacccaaaaaataatttaaaatcgccgaatctcgaaacttacccgaaccgtacgaaccaaaactaaaaaattccgatacctcctaaaaacctaacctactccgcgtatcccctcccttcctctacgccgaaattaatacgtctaaaataaa

SEQ ID NO: 24057 - DNA, 521 bp, Artificial Sequence
  chemically treated genomic DNA (Homo sapiens) CpG-island No: 24057
atgcggatcgtgatcgtcggcggttatagtgagtggcgatcgcggtaagtaggaggacggtgtcggggtgaggggtaagtgatagtattaattcgtttcgggagttttagatggttagatatatttgattgcgagcgggcgatttatataatttaggattatcgtaatgtgggatatcgtttaggcgaaagataagatggacgtttggttgtttggttcgaacgttaataaaatcgaagtggttatcgttaataacgatgcgatggtaatgggcgcggttgaagcgttgaaagtatataataagtttagtatttcggtgtttggcgtcgatgcgttgttagaagcgttggcgttggtgaaattcggtgtattggcgggtatcgtattgaacgatgttaataattaggcgaaagcgatttttgatttggcgaaaaatttggtcgatggtaaaggtgcggttgatggtattaattggaaaatcgataataaagtggttcgcgtattttatgttggcgtagata

SEQ ID NO: 24058 - DNA, 521 bp, Artificial Sequence
  chemically treated genomic DNA (Homo sapiens) CpG-island No: 24058
tatctacgccaacataaaatacgcgaaccactttattatcgattttccaattaataccatcaaccgcacctttaccatcgaccaaatttttcgccaaatcaaaaatcgctttcgcctaattattaacatcgttcaatacgatacccgccaatacaccgaatttcaccaacgccaacgcttctaacaacgcatcgacgccaaacaccgaaatactaaacttattatatactttcaacgcttcaaccgcgcccattaccatcgcatcgttattaacgataaccacttcgattttattaacgttcgaaccaaacaaccaaacgtccatcttatctttcgcctaaacgatatcccacattacgataatcctaaattatataaatcgcccgctcgcaatcaaatatatctaaccatctaaaactcccgaaacgaattaatactatcacttacccctcaccccgacaccgtcctcctacttaccgcgatcgccactcactataaccgccgacgatcacgatccgcat

SEQ ID NO: 24059 - DNA, 521 bp, Artificial Sequence
  chemically treated genomic DNA (Homo sapiens) CpG-island No: 24059
tatttacgttaatataaggtacgcggattattttgttgtcgattttttagttggtgttattagtcgtatttttattatcggttaggtttttcgttagattaaaggtcgttttcgtttggttgttagtatcgtttagtacggtgttcgttagtgtatcggattttattagcgttagcgtttttggtagcgtatcgacgttaaatatcggaatgttggatttgttgtgtgtttttagcgttttaatcgcgtttattgttatcgtatcgttgttggcgataattatttcgattttgttggcgttcgggttagatagttaggcgtttattttatttttcgtttgagcggtgttttatattgcggtggttttggattatatggatcgttcgttcgtagttaaatgtgtttagttatttagagttttcgggacgagttaatgttattatttattttttatttcgatatcgtttttttatttgtcgcggtcgttatttattgtagtcgtcgacggttacggttcgtat

SEQ ID NO: 24060 - DNA, 521 bp, Artificial Sequence
  chemically treated genomic DNA (Homo sapiens) CpG-island No: 24060
atacgaaccgtaaccgtcgacgactacaataaataacgaccgcgacaaataaaaaaacgatatcgaaataaaaaataaataataacattaactcgtcccgaaaactctaaataactaaacacatttaactacgaacgaacgatccatataatccaaaaccaccgcaatataaaacaccgctcaaacgaaaaataaaataaacgcctaactatctaacccgaacgccaacaaaatcgaaataattatcgccaacaacgatacgataacaataaacgcgattaaaacgctaaaaacacacaacaaatccaacattccgatatttaacgtcgatacgctaccaaaaacgctaacgctaataaaatccgatacactaacgaacaccgtactaaacgatactaacaaccaaacgaaaacgacctttaatctaacgaaaaacctaaccgataataaaaatacgactaataacaccaactaaaaaatcgacaacaaaataatccgcgtaccttatattaacgtaaata

SEQ ID NO: 24061 - DNA, 575 bp, Artificial Sequence
  chemically treated genomic DNA (Homo sapiens) CpG-island No: 24061
acggcgttcgttttttgtttggtaacgttttttatttcgtttgttttttcgttttatcgagttaggggttttcgtattttttttttgggcggcggttttgggtttcgagtgcggggcgggtaatatcgcgttgattgggtaggcgggacggattatagttttcggtgattttcgcgcgtcggattacgattttcgtggggtttcgcgggatttttgttttatacggaacgttcgggtcgcgtggttttgaagtcggtcgtcgggtttaggaaatgtcgtattataattttcgtcgggtttcgcggtaggtttcggaagtgcgttttagaggtttttttttcgtatacggtcgcgtttattattgtttagagattttaggaaatttagtaggtaggttttcgcgatagttttttggcgtcgcgtttttatgggtgttcgttttcggcgatggcgttatgcgcggtgcgtagacgtagcgtgacgttatataagggaaagggattagagacgttaggcggtgcggggggaggtagcggtgatttttattgagttagaagggagattttggggaagtg

SEQ ID NO: 24062 - DNA, 575 bp, Artificial Sequence
  chemically treated genomic DNA (Homo sapiens) CpG-island No: 24062
cacttccccaaaatctcccttctaactcaataaaaatcaccgctacctccccccgcaccgcctaacgtctctaatccctttcccttatataacgtcacgctacgtctacgcaccgcgcataacgccatcgccgaaaacgaacacccataaaaacgcgacgccaaaaaactatcgcgaaaacctacctactaaatttcctaaaatctctaaacaataataaacgcgaccgtatacgaaaaaaaaacctctaaaacgcacttccgaaacctaccgcgaaacccgacgaaaattataatacgacatttcctaaacccgacgaccgacttcaaaaccacgcgacccgaacgttccgtataaaacaaaaatcccgcgaaaccccacgaaaatcgtaatccgacgcgcgaaaatcaccgaaaactataatccgtcccgcctacccaatcaacgcgatattacccgccccgcactcgaaacccaaaaccgccgcccaaaaaaaaaatacgaaaacccctaactcgataaaacgaaaaaacaaacgaaataaaaaacgttaccaaacaaaaaacgaacgccgt

SEQ ID NO: 24063 - DNA, 575 bp, Artificial Sequence
  chemically treated genomic DNA (Homo sapiens) CpG-island No: 24063
tatttttttagggttttttttttgatttagtaaagattatcgttgttttttttcgtatcgtttggcgtttttgattttttttttttgtgtgacgttacgttgcgtttgcgtatcgcgtatgacgttatcgtcgggggcgagtatttatgagagcgcggcgttaggaagttatcgcgagagtttatttattaagttttttagaatttttgagtagtagtgggcgcggtcgtatgcgaaagaagggtttttgaggcgtattttcgggatttgtcgcggagttcgacggaagttgtagtgcggtattttttaggttcgacggtcgattttagggttacgcggttcgggcgtttcgtgtggagtaggagtttcgcggggttttacgggagtcgtagttcggcgcgcggggattatcgggagttgtagttcgtttcgtttgtttagttagcgcggtgttgttcgtttcgtattcggagtttagagtcgtcgtttaggaaggggatgcggaaatttttggttcggtggagcggagaggtaggcggggtgaggggcgttgttaggtaaagggcgagcgtcgt

SEQ ID NO: 24064 - DNA, 575 bp, Artificial Sequence
  chemically treated genomic DNA (Homo sapiens) CpG-island No: 24064
acgacgctcgccctttacctaacaacgcccctcaccccgcctacctctccgctccaccgaaccaaaaatttccgcatccccttcctaaacgacgactctaaactccgaatacgaaacgaacaacaccgcgctaactaaacaaacgaaacgaactacaactcccgataatccccgcgcgccgaactacgactcccgtaaaaccccgcgaaactcctactccacacgaaacgcccgaaccgcgtaaccctaaaatcgaccgtcgaacctaaaaaataccgcactacaacttccgtcgaactccgcgacaaatcccgaaaatacgcctcaaaaacccttctttcgcatacgaccgcgcccactactactcaaaaattctaaaaaacttaataaataaactctcgcgataacttcctaacgccgcgctctcataaatactcgcccccgacgataacgtcatacgcgatacgcaaacgcaacgtaacgtcacacaaaaaaaaaaaatcaaaaacgccaaacgatacgaaaaaaaacaacgataatctttactaaatcaaaaaaaaaaccctaaaaaaata

SEQ ID NO: 24065 - DNA, 678 bp, Artificial Sequence
  chemically treated genomic DNA (Homo sapiens) CpG-island No: 24065
ttttcggtcgttacggggtttacggtcgagacgttgagcgtggtcgaggcggtggtgttgtcggttgagttcgttattatgtacgtgtattggttcgtgttttgtacggtgacgttggtgaagttaagcgtgtcgttatgtaggacggagatgcgtacgcggtaggagtcgtgggttatgagggtgtcgttgggcgttagttagttgacggaggttatggaggtgttcgtgcggtatttgagttcggtagttatgttttcggtgacgttgaggttcgtgggcggttttacgatgacgggcgtatagtaggtgaaatgcgattggtttagttttttaatgtagcgttttttgaggtcggcgggcgtatgatagcgggcgtagtacgtcgtgttgttgggtatcgtttttttgagttattagtttagttagagtacgtcgtagttgtaatgttaggggttgtggttgaggtgtacgcgttcgaggcggtgtaggggcgtgaagaggtcgtggggtagcgatattaggttgttgtgggataggttgagtttttttagcgatttgaggtcgtcgaaggcgttgcgttcgatggtggttatttgggcgtgtatgagttatagtttgcgtaggttggtgagattttggaaggagttcgggcggattaggtttagtcggttgttt

SEQ ID NO: 24066 - DNA, 678 bp, Artificial Sequence
  chemically treated genomic DNA (Homo sapiens) CpG-island No: 24066
aaacaaccgactaaacctaatccgcccgaactccttccaaaatctcaccaacctacgcaaactataactcatacacgcccaaataaccaccatcgaacgcaacgccttcgacgacctcaaatcgctaaaaaaactcaacctatcccacaacaacctaatatcgctaccccacgacctcttcacgcccctacaccgcctcgaacgcgtacacctcaaccacaacccctaacattacaactacgacgtactctaactaaactaataactcaaaaaaacgatacccaacaacacgacgtactacgcccgctatcatacgcccgccgacctcaaaaaacgctacattaaaaaactaaaccaatcgcatttcacctactatacgcccgtcatcgtaaaaccgcccacgaacctcaacgtcaccgaaaacataactaccgaactcaaataccgcacgaacacctccataacctccgtcaactaactaacgcccaacgacaccctcataacccacgactcctaccgcgtacgcatctccgtcctacataacgacacgcttaacttcaccaacgtcaccgtacaaaacacgaaccaatacacgtacataataacgaactcaaccgacaacaccaccgcctcgaccacgctcaacgtctcgaccgtaaaccccgtaacgaccgaaaa

SEQ ID NO: 24067 - DNA, 678 bp, Artificial Sequence
  chemically treated genomic DNA (Homo sapiens) CpG-island No: 24067
gggtaatcggttggatttgattcgttcgggttttttttagggttttattagtttgcgtaagttgtggtttatgtacgtttaggtagttattatcgagcgtaacgttttcgacgattttaagtcgttggaggagtttaatttgttttataataatttgatgtcgttgttttacgatttttttacgtttttgtatcgtttcgagcgcgtgtattttaattataatttttggtattgtaattgcgacgtgttttggttgagttggtggtttaaggagacggtgtttagtaatacgacgtgttgcgttcgttgttatgcgttcgtcggttttaaggggcgttatattggggagttggattagtcgtattttatttgttatgcgttcgttatcgtggagtcgtttacggattttaacgttatcgagggtatggttgtcgagtttaaatgtcgtacgggtatttttatgattttcgttaattggttgacgtttaacggtatttttatgatttacggtttttatcgcgtgcgtattttcgttttgtatgacggtacgtttaattttattaacgttatcgtgtaggatacgggttagtatacgtgtatggtgacgaatttagtcggtaatattatcgtttcggttacgtttaacgtttcggtcgtggatttcgtggcggtcggggg

SEQ ID NO: 24068 - DNA, 678 bp, Artificial Sequence
  chemically treated genomic DNA (Homo sapiens) CpG-island No: 24068
cccccgaccgccacgaaatccacgaccgaaacgttaaacgtaaccgaaacgataatattaccgactaaattcgtcaccatacacgtatactaacccgtatcctacacgataacgttaataaaattaaacgtaccgtcatacaaaacgaaaatacgcacgcgataaaaaccgtaaatcataaaaataccgttaaacgtcaaccaattaacgaaaatcataaaaatacccgtacgacatttaaactcgacaaccataccctcgataacgttaaaatccgtaaacgactccacgataacgaacgcataacaaataaaatacgactaatccaactccccaatataacgccccttaaaaccgacgaacgcataacaacgaacgcaacacgtcgtattactaaacaccgtctccttaaaccaccaactcaaccaaaacacgtcgcaattacaataccaaaaattataattaaaatacacgcgctcgaaacgatacaaaaacgtaaaaaaatcgtaaaacaacgacatcaaattattataaaacaaattaaactcctccaacgacttaaaatcgtcgaaaacgttacgctcgataataactacctaaacgtacataaaccacaacttacgcaaactaataaaaccctaaaaaaaacccgaacgaatcaaatccaaccgattaccc

SEQ ID NO: 24069 - DNA, 644 bp, Artificial Sequence
  chemically treated genomic DNA (Homo sapiens) CpG-island No: 24069
tattggcggttttattgttgggcgatttgttgcgcgaagtggtatggtcgatagatgtgtttacgttggatgttgatgtaatggtggtacgcgaaattatttatcgttttagtcgtttatttttttatcgggtaatggtcgggcgacgtttgtcgtttttgaaaatcgtttcgggtttgatttggttggttttttgttcggaataagatcgtaaggaattaatcgaaatgttagtttttcgtttcggtgatgattattaattggtacgggaatcgttaaagttggaagttattttggcgcgcgcgcgtaaagagggttacggatagaattatcgcggttgggatttaggaggagaagatcgtttttatcgtcgtatcgttgcgtagtgaataacgggtgattggttgtttgaatttggtgtatatggcgagcgtaatgattattgaataggtagcggaaaagtatttttcggcgttataacgggtagtaaaatagatcgaagaaggggttgaatcgtaggttattttggtggtcggaaggcgaagcggtatgtatttacgttgatattatcgaatggcgtaaaatttttcgcggtatggtatgatagcgttcggaagagagttaatttagggtggtgaatgtga

SEQ ID NO: 24070 - DNA, 644 bp, Artificial Sequence
  chemically treated genomic DNA (Homo sapiens) CpG-island No: 24070
tcacattcaccaccctaaattaactctcttccgaacgctatcataccataccgcgaaaaattttacgccattcgataatatcaacgtaaatacataccgcttcgccttccgaccaccaaaataacctacgattcaaccccttcttcgatctattttactacccgttataacgccgaaaaatacttttccgctacctattcaataatcattacgctcgccatatacaccaaattcaaacaaccaatcacccgttattcactacgcaacgatacgacgataaaaacgatcttctcctcctaaatcccaaccgcgataattctatccgtaaccctctttacgcgcgcgcgccaaaataacttccaactttaacgattcccgtaccaattaataatcatcaccgaaacgaaaaactaacatttcgattaattccttacgatcttattccgaacaaaaaaccaaccaaatcaaacccgaaacgattttcaaaaacgacaaacgtcgcccgaccattacccgataaaaaaataaacgactaaaacgataaataatttcgcgtaccaccattacatcaacatccaacgtaaacacatctatcgaccataccacttcgcgcaacaaatcgcccaacaataaaaccgccaata

SEQ ID NO: 24071 - DNA, 644 bp, Artificial Sequence
  chemically treated genomic DNA (Homo sapiens) CpG-island No: 24071
ttatatttattattttgaattgattttttttcgggcgttattatgttatatcgcgaaaggttttgcgttattcgatggtgttaacgtaaatgtatgtcgtttcgtttttcggttattagaatagtttgcgatttaatttttttttcgatttgttttgttattcgttgtagcgtcggaagatgttttttcgttgtttgtttaatggttattgcgttcgttatatatattagatttagatagttaattattcgttgtttattgcgtagcggtacggcgatagaggcgattttttttttttggattttagtcgcggtagttttgttcgtaattttttttgcgcgcgcgcgttagaatggtttttagttttaacggttttcgtgttagttgatagttattatcggggcgggaggttaatatttcgattaattttttgcggttttgtttcgggtaaaaggttagttaggttaggttcgaggcggtttttagaagcggtaaacgtcgttcgattattgttcggtgaaaggataagcggttgaaacggtgagtggtttcgcgtattattattgtattaatatttagcgtggatatatttgtcggttatattatttcgcgtaatagatcgtttagtagtggggtcgttagtg

SEQ ID NO: 24072 - DNA, 644 bp, Artificial Sequence
  chemically treated genomic DNA (Homo sapiens) CpG-island No: 24072
cactaacgaccccactactaaacgatctattacgcgaaataatataaccgacaaatatatccacgctaaatattaatacaataataatacgcgaaaccactcaccgtttcaaccgcttatcctttcaccgaacaataatcgaacgacgtttaccgcttctaaaaaccgcctcgaacctaacctaactaaccttttacccgaaacaaaaccgcaaaaaattaatcgaaatattaacctcccgccccgataataactatcaactaacacgaaaaccgttaaaactaaaaaccattctaacgcgcgcgcgcaaaaaaaattacgaacaaaactaccgcgactaaaatccaaaaaaaaaaaatcgcctctatcgccgtaccgctacgcaataaacaacgaataattaactatctaaatctaatatatataacgaacgcaataaccattaaacaaacaacgaaaaaacatcttccgacgctacaacgaataacaaaacaaatcgaaaaaaaaattaaatcgcaaactattctaataaccgaaaaacgaaacgacatacatttacgttaacaccatcgaataacgcaaaacctttcgcgatataacataataacgcccgaaaaaaaatcaattcaaaataataaatataa

SEQ ID NO: 24073 - DNA, 1005 bp, Artificial Sequence
  chemically treated genomic DNA (Homo sapiens) CpG-island No: 24073
gggtatgtattaggatattaattgggataacgataacggtattaagtggtggatcgtcggtattcgttcgatgtataagtggacgttaattatgagtatcgtgatggaaatcggttacgataacgtcgaattttagcgtatcggcgataagaataattagtataaaattattttcgtataataatggtaggttggcgatagtatttggttacgttcggttattcgtgttttcgtaatttacgttaagtgggatgagaaatggggttacgattatatcggtaacgttgataataacgcgaatttcggtaaagtcgtttttgttgattttaacggcggtagtttcggtcgtggcgatagcgacgagtggattttcggtgtttagatggaaatttggtggtaatagtaaaattgaggtcggataaggcgtttacgtcgtattcggtaattaatgtttgatgcgacgttgtcgcgttttattaggttataaatcgtatcgaattcgtatcgggtaattgtgggttacgatggtatcgcgatagtttgtttttttttaagtagtttttcgattacgttaggatcggtaagcgtcgaggtatcgtttaggttgttggtatcgttcgtcgtaattttgcgtagaatacggcgtataattttgtcggagcgggttttaggtagggagtcggtttagtgtagtacgtttggcgtcgttagcgggttaatttttttacgtatttagttgcggatttttgcgtatagttttggtgacggttttttttcgtgattaagcgtgacgtaggcgtagatcgtttgatttttaatattgtgcggaatatttattacggcggtttcggtaattttcggatgcgttattagcgtcgatttaatttttgtcgtttttagacggtgatcggagacgtttagtacgtcgtttatacgttcggttatttagtaatagttatttttatcgcgacgcgcgtcgtcgtcgttgaaatatatatttttgaa

SEQ ID NO: 24074 - DNA, 1005 bp, Artificial Sequence
  chemically treated genomic DNA (Homo sapiens) CpG-island No: 24074
ttcaaaaatatatatttcaacgacgacgacgcgcgtcgcgataaaaataactattactaaataaccgaacgtataaacgacgtactaaacgtctccgatcaccgtctaaaaacgacaaaaattaaatcgacgctaataacgcatccgaaaattaccgaaaccgccgtaataaatattccgcacaatattaaaaatcaaacgatctacgcctacgtcacgcttaatcacgaaaaaaaaccgtcaccaaaactatacgcaaaaatccgcaactaaatacgtaaaaaaattaacccgctaacgacgccaaacgtactacactaaaccgactccctacctaaaacccgctccgacaaaattatacgccgtattctacgcaaaattacgacgaacgataccaacaacctaaacgatacctcgacgcttaccgatcctaacgtaatcgaaaaactacttaaaaaaaaacaaactatcgcgataccatcgtaacccacaattacccgatacgaattcgatacgatttataacctaataaaacgcgacaacgtcgcatcaaacattaattaccgaatacgacgtaaacgccttatccgacctcaattttactattaccaccaaatttccatctaaacaccgaaaatccactcgtcgctatcgccacgaccgaaactaccgccgttaaaatcaacaaaaacgactttaccgaaattcgcgttattatcaacgttaccgatataatcgtaaccccatttctcatcccacttaacgtaaattacgaaaacacgaataaccgaacgtaaccaaatactatcgccaacctaccattattatacgaaaataattttatactaattattcttatcgccgatacgctaaaattcgacgttatcgtaaccgatttccatcacgatactcataattaacgtccacttatacatcgaacgaataccgacgatccaccacttaataccgttatcgttatcccaattaatatcctaatacataccc

SEQ ID NO: 24075 - DNA, 1005 bp, Artificial Sequence
  chemically treated genomic DNA (Homo sapiens) CpG-island No: 24075
tttaaaaatatgtattttagcggcgacggcgcgcgtcgcgatgaagatggttattattggataatcgggcgtgtggacgacgtgttgaacgttttcggttatcgtttggggacggtagagattgagtcggcgttggtggcgtattcgaagattgtcgaagtcgtcgtagtaggtatttcgtataatattaaaggttaggcgatttacgtttacgttacgtttaattacggggaggaatcgttattagaattgtacgtagaagttcgtaattgggtgcgtaaagagattggttcgttggcgacgttagacgtgttgtattggatcgattttttgtttaaaattcgtttcggtaaaattatgcgtcgtattttgcgtaaaattgcggcgggcgatattagtaatttgggcgatatttcgacgtttgtcgattttggcgtagtcgagaagttgtttgaagagaagtaggttatcgcgatgttatcgtaatttataattgttcgatgcgagttcggtacggtttgtagtttgataagacgcgatagcgtcgtattaggtattgattgtcggatgcggcgtaaacgttttattcggttttagttttgttattattattagatttttatttgggtatcgaaggtttattcgtcgttgtcgttacgatcgaagttgtcgtcgttgaaattagtaggaacggttttgtcgaagttcgcgttgttattagcgttatcggtgtagtcgtaattttattttttattttatttggcgtaggttgcgaagatacgaatagtcgggcgtgattagatgttgtcgttagtttgttattgttgtgcgagggtaattttgtattgattgtttttgtcgtcggtgcgttgggattcgacgttgtcgtagtcgatttttattacggtgtttatgattggcgtttatttgtatatcgggcgaatatcgacggtttattatttggtgtcgttgtcgttattttagttgatattttggtatatattt

SEQ ID NO: 24076 - DNA, 1005 bp, Artificial Sequence
  chemically treated genomic DNA (Homo sapiens) CpG-island No: 24076
aaatatataccaaaatatcaactaaaataacgacaacgacaccaaataataaaccgtcgatattcgcccgatatacaaataaacgccaatcataaacaccgtaataaaaatcgactacgacaacgtcgaatcccaacgcaccgacgacaaaaacaatcaatacaaaattaccctcgcacaacaataacaaactaacgacaacatctaatcacgcccgactattcgtatcttcgcaacctacgccaaataaaataaaaaataaaattacgactacaccgataacgctaataacaacgcgaacttcgacaaaaccgttcctactaatttcaacgacgacaacttcgatcgtaacgacaacgacgaataaaccttcgatacccaaataaaaatctaataataataacaaaactaaaaccgaataaaacgtttacgccgcatccgacaatcaatacctaatacgacgctatcgcgtcttatcaaactacaaaccgtaccgaactcgcatcgaacaattataaattacgataacatcgcgataacctacttctcttcaaacaacttctcgactacgccaaaatcgacaaacgtcgaaatatcgcccaaattactaatatcgcccgccgcaattttacgcaaaatacgacgcataattttaccgaaacgaattttaaacaaaaaatcgatccaatacaacacgtctaacgtcgccaacgaaccaatctctttacgcacccaattacgaacttctacgtacaattctaataacgattcctccccgtaattaaacgtaacgtaaacgtaaatcgcctaacctttaatattatacgaaatacctactacgacgacttcgacaatcttcgaatacgccaccaacgccgactcaatctctaccgtccccaaacgataaccgaaaacgttcaacacgtcgtccacacgcccgattatccaataataaccatcttcatcgcgacgcgcgccgtcgccgctaaaatacatatttttaaa

SEQ ID NO: 24077 - DNA, 544 bp, Artificial Sequence
  chemically treated genomic DNA (Homo sapiens) CpG-island No: 24077
tagcggcgtacgcggcgttgcgtggttatggttataagagtaaaaaacgtaggtaattggcgtattatgtttgatgcgacgtttgtcgcgttttattaggtttataaaaggtgttagaatcgtaggtcggataaggcgtttacgtcgtattcggtaataagtgtttcgatgtttgatgcgacgtttgtcgcgttttattaggtttgtaaaatgtgttagaatcgcgtagggcggataaggcgtttacgtcgtattcggtaataagtaatgagtatcgagattataagttaatttagtggtttcgttagtatcggagtattcggcgattgttggcgtttatagcgaatataaagtagtaagaagatatcgtagtaaagaaagtagggggagggatcgtagttatatttgtagttcgggtcggtgataattcggaaatggggagggtattaggtacgttattgttcgtggttaatttttattttgtttgggtagtaatcgtcggggtatgtgggtgttcggcgtatataaaagaagggtttgcggg

SEQ ID NO: 24078 - DNA, 544 bp, Artificial Sequence
  chemically treated genomic DNA (Homo sapiens) CpG-island No: 24078
cccgcaaacccttcttttatatacgccgaacacccacataccccgacgattactacccaaacaaaataaaaattaaccacgaacaataacgtacctaataccctccccatttccgaattatcaccgacccgaactacaaatataactacgatccctccccctactttctttactacgatatcttcttactactttatattcgctataaacgccaacaatcgccgaatactccgatactaacgaaaccactaaattaacttataatctcgatactcattacttattaccgaatacgacgtaaacgccttatccgccctacgcgattctaacacattttacaaacctaataaaacgcgacaaacgtcgcatcaaacatcgaaacacttattaccgaatacgacgtaaacgccttatccgacctacgattctaacaccttttataaacctaataaaacgcgacaaacgtcgcatcaaacataatacgccaattacctacgttttttactcttataaccataaccacgcaacgccgcgtacgccgcta

SEQ ID NO: 24079 - DNA, 544 bp, Artificial Sequence
  chemically treated genomic DNA (Homo sapiens) CpG-island No: 24079
ttcgtaaattttttttttatatgcgtcggatatttatatgtttcgacggttgttatttaaataaggtagaagttggttacgggtaatagcgtatttggtgttttttttattttcgagttattatcgattcgggttgtaaatataattgcggtttttttttttgttttttttgttgcgatgtttttttgttgttttatgttcgttataagcgttagtaatcgtcggatatttcggtgttggcgaaattattgggttagtttatagtttcggtgtttattatttattgtcggatgcggcgtgaacgttttattcgttttacgcggttttggtatattttgtaggtttgataagacgcggtaagcgtcgtattaggtatcggagtatttattgtcggatgcggcgtgaacgttttattcggtttacggttttggtattttttgtaggtttgataagacgcggtaagcgtcgtattaggtatgatgcgttaattgtttacgttttttatttttgtggttataattacgtagcgtcgcgtacgtcgttg

SEQ ID NO: 24080 - DNA, 544 bp, Artificial Sequence
  chemically treated genomic DNA (Homo sapiens) CpG-island No: 24080
caacgacgtacgcgacgctacgtaattataaccacaaaaataaaaaacgtaaacaattaacgcatcatacctaatacgacgcttaccgcgtcttatcaaacctacaaaaaataccaaaaccgtaaaccgaataaaacgttcacgccgcatccgacaataaatactccgatacctaatacgacgcttaccgcgtcttatcaaacctacaaaatataccaaaaccgcgtaaaacgaataaaacgttcacgccgcatccgacaataaataataaacaccgaaactataaactaacccaataatttcgccaacaccgaaatatccgacgattactaacgcttataacgaacataaaacaacaaaaaaacatcgcaacaaaaaaaacaaaaaaaaaaaccgcaattatatttacaacccgaatcgataataactcgaaaataaaaaaaacaccaaatacgctattacccgtaaccaacttctaccttatttaaataacaaccgtcgaaacatataaatatccgacgcatataaaaaaaaaatttacgaa

SEQ ID NO: 24081 - DNA, 901 bp, Artificial Sequence
  chemically treated genomic DNA (Homo sapiens) CpG-island No: 24081
atttacgtttgtgtgattaattaggcggttgttatcggtggtgatgcgcgttaattggtgggttatttggtgtcgtaatcgggtttgtcgttggatattagcgtattgtaggcgtagtttcgtgaaatattgttattatatatggtatcggtggttttgttgtaatttttatagttattatttagcgttaacggtaagttggatcgtaaagttttatcgttgtttgaattgaaggtataagcgttagggcgtgcgtcgaaagcgggtagtgaaacgattatcgtcgcggtattttcgtcgttgttggggtgtgacgtgtaggatgtcgatgttgattttttcgcgtttggcggttattcgttattggtaatgaaattggtagcgtagttaagtcggtaggttgttcgttaggtgacgtcggggtaagtgatggtcgcgttaattgtcgttaaattggtaacgattattgatgttgaagaagatagtattcggcgtatgggattcgaaattattttgtcgttgcgtgaaggtaatggttcgacgttgttttgtttttattttgcgttcggttttgtttggtagtttagcgtgttttcgcgttatttcgatttataatggtcgattatcggtatttagttatcgcgttttaatggttttatgtagacggcggtaaatttggatgaagtttgcgaagcgtatttggtaacgttatttgaataataatcgtatggtttttattatttgttggggtatttttttggcggtacgttggcgtagggtattgcggcgcgattgcgtgttcgtggcgaataggtggtattttttggtttgttggatatttggtcgttagaaacgtaaaattggtaggaaaaagaagttaatggtttggattcggaagtgt

SEQ ID NO: 24082 - DNA, 901 bp, Artificial Sequence
  chemically treated genomic DNA (Homo sapiens) CpG-island No: 24082
acacttccgaatccaaaccattaacttctttttcctaccaattttacgtttctaacgaccaaatatccaacaaaccaaaaaataccacctattcgccacgaacacgcaatcgcgccgcaataccctacgccaacgtaccgccaaaaaaataccccaacaaataataaaaaccatacgattattattcaaataacgttaccaaatacgcttcgcaaacttcatccaaatttaccgccgtctacataaaaccattaaaacgcgataactaaataccgataatcgaccattataaatcgaaataacgcgaaaacacgctaaactaccaaacaaaaccgaacgcaaaataaaaacaaaacaacgtcgaaccattaccttcacgcaacgacaaaataatttcgaatcccatacgccgaatactatcttcttcaacatcaataatcgttaccaatttaacgacaattaacgcgaccatcacttaccccgacgtcacctaacgaacaacctaccgacttaactacgctaccaatttcattaccaataacgaataaccgccaaacgcgaaaaaatcaacatcgacatcctacacgtcacaccccaacaacgacgaaaataccgcgacgataatcgtttcactacccgctttcgacgcacgccctaacgcttataccttcaattcaaacaacgataaaactttacgatccaacttaccgttaacgctaaataataactataaaaattacaacaaaaccaccgataccatatataataacaatatttcacgaaactacgcctacaatacgctaatatccaacgacaaacccgattacgacaccaaataacccaccaattaacgcgcatcaccaccgataacaaccgcctaattaatcacacaaacgtaaat

SEQ ID NO: 24083 - DNA, 901 bp, Artificial Sequence
  chemically treated genomic DNA (Homo sapiens) CpG-island No: 24083
gtattttcgggtttagattattagttttttttttttgttagttttgcgtttttggcggttaggtatttagtaagttaagaaatgttatttgttcgttacgggtacgtagtcgcgtcgtaatattttgcgttagcgtatcgttaagggaatattttagtaggtaataagggttatgcggttgttgtttaagtaacgttgttagatgcgtttcgtagattttatttaggtttgtcgtcgtttgtatggggttattggggcgcggtgattgaatgtcgataatcgattattgtggatcgagataacgcgagagtacgttgaattgttaggtaaaatcggacgtaggatggaaataaaatagcgtcgggttattatttttacgtaacggtagaatggtttcgaattttatacgtcgggtgttgttttttttagtattaataatcgttgttagtttggcgatagttgacgcgattattatttgtttcggcgttatttggcgggtaatttgtcgatttaattgcgttgttagttttattgttagtagcgaatgatcgttaagcgcgaagaaattagtatcggtattttgtacgttatattttagtaacgacgagaatgtcgcggcgataatcgttttattgttcgttttcggcgtacgttttggcgtttgtgtttttagtttaggtaacggtaaggttttgcgatttagtttgtcgttggcgttaagtggtaattgtggaagttgtagtagaattatcggtattatatgtggtggtaatgttttacgaagttgcgtttgtaatgcgttggtatttaacggtaggttcgattgcgatattagatagtttattaattgacgcgtattattatcggtggtagtcgtttggttaattatataggcgtgggt

SEQ ID NO: 24084 - DNA, 901 bp, Artificial Sequence
  chemically treated genomic DNA (Homo sapiens) CpG-island No: 24084
acccacgcctatataattaaccaaacgactaccaccgataataatacgcgtcaattaataaactatctaatatcgcaatcgaacctaccgttaaataccaacgcattacaaacgcaacttcgtaaaacattaccaccacatataataccgataattctactacaacttccacaattaccacttaacgccaacgacaaactaaatcgcaaaaccttaccgttacctaaactaaaaacacaaacgccaaaacgtacgccgaaaacgaacaataaaacgattatcgccgcgacattctcgtcgttactaaaatataacgtacaaaataccgatactaatttcttcgcgcttaacgatcattcgctactaacaataaaactaacaacgcaattaaatcgacaaattacccgccaaataacgccgaaacaaataataatcgcgtcaactatcgccaaactaacaacgattattaatactaaaaaaaacaacacccgacgtataaaattcgaaaccattctaccgttacgtaaaaataataacccgacgctattttatttccatcctacgtccgattttacctaacaattcaacgtactctcgcgttatctcgatccacaataatcgattatcgacattcaatcaccgcgccccaataaccccatacaaacgacgacaaacctaaataaaatctacgaaacgcatctaacaacgttacttaaacaacaaccgcataacccttattacctactaaaatattcccttaacgatacgctaacgcaaaatattacgacgcgactacgtacccgtaacgaacaaataacatttcttaacttactaaatacctaaccgccaaaaacgcaaaactaacaaaaaaaaaaaactaataatctaaacccgaaaatac

SEQ ID NO: 24085 - DNA, 727 bp, Artificial Sequence
  chemically treated genomic DNA (Homo sapiens) CpG-island No: 24085
tttggaaggacgtcgtgttaatttacgttcgaagttatttttttcggtaattttcggcgtatggggtaaatcgatttgtgttaataacgtcgaaattttgtgtacgtttcggcgattttcgttaacggcgtggagtggtattagaatatttcgaaaagtaaagatgttggtattaagttgatgggttttttcggtcgggtgaaaaattcgggattgtgggaattgtcgttcggtattatcgtacgcgagattttcgaagattacgtcggtggtatgcgtgatggtttgaaatttaaagtttggtagttaggcggcgcggggattgattttttgatcgaagcgtattttgatttgtcgatggaattcgaaagtatcggtaaagcgggtagtcgtttgggtacggcgttggcgatggcggttgattatgagattaatatggtgtcgttggtgcgtaatttggaagagtttttcgttcgtgagttttgcggttggtgtacgtcgtgtcgcgacggtttgtcgtggagcgtgaaaattttgcgtgcgttggagcgtggtgaaggttagtcgggcgatatcgaaatatttgagtaattgtgtcgatttttaggttcgggtaaaattttttgtgtttacgtatttggtgtagtggagtcgttatagagcgttattaaatattttcgcgaagaatttgaggcgggaattaaatagtcgtttagtaatatttatt

SEQ ID NO: 24086 - DNA, 727 bp, Artificial Sequence
  chemically treated genomic DNA (Homo sapiens) CpG-island No: 24086
aataaatattactaaacgactatttaattcccgcctcaaattcttcgcgaaaatatttaataacgctctataacgactccactacaccaaatacgtaaacacaaaaaattttacccgaacctaaaaatcgacacaattactcaaatatttcgatatcgcccgactaaccttcaccacgctccaacgcacgcaaaattttcacgctccacgacaaaccgtcgcgacacgacgtacaccaaccgcaaaactcacgaacgaaaaactcttccaaattacgcaccaacgacaccatattaatctcataatcaaccgccatcgccaacgccgtacccaaacgactacccgctttaccgatactttcgaattccatcgacaaatcaaaatacgcttcgatcaaaaaatcaatccccgcgccgcctaactaccaaactttaaatttcaaaccatcacgcataccaccgacgtaatcttcgaaaatctcgcgtacgataataccgaacgacaattcccacaatcccgaatttttcacccgaccgaaaaaacccatcaacttaataccaacatctttacttttcgaaatattctaataccactccacgccgttaacgaaaatcgccgaaacgtacacaaaatttcgacgttattaacacaaatcgatttaccccatacgccgaaaattaccgaaaaaaataacttcgaacgtaaattaacacgacgtccttccaaa

SEQ ID NO: 24087 - DNA, 727 bp, Artificial Sequence
  chemically treated genomic DNA (Homo sapiens) CpG-island No: 24087
aatgggtattgttgaacggttgtttgattttcgttttaaatttttcgcggaaatatttgatggcgttttgtaacggttttattgtattaggtgcgtgggtatagaaagttttattcgggtttaagaatcgatatagttgtttaagtgtttcgatatcgttcggttgatttttattacgttttagcgtacgtagaatttttacgttttacggtagatcgtcgcggtacggcgtatattagtcgtaggatttacgggcgaaaaatttttttaggttacgtattagcgatattatgttgattttatggttaatcgttatcgttagcgtcgtatttagacggttgttcgttttatcgatattttcgaattttatcggtagattaaggtgcgtttcggttaggaagttagttttcgcgtcgtttggttgttaggttttaaattttagattattacgtatattatcggcgtaattttcgaggatttcgcgtgcggtggtgtcgaacggtagtttttatagtttcggattttttattcgatcggagaagtttattagtttggtgttagtatttttatttttcgagatgttttgatattattttacgtcgttagcgaggatcgtcggaacgtatatagggtttcgacgttgttgatataggtcggtttattttatgcgtcggaggttgtcgggaagggtggtttcgagcgtgggttagtacgacgtttttttagg

SEQ ID NO: 24088 - DNA, 727 bp, Artificial Sequence
  chemically treated genomic DNA (Homo sapiens) CpG-island No: 24088
cctaaaaaaacgtcgtactaacccacgctcgaaaccacccttcccgacaacctccgacgcataaaataaaccgacctatatcaacaacgtcgaaaccctatatacgttccgacgatcctcgctaacgacgtaaaataatatcaaaacatctcgaaaaataaaaatactaacaccaaactaataaacttctccgatcgaataaaaaatccgaaactataaaaactaccgttcgacaccaccgcacgcgaaatcctcgaaaattacgccgataatatacgtaataatctaaaatttaaaacctaacaaccaaacgacgcgaaaactaacttcctaaccgaaacgcaccttaatctaccgataaaattcgaaaatatcgataaaacgaacaaccgtctaaatacgacgctaacgataacgattaaccataaaatcaacataatatcgctaatacgtaacctaaaaaaatttttcgcccgtaaatcctacgactaatatacgccgtaccgcgacgatctaccgtaaaacgtaaaaattctacgtacgctaaaacgtaataaaaatcaaccgaacgatatcgaaacacttaaacaactatatcgattcttaaacccgaataaaactttctatacccacgcacctaatacaataaaaccgttacaaaacgccatcaaatatttccgcgaaaaatttaaaacgaaaatcaaacaaccgttcaacaatacccatt

SEQ ID NO: 24089 - DNA, 576 bp, Artificial Sequence
  chemically treated genomic DNA (Homo sapiens) CpG-island No: 24089
tatcggttagattttcgaaatttatttgggtatggttgcgaaaggtatcggcgataagattaacgttatgttgaaatagtagtaagaagtcgcgaaattgcgcgaatttatttagcgtgcgtacgatttgggcgttgacgttcgttagaaagttgatttgagtatttttagcgatgaagaagttatgcgtttggttgaaaatttgcgtaaaggtatgtttatcgtaacgtcggtgttcgacggtgcgaaagaagtagaaattaaagagttgttgaaatttggcgatttgtcgattttcggttagattcgtttgtacgatggtcgtattggtgaatagttcgagcgttcggtaatcgttggttatatgtatatgttgaaattgaattatttggtcgacgataagatgtacgcgcgttttatcggtttttatagtttggttatttagtagtcgttgggtggtaaggtatagttcggtggttagcgtttcggggagatggaagtgtgggcgttggaagtatacggcgtagtatatattttgtaggaaatgtttatcgttaagtttgatgacgtgaacgg

SEQ ID NO: 24090 - DNA, 576 bp, Artificial Sequence
  chemically treated genomic DNA (Homo sapiens) CpG-island No: 24090
ccgttcacgtcatcaaacttaacgataaacatttcctacaaaatatatactacgccgtatacttccaacgcccacacttccatctccccgaaacgctaaccaccgaactataccttaccacccaacgactactaaataaccaaactataaaaaccgataaaacgcgcgtacatcttatcgtcgaccaaataattcaatttcaacatatacatataaccaacgattaccgaacgctcgaactattcaccaatacgaccatcgtacaaacgaatctaaccgaaaatcgacaaatcgccaaatttcaacaactctttaatttctacttctttcgcaccgtcgaacaccgacgttacgataaacatacctttacgcaaattttcaaccaaacgcataacttcttcatcgctaaaaatactcaaatcaactttctaacgaacgtcaacgcccaaatcgtacgcacgctaaataaattcgcgcaatttcgcgacttcttactactatttcaacataacgttaatcttatcgccgatacctttcgcaaccatacccaaataaatttcgaaaatctaaccgata

SEQ ID NO: 24091 - DNA, 576 bp, Artificial Sequence
  chemically treated genomic DNA (Homo sapiens) CpG-island No: 24091
tcgtttacgttattagatttaacggtgagtattttttgtagggtgtatgttgcgtcgtatgtttttagcgtttatatttttattttttcgaaacgttgattatcgaattgtgttttattatttagcggttgttgagtaattaggttgtaagaatcggtggaacgcgcgtgtattttgtcgtcgattaggtggtttagttttagtatgtatatgtaattaacggttatcggacgttcgaattgtttattagtgcgattatcgtataggcggatttgatcggaagtcggtaggtcgttaagttttagtagttttttaatttttgtttttttcgtatcgtcgaatatcggcgttgcgatgggtatatttttgcgtaggtttttagttagacgtataatttttttatcgttgaaggtatttaggttaattttttgacgaacgttagcgtttagatcgtacgtacgttggatgaattcgcgtagtttcgcgattttttgttgttgttttagtatggcgttgattttgtcgtcgatatttttcgtagttatatttaggtgggtttcgaggatttgatcgatg

SEQ ID NO: 24092 - DNA, 576 bp, Artificial Sequence
  chemically treated genomic DNA (Homo sapiens) CpG-island No: 24092
catcgatcaaatcctcgaaacccacctaaatataactacgaaaaatatcgacgacaaaatcaacgccatactaaaacaacaacaaaaaatcgcgaaactacgcgaattcatccaacgtacgtacgatctaaacgctaacgttcgtcaaaaaattaacctaaataccttcaacgataaaaaaattatacgtctaactaaaaacctacgcaaaaatatacccatcgcaacgccgatattcgacgatacgaaaaaaacaaaaattaaaaaactactaaaacttaacgacctaccgacttccgatcaaatccgcctatacgataatcgcactaataaacaattcgaacgtccgataaccgttaattacatatacatactaaaactaaaccacctaatcgacgacaaaatacacgcgcgttccaccgattcttacaacctaattactcaacaaccgctaaataataaaacacaattcgataatcaacgtttcgaaaaaataaaaatataaacgctaaaaacatacgacgcaacatacaccctacaaaaaatactcaccgttaaatctaataacgtaaacga

SEQ ID NO: 24093 - DNA, 791 bp, Artificial Sequence
  chemically treated genomic DNA (Homo sapiens) CpG-island No: 24093
  misc_feature (714)..(714): n is either a, c, g or t
attttggtcgtagcgcgcgggcgatgtacgttagtttatttacgtttttacggtagatttagcgtttggaagaagatttcggttagtcgttgtttgtgcgcgataatcgtacggtgacgttgattgaagcgggcgaagagttgcgcgttttcgtttagtaaacgttgttgtagtattagtagttgcgttatattatcgattagtaagggtcgtcgttttttggcgaattatatattttttgttcggtgatcgttgtttatagttatttgtcgtcgattttggatcgttttcgcgcggaatattcgtcggtggagattaaatttattattggtgatgcggtagatgcgatggaaaaggtggttattggtgaagcggatttggcgattgcgggtaaatcggaaattttgttcggcgtagtggcgttttcgatgttggagaatttggtagtagtgttgattgttttcgcgttgttttgttcggtgcgtaattaggtgtcggtagagaagtcggattggttaacggtgtcgtttattatggtcgattaggggtcggtacgtcgtcgtattgaattgtggtttcgacgtaataaaattagtaattcgatgatttacgttacggttggcgggtatgaagcgatggtatcgatggtggtattcggttgtggcgtggtatgttgtcggaagtggtgttggaatatagtcgaaacggtgcgtnattcgtgatgatttagaacgtacgatgaaaaacgcggtggatcggcgtgtgtgttaaaaacgggtatagcgtaatgg

SEQ ID NO: 24094 - DNA, 791 bp, Artificial Sequence
  chemically treated genomic DNA (Homo sapiens) CpG-island No: 24094
  misc_feature (78)..(78): n is either a, c, g or t
ccattacgctatacccgtttttaacacacacgccgatccaccgcgtttttcatcgtacgttctaaatcatcacgaatnacgcaccgtttcgactatattccaacaccacttccgacaacataccacgccacaaccgaataccaccatcgataccatcgcttcatacccgccaaccgtaacgtaaatcatcgaattactaattttattacgtcgaaaccacaattcaatacgacgacgtaccgacccctaatcgaccataataaacgacaccgttaaccaatccgacttctctaccgacacctaattacgcaccgaacaaaacaacgcgaaaacaatcaacactactaccaaattctccaacatcgaaaacgccactacgccgaacaaaatttccgatttacccgcaatcgccaaatccgcttcaccaataaccaccttttccatcgcatctaccgcatcaccaataataaatttaatctccaccgacgaatattccgcgcgaaaacgatccaaaatcgacgacaaataactataaacaacgatcaccgaacaaaaaatatataattcgccaaaaaacgacgacccttactaatcgataatataacgcaactactaatactacaacaacgtttactaaacgaaaacgcgcaactcttcgcccgcttcaatcaacgtcaccgtacgattatcgcgcacaaacaacgactaaccgaaatcttcttccaaacgctaaatctaccgtaaaaacgtaaataaactaacgtacatcgcccgcgcgctacgaccaaaat

SEQ ID NO: 24095 - DNA, 791 bp, Artificial Sequence
  chemically treated genomic DNA (Homo sapiens) CpG-island No: 24095
  misc_feature (78)..(78): n is either a, c, g or t
ttattgcgttatattcgtttttggtatatacgtcggtttatcgcgttttttatcgtgcgttttaaattattacgggtnacgtatcgtttcggttgtgttttagtattattttcggtaatatgttacgttatagtcgagtgttattatcgatattatcgttttatgttcgttaatcgtggcgtaaattatcgggttattgattttattgcgtcgaaattatagtttaatgcggcggcgtatcggtttttgatcggttataataaacggtatcgttgattagttcggtttttttatcgatatttgattacgtatcgggtagggtagcgcgggggtaattagtattattgttagattttttagtatcgaaaacgttattgcgtcgggtaaggttttcggtttattcgtaatcgttagattcgttttattagtgattattttttttatcgtatttgtcgtattattagtagtaagtttaatttttatcgacgggtgtttcgcgcggaagcgatttagaatcggcggtagatggttgtaggtagcggttatcgagtagaagatatgtaattcgttagagagcgacggtttttgttgatcgatggtgtggcgtaattgttgatattgtaatagcgtttgttgggcgaaaacgcgtagtttttcgttcgttttagttagcgttatcgtgcggttatcgcgtataaatagcggttgatcgagatttttttttaggcgttgaatttgtcgtgagagcgtggatgggttaacgtgtatcgttcgcgcgttgcggttaaaat

SEQ ID NO: 24096 - DNA, 791 bp, Artificial Sequence
  chemically treated genomic DNA (Homo sapiens) CpG-island No: 24096
  misc_feature (714)..(714): n is either a, c, g or t
attttaaccgcaacgcgcgaacgatacacgttaacccatccacgctctcacgacaaattcaacgcctaaaaaaaaatctcgatcaaccgctatttatacgcgataaccgcacgataacgctaactaaaacgaacgaaaaactacgcgttttcgcccaacaaacgctattacaatatcaacaattacgccacaccatcgatcaacaaaaaccgtcgctctctaacgaattacatatcttctactcgataaccgctacctacaaccatctaccgccgattctaaatcgcttccgcgcgaaacacccgtcgataaaaattaaacttactactaataatacgacaaatacgataaaaaaaataatcactaataaaacgaatctaacgattacgaataaaccgaaaaccttacccgacgcaataacgttttcgatactaaaaaatctaacaataatactaattacccccgcgctaccctacccgatacgtaatcaaatatcgataaaaaaaccgaactaatcaacgataccgtttattataaccgatcaaaaaccgatacgccgccgcattaaactataatttcgacgcaataaaatcaataacccgataatttacgccacgattaacgaacataaaacgataatatcgataataacactcgactataacgtaacatattaccgaaaataatactaaaacacaaccgaaacgatacgtnacccgtaataatttaaaacgcacgataaaaaacgcgataaaccgacgtatataccaaaaacgaatataacgcaataa

SEQ ID NO: 24097 - DNA, 1314 bp, Artificial Sequence
  chemically treated genomic DNA (Homo sapiens) CpG-island No: 24097
atatttttgcgatgtaatttaattcggttgacggggagttagtaacgttgaaaatttattttttttttttttattagcggtttttttttcgataattagtacggcggatttttgtcgcggcgttgtgaacgtagtattttgattggtatcgttggtttttaggttcgttagttaaatagatttaggagtagtttagtcggtggcgttcggttttcgggtaacgttttggtttcgttggtttcggttttgtgttttaggtgattaaggatttgtttgattattatagggtttttaatgtaggcgatgatttttatggcgtcgtcgtagtcgttgtaggtttcgatgtcgatattgaaaatacgtttgagtcgttgcgtttatgttatcgacgttcgtcgttgtgttggtgttgtcggtttattagttattttgattttgttgtttttgtttcgttttgtcggcgtgattaacgttcggtgtcgattgttgggtgcgaatatttcgtggaagcgggttaggttgattttgggtttcggtattagggcggttagttttgtaatgaaatttaatggttcgaaaatgacgtgcgtggtgtcgtttcggtacggcgttttgagttggtagcgtacgttgtcgtttcgtgttaacgatagtcgtttttcggatatcgtcgggcggttgatgtatcggtatagtcgttcgagttttttgcgtttatcggttttggtcgttacgtcggcgtgtaggttggattcggttattttgttaatttcgttatcgaacggattattattggtcggtagagtttgtaaagtgaatatttttcgtttcgtttgtgaatcgatagcgatacggtaagtgatcgagtgttttagtaggggtgttatcgggtcgttatttatcgtattcgaggttagatagttgttttcgatatttcgttttagtaggttttgtcgttttagatagcgatttattcggtgggcgatggtgtgcgttagttgggtgagttttgggttggtcggcgttttgatttagcggaaacgcgttgagtcgtgggattgttcgatatatatatcgtcgagaaatagtatgtggaagtgaatatttagattgagcgtcgatttaaaacgttggattagggtgatcgcgttcgttttggttatttggtgggtatggttcgtttttttgattaggtgcgtggtaatgacgcggtaaacgatgtttagtatttattttatgatttcgggtcggttggtaaataggaaacgtagttgaaacgggaagtttaatatttattgacgtatgggttgttta

SEQ ID NO: 24098 - DNA, 1314 bp, Artificial Sequence
  chemically treated genomic DNA (Homo sapiens) CpG-island No: 24098
taaacaacccatacgtcaataaatattaaacttcccgtttcaactacgtttcctatttaccaaccgacccgaaatcataaaataaatactaaacatcgtttaccgcgtcattaccacgcacctaatcaaaaaaacgaaccatacccaccaaataaccaaaacgaacgcgatcaccctaatccaacgttttaaatcgacgctcaatctaaatattcacttccacatactatttctcgacgatatatatatcgaacaatcccacgactcaacgcgtttccgctaaatcaaaacgccgaccaacccaaaactcacccaactaacgcacaccatcgcccaccgaataaatcgctatctaaaacgacaaaacctactaaaacgaaatatcgaaaacaactatctaacctcgaatacgataaataacgacccgataacacccctactaaaacactcgatcacttaccgtatcgctatcgattcacaaacgaaacgaaaaatattcactttacaaactctaccgaccaataataatccgttcgataacgaaattaacaaaataaccgaatccaacctacacgccgacgtaacgaccaaaaccgataaacgcaaaaaactcgaacgactataccgatacatcaaccgcccgacgatatccgaaaaacgactatcgttaacacgaaacgacaacgtacgctaccaactcaaaacgccgtaccgaaacgacaccacgcacgtcattttcgaaccattaaatttcattacaaaactaaccgccctaataccgaaacccaaaatcaacctaacccgcttccacgaaatattcgcacccaacaatcgacaccgaacgttaatcacgccgacaaaacgaaacaaaaacaacaaaatcaaaataactaataaaccgacaacaccaacacaacgacgaacgtcgataacataaacgcaacgactcaaacgtattttcaatatcgacatcgaaacctacaacgactacgacgacgccataaaaatcatcgcctacattaaaaaccctataataatcaaacaaatccttaatcacctaaaacacaaaaccgaaaccaacgaaaccaaaacgttacccgaaaaccgaacgccaccgactaaactactcctaaatctatttaactaacgaacctaaaaaccaacgataccaatcaaaatactacgttcacaacgccgcgacaaaaatccgccgtactaattatcgaaaaaaaaaccgctaataaaaaaaaaaaaaataaattttcaacgttactaactccccgtcaaccgaattaaattacatcgcaaaaatat

SEQ ID NO: 24099 - DNA, 1314 bp, Artificial Sequence
  chemically treated genomic DNA (Homo sapiens) CpG-island No: 24099
tgaataatttatgcgttagtgggtgttgagtttttcgttttagttgcgttttttgtttgttagtcggttcgagattatggggtgggtgttgggtatcgtttatcgcgttattgttacgtatttggttaagaaagcgggttatatttattaagtggttaagacgggcgcggttattttgatttagcgttttggatcggcgtttaatttgaatgtttatttttatatgttgtttttcgacggtgtgtatgtcgagtaattttacggtttagcgcgttttcgttgggttaaggcgtcgattagtttagagtttatttagttgacgtatattatcgtttatcgggtgggtcgttatttggaacggtaaggtttgttggaacgggatgtcgaaaatagttatttggtttcggatgcggtggatgacgattcgatgatatttttgttggggtattcgattatttatcgtatcgttgtcggtttataggcggggcgaaaggtgtttattttgtaaattttgtcgattagtggtgattcgttcggtgacgggattggtaaggtagtcgggtttagtttgtacgtcggcgtggcggttagggtcgatgaacgtaagaagttcgaacggttgtgtcggtatattagtcgttcggcggtattcgagaagcggttgtcgttaatacgaggcggtaacgtgcgttattagtttaagacgtcgtatcgggacggtattacgtacgttattttcgaattattggattttattgtaaggttggtcgttttggtatcgaagtttagagttaatttaattcgtttttacggggtgttcgtatttaatagtcggtatcgggcgttggttacgtcggtaaaacggggtaggggtaataaggttagggtggttgatgaatcggtaatattagtataacggcgagcgtcgatgatatgggcgtaacggtttaagcgtgtttttaatatcgatatcgagatttgtagcggttgcggcggcgttatgaaagttatcgtttgtattgaagattttatagtgattaagtagatttttgattatttgaagtataaagtcgaaattagcgggattagggcgttattcgaaagtcgggcgttatcggttgagttgtttttgggtttgtttgattgacgagtttgaaggttaacgatattaattaaaatgttgcgtttatagcgtcgcggtagggattcgtcgtgttggttgtcggaaaaggagtcgttagtgggaaagaggagggtaaatttttagcgttgttggtttttcgttagtcggattgggttgtatcgtaggggtgt

SEQ ID NO: 24100 - DNA, 1314 bp, Artificial Sequence
  chemically treated genomic DNA (Homo sapiens) CpG-island No: 24100
acacccctacgatacaacccaatccgactaacgaaaaaccaacaacgctaaaaatttaccctcctctttcccactaacgactccttttccgacaaccaacacgacgaatccctaccgcgacgctataaacgcaacattttaattaatatcgttaaccttcaaactcgtcaatcaaacaaacccaaaaacaactcaaccgataacgcccgactttcgaataacgccctaatcccgctaatttcgactttatacttcaaataatcaaaaatctacttaatcactataaaatcttcaatacaaacgataactttcataacgccgccgcaaccgctacaaatctcgatatcgatattaaaaacacgcttaaaccgttacgcccatatcatcgacgctcgccgttatactaatattaccgattcatcaaccaccctaaccttattacccctaccccgttttaccgacgtaaccaacgcccgataccgactattaaatacgaacaccccgtaaaaacgaattaaattaactctaaacttcgataccaaaacgaccaaccttacaataaaatccaataattcgaaaataacgtacgtaataccgtcccgatacgacgtcttaaactaataacgcacgttaccgcctcgtattaacgacaaccgcttctcgaataccgccgaacgactaatataccgacacaaccgttcgaacttcttacgttcatcgaccctaaccgccacgccgacgtacaaactaaacccgactaccttaccaatcccgtcaccgaacgaatcaccactaatcgacaaaatttacaaaataaacacctttcgccccgcctataaaccgacaacgatacgataaataatcgaataccccaacaaaaatatcatcgaatcgtcatccaccgcatccgaaaccaaataactattttcgacatcccgttccaacaaaccttaccgttccaaataacgacccacccgataaacgataatatacgtcaactaaataaactctaaactaatcgacgccttaacccaacgaaaacgcgctaaaccgtaaaattactcgacatacacaccgtcgaaaaacaacatataaaaataaacattcaaattaaacgccgatccaaaacgctaaatcaaaataaccgcgcccgtcttaaccacttaataaatataacccgctttcttaaccaaatacgtaacaataacgcgataaacgatacccaacacccaccccataatctcgaaccgactaacaaacaaaaaacgcaactaaaacgaaaaactcaacacccactaacgcataaattattca

SEQ ID NO: 24101 - DNA, 1676 bp, Artificial Sequence
  chemically treated genomic DNA (Homo sapiens) CpG-island No: 24101
tatttcgcggtttttattgcgtgatcgagttgatcgatattcgtcgtgatacgttttatgaagtgtttgtttgcgtttgttagtcgaacgtttcgcgtatggcgtttaaatagtaggatattaaggttattttttagcgtttttatacgcgcgttgacgttcgattggttgatattaagtgttttggtcgtatgtcgaaaatttagatgttcggcgacggcgatgaattgaataagggaaatgagcggtattttgttagataggatatcgatatttacgaggtttcgatggttagtgcgtcgtatcggagcgggtttgttattagtcgtcggttagacgattggcgatttttcggtggtagttttacggagtcgaaggagtattagttttaacgaaattagtatcgttatcgtcgtggcgtaatagattacgggttacgttgtgttatcgtttaaaagtgttatcgttaatgtttcgataatgttgattattaggttttgaacgtagaagtagaacgcgatcgttgatttcgcgatgtcgtcgaattttgttaaagcgtcgttcgcggtaacggatatcgtgaagataatatcgatcgcgataatttatatcggtaggatgaaggtgaggaatgacggcgagtcgtaaagttcgtcgatttttaataggatcgtttcgtaaataagtaacgttattttacgcgttacgtattttgcgatgttttatttggcgataaaggatttcgcgaaacgggttgttacgattattataagcgcgatagtggcgaaggtaaagttgaattcgatttcggaatatttcgtttggtttatgagtatacggggagtcgtcgagaagaagacgaagaaggtgtttatatcggcgttaaagtcgatagtgtaaatttaaaaagtcggattcgcgaagatcggtaagatagatcggcgcgttttgatttgatttagagggcgggtttcgtgttatttgaaattcgtatttaggagtgcgagtatcgttagtatagttaaagtaatgaatatcgtttgttattttaagaattcgtcgattaatgtttcggcgatagggtcgagcgtaggtacgaacgttagtatcgaattgaaaaggtcgtagatgacgatatttttaggacggttggtataaacgtcgcgaatcgtcgcgaacgtcgttattagtatggtcgacgcgtttattgtttgaagtagacggaaagcgataaaggtcggtgtagttgaagattaagttgtttttagagacgtaatgacgaaagtcgttgcgttcgtaagtagaattggtcgtcgttcgattttgtttgagagcggattaaaaattatttggtttacgtcgagtattattatatagaggtttaacgtgagttggattatagcgggcgtcgtgtttaggatgtcgggtatcgttggaacgatagggagataaatatttatcgttagtgaagcgaggatgtcgaaaggagttattagtagtagtgttgtcggtagcgtataggtttacgcggggcgtgtggtggttatgacgaattaattttcgattaaggaatatcgggcgacgtttgttcgttagtaattagatgagattagttttatagagcgtcgtaataataatattggttgttgcggtttatttgtttgttgatttggaat

SEQ ID NO: 24102 - DNA, 1676 bp, Artificial Sequence
  chemically treated genomic DNA (Homo sapiens) CpG-island No: 24102
attccaaatcaacaaacaaataaaccgcaacaaccaatattattattacgacgctctataaaactaatctcatctaattactaacgaacaaacgtcgcccgatattccttaatcgaaaattaattcgtcataaccaccacacgccccgcgtaaacctatacgctaccgacaacactactactaataactcctttcgacatcctcgcttcactaacgataaatatttatctccctatcgttccaacgatacccgacatcctaaacacgacgcccgctataatccaactcacgttaaacctctatataataatactcgacgtaaaccaaataatttttaatccgctctcaaacaaaatcgaacgacgaccaattctacttacgaacgcaacgactttcgtcattacgtctctaaaaacaacttaatcttcaactacaccgacctttatcgctttccgtctacttcaaacaataaacgcgtcgaccatactaataacgacgttcgcgacgattcgcgacgtttataccaaccgtcctaaaaatatcgtcatctacgaccttttcaattcgatactaacgttcgtacctacgctcgaccctatcgccgaaacattaatcgacgaattcttaaaataacaaacgatattcattactttaactatactaacgatactcgcactcctaaatacgaatttcaaataacacgaaacccgccctctaaatcaaatcaaaacgcgccgatctatcttaccgatcttcgcgaatccgactttttaaatttacactatcgactttaacgccgatataaacaccttcttcgtcttcttctcgacgactccccgtatactcataaaccaaacgaaatattccgaaatcgaattcaactttaccttcgccactatcgcgcttataataatcgtaacaacccgtttcgcgaaatcctttatcgccaaataaaacatcgcaaaatacgtaacgcgtaaaataacgttacttatttacgaaacgatcctattaaaaatcgacgaactttacgactcgccgtcattcctcaccttcatcctaccgatataaattatcgcgatcgatattatcttcacgatatccgttaccgcgaacgacgctttaacaaaattcgacgacatcgcgaaatcaacgatcgcgttctacttctacgttcaaaacctaataatcaacattatcgaaacattaacgataacacttttaaacgataacacaacgtaacccgtaatctattacgccacgacgataacgatactaatttcgttaaaactaatactccttcgactccgtaaaactaccaccgaaaaatcgccaatcgtctaaccgacgactaataacaaacccgctccgatacgacgcactaaccatcgaaacctcgtaaatatcgatatcctatctaacaaaataccgctcatttcccttattcaattcatcgccgtcgccgaacatctaaattttcgacatacgaccaaaacacttaatatcaaccaatcgaacgtcaacgcgcgtataaaaacgctaaaaaataaccttaatatcctactatttaaacgccatacgcgaaacgttcgactaacaaacgcaaacaaacacttcataaaacgtatcacgacgaatatcgatcaactcgatcacgcaataaaaaccgcgaaata

SEQ ID NO: 24103 - DNA, 1676 bp, Artificial Sequence
  chemically treated genomic DNA (Homo sapiens) CpG-island No: 24103
attttaagttagtagataagtaagtcgtaataattagtattgttgttgcggcgttttgtaaggttagttttatttgattgttgacgagtagacgtcgttcggtattttttaatcgagggttgattcgttatgattattatacgtttcgcgtgggtttatacgttgtcggtagtattgttgttgatggtttttttcgatattttcgttttattggcgatggatatttatttttttgtcgttttagcgatgttcggtattttgaatacgacgttcgttatgatttaatttacgttgagtttttatatggtgatgttcggcgtgggttaggtgatttttggttcgtttttagatagaatcgggcgacggttaattttatttgcgggcgtaacggttttcgttattgcgtttttgggagtagtttggtttttaattgtatcggtttttgtcgtttttcgtttattttaagtagtgggcgcgtcggttatgttggtggcgacgttcgcgacggttcgcgacgtttatgttaatcgttttgagggtgtcgttatttacggtttttttagttcgatgttggcgttcgtgtttgcgttcggttttatcgtcggagtattgatcggcgagtttttgggatggtaggcgatatttattattttggttatattggcgatgttcgtatttttaaatgcgggttttaggtggtacgaaattcgttttttggattaagttaagacgcgtcgatttgttttgtcgattttcgcgagttcggttttttgggtttatattgtcggttttagcgtcggtatgggtatttttttcgtttttttttcgacggtttttcgtgtgtttataggttaagcggaatatttcgagatcggatttagttttgttttcgttattgtcgcgtttgtaatgatcgtgataattcgtttcgcgaagttttttgtcgttagatggggtatcgtaggatgcgtggcgcgtgggatggcgttgtttgtttgcggagcggttttgttggggatcggcgaattttacggttcgtcgttattttttatttttattttatcgatgtgggttgtcgcggtcggtattgtttttacggtgttcgttatcgcgaacggcgttttggtagagttcgacgatatcgcgggattagcggtcgcgttttatttttgcgtttaaagtttgatagttagtattgtcgggatattggcggtggtatttttaaacggtgatatagcgtggttcgtgatttgttacgttacggcgatggcggtattggtttcgttggggttggtgttttttcggtttcgtggggttgttatcgagaagtcgttagtcgtttaatcgacgattggtagtaggttcgtttcgatgcggcgtattaattatcgaaatttcgtgaatgtcggtattttgtttggtaggatatcgtttattttttttgtttagtttatcgtcgtcgtcgagtatttgaattttcggtatgcggttaaggtatttggtattagttagtcgagcgttagcgcgcgtgtgaaagcgttggaggataattttggtgttttgttatttgagcgttatgcgcggggcgttcggttaatagacgtaggtaggtattttatggagcgtgttacggcgggtgtcgattaattcgattacgtagtgaagatcgcggagtg

SEQ ID NO: 24104 - DNA, 1676 bp, Artificial Sequence
  chemically treated genomic DNA (Homo sapiens) CpG-island No: 24104
cactccgcgatcttcactacgtaatcgaattaatcgacacccgccgtaacacgctccataaaatacctacctacgtctattaaccgaacgccccgcgcataacgctcaaataacaaaacaccaaaattatcctccaacgctttcacacgcgcgctaacgctcgactaactaataccaaataccttaaccgcataccgaaaattcaaatactcgacgacgacgataaactaaacaaaaaaaataaacgatatcctaccaaacaaaataccgacattcacgaaatttcgataattaatacgccgcatcgaaacgaacctactaccaatcgtcgattaaacgactaacgacttctcgataacaaccccacgaaaccgaaaaaacaccaaccccaacgaaaccaataccgccatcgccgtaacgtaacaaatcacgaaccacgctatatcaccgtttaaaaataccaccgccaatatcccgacaatactaactatcaaactttaaacgcaaaaataaaacgcgaccgctaatcccgcgatatcgtcgaactctaccaaaacgccgttcgcgataacgaacaccgtaaaaacaataccgaccgcgacaacccacatcgataaaataaaaataaaaaataacgacgaaccgtaaaattcgccgatccccaacaaaaccgctccgcaaacaaacaacgccatcccacgcgccacgcatcctacgataccccatctaacgacaaaaaacttcgcgaaacgaattatcacgatcattacaaacgcgacaataacgaaaacaaaactaaatccgatctcgaaatattccgcttaacctataaacacacgaaaaaccgtcgaaaaaaaaacgaaaaaaatacccataccgacgctaaaaccgacaatataaacccaaaaaaccgaactcgcgaaaatcgacaaaacaaatcgacgcgtcttaacttaatccaaaaaacgaatttcgtaccacctaaaacccgcatttaaaaatacgaacatcgccaatataaccaaaataataaatatcgcctaccatcccaaaaactcgccgatcaatactccgacgataaaaccgaacgcaaacacgaacgccaacatcgaactaaaaaaaccgtaaataacgacaccctcaaaacgattaacataaacgtcgcgaaccgtcgcgaacgtcgccaccaacataaccgacgcgcccactacttaaaataaacgaaaaacgacaaaaaccgatacaattaaaaaccaaactactcccaaaaacgcaataacgaaaaccgttacgcccgcaaataaaattaaccgtcgcccgattctatctaaaaacgaaccaaaaatcacctaacccacgccgaacatcaccatataaaaactcaacgtaaattaaatcataacgaacgtcgtattcaaaataccgaacatcgctaaaacgacaaaaaaataaatatccatcgccaataaaacgaaaatatcgaaaaaaaccatcaacaacaatactaccgacaacgtataaacccacgcgaaacgtataataatcataacgaatcaaccctcgattaaaaaataccgaacgacgtctactcgtcaacaatcaaataaaactaaccttacaaaacgccgcaacaacaatactaattattacgacttacttatctactaacttaaaat

SEQ ID NO: 24105 - DNA, 1101 bp, Artificial Sequence
  chemically treated genomic DNA (Homo sapiens) CpG-island No: 24105
gtcgttttaattgttacgatatcgattcgttttgtacgatgtttataatttcgcggtcgagttggcggtcgatgatcggtcgttacgggataagggtgaatttatgggatttttcgattacggcgaatttgtcgttcgatagatgtacggtttcggtaaatttgtcgttgacgttttcgtcgttcgtggcggcgcggaacggtaggtttttatttaaagttatattcgattcgacgtcggttatttcgcgttttcgtaggatggcgagaaggttgcgtcggtagaagacgcggttgtttcggttgcgggtggcgtcgttttgttcgatatggtgttcgcggcgttggtttatggtttcgcggatttgttgttcgaagtcggttggcgtaaggtcggtcgtttcgtcgtggattagtcgtcggtttagttaggtcgcgtcgttcgattcgatttgtttgtttagatcgatcggggaaaggacgcgaacgttggtttgattgtttcggtcggcgttatgggcggcggtacggttgattagattatcggggatgcgttattggtcggcgtcgattcgttcgacgatatcggttcggcgtagcgtttttagtcggcgtatatgggtatcgatatagtttttatagtcgtcgtttggaacgcggtacgtataggaagaataaacgttttttttatttaagtttaatagttttggatcgtagttgattttttcgatatttttgcgatgtaatttaattcggttgacggggagttagtaacgttgaaaatttattttttttttttttattagcggtttttttttcgataattagtacggcggatttttgtcgcggcgttgtgaacgtagtattttgattggtatcgttggtttttaggttcgttagttaaatagatttaggagtagtttagtcggtggcgttcggttttcgggtaacgttttggtttcgttggtttcggttttgtgttttaggtgattaaggatggggtcgtttgcgggagagggcgaaattttacgttaaggttttggttaacgatatttttcggtaagattgatgtgtttttaggggataggagaagtcgtttgat

SEQ ID NO: 24106 - DNA, 1101 bp, Artificial Sequence
  chemically treated genomic DNA (Homo sapiens) CpG-island No: 24106
atcaaacgacttctcctatcccctaaaaacacatcaatcttaccgaaaaatatcgttaaccaaaaccttaacgtaaaatttcgccctctcccgcaaacgaccccatccttaatcacctaaaacacaaaaccgaaaccaacgaaaccaaaacgttacccgaaaaccgaacgccaccgactaaactactcctaaatctatttaactaacgaacctaaaaaccaacgataccaatcaaaatactacgttcacaacgccgcgacaaaaatccgccgtactaattatcgaaaaaaaaaccgctaataaaaaaaaaaaaaataaattttcaacgttactaactccccgtcaaccgaattaaattacatcgcaaaaatatcgaaaaaatcaactacgatccaaaactattaaacttaaataaaaaaaacgtttattcttcctatacgtaccgcgttccaaacgacgactataaaaactatatcgatacccatatacgccgactaaaaacgctacgccgaaccgatatcgtcgaacgaatcgacgccgaccaataacgcatccccgataatctaatcaaccgtaccgccgcccataacgccgaccgaaacaatcaaaccaacgttcgcgtcctttccccgatcgatctaaacaaacaaatcgaatcgaacgacgcgacctaactaaaccgacgactaatccacgacgaaacgaccgaccttacgccaaccgacttcgaacaacaaatccgcgaaaccataaaccaacgccgcgaacaccatatcgaacaaaacgacgccacccgcaaccgaaacaaccgcgtcttctaccgacgcaaccttctcgccatcctacgaaaacgcgaaataaccgacgtcgaatcgaatataactttaaataaaaacctaccgttccgcgccgccacgaacgacgaaaacgtcaacgacaaatttaccgaaaccgtacatctatcgaacgacaaattcgccgtaatcgaaaaatcccataaattcacccttatcccgtaacgaccgatcatcgaccgccaactcgaccgcgaaattataaacatcgtacaaaacgaatcgatatcgtaacaattaaaacgac

SEQ ID NO: 24107 - DNA, 1101 bp, Artificial Sequence
  chemically treated genomic DNA (Homo sapiens) CpG-island No: 24107
attaagcgattttttttattttttgggaatatattaattttatcggagaatatcgttggttaaagttttagcgtaggatttcgttttttttcgtaaacgattttatttttgattatttgaagtataaagtcgaaattagcgggattagggcgttattcgaaagtcgggcgttatcggttgagttgtttttgggtttgtttgattgacgagtttgaaggttaacgatattaattaaaatgttgcgtttatagcgtcgcggtagggattcgtcgtgttggttgtcggaaaaggagtcgttagtgggaaagaggagggtaaatttttagcgttgttggtttttcgttagtcggattgggttgtatcgtaggggtgtcgaaagagttaattgcggtttaaagttgttggatttgggtgaaaagggcgtttattttttttatacgtgtcgcgttttaggcggcgattatgagggttatgtcgatgtttatgtgcgtcggttggaggcgttacgtcgggtcggtatcgtcgagcggatcgacgtcgattaatggcgtattttcgatgatttggttagtcgtgtcgtcgtttatgacgtcggtcgagatagttaggttagcgttcgcgtttttttttcggtcgatttgaataaatagatcggatcggacggcgcgatttggttggatcggcggttgatttacggcgagacggtcgattttgcgttaatcggtttcgggtaataagttcgcgaagttatggattagcgtcgcgagtattatatcgaatagggcgacgttattcgtagtcgggatagtcgcgttttttatcggcgtaattttttcgttattttgcgggagcgcgaggtagtcggcgtcggatcggatatggttttgagtaagggtttgtcgtttcgcgtcgttacggacggcgagagcgttagcggtaagtttatcggaatcgtgtatttatcgagcggtaagttcgtcgtggtcgagaaattttatgagtttatttttgtttcgtggcggtcgattatcgatcgttaattcggtcgcgaggttatgggtatcgtgtagggcgggtcggtgtcgtggtagttagggcggt

SEQ ID NO: 24108 - DNA, 1101 bp, Artificial Sequence
  chemically treated genomic DNA (Homo sapiens) CpG-island No: 24108
accgccctaactaccacgacaccgacccgccctacacgatacccataacctcgcgaccgaattaacgatcgataatcgaccgccacgaaacaaaaataaactcataaaatttctcgaccacgacgaacttaccgctcgataaatacacgattccgataaacttaccgctaacgctctcgccgtccgtaacgacgcgaaacgacaaacccttactcaaaaccatatccgatccgacgccgactacctcgcgctcccgcaaaataacgaaaaaattacgccgataaaaaacgcgactatcccgactacgaataacgtcgccctattcgatataatactcgcgacgctaatccataacttcgcgaacttattacccgaaaccgattaacgcaaaatcgaccgtctcgccgtaaatcaaccgccgatccaaccaaatcgcgccgtccgatccgatctatttattcaaatcgaccgaaaaaaaaacgcgaacgctaacctaactatctcgaccgacgtcataaacgacgacacgactaaccaaatcatcgaaaatacgccattaatcgacgtcgatccgctcgacgataccgacccgacgtaacgcctccaaccgacgcacataaacatcgacataaccctcataatcgccgcctaaaacgcgacacgtataaaaaaaataaacgcccttttcacccaaatccaacaactttaaaccgcaattaactctttcgacacccctacgatacaacccaatccgactaacgaaaaaccaacaacgctaaaaatttaccctcctctttcccactaacgactccttttccgacaaccaacacgacgaatccctaccgcgacgctataaacgcaacattttaattaatatcgttaaccttcaaactcgtcaatcaaacaaacccaaaaacaactcaaccgataacgcccgactttcgaataacgccctaatcccgctaatttcgactttatacttcaaataatcaaaaataaaatcgtttacgaaaaaaaacgaaatcctacgctaaaactttaaccaacgatattctccgataaaattaatatattcccaaaaaataaaaaaaatcgcttaat

SEQ ID NO: 24109 - DNA, 627 bp, Artificial Sequence
  chemically treated genomic DNA (Homo sapiens) CpG-island No: 24109
taagttagagggtttaatcgtagatagaaggtaaggcgttcgcggtcgggggtttcgatttttaatatattgaataggatagcgaaggcgcgttttgttttatttggcgttgtttagtttttttcggcgttagtaattatgagtgttaaatcggtatagcgatttgttgtttcgagtcgtttaaggtcgattagattcgtgtattgaagagttttagggtttattatgaagttcggtatgtagggattattatggtaaataattatatcggtgcgtttttggtcgagtcgtatcggtagttttcgttcgatacgagttaaaagatcgagttgcggcgtatttttgttttcgttcggtaagaagtcgggattgacggtattgcgggatattatattaacggcgcgttcgaatattcgcgatagtttgcgtttaaacggatattgattaatcgataggttgtgaatagcgttaagttgttgttttattgacggttacgttttgagtaaattcgttttagatagattagtcgtcggtattttcggaattgtcgttattattaagtatgtatttttttgttttttttgttagttgattatttcggggtaagttatatttcgatttttgagt

SEQ ID NO: 24110 - DNA, 627 bp, Artificial Sequence
  chemically treated genomic DNA (Homo sapiens) CpG-island No: 24110
actcaaaaatcgaaatataacttaccccgaaataatcaactaacaaaaaaaacaaaaaaatacatacttaataataacgacaattccgaaaataccgacgactaatctatctaaaacgaatttactcaaaacgtaaccgtcaataaaacaacaacttaacgctattcacaacctatcgattaatcaatatccgtttaaacgcaaactatcgcgaatattcgaacgcgccgttaatataatatcccgcaataccgtcaatcccgacttcttaccgaacgaaaacaaaaatacgccgcaactcgatcttttaactcgtatcgaacgaaaactaccgatacgactcgaccaaaaacgcaccgatataattatttaccataataatccctacataccgaacttcataataaaccctaaaactcttcaatacacgaatctaatcgaccttaaacgactcgaaacaacaaatcgctataccgatttaacactcataattactaacgccgaaaaaaactaaacaacgccaaataaaacaaaacgcgccttcgctatcctattcaatatattaaaaatcgaaacccccgaccgcgaacgccttaccttctatctacgattaaaccctctaactta

SEQ ID NO: 24111 - DNA, 627 bp, Artificial Sequence
  chemically treated genomic DNA (Homo sapiens) CpG-island No: 24111
gtttaaaggtcgaggtgtggtttgtttcgaggtgattaattggtaggaggaataggagggtgtatgtttggtgataacggtaatttcgggagtatcggcggttgatttgtttggagcggatttgtttaaagcgtggtcgttaatggggtagtaatttggcgttgtttatagtttatcggttgattaatgttcgtttgagcgtaggttgtcgcgaatgttcggacgcgtcgttgatgtggtgtttcgtaatgtcgttaatttcgattttttatcggacgaggataagagtacgtcgtagttcgattttttggttcgtgtcgaacgagagttatcggtgcggttcgattaagagcgtatcgatatggttgtttgttatggtgatttttgtatgtcgaattttatggtggattttaaaattttttaatgtacgggtttgatcgattttgggcggttcggaatagtagatcgttatgtcgatttggtatttatgattgttaacgtcgaagagaattgggtagcgttagatgaagtagagcgcgttttcgttgttttatttaatgtattggggatcgaagttttcgatcgcgaacgttttgttttttatttgcgattggattttttgatttg

SEQ ID NO: 24112 - DNA, 627 bp, Artificial Sequence
  chemically treated genomic DNA (Homo sapiens) CpG-island No: 24112
caaatcaaaaaatccaatcgcaaataaaaaacaaaacgttcgcgatcgaaaacttcgatccccaatacattaaataaaacaacgaaaacgcgctctacttcatctaacgctacccaattctcttcgacgttaacaatcataaataccaaatcgacataacgatctactattccgaaccgcccaaaatcgatcaaacccgtacattaaaaaattttaaaatccaccataaaattcgacatacaaaaatcaccataacaaacaaccatatcgatacgctcttaatcgaaccgcaccgataactctcgttcgacacgaaccaaaaaatcgaactacgacgtactcttatcctcgtccgataaaaaatcgaaattaacgacattacgaaacaccacatcaacgacgcgtccgaacattcgcgacaacctacgctcaaacgaacattaatcaaccgataaactataaacaacgccaaattactaccccattaacgaccacgctttaaacaaatccgctccaaacaaatcaaccgccgatactcccgaaattaccgttatcaccaaacatacaccctcctattcctcctaccaattaatcacctcgaaacaaaccacacctcgacctttaaac

SEQ ID NO: 24113 - DNA, 516 bp, Artificial Sequence
  chemically treated genomic DNA (Homo sapiens) CpG-island No: 24113
gagttcgtttttgggatcgatatatcggtagagagtgacgcgttcgatgtcgagttttttgtagagatcggaaattgaagtatcgcgttgggttatggcggtttgcgcgagacgtatttgagttttggtgagcgcgaattttcgttcgtttttgcgatcgcgcgttttcgcggaggcgagattcgttatggtgcgttttcggattagatttcgttcgaattcggttaaggtggcgaagatttcgaatattatgcgatcggacgtagtcgtggtgtcgatttgagcgttttttttagttagaattcgtaggtcgattttgcggtttgatagtttttttatcgtgttgattagatgggtaagcgatcgttcgaggcgatcgagtttttagattattagtatatcgtcgttacgtaatgatttgaggtaggtagttaagttagggcgattattacgatcgtcggaagtaagattattatagatattgtttcgtttgttaacggcgattgaaaattgata

SEQ ID NO: 24114 - DNA, 516 bp, Artificial Sequence
  chemically treated genomic DNA (Homo sapiens) CpG-island No: 24114
tatcaattttcaatcgccgttaacaaacgaaacaatatctataataatcttacttccgacgatcgtaataatcgccctaacttaactacctacctcaaatcattacgtaacgacgatatactaataatctaaaaactcgatcgcctcgaacgatcgcttacccatctaatcaacacgataaaaaaactatcaaaccgcaaaatcgacctacgaattctaactaaaaaaaacgctcaaatcgacaccacgactacgtccgatcgcataatattcgaaatcttcgccaccttaaccgaattcgaacgaaatctaatccgaaaacgcaccataacgaatctcgcctccgcgaaaacgcgcgatcgcaaaaacgaacgaaaattcgcgctcaccaaaactcaaatacgtctcgcgcaaaccgccataacccaacgcgatacttcaatttccgatctctacaaaaaactcgacatcgaacgcgtcactctctaccgatatatcgatcccaaaaacgaactc

SEQ ID NO: 24115 - DNA, 516 bp, Artificial Sequence
  chemically treated genomic DNA (Homo sapiens) CpG-island No: 24115
tattagtttttaatcgtcgttgataaacgggataatatttatgatgattttgttttcggcggtcgtgatgatcgttttggtttgattgtttgttttaagttattgcgtgacggcgatgtgttggtggtttggaagttcgatcgtttcggacgatcgtttgtttatttggttaatacggtgaaggagttgttagatcgtaagatcggtttgcgggttttgattggaaagggcgtttagatcgatattacgattgcgttcggtcgtatggtgttcggaattttcgttattttggtcgagttcgagcgggatttgattcgagagcgtattatggcgggtttcgttttcgcgagagcgcgcggtcgtaagggcggacgaaaattcgcgtttattaaagtttaggtgcgtttcgcgtaagtcgttatggtttagcgcgatattttagttttcgatttttgtaaggaattcggtatcgagcgcgttattttttatcgatatgtcggttttaaaggcgagttt

SEQ ID NO: 24116 - DNA, 516 bp, Artificial Sequence
  chemically treated genomic DNA (Homo sapiens) CpG-island No: 24116
aaactcgcctttaaaaccgacatatcgataaaaaataacgcgctcgataccgaattccttacaaaaatcgaaaactaaaatatcgcgctaaaccataacgacttacgcgaaacgcacctaaactttaataaacgcgaattttcgtccgcccttacgaccgcgcgctctcgcgaaaacgaaacccgccataatacgctctcgaatcaaatcccgctcgaactcgaccaaaataacgaaaattccgaacaccatacgaccgaacgcaatcgtaatatcgatctaaacgccctttccaatcaaaacccgcaaaccgatcttacgatctaacaactccttcaccgtattaaccaaataaacaaacgatcgtccgaaacgatcgaacttccaaaccaccaacacatcgccgtcacgcaataacttaaaacaaacaatcaaaccaaaacgatcatcacgaccgccgaaaacaaaatcatcataaatattatcccgtttatcaacgacgattaaaaactaata

SEQ ID NO: 24117 - DNA, 1542 bp, Artificial Sequence
  chemically treated genomic DNA (Homo sapiens) CpG-island No: 24117
cgagcggcgaaatatgggttaagagatcgggcgatagtagttttttatcgcgtttttggtttgtaacgatttcgtcgagttttatggtgttttagaagatgatgatggcggcgagtagatttatgtcggcgatgcggtaatgttggttttcggcggaacggtcgcggattttatcgcggcggtggaagttgattgttcgttttagcgtatgatgagtttcgtttttgttgagttcgatttgggtacgtcgttggagttcggtatttagaatttagtcgattatgaatagggtgcgttcgacgcgatcgatttttcgtagggttgtcgcgagttcgttttgtcgcggataggaggcgagttttcgtagaatttggtttggcgcgacggtttcggtagtaatggtggcggcgatgcgtaggatgtcgggttaattgcgttcgattatggtttggttgattttttcgtcgattaacgttcgtaggtgcgtcggggcggtcgacggattgaacgcgtagagtcgtttggatggtaggtcgcggatgcgcggagcgaatcggtagtcgagaatggtatatgcggtaaagacgtgatcggtgaagtcgttcgtgtcggtgaattgttcgcggatattgcgtttagtatcgtttattagtaggttatcgaggatgtaaggcgtttcgtttgtcgttgtaggaattatttgggttgcgaacggcgtatattggtcggagacgtggttataggtttttaggttcggggtattgttatatttcgcgttgattaggtttatggttttattttgttttgtagcgacgaagaattgttcgtcgttcgaagtcgacgtgtttatgttttagaatcgggttatgggtaacgttgtttgtgtttcgattattatggttagcgttcggttataggtttcgttttcgatatgttatcgtttaatgcggattaatttttagaaggtgtgggtgtttgtcgtattcgttattttgcgtaagtcgaggttgatttttttcgttaagataacgtttattagttcgattcggttagcgtagggtgtttttgtgcgtagatgggtgaacgtttcggtgaagtcggtcgtcgtatttatttttagtaggagatcggtgatgcgcgtgggcgggatttgtttgtagagatcgagtattagattttcggcgtttgtcggcgcggcggtttcgagtttttcgatatgtagaacgtcgtttttaatcgattcgttcgggatcgtgtttgcgcgagcggtacggttaagttcgcgtaatcgtatgtcgaggcgagtttgtcggtttgttagttattttttcggtcgtaatggtatagcgagacgatcgtttttcgcgatggattgtgtcggaacgagtgcgtgttttagatcgttatagcgtcgggatttagtaagttagatattttcggagcggaacgtatggttttgtcgtaaattttttaggttaattcgatgttgattatggggagagaagttgtcgtttttgatattgcggagcgagtcgatgattt

SEQ ID NO: 24118 - DNA, 1542 bp, Artificial Sequence
  chemically treated genomic DNA (Homo sapiens) CpG-island No: 24118
aaatcatcgactcgctccgcaatatcaaaaacgacaacttctctccccataatcaacatcgaattaacctaaaaaatttacgacaaaaccatacgttccgctccgaaaatatctaacttactaaatcccgacgctataacgatctaaaacacgcactcgttccgacacaatccatcgcgaaaaacgatcgtctcgctataccattacgaccgaaaaaataactaacaaaccgacaaactcgcctcgacatacgattacgcgaacttaaccgtaccgctcgcgcaaacacgatcccgaacgaatcgattaaaaacgacgttctacatatcgaaaaactcgaaaccgccgcgccgacaaacgccgaaaatctaatactcgatctctacaaacaaatcccgcccacgcgcatcaccgatctcctactaaaaataaatacgacgaccgacttcaccgaaacgttcacccatctacgcacaaaaacaccctacgctaaccgaatcgaactaataaacgttatcttaacgaaaaaaatcaacctcgacttacgcaaaataacgaatacgacaaacacccacaccttctaaaaattaatccgcattaaacgataacatatcgaaaacgaaacctataaccgaacgctaaccataataatcgaaacacaaacaacgttacccataacccgattctaaaacataaacacgtcgacttcgaacgacgaacaattcttcgtcgctacaaaacaaaataaaaccataaacctaatcaacgcgaaatataacaataccccgaacctaaaaacctataaccacgtctccgaccaatatacgccgttcgcaacccaaataattcctacaacgacaaacgaaacgccttacatcctcgataacctactaataaacgatactaaacgcaatatccgcgaacaattcaccgacacgaacgacttcaccgatcacgtctttaccgcatataccattctcgactaccgattcgctccgcgcatccgcgacctaccatccaaacgactctacgcgttcaatccgtcgaccgccccgacgcacctacgaacgttaatcgacgaaaaaatcaaccaaaccataatcgaacgcaattaacccgacatcctacgcatcgccgccaccattactaccgaaaccgtcgcgccaaaccaaattctacgaaaactcgcctcctatccgcgacaaaacgaactcgcgacaaccctacgaaaaatcgatcgcgtcgaacgcaccctattcataatcgactaaattctaaataccgaactccaacgacgtacccaaatcgaactcaacaaaaacgaaactcatcatacgctaaaacgaacaatcaacttccaccgccgcgataaaatccgcgaccgttccgccgaaaaccaacattaccgcatcgccgacataaatctactcgccgccatcatcatcttctaaaacaccataaaactcgacgaaatcgttacaaaccaaaaacgcgataaaaaactactatcgcccgatctcttaacccatatttcgccgctcg

SEQ ID NO: 24119 - DNA, 1542 bp, Artificial Sequence
  chemically treated genomic DNA (Homo sapiens) CpG-island No: 24119
aaattatcggttcgtttcgtaatattaggagcggtaatttttttttttatggttaatatcgagttaatttgaagaatttgcgataaggttatgcgtttcgtttcggagatgtttggtttattaggtttcggcgttatggcgatttgaaatacgtattcgtttcggtataatttatcgcggaaggcggtcgtttcgttgtgttattgcggtcggaggaatggttggtagatcggtaagttcgtttcgatatgcggttgcgcgagtttggtcgtgtcgttcgcgtaggtacgatttcgggcgggtcgattgaaaacggcgttttgtatatcgagaaattcgaagtcgtcgcgtcgataggcgtcgaagatttggtgttcgatttttataagtagatttcgtttacgcgtattatcgattttttgttggaggtggatgcggcgatcggttttatcgaagcgtttatttatttgcgtataggagtattttgcgttgatcggatcgggttaatgaacgttattttggcggaagggattaatttcggtttgcgtaaaatggcggatgcgataaatatttatattttttgggaattgattcgtattggacggtggtatgtcgagggcgaagtttatgatcgggcgttggttatggtggtcgaggtataggtagcgttatttatggttcggttttggggtatgggtacgtcggtttcgagcgacggatagtttttcgtcgttatagagtaaggtgaggttatgaatttggttaacgcgaaatatggtaatatttcgggtttgaaagtttatagttacgttttcgattaatatgcgtcgttcgtaatttaggtgatttttgtaacggtaagcgaagcgttttatattttcgatggtttgttgatgaacgatgttggacgtaatattcgcgagtagtttatcgatacgggcggttttatcgattacgtttttgtcgtatgtgttattttcggttatcggttcgtttcgcgtattcgcgatttgttatttaaacggttttacgcgtttaattcgtcggtcgtttcggcgtatttgcgagcgttgatcggcggaaaggttaattaagttatgatcgagcgtaattggttcgatattttgcgtatcgtcgttattattgttgtcgggatcgtcgcgttaagttagattttgcggaaattcgttttttattcgcggtagaacgagttcgcgatagttttgcgggaagtcggtcgcgtcgagcgtattttgtttatgatcgattggattttggatgtcgaattttaacggcgtgtttagatcgggtttaataaaggcgaagtttattatgcgttgaagcgggtaattagtttttatcgtcgcggtgaaattcgcgatcgtttcgtcgaaggttagtattatcgtatcgtcggtatgaatttgttcgtcgttattattattttttggaatattatgaagttcggcgaggtcgttgtaaattagaaacgcgatggaaagttgttatcgttcgattttttggtttatgtttcgtcgttcg

SEQ ID NO: 24120 - DNA, 1542 bp, Artificial Sequence
  chemically treated genomic DNA (Homo sapiens) CpG-island No: 24120
cgaacgacgaaacataaaccaaaaaatcgaacgataacaactttccatcgcgtttctaatttacaacgacctcgccgaacttcataatattccaaaaaataataataacgacgaacaaattcataccgacgatacgataatactaaccttcgacgaaacgatcgcgaatttcaccgcgacgataaaaactaattacccgcttcaacgcataataaacttcgcctttattaaacccgatctaaacacgccgttaaaattcgacatccaaaatccaatcgatcataaacaaaatacgctcgacgcgaccgacttcccgcaaaactatcgcgaactcgttctaccgcgaataaaaaacgaatttccgcaaaatctaacttaacgcgacgatcccgacaacaataataacgacgatacgcaaaatatcgaaccaattacgctcgatcataacttaattaacctttccgccgatcaacgctcgcaaatacgccgaaacgaccgacgaattaaacgcgtaaaaccgtttaaataacaaatcgcgaatacgcgaaacgaaccgataaccgaaaataacacatacgacaaaaacgtaatcgataaaaccgcccgtatcgataaactactcgcgaatattacgtccaacatcgttcatcaacaaaccatcgaaaatataaaacgcttcgcttaccgttacaaaaatcacctaaattacgaacgacgcatattaatcgaaaacgtaactataaactttcaaacccgaaatattaccatatttcgcgttaaccaaattcataacctcaccttactctataacgacgaaaaactatccgtcgctcgaaaccgacgtacccataccccaaaaccgaaccataaataacgctacctatacctcgaccaccataaccaacgcccgatcataaacttcgccctcgacataccaccgtccaatacgaatcaattcccaaaaaatataaatatttatcgcatccgccattttacgcaaaccgaaattaatcccttccgccaaaataacgttcattaacccgatccgatcaacgcaaaatactcctatacgcaaataaataaacgcttcgataaaaccgatcgccgcatccacctccaacaaaaaatcgataatacgcgtaaacgaaatctacttataaaaatcgaacaccaaatcttcgacgcctatcgacgcgacgacttcgaatttctcgatatacaaaacgccgttttcaatcgacccgcccgaaatcgtacctacgcgaacgacacgaccaaactcgcgcaaccgcatatcgaaacgaacttaccgatctaccaaccattcctccgaccgcaataacacaacgaaacgaccgccttccgcgataaattataccgaaacgaatacgtatttcaaatcgccataacgccgaaacctaataaaccaaacatctccgaaacgaaacgcataaccttatcgcaaattcttcaaattaactcgatattaaccataaaaaaaaaaattaccgctcctaatattacgaaacgaaccgataattt

SEQ ID NO: 24121 - DNA, 725 bp, Artificial Sequence
  chemically treated genomic DNA (Homo sapiens) CpG-island No: 24121
gcgttagtcgaaggatgattttaagggtaggtatttcgaggtttggttgattgtataggcggttgtttggtatttgcgttattcgtttagttatcgtgatttggaagagatgtttcgcgagcggggtttcgaggtcgattatagtacgattaatcgttgggtattggtttatgtatttgttatcgagaaacggttgcggtagtttcgtcgattttattgcggttcggttcggattgatgagatttatgttaagattcgcggtaaatggcgttatttgtatcgagttatcgataagtatggtaattcggtggattttttgttgatcgttaagcgcgatttcgacgttgttaagcggttttttcgaaagatgtttaaagatgaatttttgttgtcgtcgaataggattgggacggacggggttaatattttttcgttaacgattaaaacgtcggttgatgatgggtttttttatttcgatttcgtgtattatgtgattaaatatttttagtaggggattgagagcgattattttcgggtgaagaagaatatgtcgaagatcggcggtttttaattttttaatacggcgcggcgaattatcgcgggtttcgaggcgatgttgtggttgcggaagggttttggttttttaggcggttggatcgttaatgattagaatgatttgtttgcgcgttttttcggattgtaaaaggttaataaagtatgaaaat

SEQ ID NO: 24122 - DNA, 725 bp, Artificial Sequence
  chemically treated genomic DNA (Homo sapiens) CpG-island No: 24122
attttcatactttattaaccttttacaatccgaaaaaacgcgcaaacaaatcattctaatcattaacgatccaaccgcctaaaaaaccaaaacccttccgcaaccacaacatcgcctcgaaacccgcgataattcgccgcgccgtattaaaaaattaaaaaccgccgatcttcgacatattcttcttcacccgaaaataatcgctctcaatcccctactaaaaatatttaatcacataatacacgaaatcgaaataaaaaaacccatcatcaaccgacgttttaatcgttaacgaaaaaatattaaccccgtccgtcccaatcctattcgacgacaacaaaaattcatctttaaacatctttcgaaaaaaccgcttaacaacgtcgaaatcgcgcttaacgatcaacaaaaaatccaccgaattaccatacttatcgataactcgatacaaataacgccatttaccgcgaatcttaacataaatctcatcaatccgaaccgaaccgcaataaaatcgacgaaactaccgcaaccgtttctcgataacaaatacataaaccaatacccaacgattaatcgtactataatcgacctcgaaaccccgctcgcgaaacatctcttccaaatcacgataactaaacgaataacgcaaataccaaacaaccgcctatacaatcaaccaaacctcgaaatacctacccttaaaatcatccttcgactaacgc

SEQ ID NO: 24123 - DNA, 725 bp, Artificial Sequence
  chemically treated genomic DNA (Homo sapiens) CpG-island No: 24123
atttttatgttttgttaattttttgtagttcgaagaggcgcgtaagtaaattattttggttattgacggtttagtcgtttgaaaagttaaagttttttcgtagttatagtatcgtttcgaaattcgcgatggttcgtcgcgtcgtgttaaaggattggaaatcgtcgattttcggtatgtttttttttattcggaaatggtcgtttttaattttttgttggagatgtttggttatataatgtacgggatcgggatggagaagtttattattaatcgacgttttgatcgttgacgggaaggtgttggtttcgttcgttttaattttgttcggcgataataagggtttatttttaagtatttttcggaagaatcgtttggtagcgtcgagatcgcgtttagcggttagtaggaaatttatcggattgttatgtttatcgatggttcggtatagatagcgttatttgtcgcggattttgatataggttttattaattcggatcgagtcgtaatggggtcgacgaaattgtcgtagtcgtttttcgatgataggtgtataagttaatatttagcggttgatcgtgttatgatcgatttcgaagtttcgttcgcgaaatattttttttaagttacgatagttgagcgggtagcgtaagtattaggtaatcgtttgtataattagttaggtttcgaaatgtttgtttttgaaattatttttcgattggcgt

SEQ ID NO: 24124 - DNA, 725 bp, Artificial Sequence
  chemically treated genomic DNA (Homo sapiens) CpG-island No: 24124
acgccaatcgaaaaataatttcaaaaacaaacatttcgaaacctaactaattatacaaacgattacctaatacttacgctacccgctcaactatcgtaacttaaaaaaaatatttcgcgaacgaaacttcgaaatcgatcataacacgatcaaccgctaaatattaacttatacacctatcatcgaaaaacgactacgacaatttcgtcgaccccattacgactcgatccgaattaataaaacctatatcaaaatccgcgacaaataacgctatctataccgaaccatcgataaacataacaatccgataaatttcctactaaccgctaaacgcgatctcgacgctaccaaacgattcttccgaaaaatacttaaaaataaacccttattatcgccgaacaaaattaaaacgaacgaaaccaacaccttcccgtcaacgatcaaaacgtcgattaataataaacttctccatcccgatcccgtacattatataaccaaacatctccaacaaaaaattaaaaacgaccatttccgaataaaaaaaaacataccgaaaatcgacgatttccaatcctttaacacgacgcgacgaaccatcgcgaatttcgaaacgatactataactacgaaaaaactttaacttttcaaacgactaaaccgtcaataaccaaaataatttacttacgcgcctcttcgaactacaaaaaattaacaaaacataaaaat

SEQ ID NO: 24125 - DNA, 980 bp, Artificial Sequence
  chemically treated genomic DNA (Homo sapiens) CpG-island No: 24125
gatacgttcggaataatttagttattgtatttatgtttcgagttggtgtggtttgcggatcgtatgtcggtatttcgttgcgtaagatttgtatttaatcggtaggtacgggcggcgatttttaatttgcgggattagttagattattcgagtgcgtgggtatgataatcgtgttttggggattaatataatttagaagggtttgaattattgcgatcggttttttcgcgatttagtcgagcgagtttagcgaattgtggacgagaattgtgttattaagcgtaaggtcgttttttcgtatttgttttgttaggttcgcgcgagttgttggttgaggcgttttcgaaattagtttttgttcggtcggtatttattttatttttttgttttcggacgagtgttggggcgtcggtttttattatcggcgagtatttttatatagttatcggtttagacggtcgcgtttttgcgggcgatttgtgtacgttcgatagtttcggtttcggatcggacgattgcgtcgtatcgattttgcgtttaagttgtattatcgaaattgtcgttaattaagttttgatagagttggttaagattaatgcggagtatatacgttcggagtcgcggcgattttgtaagtttcggatgttttcgttcgaagtagcgcgtttgttgttttatataagttaattacggtttttagaagaagatgttggcgatttcgtattgggaattttcgaatatcgtttcgttttagttaatgatcgttgttatgcggttattgttcgttaggatattgttggagtcgaaattcgcgtgtacgaggtgtcggatttcggggtagttttcggtttaaagtattagtttatcgagagtttgcgcgacggacgtattgacggtgtcgtttattatagtttgttagtgatatatatggggattagtaatcgcgtatatgaaattacgttatgtagtgtattgatcga

SEQ ID NO: 24126 - DNA, 980 bp, Artificial Sequence
  chemically treated genomic DNA (Homo sapiens) CpG-island No: 24126
tcgatcaatacactacataacgtaatttcatatacgcgattactaatccccatatatatcactaacaaactataataaacgacaccgtcaatacgtccgtcgcgcaaactctcgataaactaatactttaaaccgaaaactaccccgaaatccgacacctcgtacacgcgaatttcgactccaacaatatcctaacgaacaataaccgcataacaacgatcattaactaaaacgaaacgatattcgaaaattcccaatacgaaatcgccaacatcttcttctaaaaaccgtaattaacttatataaaacaacaaacgcgctacttcgaacgaaaacatccgaaacttacaaaatcgccgcgactccgaacgtatatactccgcattaatcttaaccaactctatcaaaacttaattaacgacaatttcgataatacaacttaaacgcaaaatcgatacgacgcaatcgtccgatccgaaaccgaaactatcgaacgtacacaaatcgcccgcaaaaacgcgaccgtctaaaccgataactatataaaaatactcgccgataataaaaaccgacgccccaacactcgtccgaaaacaaaaaaataaaataaataccgaccgaacaaaaactaatttcgaaaacgcctcaaccaacaactcgcgcgaacctaacaaaacaaatacgaaaaaacgaccttacgcttaataacacaattctcgtccacaattcgctaaactcgctcgactaaatcgcgaaaaaaccgatcgcaataattcaaacccttctaaattatattaatccccaaaacacgattatcatacccacgcactcgaataatctaactaatcccgcaaattaaaaatcgccgcccgtacctaccgattaaatacaaatcttacgcaacgaaataccgacatacgatccgcaaaccacaccaactcgaaacataaatacaataactaaattattccgaacgtatc

SEQ ID NO: 24127 - DNA, 980 bp, Artificial Sequence
  chemically treated genomic DNA (Homo sapiens) CpG-island No: 24127
tcggttaatatattatatggcgtgattttatatgcgcgattgttgatttttatgtgtattattggtaaattgtgatggacgatatcgttagtgcgttcgtcgcgtaggttttcgatgagttgatgttttgggtcgaggattgtttcgaagttcggtatttcgtgtacgcggatttcggttttaataatgttttgacggataatggtcgtataatagcggttattgattggagcgaggcgatgttcggggatttttaatacgaggtcgttaatatttttttttggaggtcgtggttggtttgtatggagtagtagacgcgttatttcgagcggaggtattcggagtttgtaggatcgtcgcggtttcgggcgtatatgtttcgtattggttttgattaattttattagagtttggttgacggtaatttcgatgatgtagtttgggcgtagggtcgatgcgacgtaatcgttcgattcggagtcgggattgtcgggcgtatataaatcgttcgtagaagcgcggtcgtttggatcgatggttgtgtagaagtattcgtcgatagtggaaatcgacgttttagtattcgttcgagggtaaaggaatagagtagatgtcgatcgaataagagttgatttcgagaacgttttagttagtaattcgcgcgagtttagtaaggtaaatgcgagagaacggttttacgtttggtggtatagttttcgtttatagttcgttaagttcgttcggttgggtcgcgggagggtcggtcgtagtgatttaggtttttttggattgtgttggtttttagggtacgattgttatgtttacgtattcgggtgatttgattgatttcgtagattggagatcgtcgttcgtgtttgtcgattgggtgtagattttgcgtaacgagatgtcggtatacgattcgtaaattatattaattcggaatatgggtgtagtggttgaattgtttcgggcgtgtt

SEQ ID NO: 24128 - DNA, 980 bp, Artificial Sequence
  chemically treated genomic DNA (Homo sapiens) CpG-island No: 24128
aacacgcccgaaacaattcaaccactacacccatattccgaattaatataatttacgaatcgtataccgacatctcgttacgcaaaatctacacccaatcgacaaacacgaacgacgatctccaatctacgaaatcaatcaaatcacccgaatacgtaaacataacaatcgtaccctaaaaaccaacacaatccaaaaaaacctaaatcactacgaccgaccctcccgcgacccaaccgaacgaacttaacgaactataaacgaaaactataccaccaaacgtaaaaccgttctctcgcatttaccttactaaactcgcgcgaattactaactaaaacgttctcgaaatcaactcttattcgatcgacatctactctattcctttaccctcgaacgaatactaaaacgtcgatttccactatcgacgaatacttctacacaaccatcgatccaaacgaccgcgcttctacgaacgatttatatacgcccgacaatcccgactccgaatcgaacgattacgtcgcatcgaccctacgcccaaactacatcatcgaaattaccgtcaaccaaactctaataaaattaatcaaaaccaatacgaaacatatacgcccgaaaccgcgacgatcctacaaactccgaatacctccgctcgaaataacgcgtctactactccatacaaaccaaccacgacctccaaaaaaaaatattaacgacctcgtattaaaaatccccgaacatcgcctcgctccaatcaataaccgctattatacgaccattatccgtcaaaacattattaaaaccgaaatccgcgtacacgaaataccgaacttcgaaacaatcctcgacccaaaacatcaactcatcgaaaacctacgcgacgaacgcactaacgatatcgtccatcacaatttaccaataatacacataaaaatcaacaatcgcgcatataaaatcacgccatataatatattaaccga

SEQ ID NO: 24129 - DNA, 531 bp, Artificial Sequence
  chemically treated genomic DNA (Homo sapiens) CpG-island No: 24129
tttttcgagagttgtattaggtcggagacgttgtcgaatttttcgattagaaatttttcgatagacgtcgcggtgagtttaggtttttttatattttattgttttcggacgagcgtttgtttcgttattcgtcgttcgtcgtgttaatcggattagtcgtttaaatgcgggattttcgttagtcggaggttaaacggtattgagcgttagtatattattagcgagttgaagaaagataattttcgattcgttttacgtgttgttttagtaattagcgcgattttgtttttttaacgttatttcgtttttcgtttatgagtttagttaatcgattggcgagcggtatcgtatttttcgtatttcgtttttggcggatgtaggaagattaacggatttcggtttagttgatttagggttgtcgttataatgtcgcgggagcggattaatcgagtaaaggtatgatcgattggattttttttttgaaggtttttttttttgagttatttgttcgttaaggtaaagcgtttatag

SEQ ID NO: 24130 - DNA, 531 bp, Artificial Sequence
  chemically treated genomic DNA (Homo sapiens) CpG-island No: 24130
ctataaacgctttaccttaacgaacaaataactcaaaaaaaaaaaccttcaaaaaaaaaatccaatcgatcatacctttactcgattaatccgctcccgcgacattataacgacaaccctaaatcaactaaaccgaaatccgttaatcttcctacatccgccaaaaacgaaatacgaaaaatacgataccgctcgccaatcgattaactaaactcataaacgaaaaacgaaataacgttaaaaaaacaaaatcgcgctaattactaaaacaacacgtaaaacgaatcgaaaattatctttcttcaactcgctaataatatactaacgctcaataccgtttaacctccgactaacgaaaatcccgcatttaaacgactaatccgattaacacgacgaacgacgaataacgaaacaaacgctcgtccgaaaacaataaaatataaaaaaacctaaactcaccgcgacgtctatcgaaaaatttctaatcgaaaaattcgacaacgtctccgacctaatacaactctcgaaaaa

SEQ ID NO: 24131 - DNA, 531 bp, Artificial Sequence
  chemically treated genomic DNA (Homo sapiens) CpG-island No: 24131
ttgtgagcgttttgttttggcggataggtggtttaaggagaagagtttttagaaggaaggtttagtcggttatgtttttgttcggttgattcgttttcgcgatattgtggcgatagttttgggttaattgggtcgagattcgttgatttttttgtattcgttagaggcgggatgcgaagaatgcgatgtcgttcgttagtcgattggttgagtttatgagcggagaacgagatgacgttggaggggtaaggtcgcgttgattgttggggtaatacgtggagcggatcggggattgtttttttttagttcgttgatgatatgttgacgtttaatgtcgtttggttttcgattaacgaaaatttcgtatttggacggttgattcgattggtacggcggacggcgaatggcggagtagacgttcgttcgggggtaatgagatatgaaaaagtttgaatttatcgcgacgtttgtcgagaagtttttgatcgaaaagttcgatagcgttttcgatttgatgtagttttcggaggg

SEQ ID NO: 24132 - DNA, 531 bp, Artificial Sequence
  chemically treated genomic DNA (Homo sapiens) CpG-island No: 24132
ccctccgaaaactacatcaaatcgaaaacgctatcgaacttttcgatcaaaaacttctcgacaaacgtcgcgataaattcaaactttttcatatctcattacccccgaacgaacgtctactccgccattcgccgtccgccgtaccaatcgaatcaaccgtccaaatacgaaattttcgttaatcgaaaaccaaacgacattaaacgtcaacatatcatcaacgaactaaaaaaaaacaatccccgatccgctccacgtattaccccaacaatcaacgcgaccttacccctccaacgtcatctcgttctccgctcataaactcaaccaatcgactaacgaacgacatcgcattcttcgcatcccgcctctaacgaatacaaaaaaatcaacgaatctcgacccaattaacccaaaactatcgccacaatatcgcgaaaacgaatcaaccgaacaaaaacataaccgactaaaccttccttctaaaaactcttctccttaaaccacctatccgccaaaacaaaacgctcacaa

SEQ ID NO: 24133 - DNA, 1432 bp, Artificial Sequence
  chemically treated genomic DNA (Homo sapiens) CpG-island No: 24133
  misc_feature (50)..(50): n is either a, c, g or t
ttgggtttgttggtttggtaggattttatgttcggcggcggtatgtagtncggttacgattcggtttttcgtgttagcgtgatggtcgaggcgcgcgataacgtgcgtcggttgcgttattattttagtatcgtgttgtggtgtggtaataacgaggaagaaatcgtttggaaggattggggttacggtcgcgatttgaaggcggtcgattcggcgtttgtagcgaaggtgtggtagggttatgtcgatttggttcggtaacgatttgcgttaggtggtgggtgaggaggggttgggcgtgtcgtattggtttagttcgtttagtaatgatttggacgagaaagttaacgattttattcgcggcgatagtattattggtaggtttggggtaattcggcgttgtcggtgtaggtttatttgcgcgagattttacgttttatgttcgagtacgggttgtaggcgtggtcgtcggtggcgacggtggattagatcgtatattcgtgtcgagtagcgtatcgatagttcggttattcgcgcgtattagaaatttatggtcggcgagggtaatagtcgtttgttgtattatatcgaattgggttacggtacgttaaaggatttcgaggatttcgtttatttgagttaggtgatgtaggtcgatggtatcgttttggcggcgttgtattatcgcgtttcgcgttcgtatacgatgggttcgttgtattggtagtttaacgatgtttggtcgggcgttttatggtttagcgtggattatttcggtcgttggaaggcgttgtattttgtcgcgcggcgttttttcgcgtcggtgacggtggttgcgttgcgcgacgagggtaatacgcgggtgcgtttgattaatgatggcgtcgcgcgggaggtacgtttgcggttgcgggtgatggacgaggcgattattcgcgatttgtgtcggggtttttattcgggtgaggtcgcgtcggacgtgttgttgtgcgtgattgacgttattaatttgcgtttgtatttgcgtttcgcgttggaattgcgcgaattgggtaagtcgatggtggtggttttgaatatggtcgatgtcgtttagcgtcgtggtatttaggtggatgtggtcgcgttggagcgcgagttgggcgtgtcggtggtggagatcgtggcggtgcgtaagtagggtgttaaggttttggtcgagcgtttggacgcgatggtgtcgtatttggatgtatcggtgtcgggttcggaaggcggtatcgattattacgttaaggtgcgttagatttttgcggtggtcgtgcgtatgtcgtacgtatcgcgaagatcgatgacgcgttggaatcgttgtgttgttggtatttcggtgttcgggtttggttagtttgttcgtggttatgttttttgattttttatagcgggttattttggg

SEQ ID NO: 24134 - DNA, 1432 bp, Artificial Sequence
  chemically treated genomic DNA (Homo sapiens) CpG-island No: 24134
  misc_feature (1383)..(1383): n is either a, c, g or t
cccaaaataacccgctataaaaaatcaaaaaacataaccacgaacaaactaaccaaacccgaacaccgaaataccaacaacacaacgattccaacgcgtcatcgatcttcgcgatacgtacgacatacgcacgaccaccgcaaaaatctaacgcaccttaacgtaataatcgataccgccttccgaacccgacaccgatacatccaaatacgacaccatcgcgtccaaacgctcgaccaaaaccttaacaccctacttacgcaccgccacgatctccaccaccgacacgcccaactcgcgctccaacgcgaccacatccacctaaataccacgacgctaaacgacatcgaccatattcaaaaccaccaccatcgacttacccaattcgcgcaattccaacgcgaaacgcaaatacaaacgcaaattaataacgtcaatcacgcacaacaacacgtccgacgcgacctcacccgaataaaaaccccgacacaaatcgcgaataatcgcctcgtccatcacccgcaaccgcaaacgtacctcccgcgcgacgccatcattaatcaaacgcacccgcgtattaccctcgtcgcgcaacgcaaccaccgtcaccgacgcgaaaaaacgccgcgcgacaaaatacaacgccttccaacgaccgaaataatccacgctaaaccataaaacgcccgaccaaacatcgttaaactaccaatacaacgaacccatcgtatacgaacgcgaaacgcgataatacaacgccgccaaaacgataccatcgacctacatcacctaactcaaataaacgaaatcctcgaaatcctttaacgtaccgtaacccaattcgatataatacaacaaacgactattaccctcgccgaccataaatttctaatacgcgcgaataaccgaactatcgatacgctactcgacacgaatatacgatctaatccaccgtcgccaccgacgaccacgcctacaacccgtactcgaacataaaacgtaaaatctcgcgcaaataaacctacaccgacaacgccgaattaccccaaacctaccaataatactatcgccgcgaataaaatcgttaactttctcgtccaaatcattactaaacgaactaaaccaatacgacacgcccaacccctcctcacccaccacctaacgcaaatcgttaccgaaccaaatcgacataaccctaccacaccttcgctacaaacgccgaatcgaccgccttcaaatcgcgaccgtaaccccaatccttccaaacgatttcttcctcgttattaccacaccacaacacgatactaaaataataacgcaaccgacgcacgttatcgcgcgcctcgaccatcacgctaacacgaaaaaccgaatcgtaaccgnactacataccgccgccgaacataaaatcctaccaaaccaacaaacccaa

SEQ ID NO: 24135 - DNA, 1432 bp, Artificial Sequence
  chemically treated genomic DNA (Homo sapiens) CpG-island No: 24135
  misc_feature (1383)..(1383): n is either a, c, g or t
tttagggtaattcgttgtggaagattaaggaatataattacggataggttgattaggttcgaatatcggggtgttagtagtatagcggttttagcgcgttatcgattttcgcggtacgtgcggtatgcgtacggttatcgtaaggatttggcgtattttggcgtggtagtcgatgtcgtttttcgggttcggtatcggtgtatttaggtgcggtattatcgcgtttaggcgttcgattagggttttggtattttgtttgcgtatcgttacggtttttattatcggtacgtttagttcgcgttttagcgcggttatatttatttggatgttacggcgttgggcggtatcgattatgtttagggttattattatcggtttgtttagttcgcgtagttttagcgcgaaacgtaggtgtaggcgtaggttggtggcgttaattacgtatagtagtacgttcggcgcggttttattcgggtagaagtttcggtataggtcgcgggtgatcgtttcgtttattattcgtagtcgtaaacgtgtttttcgcgcggcgttattattgattaggcgtattcgcgtattgttttcgtcgcgtagcgtagttatcgttatcggcgcgaagaaacgtcgcgcggtaaagtgtagcgttttttagcggtcgaagtagtttacgttggattatgaagcgttcggttagatatcgttgagttgttagtatagcgaatttatcgtgtacggacgcgaggcgcggtgatgtagcgtcgttagggcgatgttatcggtttgtattatttggtttaggtagacgaagttttcgaagttttttggcgtgtcgtagtttagttcgatgtaatgtagtaggcggttgttgttttcgtcggttatgaatttttggtgcgcgcggatgatcgggttgtcgatgcgttgttcggtacgggtgtgcgatttggtttatcgtcgttatcgacggttacgtttgtagttcgtattcggatatgaagcgtggggtttcgcgtagataggtttgtatcggtagcgtcggattgttttagatttgttagtaatgttgtcgtcgcgggtggaatcgttggttttttcgtttagattattgttgggcgagttggattagtacggtacgtttagtttttttttatttattatttggcgtaggtcgttgtcgaattaggtcgatatagttttgttatattttcgttgtaaacgtcgggtcggtcgtttttaggtcgcgatcgtggttttagtttttttaggcggtttttttttcgttgttattatattatagtacgatgttggggtgatggcgtagtcggcgtacgttgtcgcgcgtttcggttattacgttggtacggaaggtcggatcgtaatcgngttgtatgtcgtcgtcgaatatgaagttttgttagattagtaggtttag

SEQ ID NO: 24136 - DNA, 1432 bp, Artificial Sequence
  chemically treated genomic DNA (Homo sapiens) CpG-island No: 24136
  misc_feature (50)..(50): n is either a, c, g or t
ctaaacctactaatctaacaaaacttcatattcgacgacgacatacaacncgattacgatccgaccttccgtaccaacgtaataaccgaaacgcgcgacaacgtacgccgactacgccatcaccccaacatcgtactataatataataacaacgaaaaaaaaaccgcctaaaaaaactaaaaccacgatcgcgacctaaaaacgaccgacccgacgtttacaacgaaaatataacaaaactatatcgacctaattcgacaacgacctacgccaaataataaataaaaaaaaactaaacgtaccgtactaatccaactcgcccaacaataatctaaacgaaaaaaccaacgattccacccgcgacgacaacattactaacaaatctaaaacaatccgacgctaccgatacaaacctatctacgcgaaaccccacgcttcatatccgaatacgaactacaaacgtaaccgtcgataacgacgataaaccaaatcgcacacccgtaccgaacaacgcatcgacaacccgatcatccgcgcgcaccaaaaattcataaccgacgaaaacaacaaccgcctactacattacatcgaactaaactacgacacgccaaaaaacttcgaaaacttcgtctacctaaaccaaataatacaaaccgataacatcgccctaacgacgctacatcaccgcgcctcgcgtccgtacacgataaattcgctatactaacaactcaacgatatctaaccgaacgcttcataatccaacgtaaactacttcgaccgctaaaaaacgctacactttaccgcgcgacgtttcttcgcgccgataacgataactacgctacgcgacgaaaacaatacgcgaatacgcctaatcaataataacgccgcgcgaaaaacacgtttacgactacgaataataaacgaaacgatcacccgcgacctataccgaaacttctacccgaataaaaccgcgccgaacgtactactatacgtaattaacgccaccaacctacgcctacacctacgtttcgcgctaaaactacgcgaactaaacaaaccgataataataaccctaaacataatcgataccgcccaacgccgtaacatccaaataaatataaccgcgctaaaacgcgaactaaacgtaccgataataaaaaccgtaacgatacgcaaacaaaataccaaaaccctaatcgaacgcctaaacgcgataataccgcacctaaatacaccgataccgaacccgaaaaacgacatcgactaccacgccaaaatacgccaaatccttacgataaccgtacgcataccgcacgtaccgcgaaaatcgataacgcgctaaaaccgctatactactaacaccccgatattcgaacctaatcaacctatccgtaattatattccttaatcttccacaacgaattaccctaaa

SEQ ID NO: 24137 - DNA, 932 bp, Artificial Sequence
  chemically treated genomic DNA (Homo sapiens) CpG-island No: 24137
ttggtcgagaaggtttcggagtggaagggcgaggcggttttcgaggacgagaagtcggcgtggttgtcgattacggtggatacgttggtcgaacgtatttaggtgcgtattaatggcgtcgtcgacgttaattcgattaatttgttggcgttggcgttgttgtttacgtcgaatacgcgatgggcgaggtcgatttgatcgcgtagatcgagttgtgtaagattttgttggtcgagatgtcgtattcggatcgggtgacggtgatttcgtattcgtcggaacggattatcgtttacgtcgaggaaattaacgtttttattcgtattaagtattcgttgggcgacgtgtttagcgttagcggcgatatcgcggtgttgttgagttattttcgtaataacgtgttgtatttgtttatcgtttcgtcgtgggtgtgtttgttgtttttagaataatcgtcgtatgagtcgtatcggtttggtttagttgggtcgtacggtgtattcgtttttgtaggtcgagttgtttttgtcgtggagcgaagacgagttcgcgtagcgtatcgattagattattaacgtgttcgtgcgcgagggtttgttgtagaacgttaacgacgaatacggcgggtattcggcgtcgtatcgttggataagttatgtcgagcgtttgtagaacgtcggcgtgttttggtagatttattaggatatggtcgataattttatcgataattcgttggtcggtttcgaggcgtttcgtcgtgtttatagcgcggtattcgggtatgattcgtagttgcgcgtacgcgttgttagtattcgtggtttgttatagttgcgttaggacgtattcgacgggcgtttgtcgtaggttagttttattatcgtcgatgtcgtcggtagcgaatatttcggttcgtttagttcggtttaggg

SEQ ID NO: 24138 - DNA, 932 bp, Artificial Sequence
  chemically treated genomic DNA (Homo sapiens) CpG-island No: 24138
ccctaaaccgaactaaacgaaccgaaatattcgctaccgacgacatcgacgataataaaactaacctacgacaaacgcccgtcgaatacgtcctaacgcaactataacaaaccacgaatactaacaacgcgtacgcgcaactacgaatcatacccgaataccgcgctataaacacgacgaaacgcctcgaaaccgaccaacgaattatcgataaaattatcgaccatatcctaataaatctaccaaaacacgccgacgttctacaaacgctcgacataacttatccaacgatacgacgccgaatacccgccgtattcgtcgttaacgttctacaacaaaccctcgcgcacgaacacgttaataatctaatcgatacgctacgcgaactcgtcttcgctccacgacaaaaacaactcgacctacaaaaacgaatacaccgtacgacccaactaaaccaaaccgatacgactcatacgacgattattctaaaaacaacaaacacacccacgacgaaacgataaacaaatacaacacgttattacgaaaataactcaacaacaccgcgatatcgccgctaacgctaaacacgtcgcccaacgaatacttaatacgaataaaaacgttaatttcctcgacgtaaacgataatccgttccgacgaatacgaaatcaccgtcacccgatccgaatacgacatctcgaccaacaaaatcttacacaactcgatctacgcgatcaaatcgacctcgcccatcgcgtattcgacgtaaacaacaacgccaacgccaacaaattaatcgaattaacgtcgacgacgccattaatacgcacctaaatacgttcgaccaacgtatccaccgtaatcgacaaccacgccgacttctcgtcctcgaaaaccgcctcgcccttccactccgaaaccttctcgaccaa

SEQ ID NO: 24139 - DNA, 932 bp, Artificial Sequence
  chemically treated genomic DNA (Homo sapiens) CpG-island No: 24139
ttttgggtcgggttggacggatcgggatgttcgttgtcggcggtatcggcgatgatgaagttgatttgcggtaggcgttcgtcgagtacgttttggcgtagttgtggtaggttacgggtgttgatagcgcgtgcgcgtagttgcggattatgttcgggtgtcgcgttgtaggtacgacggaacgtttcgaagtcggttagcgggttgtcggtgaagttgtcggttatgttttggtagatttgttaggatacgtcggcgttttgtaggcgttcgatatagtttgtttagcggtacgacgtcggatgttcgtcgtgttcgtcgttgacgttttgtagtaggttttcgcgtacgaatacgttgatggtttggtcgatgcgttgcgcgaattcgttttcgttttacggtaggaatagttcggtttgtaggaacgggtatatcgtgcggtttagttggattaggtcggtgcggtttatgcggcggttgttttggaagtagtaggtatatttacgacgaggcggtgaataaatgtagtacgttgttgcggaagtagtttagtagtatcgcggtatcgtcgttgacgttgagtacgtcgtttagcggatgtttgatgcgggtgaggacgttgattttttcggcgtgggcgatgattcgtttcggcgagtgcggagttatcgttattcgattcgagtacggtatttcgattagtagggttttgtatagttcgatttgcgcgattaggtcggtttcgtttatcgcgtgttcggcgtggatagtagcgttagcgttagtaggttgatcgggttgacgtcggcggcgttattgatgcgtatttggatgcgttcggttagcgtatttatcgtggtcgatagttacgtcggtttttcgttttcggagatcgtttcgtttttttatttcggggttttttcggttag

SEQ ID NO: 24140 - DNA, 932 bp, Artificial Sequence
  chemically treated genomic DNA (Homo sapiens) CpG-island No: 24140
ctaaccgaaaaaaccccgaaataaaaaaacgaaacgatctccgaaaacgaaaaaccgacgtaactatcgaccacgataaatacgctaaccgaacgcatccaaatacgcatcaataacgccgccgacgtcaacccgatcaacctactaacgctaacgctactatccacgccgaacacgcgataaacgaaaccgacctaatcgcgcaaatcgaactatacaaaaccctactaatcgaaataccgtactcgaatcgaataacgataactccgcactcgccgaaacgaatcatcgcccacgccgaaaaaatcaacgtcctcacccgcatcaaacatccgctaaacgacgtactcaacgtcaacgacgataccgcgatactactaaactacttccgcaacaacgtactacatttattcaccgcctcgtcgtaaatatacctactacttccaaaacaaccgccgcataaaccgcaccgacctaatccaactaaaccgcacgatatacccgttcctacaaaccgaactattcctaccgtaaaacgaaaacgaattcgcgcaacgcatcgaccaaaccatcaacgtattcgtacgcgaaaacctactacaaaacgtcaacgacgaacacgacgaacatccgacgtcgtaccgctaaacaaactatatcgaacgcctacaaaacgccgacgtatcctaacaaatctaccaaaacataaccgacaacttcaccgacaacccgctaaccgacttcgaaacgttccgtcgtacctacaacgcgacacccgaacataatccgcaactacgcgcacgcgctatcaacacccgtaacctaccacaactacgccaaaacgtactcgacgaacgcctaccgcaaatcaacttcatcatcgccgataccgccgacaacgaacatcccgatccgtccaacccgacccaaaa

SEQ ID NO: 24141 - DNA, 847 bp, Artificial Sequence
  chemically treated genomic DNA (Homo sapiens) CpG-island No: 24141
  misc_feature (54)..(54): n is either a, c, g or t
  misc_feature (216)..(216): n is either a, c, g or t
  misc_feature (270)..(270): n is either a, c, g or t
  misc_feature (368)..(368): n is either a, c, g or t
agttcgtaatcgagtgtttttatgaaagtgatttgcgtcgggtaaagcgacgtntgtatggcgtttttcgttcggtatgtcgattttaatttttgtttcggtaaaggcgtaaatatatttacggttttcgtttcgatcgttgcgcggatgaaataggtcgtagagtaaatcggacgcgacgttggtttttatgtgttgtttatggtgattgtcgantaaatcgacgatgtcgttcgcgttaaatgggaatattataaagcgggcgcggantaagaggcgttaagttggttaatcgaataaagttagaaagatattcgtttcggtattgatattaacgttcgttagatggtcgattttatttcggcggntaatattaatatggggacgttagtcggtttttacgttagtgtcgcgcgtatgttagatgaagtcgtaagcgtgtttggtgtcgaaggcgtgttgttaattttcgacgattttttgtcgggaatcgaaattttcggcgagcgtatttaattattgatgtaatgtcgcgtttatttatttgcgttgatttaggaggtggtatgatgacgattttaatcgttcgatcggaagttattattttcgattcgtagtaaagtgcgttgatcgtggtggatatgtaaaacgtttatgttacgttaggcggttatttagatttcgtcgggtttgatgttttaattattcgttcggttattgttaatatttaaatcgtcgtgatcgtagcgcgagcggtagggatgttgattatttggttttaaaatggttgggatgaatagtatgtcgaggttggcggattcggtttatcgaatttttataaatcgaa

SEQ ID NO: 24142 - DNA, 847 bp, Artificial Sequence
  chemically treated genomic DNA (Homo sapiens) CpG-island No: 24142
  misc_feature (480)..(480): n is either a, c, g or t
  misc_feature (578)..(578): n is either a, c, g or t
  misc_feature (632)..(632): n is either a, c, g or t
  misc_feature (794)..(794): n is either a, c, g or t
ttcgatttataaaaattcgataaaccgaatccgccaacctcgacatactattcatcccaaccattttaaaaccaaataatcaacatccctaccgctcgcgctacgatcacgacgatttaaatattaacaataaccgaacgaataattaaaacatcaaacccgacgaaatctaaataaccgcctaacgtaacataaacgttttacatatccaccacgatcaacgcactttactacgaatcgaaaataataacttccgatcgaacgattaaaatcgtcatcataccacctcctaaatcaacgcaaataaataaacgcgacattacatcaataattaaatacgctcgccgaaaatttcgattcccgacaaaaaatcgtcgaaaattaacaacacgccttcgacaccaaacacgcttacgacttcatctaacatacgcgcgacactaacgtaaaaaccgactaacgtccccatattaatattanccgccgaaataaaatcgaccatctaacgaacgttaatatcaataccgaaacgaatatctttctaactttattcgattaaccaacttaacgcctcttantccgcgcccgctttataatattcccatttaacgcgaacgacatcgtcgatttantcgacaatcaccataaacaacacataaaaaccaacgtcgcgtccgatttactctacgacctatttcatccgcgcaacgatcgaaacgaaaaccgtaaatatatttacgcctttaccgaaacaaaaattaaaatcgacataccgaacgaaaaacgccatacanacgtcgctttacccgacgcaaatcactttcataaaaacactcgattacgaact

SEQ ID NO: 24143 - DNA, 847 bp, Artificial Sequence
  chemically treated genomic DNA (Homo sapiens) CpG-island No: 24143
  misc_feature (480)..(480): n is either a, c, g or t
  misc_feature (578)..(578): n is either a, c, g or t
  misc_feature (632)..(632): n is either a, c, g or t
  misc_feature (794)..(794): n is either a, c, g or t
ttcgatttatgaaaattcggtgagtcgggttcgttagtttcgatatattgtttattttagttattttgaaattagatgattagtatttttgtcgttcgcgttgcggttacggcggtttgaatgttggtaatgatcgggcgagtggttgagatattaaattcggcgagatttaagtagtcgtttggcgtggtataagcgttttgtatatttattacgattagcgtattttgttgcggatcgaaggtaatggttttcggtcgagcggttaaggtcgttattatgttattttttgagttagcgtaggtagatgggcgcggtattgtattagtggttgaatgcgttcgtcgaaggtttcgattttcgatagaaaatcgtcgaaggttaatagtacgttttcggtattaggtacgtttgcgattttatttaatatgcgcgcgatattggcgtaagaatcgattaacgtttttatattgatgttantcgtcgaagtgggatcggttatttgacgaacgttggtgttagtatcggagcgggtatttttttgattttgttcggttagttagtttaacgttttttanttcgcgttcgttttgtagtgtttttatttggcgcgagcggtatcgtcggtttantcggtaattattataaataatatataagagttaacgtcgcgttcggtttgttttgcggtttgttttattcgcgtagcggtcggggcgaaagtcgtgggtgtatttacgtttttgtcgaaatagaagttgaaatcggtatatcgggcggagaacgttatgtangcgtcgttttgttcggcgtagattatttttatggggatattcggttgcggatt

SEQ ID NO: 24144 - DNA, 847 bp, Artificial Sequence
  chemically treated genomic DNA (Homo sapiens) CpG-island No: 24144
  misc_feature (54)..(54): n is either a, c, g or t
  misc_feature (216)..(216): n is either a, c, g or t
  misc_feature (270)..(270): n is either a, c, g or t
  misc_feature (368)..(368): n is either a, c, g or t
aatccgcaaccgaatatccccataaaaataatctacgccgaacaaaacgacgcntacataacgttctccgcccgatataccgatttcaacttctatttcgacaaaaacgtaaatacacccacgactttcgccccgaccgctacgcgaataaaacaaaccgcaaaacaaaccgaacgcgacgttaactcttatatattatttataataattaccgantaaaccgacgataccgctcgcgccaaataaaaacactacaaaacgaacgcgaantaaaaaacgttaaactaactaaccgaacaaaatcaaaaaaatacccgctccgatactaacaccaacgttcgtcaaataaccgatcccacttcgacgantaacatcaatataaaaacgttaatcgattcttacgccaatatcgcgcgcatattaaataaaatcgcaaacgtacctaataccgaaaacgtactattaaccttcgacgattttctatcgaaaatcgaaaccttcgacgaacgcattcaaccactaatacaataccgcgcccatctacctacgctaactcaaaaaataacataataacgaccttaaccgctcgaccgaaaaccattaccttcgatccgcaacaaaatacgctaatcgtaataaatatacaaaacgcttataccacgccaaacgactacttaaatctcgccgaatttaatatctcaaccactcgcccgatcattaccaacattcaaaccgccgtaaccgcaacgcgaacgacaaaaatactaatcatctaatttcaaaataactaaaataaacaatatatcgaaactaacgaacccgactcaccgaattttcataaatcgaa

SEQ ID NO: 24145 - DNA, 763 bp, Artificial Sequence
  chemically treated genomic DNA (Homo sapiens) CpG-island No: 24145
tttgttatttcgttattttcggatttcgtatcgtcgtgtttttcggtttaagttttaatattcgggtaattggcgtgttttattagttcggtagtatgaattattattcgttagttttttattggagacgacggaagatcgttgtcgaagcggcgttttatcgttttagtatgacgttttgtattgttttattgttgaagtcgtcggtagtgacgtttagtgtagtgttttacgattatagtagtttagcgcgaacgtgatattagttttttttcgttattatagtagaattcgaattcgttagagtattatgttgattgtttttttttacggttattttgtttgtatgtgttcgtttcgaggcggtatagtaggttttcgtttaagtaatagcgtattttggcgtatgatcggtaaatacgtttggtattgatcgtaggtatattattaagttttgtcgtttgcgaagtagcgtttatattcgacgataattatacgttggtagttttcgataatatggtgtatacggagaagtatattcgtattattagtgtgatattgcggcggttatttatttagttatcggttcgtttgagaatgacgtgtattgcgtacgcgatattcggagataacggttgattaagtttattttttatttcgggtaataagggcgcgtgcgttatttatttttttgttcgtttatattaacggtttttttgaggagtttattttttatcgtttttttgtcgagtagcgttggagt

SEQ ID NO: 24146 - DNA, 763 bp, Artificial Sequence
  chemically treated genomic DNA (Homo sapiens) CpG-island No: 24146
actccaacgctactcgacaaaaaaacgataaaaaataaactcctcaaaaaaaccgttaatataaacgaacaaaaaaataaataacgcacgcgcccttattacccgaaataaaaaataaacttaatcaaccgttatctccgaatatcgcgtacgcaatacacgtcattctcaaacgaaccgataactaaataaataaccgccgcaatatcacactaataatacgaatatacttctccgtatacaccatattatcgaaaactaccaacgtataattatcgtcgaatataaacgctacttcgcaaacgacaaaacttaataatatacctacgatcaataccaaacgtatttaccgatcatacgccaaaatacgctattacttaaacgaaaacctactataccgcctcgaaacgaacacatacaaacaaaataaccgtaaaaaaaaacaatcaacataatactctaacgaattcgaattctactataataacgaaaaaaaactaatatcacgttcgcgctaaactactataatcgtaaaacactacactaaacgtcactaccgacgacttcaacaataaaacaatacaaaacgtcatactaaaacgataaaacgccgcttcgacaacgatcttccgtcgtctccaataaaaaactaacgaataataattcatactaccgaactaataaaacacgccaattacccgaatattaaaacttaaaccgaaaaacacgacgatacgaaatccgaaaataacgaaataacaaa

SEQ ID NO: 24147 - DNA, 763 bp, Artificial Sequence
  chemically treated genomic DNA (Homo sapiens) CpG-island No: 24147
attttagcgttgttcggtaagaaaacgatggaaaatgaattttttaaagaagtcgttgatatggacgggtaaaaaagtggatagcgtacgcgtttttattgttcggggtggggagtaagtttagttagtcgttgttttcgggtgtcgcgtgcgtagtgtacgttatttttagacgaatcgatgattggatggatggtcgtcgtagtgttatattgatgatacggatgtgttttttcgtatatattatgttatcgggagttgttaacgtatggttatcgtcgggtatgggcgttgtttcgtagacggtagaatttgatggtatgtttgcgattaatgttaaacgtgtttatcggttatgcgttagaatgcgttgttgtttgagcgaaaatttgttgtatcgtttcgaaacgggtatatataggtagagtggtcgtgaaagaaagtaattagtatggtgttttgacgggttcgagttttgttgtgataacggagagagattggtgttacgttcgcgttggattgttgtgatcgtgaggtattgtattgggcgttattatcggcggttttaatagtgaaatagtataggacgttatgttggagcggtggaacgtcgtttcggtaacgatttttcgtcgtttttagtggagggttgacggataatggtttatgttatcgggttaatgaaatacgttagttgttcggatgttgggatttgaatcgaagaatacggcggtgcggagttcgggagtaacggaatagtaga

SEQ ID NO: 24148 - DNA, 763 bp, Artificial Sequence
  chemically treated genomic DNA (Homo sapiens) CpG-island No: 24148
tctactattccgttactcccgaactccgcaccgccgtattcttcgattcaaatcccaacatccgaacaactaacgtatttcattaacccgataacataaaccattatccgtcaaccctccactaaaaacgacgaaaaatcgttaccgaaacgacgttccaccgctccaacataacgtcctatactatttcactattaaaaccgccgataataacgcccaatacaatacctcacgatcacaacaatccaacgcgaacgtaacaccaatctctctccgttatcacaacaaaactcgaacccgtcaaaacaccatactaattactttctttcacgaccactctacctatatatacccgtttcgaaacgatacaacaaattttcgctcaaacaacaacgcattctaacgcataaccgataaacacgtttaacattaatcgcaaacataccatcaaattctaccgtctacgaaacaacgcccatacccgacgataaccatacgttaacaactcccgataacataatatatacgaaaaaacacatccgtatcatcaatataacactacgacgaccatccatccaatcatcgattcgtctaaaaataacgtacactacgcacgcgacacccgaaaacaacgactaactaaacttactccccaccccgaacaataaaaacgcgtacgctatccacttttttacccgtccatatcaacgacttctttaaaaaattcattttccatcgttttcttaccgaacaacgctaaaat

SEQ ID NO: 24149 - DNA, 716 bp, Artificial Sequence
  chemically treated genomic DNA (Homo sapiens) CpG-island No: 24149
gagttggggtacgatggttgcggcgggcggaagtacgttaacgcgtgtttagaaacggggagtgtgtatgcgtcgcgtggggagggggggggcggaggggagtggacgggtgggatagagtcgatagcggggagtttatggttttgggataggcgtaagaattttaagggggcggttagcgcgggcgcggttttagcggattaagaatgggcgcgaggagatgcggggtaatttggttaacgcgggcgatagggtgaatggtaggggcggcgaagtgcggtgttggcgagaaaagttacggcggcgtatttatggttagaaagggggatgggtattgggtaatggtcgagggcgggtagattaggggttgttggcgcggggcggggggaggtgaatggatcgtaattggagtgatagatatttgttgcgtaaaagtatcggattaagtgttttgtcgcgcgtatttgacgagagaaagggtagacgggcgtgggggtaaaagtttagcggaggagagaaattttcgggagataaagggtgtaggcggcgggagggcgtaatttcgtgggtgggtattacggattatagttttcggttttaatggcggttttagtcgttttattatgggcggtttttattattttcgtgggggtaatttttttcgtttgtggaagaatttcggtgtgtggaagatttttacggttgttgcggggttg

SEQ ID NO: 24150 - DNA, 716 bp, Artificial Sequence
  chemically treated genomic DNA (Homo sapiens) CpG-island No: 24150
caaccccgcaacaaccgtaaaaatcttccacacaccgaaattcttccacaaacgaaaaaaattacccccacgaaaataataaaaaccgcccataataaaacgactaaaaccgccattaaaaccgaaaactataatccgtaatacccacccacgaaattacgccctcccgccgcctacaccctttatctcccgaaaatttctctcctccgctaaacttttacccccacgcccgtctaccctttctctcgtcaaatacgcgcgacaaaacacttaatccgatacttttacgcaacaaatatctatcactccaattacgatccattcacctccccccgccccgcgccaacaacccctaatctacccgccctcgaccattacccaatacccatccccctttctaaccataaatacgccgccgtaacttttctcgccaacaccgcacttcgccgcccctaccattcaccctatcgcccgcgttaaccaaattaccccgcatctcctcgcgcccattcttaatccgctaaaaccgcgcccgcgctaaccgcccccttaaaattcttacgcctatcccaaaaccataaactccccgctatcgactctatcccacccgtccactcccctccgccccccccctccccacgcgacgcatacacactccccgtttctaaacacgcgttaacgtacttccgcccgccgcaaccatcgtaccccaactc

SEQ ID NO: 24151 - DNA, 716 bp, Artificial Sequence
  chemically treated genomic DNA (Homo sapiens) CpG-island No: 24151
tagtttcgtaatagtcgtggaggttttttatatatcggagtttttttataaacgggggggattatttttacgaaggtggtgggggtcgtttataataaggcggttgaggtcgttattaggatcggagattatgattcgtggtgtttatttacgaaattacgttttttcgtcgtttgtattttttatttttcggaggtttttttttttcgttaaatttttatttttacgttcgtttgttttttttttcgttaggtgcgcgcgataaggtatttaattcggtgtttttacgtagtaggtatttattattttaattgcggtttatttattttttttcgtttcgcgttagtagtttttaatttgttcgttttcggttattgtttaatatttatttttttttttagttataaatacgtcgtcgtaatttttttcgttaatatcgtatttcgtcgtttttgttatttattttgtcgttcgcgttagttaaattatttcgtattttttcgcgtttatttttagttcgttggggtcgcgttcgcgttggtcgtttttttaaggtttttgcgtttattttagggttataagtttttcgttatcggttttattttattcgtttattttttttcgttttttttttttttacgcggcgtatgtatatttttcgtttttaggtacgcgttagcgtgttttcgttcgtcgtagttatcgtgttttagttt

SEQ ID NO: 24152 - DNA, 716 bp, Artificial Sequence
  chemically treated genomic DNA (Homo sapiens) CpG-island No: 24152
aaactaaaacacgataactacgacgaacgaaaacacgctaacgcgtacctaaaaacgaaaaatatacatacgccgcgtaaaaaaaaaaaaaacgaaaaaaaataaacgaataaaataaaaccgataacgaaaaacttataaccctaaaataaacgcaaaaaccttaaaaaaacgaccaacgcgaacgcgaccccaacgaactaaaaataaacgcgaaaaaatacgaaataatttaactaacgcgaacgacaaaataaataacaaaaacgacgaaatacgatattaacgaaaaaaattacgacgacgtatttataactaaaaaaaaaaataaatattaaacaataaccgaaaacgaacaaattaaaaactactaacgcgaaacgaaaaaaaataaataaaccgcaattaaaataataaatacctactacgtaaaaacaccgaattaaataccttatcgcgcgcacctaacgaaaaaaaaaacaaacgaacgtaaaaataaaaatttaacgaaaaaaaaaaacctccgaaaaataaaaaatacaaacgacgaaaaaacgtaatttcgtaaataaacaccacgaatcataatctccgatcctaataacgacctcaaccgccttattataaacgacccccaccaccttcgtaaaaataatcccccccgtttataaaaaaactccgatatataaaaaacctccacgactattacgaaacta

SEQ ID NO: 24153 - DNA, 524 bp, Artificial Sequence
  chemically treated genomic DNA (Homo sapiens) CpG-island No: 24153
ggggtgtcgtaatgacgtaggttaaatttacgattaagtttgcgtttgcgttttatcgtgttcggttatttaggtcggggaaaatttggtcgtggttagtttggcgattgaatgaattcggttaacggcgtcgggggagatggcgggtttgtcgtatttgggcggtcgtttcggttttttcgatatttttagcgtagtattaagacgaatatgcggtagtggtttgtcgatattattatttgcggacgaaatgttttaaattggaagtttgtttattttagacgtttgattaggtaaacgtgcgggaatttcgttaggataaatagtgagggtgcgttatcgttaagtcgattattacgtagcgtcgggatttttttacgttaatattaataatgtcgttggtggtcgtttgaattgacgttagtttcggtagtttatgttgattttttcgaacgtcgtattttgttaggtattttgattagttgttgtagtaatgaaattatattagcgtgttgatcgatggt

SEQ ID NO: 24154 - DNA, 524 bp, Artificial Sequence
  chemically treated genomic DNA (Homo sapiens) CpG-island No: 24154
accatcgatcaacacgctaatataatttcattactacaacaactaatcaaaatacctaacaaaatacgacgttcgaaaaaatcaacataaactaccgaaactaacgtcaattcaaacgaccaccaacgacattattaatattaacgtaaaaaaatcccgacgctacgtaataatcgacttaacgataacgcaccctcactatttatcctaacgaaattcccgcacgtttacctaatcaaacgtctaaaataaacaaacttccaatttaaaacatttcgtccgcaaataataatatcgacaaaccactaccgcatattcgtcttaatactacgctaaaaatatcgaaaaaaccgaaacgaccgcccaaatacgacaaacccgccatctcccccgacgccgttaaccgaattcattcaatcgccaaactaaccacgaccaaattttccccgacctaaataaccgaacacgataaaacgcaaacgcaaacttaatcgtaaatttaacctacgtcattacgacacccc

SEQ ID NO: 24155 - DNA, 524 bp, Artificial Sequence
  chemically treated genomic DNA (Homo sapiens) CpG-island No: 24155
attatcgattagtacgttaatatggttttattattgtaataattgattaggatgtttggtaaaatgcggcgttcgaagggattagtatggattgtcggggttggcgttagtttaggcgattattagcggtattattgatgttaacgtgagaaaatttcggcgttgcgtggtaatcgatttagcgatggcgtatttttattgtttattttggcgaagttttcgtacgtttgtttggttaggcgtttgggataagtaggtttttagtttgaggtatttcgttcgtaggtgatggtgtcgataaattattatcgtatattcgttttgatgttgcgttggaggtatcgaggaagtcggaacgatcgtttagatacggtaaattcgttatttttttcgacgtcgttggtcggatttatttaatcgttagattggttacgattaggtttttttcgatttggatagtcgggtacgatgagacgtaagcgtagatttaatcgtgagtttagtttacgttattacggtatttt

SEQ ID NO: 24156 - DNA, 524 bp, Artificial Sequence
  chemically treated genomic DNA (Homo sapiens) CpG-island No: 24156
aaaataccgtaataacgtaaactaaactcacgattaaatctacgcttacgtctcatcgtacccgactatccaaatcgaaaaaaacctaatcgtaaccaatctaacgattaaataaatccgaccaacgacgtcgaaaaaaataacgaatttaccgtatctaaacgatcgttccgacttcctcgatacctccaacgcaacatcaaaacgaatatacgataataatttatcgacaccatcacctacgaacgaaatacctcaaactaaaaacctacttatcccaaacgcctaaccaaacaaacgtacgaaaacttcgccaaaataaacaataaaaatacgccatcgctaaatcgattaccacgcaacgccgaaattttctcacgttaacatcaataataccgctaataatcgcctaaactaacgccaaccccgacaatccatactaatcccttcgaacgccgcattttaccaaacatcctaatcaattattacaataataaaaccatattaacgtactaatcgataat

SEQ ID NO: 24157 - DNA, 638 bp, Artificial Sequence
  chemically treated genomic DNA (Homo sapiens) CpG-island No: 24157
tcgggtattatattagggagtaatgtattaacgttgtataacggatcgtagttttggtaagcgcggtaattttggtttttaatattatgtcgtgcgtagtttaggtagaaggacgatatattttggtttttttacgttgtgtatatatatcgggatacgtagtatggaggcgagagtgataagtttgcgttaacgtggtcgatggttagaattttatggttagcgttttagtcgttattatcgagtatatattcgtaaacggttttttatcggtgaggcgggtgtaaattaggtggttggttaggttgagttggtgcgtttgttgaggagttatgtatatttttcggtaattttacgttttagtttttcgcgatttgcgtatcggttttaggtttttgatgatgttgatacgagttatggtgaacggacgtcgttttcggtaaggaagcgggaagagtaatcgtcgttacggaagtttcgtggatcgtcgggtattattcggtagcggcgaggtaagcgttagtttttgttgagagattttttagtgtggttttatcgtcgggttattttcgtttcgcgttgtttataggaatcgtttagcgtagatagtattcggacgttaaaaagcgtattagtga

SEQ ID NO: 24158 - DNA, 638 bp, Artificial Sequence
  chemically treated genomic DNA (Homo sapiens) CpG-island No: 24158
tcactaatacgctttttaacgtccgaatactatctacgctaaacgattcctataaacaacgcgaaacgaaaataacccgacgataaaaccacactaaaaaatctctcaacaaaaactaacgcttacctcgccgctaccgaataatacccgacgatccacgaaacttccgtaacgacgattactcttcccgcttccttaccgaaaacgacgtccgttcaccataactcgtatcaacatcatcaaaaacctaaaaccgatacgcaaatcgcgaaaaactaaaacgtaaaattaccgaaaaatatacataactcctcaacaaacgcaccaactcaacctaaccaaccacctaatttacacccgcctcaccgataaaaaaccgtttacgaatatatactcgataataacgactaaaacgctaaccataaaattctaaccatcgaccacgttaacgcaaacttatcactctcgcctccatactacgtatcccgatatatatacacaacgtaaaaaaaccaaaatatatcgtccttctacctaaactacgcacgacataatattaaaaaccaaaattaccgcgcttaccaaaactacgatccgttatacaacgttaatacattactccctaatataatacccga

SEQ ID NO: 24159 - DNA, 638 bp, Artificial Sequence
  chemically treated genomic DNA (Homo sapiens) CpG-island No: 24159
ttattaatacgttttttaacgttcggatattgtttgcgttggacggtttttgtaaataacgcgaagcgaaggtaattcgacgatgaagttatattgggaaattttttagtaagggttgacgtttgtttcgtcgttatcgaatggtgttcggcgatttacgaaattttcgtggcggcggttatttttttcgtttttttatcgaaggcggcgttcgtttattatgattcgtgttaatattattaaaggtttgggatcggtacgtaaatcgcggaaggttggagcgtggaattgtcgaaggatgtgtatgattttttaataaacgtattaatttaatttggttaattatttggtttgtattcgttttatcggtaaagggtcgtttacggatgtgtattcggtaatggcgattggggcgttaattatggggttttgattatcggttacgttggcgtagatttattattttcgtttttatgttgcgtatttcggtatgtatgtataacgtgaagagattaaagtgtatcgtttttttgtttgggttgcgtacggtatggtattgaaggttaggattatcgcgtttgttagaattacggttcgttgtatagcgttaatatattattttttgatgtgatgttcgg

SEQ ID NO: 24160 - DNA, 638 bp, Artificial Sequence
  chemically treated genomic DNA (Homo sapiens) CpG-island No: 24160
ccgaacatcacatcaaaaaataatatattaacgctatacaacgaaccgtaattctaacaaacgcgataatcctaaccttcaataccataccgtacgcaacccaaacaaaaaaacgatacactttaatctcttcacgttatacatacataccgaaatacgcaacataaaaacgaaaataataaatctacgccaacgtaaccgataatcaaaaccccataattaacgccccaatcgccattaccgaatacacatccgtaaacgaccctttaccgataaaacgaatacaaaccaaataattaaccaaattaaattaatacgtttattaaaaaatcatacacatccttcgacaattccacgctccaaccttccgcgatttacgtaccgatcccaaacctttaataatattaacacgaatcataataaacgaacgccgccttcgataaaaaaacgaaaaaaataaccgccgccacgaaaatttcgtaaatcgccgaacaccattcgataacgacgaaacaaacgtcaacccttactaaaaaatttcccaatataacttcatcgtcgaattaccttcgcttcgcgttatttacaaaaaccgtccaacgcaaacaatatccgaacgttaaaaaacgtattaataa

SEQ ID NO: 24161 - DNA, 522 bp, Artificial Sequence
  chemically treated genomic DNA (Homo sapiens) CpG-island No: 24161
gttacgataatgcgggtttgtacgattcggtaggcgtcggtggtatatacgttatgtacgtgttgtattatgttgataagttaaatttgtattatggtttgtcggagaattcggaaattagcgaaatcgtgaaattttggaaaggtatttggaaatcgttcgcggttgttggttttgcggttatttttgcggttagtattttttattacgtgggtgtcggttcgaatcgtgcggatgaggaagagaataatttgtacgaagagaaagacgaggagcgtaaatgaaacgacgtgatattatcgtgcgttatatcgcgtcggaacgtattaattattggattatcgttttttgttttattttggcggcggtgagcgggttgggttttttgttttcgttttttaattggttgatgtaaattatgggtatatcgtagttggcgcgaattttgtattcgtttgtcggcgtggttatgtttgtttcgtttattattatgttttttcgttattggtattataatttaat

SEQ ID NO: 24162 - DNA, 522 bp, Artificial Sequence
  chemically treated genomic DNA (Homo sapiens) CpG-island No: 24162
attaaattataataccaataacgaaaaaacataataataaacgaaacaaacataaccacgccgacaaacgaatacaaaattcgcgccaactacgatatacccataatttacatcaaccaattaaaaaacgaaaacaaaaaacccaacccgctcaccgccgccaaaataaaacaaaaaacgataatccaataattaatacgttccgacgcgatataacgcacgataatatcacgtcgtttcatttacgctcctcgtctttctcttcgtacaaattattctcttcctcatccgcacgattcgaaccgacacccacgtaataaaaaatactaaccgcaaaaataaccgcaaaaccaacaaccgcgaacgatttccaaatacctttccaaaatttcacgatttcgctaatttccgaattctccgacaaaccataatacaaatttaacttatcaacataatacaacacgtacataacgtatataccaccgacgcctaccgaatcgtacaaacccgcattatcgtaac

SEQ ID NO: 24163 - DNA, 522 bp, Artificial Sequence
  chemically treated genomic DNA (Homo sapiens) CpG-island No: 24163
attaggttgtgatgttagtaacggaaaaatatgatgatgaacgaggtaaatataattacgtcgataaacgggtgtagaattcgcgttagttgcggtgtgtttatgatttgtattaattagttgaaggacgggaataaaaagtttagttcgtttatcgtcgttaggatgaagtagaaggcggtgatttagtggttgatacgtttcggcgcggtgtagcgtacgatggtgttacgtcgttttatttgcgtttttcgttttttttttcgtgtagattatttttttttttattcgtacggttcggatcgatatttacgtagtggaagatattggtcgtaaaggtagtcgtaaagttaatagtcgcgagcggtttttagatgtttttttagaattttacggtttcgttgattttcgggtttttcggtaagttatgatatagatttggtttgttagtatggtgtagtacgtatatgacgtgtgtattatcgacgtttgtcggatcgtatagattcgtattgtcgtaat

SEQ ID NO: 24164 - DNA, 522 bp, Artificial Sequence
  chemically treated genomic DNA (Homo sapiens) CpG-island No: 24164
attacgacaatacgaatctatacgatccgacaaacgtcgataatacacacgtcatatacgtactacaccatactaacaaaccaaatctatatcataacttaccgaaaaacccgaaaatcaacgaaaccgtaaaattctaaaaaaacatctaaaaaccgctcgcgactattaactttacgactacctttacgaccaatatcttccactacgtaaatatcgatccgaaccgtacgaataaaaaaaaaaataatctacacgaaaaaaaaaacgaaaaacgcaaataaaacgacgtaacaccatcgtacgctacaccgcgccgaaacgtatcaaccactaaatcaccgccttctacttcatcctaacgacgataaacgaactaaactttttattcccgtccttcaactaattaatacaaatcataaacacaccgcaactaacgcgaattctacacccgtttatcgacgtaattatatttacctcgttcatcatcatatttttccgttactaacatcacaacctaat

SEQ ID NO: 24165 - DNA, 669 bp, Artificial Sequence
  chemically treated genomic DNA (Homo sapiens) CpG-island No: 24165
gcgttgggtattgtgttgaaagggtaattggcgttggggatgttgttggcggtgtaaatagttacgggggtgttggcgtttgtggtgatgattgtgttgtcgcgttattcgttggtggtggaagtgaagcgttagttttgtcgtagcgaaaaaatgaaaatgtttttacgggcggggtgagttgttgttttcggtttcgataacggttgtcggatgcggcgtaaaacgttttattcgttttacggttttgtgttcgggatttgtaggtttgataagaacgcgtgagcgtcgtattcggtaattagtattcggtaattattattaggtattttttatttttagtattttatgcgtttttgttataatattttcggcggtaaagttaaagaacgggaatagtttattcgtcggagtagatttttcgtaattcgttatttcgataatgttttttttagattaatatatttgtattagtaatcggtaatatttgtttttatcgttacgcgagtcgtaacgttagaaggtaatatcgattttcgatattttttattttgggcgtcgaaaatatcggtcgagggtagggaaattacgcgtatattgcgatttttttttgttaatttttttgtcgtttgtagggtaatttttatttttgaatcggtggtaattaga

SEQ ID NO: 24166 - DNA, 669 bp, Artificial Sequence
  chemically treated genomic DNA (Homo sapiens) CpG-island No: 24166
tctaattaccaccgattcaaaaataaaaattaccctacaaacgacaaaaaaattaacaaaaaaaaatcgcaatatacgcgtaatttccctaccctcgaccgatattttcgacgcccaaaataaaaaatatcgaaaatcgatattaccttctaacgttacgactcgcgtaacgataaaaacaaatattaccgattactaatacaaatatattaatctaaaaaaaacattatcgaaataacgaattacgaaaaatctactccgacgaataaactattcccgttctttaactttaccgccgaaaatattataacaaaaacgcataaaatactaaaaataaaaaatacctaataataattaccgaatactaattaccgaatacgacgctcacgcgttcttatcaaacctacaaatcccgaacacaaaaccgtaaaacgaataaaacgttttacgccgcatccgacaaccgttatcgaaaccgaaaacaacaactcaccccgcccgtaaaaacattttcattttttcgctacgacaaaactaacgcttcacttccaccaccaacgaataacgcgacaacacaatcatcaccacaaacgccaacacccccgtaactatttacaccgccaacaacatccccaacgccaattaccctttcaacacaatacccaacgc

SEQ ID NO: 24167 - DNA, 669 bp, Artificial Sequence
  chemically treated genomic DNA (Homo sapiens) CpG-island No: 24167
tttgattgttatcggtttagagatggaaattattttgtaagcggtagagaaattagtaggagaaggtcgtaatgtacgcgtagtttttttgttttcgatcgatattttcgacgtttaggatgaggaatatcgggagtcggtgttgttttttaacgttgcggttcgcgtggcggtggaagtaggtattgtcgattattggtataagtatgttggtttgaaaggggtattgtcgggatgacgggttacggggaatttgtttcggcggataagttgttttcgttttttggttttatcgtcgagaatattgtggtaaaagcgtataaggtgttgggagtgaaaggtgtttgatggtgattgtcggatgttgattgtcggatgcgacgtttacgcgtttttattaggtttataggtttcgagtatagaatcgtaggacggataaggcgttttacgtcgtattcggtaatcgttgtcggaatcgaaaatagtaatttatttcgttcgtaaaagtatttttattttttcgttgcgataaaattgacgttttatttttattattagcggatggcgcgatagtataattattattataaacgttagtattttcgtggttatttgtatcgttagtagtatttttagcgttagttgtttttttagtataatgtttagcgt

SEQ ID NO: 24168 - DNA, 669 bp, Artificial Sequence
  chemically treated genomic DNA (Homo sapiens) CpG-island No: 24168
acgctaaacattatactaaaaaaacaactaacgctaaaaatactactaacgatacaaataaccacgaaaatactaacgtttataataataattatactatcgcgccatccgctaataataaaaataaaacgtcaattttatcgcaacgaaaaaataaaaatacttttacgaacgaaataaattactattttcgattccgacaacgattaccgaatacgacgtaaaacgccttatccgtcctacgattctatactcgaaacctataaacctaataaaaacgcgtaaacgtcgcatccgacaatcaacatccgacaatcaccatcaaacacctttcactcccaacaccttatacgcttttaccacaatattctcgacgataaaaccaaaaaacgaaaacaacttatccgccgaaacaaattccccgtaacccgtcatcccgacaatacccctttcaaaccaacatacttataccaataatcgacaatacctacttccaccgccacgcgaaccgcaacgttaaaaaacaacaccgactcccgatattcctcatcctaaacgtcgaaaatatcgatcgaaaacaaaaaaactacgcgtacattacgaccttctcctactaatttctctaccgcttacaaaataatttccatctctaaaccgataacaatcaaa

SEQ ID NO: 24169 - DNA, 865 bp, Artificial Sequence
  chemically treated genomic DNA (Homo sapiens) CpG-island No: 24169
cgtttcggttttttacgtcgtaaagagatggaaaagcgcgttatcgaattgatggtattttacggtttttttttcgacgtgcgcgaatcgtttaatcgttttttagtcgcgatgtagtaaatcgtcgttatttgtcgggttatcgatttttttgttaagtgttgattttcgatgaatttatcgttagtttcgatatttaggaagtggagttattgtttgatttgatgcgttagttgcgcgatcgcggcgttagtttgatttttgttatttattttttcgattaggtttattaggttagcgatcggattatcgttttacgtaacggtagtttcgtaggttgtcgggaaacgtgcgagttatcgtagatcgaattggtaaaaatgatgttggggcgcgagttggatatttacgcgttatagcgtgtcgggcgatatattgttgagcgataaattcgttgtcgcgtttaaaaattacggtaaaaaaggaacgatcgtatcgtttgatttcgaagtacgtttcggcgagatcgtcggtttggttggattgttgggattaggacgtatcgaaatcgtcgaagtgattttcggtattaaatttgttgatagcggtacggcgttgattaaaggtaaatcgtaaaatttgcgatcgttatattaggtttcggtattgggtattggtttttgttcggaagataggaaaatcgatggtattatcgttgtcgtttcggtgcgggaaaatattattttcgttttttaggtttagcgcggttggttacgttttatttttcgtaaagaatagtaagagattgtcgaacgttttattcgttagtttggtattcgtatatttttaattgaataatcgattg

SEQ ID NO: 24170 - DNA, 865 bp, Artificial Sequence
  chemically treated genomic DNA (Homo sapiens) CpG-island No: 24170
caatcgattattcaattaaaaatatacgaataccaaactaacgaataaaacgttcgacaatctcttactattctttacgaaaaataaaacgtaaccaaccgcgctaaacctaaaaaacgaaaataatattttcccgcaccgaaacgacaacgataataccatcgattttcctatcttccgaacaaaaaccaatacccaataccgaaacctaatataacgatcgcaaattttacgatttacctttaatcaacgccgtaccgctatcaacaaatttaataccgaaaatcacttcgacgatttcgatacgtcctaatcccaacaatccaaccaaaccgacgatctcgccgaaacgtacttcgaaatcaaacgatacgatcgttccttttttaccgtaatttttaaacgcgacaacgaatttatcgctcaacaatatatcgcccgacacgctataacgcgtaaatatccaactcgcgccccaacatcatttttaccaattcgatctacgataactcgcacgtttcccgacaacctacgaaactaccgttacgtaaaacgataatccgatcgctaacctaataaacctaatcgaaaaaataaataacaaaaatcaaactaacgccgcgatcgcgcaactaacgcatcaaatcaaacaataactccacttcctaaatatcgaaactaacgataaattcatcgaaaatcaacacttaacaaaaaaatcgataacccgacaaataacgacgatttactacatcgcgactaaaaaacgattaaacgattcgcgcacgtcgaaaaaaaaaccgtaaaataccatcaattcgataacgcgcttttccatctctttacgacgtaaaaaaccgaaacg

SEQ ID NO: 24171 - DNA, 865 bp, Artificial Sequence
  chemically treated genomic DNA (Homo sapiens) CpG-island No: 24171
taatcggttgtttagttgaaggtgtgcgaatgttaagttggcggataaagcgttcggtaattttttgttgttttttgcgggaaatgggacgtagttagtcgcgttgggtttggagagcgaggatgatattttttcgtatcgaggcggtagcgatgatgttatcggtttttttgtttttcgggtagaagttaatgtttagtatcgaagtttgatgtggcgatcgtaggttttgcggtttgtttttgattaacgtcgtgtcgttgttagtaggtttgatatcgaagattatttcggcggtttcggtacgttttgattttagtaatttagttagatcgacgatttcgtcggggcgtatttcgagattaaacggtgcgatcgttttttttttgtcgtaatttttgaacgcggtaacgggtttgtcgtttaataatgtatcgttcggtacgttgtagcgcgtgggtatttagttcgcgttttagtattatttttattagttcgatttgcggtagttcgtacgtttttcgatagtttacgaaattgtcgttgcgtaagacggtgattcgatcgttgatttgatagatttgatcgagaaagtgagtgataaaaattaggttgacgtcgcgatcgcgtaattgacgtattaggttaaatagtaattttattttttgggtgtcgagattggcggtgggtttatcgaggattagtatttggtagagagatcgatagttcgataaatagcgacgatttgttgtatcgcgattgaaaagcggttgagcggttcgcgtacgtcgagggagaaatcgtaagatgttattagttcggtggcgcgtttttttatttttttgcggcgtagaaggtcgaagcg

SEQ ID NO: 24172 - DNA, 865 bp, Artificial Sequence
  chemically treated genomic DNA (Homo sapiens) CpG-island No: 24172
cgcttcgaccttctacgccgcaaaaaaataaaaaaacgcgccaccgaactaataacatcttacgatttctccctcgacgtacgcgaaccgctcaaccgcttttcaatcgcgatacaacaaatcgtcgctatttatcgaactatcgatctctctaccaaatactaatcctcgataaacccaccgccaatctcgacacccaaaaaataaaattactatttaacctaatacgtcaattacgcgatcgcgacgtcaacctaatttttatcactcactttctcgatcaaatctatcaaatcaacgatcgaatcaccgtcttacgcaacgacaatttcgtaaactatcgaaaaacgtacgaactaccgcaaatcgaactaataaaaataatactaaaacgcgaactaaatacccacgcgctacaacgtaccgaacgatacattattaaacgacaaacccgttaccgcgttcaaaaattacgacaaaaaaaaaacgatcgcaccgtttaatctcgaaatacgccccgacgaaatcgtcgatctaactaaattactaaaatcaaaacgtaccgaaaccgccgaaataatcttcgatatcaaacctactaacaacgacacgacgttaatcaaaaacaaaccgcaaaacctacgatcgccacatcaaacttcgatactaaacattaacttctacccgaaaaacaaaaaaaccgataacatcatcgctaccgcctcgatacgaaaaaatatcatcctcgctctccaaacccaacgcgactaactacgtcccatttcccgcaaaaaacaacaaaaaattaccgaacgctttatccgccaacttaacattcgcacaccttcaactaaacaaccgatta

SEQ ID NO: 24173 - DNA, 632 bp, Artificial Sequence
  chemically treated genomic DNA (Homo sapiens) CpG-island No: 24173
  misc_feature (587)..(589): n is either a, c, g or t
  misc_feature (608)..(609): n is either a, c, g or t
tattattagcgaaatgtcggtagaagaagcgtatcgttatattcgtagcggcgtgttgaaatattatttatcggttttgtattcggaagatgttattgaagggtcgttggcgtttgtcgagaagcgcgattcggtgtggaaaggacgttaataatcgtgagttattacgtttttgaggggttaatttcggtggtttattcgacggcgtttgtttattttagtgtcgttttgattggcgatgtgattgtgggagtcggtgtttatatcggtttattcgttttattgcgtggtgattacgggcggttgatcgtgtaagcgggagttaatatttaggatggttgtattatgtatggttattgcgatattgatattatcgttggggaaaacggttatatcgggtacggagcgattttgtatggttgtttgattggtcgcgatgtattggtcgggatgaatagcgtgattatggatggcgcggttattggcgaagagagtattgttgtcgttatgagttttgttaaagcgggttttcgcggcgagaaacgttagttgttgatgggtacgttagtcgcgcgcgtgatacgtannnatgtatagtgacgtacganngttatacgtggaaacggttgaat

SEQ ID NO: 24174 - DNA, 632 bp, Artificial Sequence
  chemically treated genomic DNA (Homo sapiens) CpG-island No: 24174
  misc_feature (24)..(25): n is either a, c, g or t
  misc_feature (44)..(46): n is either a, c, g or t
attcaaccgtttccacgtataacnntcgtacgtcactatacatnnntacgtatcacgcgcgcgactaacgtacccatcaacaactaacgtttctcgccgcgaaaacccgctttaacaaaactcataacgacaacaatactctcttcgccaataaccgcgccatccataatcacgctattcatcccgaccaatacatcgcgaccaatcaaacaaccatacaaaatcgctccgtacccgatataaccgttttccccaacgataatatcaatatcgcaataaccatacataatacaaccatcctaaatattaactcccgcttacacgatcaaccgcccgtaatcaccacgcaataaaacgaataaaccgatataaacaccgactcccacaatcacatcgccaatcaaaacgacactaaaataaacaaacgccgtcgaataaaccaccgaaattaacccctcaaaaacgtaataactcacgattattaacgtcctttccacaccgaatcgcgcttctcgacaaacgccaacgacccttcaataacatcttccgaatacaaaaccgataaataatatttcaacacgccgctacgaatataacgatacgcttcttctaccgacatttcgctaataata

SEQ ID NO: 24175 - DNA, 632 bp, Artificial Sequence
  chemically treated genomic DNA (Homo sapiens) CpG-island No: 24175
  misc_feature (24)..(25): n is either a, c, g or t
  misc_feature (44)..(46): n is either a, c, g or t
atttaatcgtttttacgtgtaatnntcgtacgttattatatatnnntgcgtattacgcgcgcggttggcgtatttattaataattggcgtttttcgtcgcgaaagttcgttttgataaagtttatggcggtaataatgtttttttcgttaatgatcgcgttatttataattacgttgtttatttcgattaatgtatcgcgattaattaaataattatgtaggatcgtttcgtgttcgatatggtcgttttttttaacgatagtgttagtgtcgtagtagttatgtataatgtagttattttgaatattggttttcgtttgtacgattaatcgttcgtagttattacgtagtgaggcgagtgggtcgatgtagatatcggtttttataattatatcgttaattaagacggtattgggatggataaacgtcgtcgggtgaattatcggaattaattttttaaaggcgtaatagtttacggttgttaacgttttttttatatcggatcgcgtttttcggtaaacgttagcggttttttaatggtatttttcgaatgtagaatcgatggatagtgttttaatacgtcgttgcgaatatagcgatacgttttttttatcggtatttcgttggtggtg

SEQ ID NO: 24176 - DNA, 632 bp, Artificial Sequence
  chemically treated genomic DNA (Homo sapiens) CpG-island No: 24176
  misc_feature (587)..(589): n is either a, c, g or t
  misc_feature (608)..(609): n is either a, c, g or t
caccaccaacgaaataccgataaaaaaaacgtatcgctatattcgcaacgacgtattaaaacactatccatcgattctacattcgaaaaataccattaaaaaaccgctaacgtttaccgaaaaacgcgatccgatataaaaaaaacgttaacaaccgtaaactattacgcctttaaaaaattaattccgataattcacccgacgacgtttatccatcccaataccgtcttaattaacgatataattataaaaaccgatatctacatcgacccactcgcctcactacgtaataactacgaacgattaatcgtacaaacgaaaaccaatattcaaaataactacattatacataactactacgacactaacactatcgttaaaaaaaacgaccatatcgaacacgaaacgatcctacataattatttaattaatcgcgatacattaatcgaaataaacaacgtaattataaataacgcgatcattaacgaaaaaaacattattaccgccataaactttatcaaaacgaactttcgcgacgaaaaacgccaattattaataaatacgccaaccgcgcgcgtaatacgcannnatatataataacgtacgannattacacgtaaaaacgattaaat

SEQ ID NO: 24177 - DNA, 867 bp, Artificial Sequence
  chemically treated genomic DNA (Homo sapiens) CpG-island No: 24177
attgtcggacgttgttatttgcggcggcgtttggcgaaaatgtcgtaattttattagtattagtaataataatacgtcgattattaataaattaaaatcgttcgcgtttgcggaagtaatcggtgttattatcgcgtttaaattatttagtagcgtcgcgtttatggtatcgttcgttacgttttgcgtcgtttataaatcgttaattcgttttaatatcgttttcggggtttgcgtttgtagtattgtgtattgtagtaacgagttgatcgtatttaattagtcgaatagcgttagataaattacgtttaaaatttatatcggtattaggttaaatagattaatggcgaggaacgattttagcgtggagagtagtattaataattttggtcgcgtattatgtgttagtttttcgttggttaacgtattaatagtcgcgtcgagcgggatcgtcgcgtagagaaaattaatttgtgtcgttgatatttgttagttgttagttagcgtcggatatagtattcgtatcgcgttcgttatcgttaataaattatttagtagcgtaatttcgtttattagcgggttggtaagtagaaaacgaaattttgttagtaatgattttaacggatgtttacgcggttgcggtggcggtggtaacgtcggaaggtttaataacggtagtaaggtaataaacgtgttcgtcgtcgttagttcgtagttttaggttacgttatcggtcgttagtaataaatcgttaattatgggcgaaattatcgattttagacgtacggttaatatggtgatcgtttcggtttgtattaagtttttacgttttattagtgttggtgtcgtcgttaatagcgtcgtaat

SEQ ID NO: 24178 - DNA, 867 bp, Artificial Sequence
  chemically treated genomic DNA (Homo sapiens) CpG-island No: 24178
attacgacgctattaacgacgacaccaacactaataaaacgtaaaaacttaatacaaaccgaaacgatcaccatattaaccgtacgtctaaaatcgataatttcgcccataattaacgatttattactaacgaccgataacgtaacctaaaactacgaactaacgacgacgaacacgtttattaccttactaccgttattaaaccttccgacgttaccaccgccaccgcaaccgcgtaaacatccgttaaaatcattactaacaaaatttcgttttctacttaccaacccgctaataaacgaaattacgctactaaataatttattaacgataacgaacgcgatacgaatactatatccgacgctaactaacaactaacaaatatcaacgacacaaattaattttctctacgcgacgatcccgctcgacgcgactattaatacgttaaccaacgaaaaactaacacataatacgcgaccaaaattattaatactactctccacgctaaaatcgttcctcgccattaatctatttaacctaataccgatataaattttaaacgtaatttatctaacgctattcgactaattaaatacgatcaactcgttactacaatacacaatactacaaacgcaaaccccgaaaacgatattaaaacgaattaacgatttataaacgacgcaaaacgtaacgaacgataccataaacgcgacgctactaaataatttaaacgcgataataacaccgattacttccgcaaacgcgaacgattttaatttattaataatcgacgtattattattactaatactaataaaattacgacattttcgccaaacgccgccgcaaataacaacgtccgacaat

SEQ ID NO: 24179 - DNA, 867 bp, Artificial Sequence
  chemically treated genomic DNA (Homo sapiens) CpG-island No: 24179
gttacggcgttattggcggcgatattagtattggtagggcgtgaaaatttaatgtaggtcggggcgattattatgttgatcgtgcgtttggggtcggtgatttcgtttatgattggcggtttattgttggcgatcggtggcgtagtttggaattacgggttggcggcggcgggtacgtttattattttgttatcgttgttaagtttttcggcgttgttatcgttatcgtagtcgcgtgagtattcgttgaaattattattggtaggatttcgttttttgtttgttagttcgttggtgggcgggattgcgttgttgggtggtttattgacgatggcgagcgcggtgcgggtattgtattcggcgttggttgataattggtagatgttagcggtatagattggttttttttacgcggcgatttcgttcggcgcggttattggtgcgttaattagcgggaagttggtatatagtgcgcgattagggttattgatgttgttttttacgttgggatcgtttttcgttattggtttgtttggtttgatgtcgatgtggattttaggcgtggtttgtttggcgttgttcggttggttgagtgcggttagttcgttgttgtaatatataatgttgtaaacgtaaatttcggaagcgatgttagggcggattaacggtttgtggacggcgtagaacgtgacgggcgatgttataggcgcggcgttgttgggtggtttgggcgcgatgatgatatcggttgttttcgtaagcgcgagcggttttggtttgttgatagtcggcgtgttgttattgttggtgttggtggagttgcgatattttcgttagacgtcgtcgtaggtgatagcgttcgatagt

SEQ ID NO: 24180 - DNA, 867 bp, Artificial Sequence
  chemically treated genomic DNA (Homo sapiens) CpG-island No: 24180
actatcgaacgctatcacctacgacgacgtctaacgaaaatatcgcaactccaccaacaccaacaataacaacacgccgactatcaacaaaccaaaaccgctcgcgcttacgaaaacaaccgatatcatcatcgcgcccaaaccacccaacaacgccgcgcctataacatcgcccgtcacgttctacgccgtccacaaaccgttaatccgccctaacatcgcttccgaaatttacgtttacaacattatatattacaacaacgaactaaccgcactcaaccaaccgaacaacgccaaacaaaccacgcctaaaatccacatcgacatcaaaccaaacaaaccaataacgaaaaacgatcccaacgtaaaaaacaacatcaataaccctaatcgcgcactatataccaacttcccgctaattaacgcaccaataaccgcgccgaacgaaatcgccgcgtaaaaaaaaccaatctataccgctaacatctaccaattatcaaccaacgccgaatacaatacccgcaccgcgctcgccatcgtcaataaaccacccaacaacgcaatcccgcccaccaacgaactaacaaacaaaaaacgaaatcctaccaataataatttcaacgaatactcacgcgactacgataacgataacaacgccgaaaaacttaacaacgataacaaaataataaacgtacccgccgccgccaacccgtaattccaaactacgccaccgatcgccaacaataaaccgccaatcataaacgaaatcaccgaccccaaacgcacgatcaacataataatcgccccgacctacattaaattttcacgccctaccaatactaatatcgccgccaataacgccgtaac

SEQ ID NO: 24181 - DNA, 663 bp, Artificial Sequence
  chemically treated genomic DNA (Homo sapiens) CpG-island No: 24181
  misc_feature (14)..(14): n is either a, c, g or t
  misc_feature (55)..(55): n is either a, c, g or t
  misc_feature (60)..(60): n is either a, c, g or t
  misc_feature (87)..(88): n is either a, c, g or t
  misc_feature (129)..(129): n is either a, c, g or t
  misc_feature (197)..(197): n is either a, c, g or t
  misc_feature (277)..(277): n is either a, c, g or t
  misc_feature (281)..(283): n is either a, c, g or t
  misc_feature (299)..(299): n is either a, c, g or t
  misc_feature (319)..(319): n is either a, c, g or t
  misc_feature (339)..(339): n is either a, c, g or t
  misc_feature (354)..(354): n is either a, c, g or t
  misc_feature (370)..(370): n is either a, c, g or t
  misc_feature (414)..(414): n is either a, c, g or t
  misc_feature (481)..(481): n is either a, c, g or t
  misc_feature (492)..(492): n is either a, c, g or t
  misc_feature (497)..(497): n is either a, c, g or t
  misc_feature (597)..(597): n is either a, c, g or t
  misc_feature (602)..(602): n is either a, c, g or t
ggggtcggtcgttntcgggtttaggtcgttttcgcgtttcggttttcgcggtttnggggncgcgggggcgcgtcggatcggcgagtnngcgggcggggcgggggggggggtttaggtcgcggggggcgnacgcggagttttcgggggtcggcggtcgtatcgggcggtcgagggcgggcgcgaggaacgcgaacgtngcggcgggcgaggggggcgagggcggcgggtcgcggcgcgcggcgcgtcggtcgcgacggagagagagtaatagttcggncgtnnntcgcgcgtcggatcgnttaacgcgtttcgagtaganagagttagggacggtcgttngttacggggggcggngcggcgcgcggcggangcgcgtcgtagtcgcgcggcgacggcgcgcggagggtacggggnagggcgcgagatagggagggaggcgacggacgggcggggtatagatcgtcggcggacgaggggagtnggagcgggcgnggagncggtacgagagatcgacgggtagcgcgacgggcgtaggacggcggcgaggggcgagggagcgggcgcggcgcgggcgaaggcgcggagagaggcgtcggnagganggggcgggggagggcgcgttcggagagaggaggtcggagagaggagagaatcggagggagt

SEQ ID NO: 24182 - DNA, 663 bp, Artificial Sequence
  chemically treated genomic DNA (Homo sapiens) CpG-island No: 24182
  misc_feature (62)..(62): n is either a, c, g or t
  misc_feature (67)..(67): n is either a, c, g or t
  misc_feature (167)..(167): n is either a, c, g or t
  misc_feature (172)..(172): n is either a, c, g or t
  misc_feature (183)..(183): n is either a, c, g or t
  misc_feature (250)..(250): n is either a, c, g or t
  misc_feature (294)..(294): n is either a, c, g or t
  misc_feature (310)..(310): n is either a, c, g or t
  misc_feature (325)..(325): n is either a, c, g or t
  misc_feature (345)..(345): n is either a, c, g or t
  misc_feature (365)..(365): n is either a, c, g or t
  misc_feature (381)..(383): n is either a, c, g or t
  misc_feature (387)..(387): n is either a, c, g or t
  misc_feature (467)..(467): n is either a, c, g or t
  misc_feature (535)..(535): n is either a, c, g or t
  misc_feature (576)..(577): n is either a, c, g or t
  misc_feature (604)..(604): n is either a, c, g or t
  misc_feature (609)..(609): n is either a, c, g or t
  misc_feature (650)..(650): n is either a, c, g or t
actccctccgattctctcctctctccgacctcctctctccgaacgcgccctcccccgccccntcctnccgacgcctctctccgcgccttcgcccgcgccgcgcccgctccctcgcccctcgccgccgtcctacgcccgtcgcgctacccgtcgatctctcgtaccgnctccncgcccgctccnactcccctcgtccgccgacgatctataccccgcccgtccgtcgcctccctccctatctcgcgccctnccccgtaccctccgcgcgccgtcgccgcgcgactacgacgcgcntccgccgcgcgccgcnccgccccccgtaacnaacgaccgtccctaactctntctactcgaaacgcgttaancgatccgacgcgcgannnacgnccgaactattactctctctccgtcgcgaccgacgcgccgcgcgccgcgacccgccgccctcgcccccctcgcccgccgcnacgttcgcgttcctcgcgcccgccctcgaccgcccgatacgaccgccgacccccgaaaactccgcgtncgccccccgcgacctaaacccccccccccgccccgcccgcnnactcgccgatccgacgcgcccccgcgnccccnaaaccgcgaaaaccgaaacgcgaaaacgacctaaacccganaacgaccgacccc

SEQ ID NO: 24183 - DNA, 663 bp, Artificial Sequence
  chemically treated genomic DNA (Homo sapiens) CpG-island No: 24183
  misc_feature (62)..(62): n is either a, c, g or t
  misc_feature (67)..(67): n is either a, c, g or t
  misc_feature (167)..(167): n is either a, c, g or t
  misc_feature (172)..(172): n is either a, c, g or t
  misc_feature (183)..(183): n is either a, c, g or t
  misc_feature (250)..(250): n is either a, c, g or t
  misc_feature (294)..(294): n is either a, c, g or t
  misc_feature (310)..(310): n is either a, c, g or t
  misc_feature (325)..(325): n is either a, c, g or t
  misc_feature (345)..(345): n is either a, c, g or t
  misc_feature (365)..(365): n is either a, c, g or t
  misc_feature (381)..(383): n is either a, c, g or t
  misc_feature (387)..(387): n is either a, c, g or t
  misc_feature (467)..(467): n is either a, c, g or t
  misc_feature (535)..(535): n is either a, c, g or t
  misc_feature (576)..(577): n is either a, c, g or t
  misc_feature (604)..(604): n is either a, c, g or t
  misc_feature (609)..(609): n is either a, c, g or t
  misc_feature (650)..(650): n is either a, c, g or t
gtttttttcggttttttttttttttcggtttttttttttcgggcgcgttttttttcgttttnttttntcggcgttttttttcgcgttttcgttcgcgtcgcgttcgttttttcgtttttcgtcgtcgttttgcgttcgtcgcgttgttcgtcggtttttcgtgtcgnttttncgttcgttttngtttttttcgttcgtcggcggtttgtgtttcgttcgttcgtcgtttttttttttgtttcgcgttttntttcgtgtttttcgcgcgtcgtcgtcgcgcggttgcggcgcgtnttcgtcgcgcgtcgtntcgtttttcgtggtnggcggtcgtttttggttttntttgttcggggcgcgttggncggttcggcgcgcggnnngcgntcgggttgttgtttttttttcgtcgcggtcggcgcgtcgcgcgtcgcggttcgtcgttttcgtttttttcgttcgtcgtngcgttcgcgtttttcgcgttcgttttcggtcgttcggtgcggtcgtcggttttcgggggtttcgcgtncgtttttcgcggtttgggttttttttttcgtttcgttcgtnngttcgtcggttcggcgcgttttcgcgnttttngggtcgcgggggtcggggcgcgggggcggtttgggttcggnggcggtcggtttt

SEQ ID NO: 24184 - DNA, 663 bp, Artificial Sequence
  chemically treated genomic DNA (Homo sapiens) CpG-island No: 24184
  misc_feature (14)..(14): n is either a, c, g or t
  misc_feature (55)..(55): n is either a, c, g or t
  misc_feature (60)..(60): n is either a, c, g or t
  misc_feature (87)..(88): n is either a, c, g or t
  misc_feature (129)..(129): n is either a, c, g or t
  misc_feature (197)..(197): n is either a, c, g or t
  misc_feature (277)..(277): n is either a, c, g or t
  misc_feature (281)..(283): n is either a, c, g or t
  misc_feature (299)..(299): n is either a, c, g or t
  misc_feature (319)..(319): n is either a, c, g or t
  misc_feature (339)..(339): n is either a, c, g or t
  misc_feature (354)..(354): n is either a, c, g or t
  misc_feature (370)..(370): n is either a, c, g or t
  misc_feature (414)..(414): n is either a, c, g or t
  misc_feature (481)..(481): n is either a, c, g or t
  misc_feature (492)..(492): n is either a, c, g or t
  misc_feature (497)..(497): n is either a, c, g or t
  misc_feature (597)..(597): n is either a, c, g or t
  misc_feature (602)..(602): n is either a, c, g or t
aaaaccgaccgccnccgaacccaaaccgcccccgcgccccgacccccgcgacccnaaaancgcgaaaacgcgccgaaccgacgaacnnacgaacgaaacgaaaaaaaaaacccaaaccgcgaaaaacgnacgcgaaacccccgaaaaccgacgaccgcaccgaacgaccgaaaacgaacgcgaaaaacgcgaacgcnacgacgaacgaaaaaaacgaaaacgacgaaccgcgacgcgcgacgcgccgaccgcgacgaaaaaaaaacaacaacccgancgcnnnccgcgcgccgaaccgnccaacgcgccccgaacaaanaaaaccaaaaacgaccgccnaccacgaaaaacganacgacgcgcgacgaanacgcgccgcaaccgcgcgacgacgacgcgcgaaaaacacgaaanaaaacgcgaaacaaaaaaaaaaacgacgaacgaacgaaacacaaaccgccgacgaacgaaaaaaacnaaaacgaacgnaaaancgacacgaaaaaccgacgaacaacgcgacgaacgcaaaacgacgacgaaaaacgaaaaaacgaacgcgacgcgaacgaaaacgcgaaaaaaaacgccganaaaanaaaacgaaaaaaaacgcgcccgaaaaaaaaaaaccgaaaaaaaaaaaaaaccgaaaaaaac

SEQ ID NO: 24185 - DNA, 689 bp, Artificial Sequence
  chemically treated genomic DNA (Homo sapiens) CpG-island No: 24185
  misc_feature (29)..(29): n is either a, c, g or t
  misc_feature (33)..(33): n is either a, c, g or t
  misc_feature (202)..(202): n is either a, c, g or t
  misc_feature (355)..(355): n is either a, c, g or t
  misc_feature (362)..(362): n is either a, c, g or t
  misc_feature (493)..(493): n is either a, c, g or t
  misc_feature (672)..(672): n is either a, c, g or t
gcggtcgggggcggggcgggacggacggngttnggaagggggggcggggggcgcgggcgcgggggggtcgaaatttttcgggggcggttcgcggcggggggggcgggggggggtcgagggaagcgcggacgggggcgttcgggcggggggcgtacgtaggggcgttattcgggcggaggggtcgatagcgggggcggcggtnatttttaggggcgagggcggggcggggggcgcggggcgggaggaaggcgggggtcggtcgggacgcgcgggcgcgcggcggagcgacgcggtatcggagagggtagcgtcgcgggggcggagggcggcgcgtagcggtagcggcgggggcggngcgggancgaggggagaggagtagggtagcgcggcgcggcgggagtaggacgaggaagaggagcgggcggtcgggcgggaaggcgagttagtagagcggaaaacggcgcgaggacgaacggaggcgggcgaggaatanggcgcgtcgtcgcgcgagaagagagagagagggagggggagcgacgagagaagtagggagcgaggcggaggcgaagcgagtacggggagcgagggaaagtataaggcggagggagagtatagaagaagagagacggagaaggagacggagtatagtaagtagagaataagcgattagancgggggaagaagggcga

SEQ ID NO: 24186 - DNA, 689 bp, Artificial Sequence
  chemically treated genomic DNA (Homo sapiens) CpG-island No: 24186
  misc_feature (18)..(18): n is either a, c, g or t
  misc_feature (197)..(197): n is either a, c, g or t
  misc_feature (328)..(328): n is either a, c, g or t
  misc_feature (335)..(335): n is either a, c, g or t
  misc_feature (488)..(488): n is either a, c, g or t
  misc_feature (657)..(657): n is either a, c, g or t
  misc_feature (661)..(661): n is either a, c, g or t
tcgcccttcttcccccgntctaatcgcttattctctacttactatactccgtctccttctccgtctctcttcttctatactctccctccgccttatactttccctcgctccccgtactcgcttcgcctccgcctcgctccctacttctctcgtcgctccccctccctctctctctcttctcgcgcgacgacgcgccntattcctcgcccgcctccgttcgtcctcgcgccgttttccgctctactaactcgccttcccgcccgaccgcccgctcctcttcctcgtcctactcccgccgcgccgcgctaccctactcctctcccctcgntcccgcnccgcccccgccgctaccgctacgcgccgccctccgcccccgcgacgctaccctctccgataccgcgtcgctccgccgcgcgcccgcgcgtcccgaccgacccccgccttcctcccgccccgcgccccccgccccgccctcgcccctaaaaatnaccgccgcccccgctatcgacccctccgcccgaataacgcccctacgtacgccccccgcccgaacgcccccgtccgcgcttccctcgacccccccccgccccccccgccgcgaaccgcccccgaaaaatttcgacccccccgcgcccgcgccccccgcccccccttccnaacnccgtccgtcccgccccgcccccgaccgc

SEQ ID NO: 24187 - DNA, 689 bp, Artificial Sequence
  chemically treated genomic DNA (Homo sapiens) CpG-island No: 24187
  misc_feature (18)..(18): n is either a, c, g or t
  misc_feature (197)..(197): n is either a, c, g or t
  misc_feature (328)..(328): n is either a, c, g or t
  misc_feature (335)..(335): n is either a, c, g or t
  misc_feature (488)..(488): n is either a, c, g or t
  misc_feature (657)..(657): n is either a, c, g or t
  misc_feature (661)..(661): n is either a, c, g or t
tcgttttttttttttcgntttggtcgtttgttttttgtttgttgtgtttcgttttttttttcgtttttttttttttgtgtttttttttcgttttgtgttttttttcgtttttcgtgttcgtttcgttttcgtttcgttttttgtttttttcgtcgtttttttttttttttttttttttttcgcgcggcggcgcgttntgtttttcgttcgttttcgttcgttttcgcgtcgtttttcgttttgttggttcgttttttcgttcggtcgttcgtttttttttttcgttttgttttcgtcgcgtcgcgttgttttgttttttttttttcgntttcgtntcgttttcgtcgttgtcgttgcgcgtcgtttttcgttttcgcggcgttgtttttttcggtgtcgcgtcgtttcgtcgcgcgttcgcgcgtttcggtcggttttcgtttttttttcgtttcgcgtttttcgtttcgttttcgtttttgggggtngtcgtcgttttcgttgtcggttttttcgttcgggtggcgtttttgcgtgcgtttttcgttcgggcgttttcgttcgcgtttttttcggttttttttcgtttttttcgtcgcgggtcgttttcggggggtttcggttttttcgcgttcgcgtttttcgtttttttttttnggtntcgttcgtttcgtttcgttttcggtcgt

SEQ ID NO: 24188 - DNA, 689 bp, Artificial Sequence
  chemically treated genomic DNA (Homo sapiens) CpG-island No: 24188
  misc_feature (29)..(29): n is either a, c, g or t
  misc_feature (33)..(33): n is either a, c, g or t
  misc_feature (202)..(202): n is either a, c, g or t
  misc_feature (355)..(355): n is either a, c, g or t
  misc_feature (362)..(362): n is either a, c, g or t
  misc_feature (493)..(493): n is either a, c, g or t
  misc_feature (672)..(672): n is either a, c, g or t
acgaccgaaaacgaaacgaaacgaacganaccnaaaaaaaaaaacgaaaaacgcgaacgcgaaaaaaccgaaaccccccgaaaacgacccgcgacgaaaaaaacgaaaaaaaaccgaaaaaaacgcgaacgaaaacgcccgaacgaaaaacgcacgcaaaaacgccacccgaacgaaaaaaccgacaacgaaaacgacgacnacccccaaaaacgaaaacgaaacgaaaaacgcgaaacgaaaaaaaaacgaaaaccgaccgaaacgcgcgaacgcgcgacgaaacgacgcgacaccgaaaaaaacaacgccgcgaaaacgaaaaacgacgcgcaacgacaacgacgaaaacganacgaaancgaaaaaaaaaaaacaaaacaacgcgacgcgacgaaaacaaaacgaaaaaaaaaaacgaacgaccgaacgaaaaaacgaaccaacaaaacgaaaaacgacgcgaaaacgaacgaaaacgaacgaaaaacanaacgcgccgccgcgcgaaaaaaaaaaaaaaaaaaaaaaaaacgacgaaaaaaacaaaaaacgaaacgaaaacgaaacgaacacgaaaaacgaaaaaaaacacaaaacgaaaaaaaaacacaaaaaaaaaaaaacgaaaaaaaaaacgaaacacaacaaacaaaaaacaaacgaccaaancgaaaaaaaaaaaacga

SEQ ID NO: 24189 - DNA, 596 bp, Artificial Sequence
  chemically treated genomic DNA (Homo sapiens) CpG-island No: 24189
  misc_feature (13)..(13): n is either a, c, g or t
  misc_feature (38)..(38): n is either a, c, g or t
  misc_feature (65)..(65): n is either a, c, g or t
  misc_feature (97)..(97): n is either a, c, g or t
  misc_feature (152)..(152): n is either a, c, g or t
  misc_feature (192)..(192): n is either a, c, g or t
  misc_feature (285)..(285): n is either a, c, g or t
  misc_feature (287)..(287): n is either a, c, g or t
  misc_feature (305)..(305): n is either a, c, g or t
  misc_feature (456)..(456): n is either a, c, g or t
  misc_feature (497)..(497): n is either a, c, g or t
  misc_feature (511)..(512): n is either a, c, g or t
  misc_feature (568)..(568): n is either a, c, g or t
  misc_feature (576)..(576): n is either a, c, g or t
tacgcggttcggnggcgcggttttttcgcgttcggggncgcggtcggcggcgtcgtcgtcgcgtngcgggggcggcggtttttattagggttcgcgngtcgttcgcgtttcggtttcgcggggcggtcggcggcgtcgtattttcggggcgngcggttattacgggcgggcgcggtttcgcggcgtcggttngagcgggtcgacggtttttcgtttcgcgaacgggcgtcggtcgtacggttcgggcggggcgtattcggtcgcgcgggttcggtcgattagcgntntcggtcggaggtcgtttntagggggcgcgcgcgcgcgcgtttcgatagtcgttcgcgtcgcggttcgcgcggcggcgtcgcgggtagcgaggggttcggcgatttcgtcgattcggacgggtcgtatttatcgtcgttttcgcgcggcgcgggcgcgatttcgataggnggcgttcgtatttcgttttcgcgtcgtcgcgggattcgcgncggcgttcgcgttnnggttcggtcgtcgcgcgcgcgggtattagtaggggagtaagtttagcgtcgcgttncggcgttnagaggatcggacgggcgagg

SEQ ID NO: 24190 - DNA, 596 bp, Artificial Sequence
  chemically treated genomic DNA (Homo sapiens) CpG-island No: 24190
  misc_feature (21)..(21): n is either a, c, g or t
  misc_feature (29)..(29): n is either a, c, g or t
  misc_feature (85)..(86): n is either a, c, g or t
  misc_feature (100)..(100): n is either a, c, g or t
  misc_feature (141)..(141): n is either a, c, g or t
  misc_feature (292)..(292): n is either a, c, g or t
  misc_feature (310)..(310): n is either a, c, g or t
  misc_feature (312)..(312): n is either a, c, g or t
  misc_feature (405)..(405): n is either a, c, g or t
  misc_feature (445)..(445): n is either a, c, g or t
  misc_feature (500)..(500): n is either a, c, g or t
  misc_feature (532)..(532): n is either a, c, g or t
  misc_feature (559)..(559): n is either a, c, g or t
  misc_feature (584)..(584): n is either a, c, g or t
cctcgcccgtccgatcctctnaacgccgnaacgcgacgctaaacttactcccctactaatacccgcgcgcgcgacgaccgaaccnnaacgcgaacgccgncgcgaatcccgcgacgacgcgaaaacgaaatacgaacgccncctatcgaaatcgcgcccgcgccgcgcgaaaacgacgataaatacgacccgtccgaatcgacgaaatcgccgaacccctcgctacccgcgacgccgccgcgcgaaccgcgacgcgaacgactatcgaaacgcgcgcgcgcgcgccccctanaaacgacctccgaccganancgctaatcgaccgaacccgcgcgaccgaatacgccccgcccgaaccgtacgaccgacgcccgttcgcgaaacgaaaaaccgtcgacccgctcnaaccgacgccgcgaaaccgcgcccgcccgtaataaccgcncgccccgaaaatacgacgccgccgaccgccccgcgaaaccgaaacgcgaacgacncgcgaaccctaataaaaaccgccgcccccgcnacgcgacgacgacgccgccgaccgcgnccccgaacgcgaaaaaaccgcgccnccgaaccgcgta

SEQ ID NO: 24191 - DNA, 596 bp, Artificial Sequence
  chemically treated genomic DNA (Homo sapiens) CpG-island No: 24191
  misc_feature (21)..(21): n is either a, c, g or t
  misc_feature (29)..(29): n is either a, c, g or t
  misc_feature (85)..(86): n is either a, c, g or t
  misc_feature (100)..(100): n is either a, c, g or t
  misc_feature (141)..(141): n is either a, c, g or t
  misc_feature (292)..(292): n is either a, c, g or t
  misc_feature (310)..(310): n is either a, c, g or t
  misc_feature (312)..(312): n is either a, c, g or t
  misc_feature (405)..(405): n is either a, c, g or t
  misc_feature (445)..(445): n is either a, c, g or t
  misc_feature (500)..(500): n is either a, c, g or t
  misc_feature (532)..(532): n is either a, c, g or t
  misc_feature (559)..(559): n is either a, c, g or t
  misc_feature (584)..(584): n is either a, c, g or t
tttcgttcgttcggttttttnggcgtcgnggcgcggcgttgggtttgtttttttgttggtgttcgcgcgcgcggcggtcgggttnnggcgcgggcgtcgncgcgggtttcgcggcggcgcgggggcggggtgcgggcgttntttgtcggggtcgcgttcgcgtcgcgcgggggcggcggtgggtgcggttcgttcgggtcggcggggtcgtcgggtttttcgttgttcgcggcgtcgtcgcgcgggtcgcggcgcgggcggttgtcggggcgcgcgcgcgcgcgttttttgngggcggttttcggtcggngncgttggtcggtcgggttcgcgcggtcgggtgcgtttcgttcgggtcgtgcggtcggcgttcgttcgcggggcggggggtcgtcggttcgtttnggtcggcgtcgcggggtcgcgttcgttcgtggtggtcgtncgtttcgggggtgcggcgtcgtcggtcgtttcgcggggtcggggcgcgggcggtncgcgggttttggtgggggtcgtcgttttcgtngcgcggcggcggcgtcgtcggtcgcgntttcgggcgcgggggggtcgcgttntcgggtcgcgtg

SEQ ID NO: 24192 - DNA, 596 bp, Artificial Sequence
  chemically treated genomic DNA (Homo sapiens) CpG-island No: 24192
  misc_feature (13)..(13): n is either a, c, g or t
  misc_feature (38)..(38): n is either a, c, g or t
  misc_feature (65)..(65): n is either a, c, g or t
  misc_feature (97)..(97): n is either a, c, g or t
  misc_feature (152)..(152): n is either a, c, g or t
  misc_feature (192)..(192): n is either a, c, g or t
  misc_feature (285)..(285): n is either a, c, g or t
  misc_feature (287)..(287): n is either a, c, g or t
  misc_feature (305)..(305): n is either a, c, g or t
  misc_feature (456)..(456): n is either a, c, g or t
  misc_feature (497)..(497): n is either a, c, g or t
  misc_feature (511)..(512): n is either a, c, g or t
  misc_feature (568)..(568): n is either a, c, g or t
  misc_feature (576)..(576): n is either a, c, g or t
cacgcgacccganaacgcgacccccccgcgcccgaaancgcgaccgacgacgccgccgccgcgcnacgaaaacgacgacccccaccaaaacccgcgnaccgcccgcgccccgaccccgcgaaacgaccgacgacgccgcacccccgaaacgnacgaccaccacgaacgaacgcgaccccgcgacgccgaccnaaacgaaccgacgaccccccgccccgcgaacgaacgccgaccgcacgacccgaacgaaacgcacccgaccgcgcgaacccgaccgaccaacgncnccgaccgaaaaccgcccncaaaaaacgcgcgcgcgcgcgccccgacaaccgcccgcgccgcgacccgcgcgacgacgccgcgaacaacgaaaaacccgacgaccccgccgacccgaacgaaccgcacccaccgccgcccccgcgcgacgcgaacgcgaccccgacaaanaacgcccgcaccccgcccccgcgccgccgcgaaacccgcgncgacgcccgcgccnnaacccgaccgccgcgcgcgcgaacaccaacaaaaaaacaaacccaacgccgcgccncgacgccnaaaaaaccgaacgaacgaaa

SEQ ID NO: 24193 - DNA, 577 bp, Artificial Sequence
  chemically treated genomic DNA (Homo sapiens) CpG-island No: 24193
  misc_feature (4)..(4): n is either a, c, g or t
  misc_feature (17)..(17): n is either a, c, g or t
  misc_feature (56)..(57): n is either a, c, g or t
  misc_feature (240)..(240): n is either a, c, g or t
  misc_feature (325)..(325): n is either a, c, g or t
  misc_feature (355)..(355): n is either a, c, g or t
  misc_feature (388)..(388): n is either a, c, g or t
  misc_feature (564)..(564): n is either a, c, g or t
gggngcgtcgggggcgnacgggttcggcggtcggggcggcgtcggggcggcggggnngacggggggggcgcgcgggcgtcgggggcgttcggcgtcgtcggggtcgcggtcgtcgggcggcgcgcgtcgggagggcggggggggggggggtcgcgggggcggtcggtcgggggaggggcggacgcgggggaggcggcgcgcggtcggcgggaggcggagggtatagtcgatagggggttncgcgcgcgggcgaagcggttcgcggcgggggcggagcggggggggagggcggggaacgggaggggggggttcgcggggagaaaangggggaagcggacggttagagagggggagnggggagggggagggagggagcggggcggcgcgnggtagggggggagagagggggaaggacgggggcggcgggggggcgcgcgcgggggcggagagggcgcgggggggggggagcgaggggggcgggggggcgagcgagcgggagcggggagggtaaggtattaggaggtagaagaggcggcgggggcgaggcgggaaggggggagtagnaagaggggatagg

SEQ ID NO: 24194 - DNA, 577 bp, Artificial Sequence
  chemically treated genomic DNA (Homo sapiens) CpG-island No: 24194
  misc_feature (14)..(14): n is either a, c, g or t
  misc_feature (190)..(190): n is either a, c, g or t
  misc_feature (223)..(223): n is either a, c, g or t
  misc_feature (253)..(253): n is either a, c, g or t
  misc_feature (338)..(338): n is either a, c, g or t
  misc_feature (521)..(522): n is either a, c, g or t
  misc_feature (561)..(561): n is either a, c, g or t
  misc_feature (574)..(574): n is either a, c, g or t
cctatcccctcttnctactccccccttcccgcctcgcccccgccgcctcttctacctcctaataccttaccctccccgctcccgctcgctcgcccccccgcccccctcgctcccccccccccgcgccctctccgcccccgcgcgcgcccccccgccgcccccgtccttccccctctctccccccctaccncgcgccgccccgctccctccctccccctccccnctccccctctctaaccgtccgcttcccccnttttctccccgcgaacccccccctcccgttccccgccctccccccccgctccgcccccgccgcgaaccgcttcgcccgcgcgcgnaaccccctatcgactataccctccgcctcccgccgaccgcgcgccgcctcccccgcgtccgcccctcccccgaccgaccgcccccgcgaccccccccccccccgccctcccgacgcgcgccgcccgacgaccgcgaccccgacgacgccgaacgcccccgacgcccgcgcgccccccccgtcnnccccgccgccccgacgccgccccgaccgccgaacccgtncgcccccgacgcnccc

SEQ ID NO: 24195 - DNA, 577 bp, Artificial Sequence
  chemically treated genomic DNA (Homo sapiens) CpG-island No: 24195
  misc_feature (14)..(14): n is either a, c, g or t
  misc_feature (190)..(190): n is either a, c, g or t
  misc_feature (223)..(223): n is either a, c, g or t
  misc_feature (253)..(253): n is either a, c, g or t
  misc_feature (338)..(338): n is either a, c, g or t
  misc_feature (521)..(522): n is either a, c, g or t
  misc_feature (561)..(561): n is either a, c, g or t
  misc_feature (574)..(574): n is either a, c, g or t
tttgtttttttttnttgttttttttttttcgtttcgttttcgtcgttttttttgttttttggtgttttgtttttttcgttttcgttcgttcgttttttcgtttttttcgttttttttttttcgcgtttttttcgttttcgcgcgcgttttttcgtcgttttcgtttttttttttttttttttttttgttncgcgtcgtttcgttttttttttttttttttttnttttttttttttggtcgttcgttttttttntttttttttcgcgggtttttttttttcgtttttcgtttttttttttcgtttcgttttcgtcgcgggtcgtttcgttcgcgcgcgnggttttttgtcggttgtgtttttcgtttttcgtcggtcgcgcgtcgtttttttcgcgttcgtttttttttcggtcggtcgttttcgcggtttttttttttttcgttttttcggcgcgcgtcgttcggcggtcgcggtttcggcggcgtcgggcgttttcggcgttcgcgcgtttttttcgttnntttcgtcgtttcggcgtcgtttcggtcgtcgggttcgtncgttttcggcgtnttt

SEQ ID NO: 24196 - DNA, 577 bp, Artificial Sequence
  chemically treated genomic DNA (Homo sapiens) CpG-island No: 24196
  misc_feature (4)..(4): n is either a, c, g or t
  misc_feature (17)..(17): n is either a, c, g or t
  misc_feature (56)..(57): n is either a, c, g or t
  misc_feature (240)..(240): n is either a, c, g or t
  misc_feature (325)..(325): n is either a, c, g or t
  misc_feature (355)..(355): n is either a, c, g or t
  misc_feature (388)..(388): n is either a, c, g or t
  misc_feature (564)..(564): n is either a, c, g or t
aaanacgccgaaaacgnacgaacccgacgaccgaaacgacgccgaaacgacgaaannaacgaaaaaaacgcgcgaacgccgaaaacgcccgacgccgccgaaaccgcgaccgccgaacgacgcgcgccgaaaaaacgaaaaaaaaaaaaaccgcgaaaacgaccgaccgaaaaaaaaacgaacgcgaaaaaaacgacgcgcgaccgacgaaaaacgaaaaacacaaccgacaaaaaaccncgcgcgcgaacgaaacgacccgcgacgaaaacgaaacgaaaaaaaaaaacgaaaaacgaaaaaaaaaaacccgcgaaaaaaaaanaaaaaaaacgaacgaccaaaaaaaaaaaanaaaaaaaaaaaaaaaaaaaacgaaacgacgcgnaacaaaaaaaaaaaaaaaaaaaaaaacgaaaacgacgaaaaaacgcgcgcgaaaacgaaaaaaacgcgaaaaaaaaaaaacgaaaaaaacgaaaaaacgaacgaacgaaaacgaaaaaaacaaaacaccaaaaaacaaaaaaaacgacgaaaacgaaacgaaaaaaaaaaaacaanaaaaaaaaacaaa

SEQ ID NO: 24197 - DNA, 585 bp, Artificial Sequence
  chemically treated genomic DNA (Homo sapiens) CpG-island No: 24197
tgcgcggttgtttaggagatgttagtgtgaaggagggaagagaattggttcgttaagtttcgtagacgatgaaaggtacgtatatcgtttcgggagtaaagttaagaggagcgtgcgttatcgcgatcgagtagggattattggagagtgagtttagggtaaatatgaggagtacgcgaacgacgttatcggacgggtggagagtttttagggttattatcgaattttacggcgaagataataaggacgaaggttagttaacgagatagagacgtcgttatataatagcgaagatacggattcgcgacgttaatttaattatggacgttttagtagtatcggcgggatatcgtatcgtttagaggaagtgatatagcgtttagttttttaattattagggtttttcgattattttacggtagattatttcgtattagaagtcgatattttaaaataatagattaatacgttagagcgcgtagcggacgagagacgtttttaagagagagaataagtaagaaaagtataataaagaggggtacgcggtggcggcgttataattagtggattttttttgtgtagtat

SEQ ID NO: 24198 - DNA, 585 bp, Artificial Sequence
  chemically treated genomic DNA (Homo sapiens) CpG-island No: 24198
atactacacaaaaaaaatccactaattataacgccgccaccgcgtacccctctttattatacttttcttacttattctctctcttaaaaacgtctctcgtccgctacgcgctctaacgtattaatctattattttaaaatatcgacttctaatacgaaataatctaccgtaaaataatcgaaaaaccctaataattaaaaaactaaacgctatatcacttcctctaaacgatacgatatcccgccgatactactaaaacgtccataattaaattaacgtcgcgaatccgtatcttcgctattatataacgacgtctctatctcgttaactaaccttcgtccttattatcttcgccgtaaaattcgataataaccctaaaaactctccacccgtccgataacgtcgttcgcgtactcctcatatttaccctaaactcactctccaataatccctactcgatcgcgataacgcacgctcctcttaactttactcccgaaacgatatacgtacctttcatcgtctacgaaacttaacgaaccaattctcttccctccttcacactaacatctcctaaacaaccgcgca

SEQ ID NO: 24199 - DNA, 585 bp, Artificial Sequence
  chemically treated genomic DNA (Homo sapiens) CpG-island No: 24199
atattatataagggggatttattagttatagcgtcgttatcgcgtgtttttttttgttgtattttttttgtttatttttttttttgggggcgtttttcgttcgttgcgcgttttggcgtgttggtttattgttttggggtgtcgatttttaatacggggtggtttatcgtaggatggtcgaggggttttgatggttaaagggttgggcgttgtgttattttttttgggcggtgcggtgtttcgtcgatgttgttgaggcgtttatggttaggttggcgtcgcgggttcgtgttttcgttgttgtatggcggcgtttttgtttcgttgattgattttcgtttttattgttttcgtcgtgaaattcggtggtaattttggggattttttattcgttcgatggcgtcgttcgcgtgttttttatatttgttttggatttattttttagtggtttttgttcggtcgcggtggcgtacgttttttttggttttgttttcgaagcggtgtacgtgttttttatcgtttgcgagatttggcgagttaattttttttttttttttatattgatattttttgagtagtcgcgta

SEQ ID NO: 24200 - DNA, 585 bp, Artificial Sequence
  chemically treated genomic DNA (Homo sapiens) CpG-island No: 24200
tacgcgactactcaaaaaatatcaatataaaaaaaaaaaaaaaattaactcgccaaatctcgcaaacgataaaaaacacgtacaccgcttcgaaaacaaaaccaaaaaaaacgtacgccaccgcgaccgaacaaaaaccactaaaaaataaatccaaaacaaatataaaaaacacgcgaacgacgccatcgaacgaataaaaaatccccaaaattaccaccgaatttcacgacgaaaacaataaaaacgaaaatcaatcaacgaaacaaaaacgccgccatacaacaacgaaaacacgaacccgcgacgccaacctaaccataaacgcctcaacaacatcgacgaaacaccgcaccgcccaaaaaaaataacacaacgcccaaccctttaaccatcaaaacccctcgaccatcctacgataaaccaccccgtattaaaaatcgacaccccaaaacaataaaccaacacgccaaaacgcgcaacgaacgaaaaacgcccccaaaaaaaaaaataaacaaaaaaaatacaacaaaaaaaaacacgcgataacgacgctataactaataaatcccccttatataatat

SEQ ID NO: 24201 - DNA, 952 bp, Artificial Sequence
  chemically treated genomic DNA (Homo sapiens) CpG-island No: 24201
taggcgttgtattaggcgggttttgaaacgcgtattttgcgtggattggatgaattgggttgggatgttgtcgggtaattgattgatggggaagggcgattggttaattgcgtgtggaaaatttgggcgtgggaaatcgcgtttgattagattcgtgaagttagcgatcgtgagtttgttgcggtgttaattcgtatcggttattcgtaaaacgaagtgcgttttatcgacgtattgttgcgttcggaagtgttggtttttgagtcgttgtggacggtgattttcggtaataaagcgattttgtcgattttttggtcgttgtttaggacgataacggcgagattatcgattcgtataacggtttgggcgatttgtaaaatcgtttgttgcgttatgtttttttcgtttttggcgaagattcgttacgcgtattgcgcgtggcgcgttttgttgcgcgttatgcggagcgcggtttaaaaattgtcgattatattttggcgttgatgcgcgagatgatttatgcgggtgaattggaatatttgacgtttgaacgggtatggaaagagacggaaagcgtttttattattcgtaatttataggtgtttttttaggtattgcgcgattgcggcgtattgcgcgttttattttcggaaattgacgtattgtttggcgtttcggtttttgttaagtggtattcggaaatcgatacgggtatttatattttaatgacgtttttaatggcggcgatgttgagttcgtaggtcgatgttcgtttcgtaattttatgttacgatttcggtaaaggggtgacgtcgttagaattttgggtcgcgttatttattggttatgggtttcggcgggttgtttaagttagttgggaataaatttattgtttagtcggttttgtcgtcgtggtttaaaatggtaaattgtagtcgaattgttaaggtta

SEQ ID NO: 24202 - DNA, 952 bp, Artificial Sequence
  chemically treated genomic DNA (Homo sapiens) CpG-island No: 24202
taaccttaacaattcgactacaatttaccattttaaaccacgacgacaaaaccgactaaacaataaatttattcccaactaacttaaacaacccgccgaaacccataaccaataaataacgcgacccaaaattctaacgacgtcacccctttaccgaaatcgtaacataaaattacgaaacgaacatcgacctacgaactcaacatcgccgccattaaaaacgtcattaaaatataaatacccgtatcgatttccgaataccacttaacaaaaaccgaaacgccaaacaatacgtcaatttccgaaaataaaacgcgcaatacgccgcaatcgcgcaatacctaaaaaaacacctataaattacgaataataaaaacgctttccgtctctttccatacccgttcaaacgtcaaatattccaattcacccgcataaatcatctcgcgcatcaacgccaaaatataatcgacaatttttaaaccgcgctccgcataacgcgcaacaaaacgcgccacgcgcaatacgcgtaacgaatcttcgccaaaaacgaaaaaaacataacgcaacaaacgattttacaaatcgcccaaaccgttatacgaatcgataatctcgccgttatcgtcctaaacaacgaccaaaaaatcgacaaaatcgctttattaccgaaaatcaccgtccacaacgactcaaaaaccaacacttccgaacgcaacaatacgtcgataaaacgcacttcgttttacgaataaccgatacgaattaacaccgcaacaaactcacgatcgctaacttcacgaatctaatcaaacgcgatttcccacgcccaaattttccacacgcaattaaccaatcgcccttccccatcaatcaattacccgacaacatcccaacccaattcatccaatccacgcaaaatacgcgtttcaaaacccgcctaatacaacgccta

SEQ ID NO: 24203 - DNA, 952 bp, Artificial Sequence
  chemically treated genomic DNA (Homo sapiens) CpG-island No: 24203
tggttttaataattcggttgtaatttattattttgggttacggcggtaagatcggttgggtaataggtttgtttttaattaatttaaataattcgtcggggtttatgattaatagatgacgcggtttagagttttggcggcgttatttttttatcgagatcgtggtataaagttgcgaaacggatatcgatttgcggatttagtatcgtcgttattgagagcgttattaaggtatgaatattcgtatcgattttcggatgttatttggtaggggtcggaacgttaaatagtgcgttaattttcgggaataaaacgcgtagtgcgtcgtaatcgcgtagtatttggaagaatatttgtggattgcgggtggtgagggcgtttttcgtttttttttatattcgtttaggcgttaggtgttttagtttattcgtatgggttatttcgcgtattaacgttagagtataatcggtaatttttaaatcgcgtttcgtataacgcgtagtaaaacgcgttacgcgtaatacgcgtaacggattttcgttaaaagcgggggaaatatggcgtaatagacgattttgtagatcgtttagatcgttgtacgggtcgataatttcgtcgttatcgttttgggtagcgattagaggatcggtagaatcgttttgttgtcggggattatcgtttatagcggtttaaagattagtattttcgggcgtagtaatacgtcgataagacgtatttcgttttgcggatgatcggtacggattggtatcgtagtaaatttacggtcgttaattttacgaatttgattaaacgcggttttttacgtttaggttttttatacgtagttaattagtcgtttttttttattaattagttgttcggtagtattttagtttagtttatttaatttacgtaagatacgcgttttaaagttcgtttggtgtagcgtttg

SEQ ID NO: 24204 - DNA, 952 bp, Artificial Sequence
  chemically treated genomic DNA (Homo sapiens) CpG-island No: 24204
caaacgctacaccaaacgaactttaaaacgcgtatcttacgtaaattaaataaactaaactaaaatactaccgaacaactaattaataaaaaaaaacgactaattaactacgtataaaaaacctaaacgtaaaaaaccgcgtttaatcaaattcgtaaaattaacgaccgtaaatttactacgataccaatccgtaccgatcatccgcaaaacgaaatacgtcttatcgacgtattactacgcccgaaaatactaatctttaaaccgctataaacgataatccccgacaacaaaacgattctaccgatcctctaatcgctacccaaaacgataacgacgaaattatcgacccgtacaacgatctaaacgatctacaaaatcgtctattacgccatatttcccccgcttttaacgaaaatccgttacgcgtattacgcgtaacgcgttttactacgcgttatacgaaacgcgatttaaaaattaccgattatactctaacgttaatacgcgaaataacccatacgaataaactaaaacacctaacgcctaaacgaatataaaaaaaaacgaaaaacgccctcaccacccgcaatccacaaatattcttccaaatactacgcgattacgacgcactacgcgttttattcccgaaaattaacgcactatttaacgttccgacccctaccaaataacatccgaaaatcgatacgaatattcataccttaataacgctctcaataacgacgatactaaatccgcaaatcgatatccgtttcgcaactttataccacgatctcgataaaaaaataacgccgccaaaactctaaaccgcgtcatctattaatcataaaccccgacgaattatttaaattaattaaaaacaaacctattacccaaccgatcttaccgccgtaacccaaaataataaattacaaccgaattattaaaacca

SEQ ID NO: 24205 - DNA, 550 bp, Artificial Sequence
  chemically treated genomic DNA (Homo sapiens) CpG-island No: 24205
acgataaatagagatttattcgataatcgttaaatacgagcgaacgtcgttttaatatatatataaaagtatattaatagattagacgttatttatatttaatttcgattcgtcggtcgttttttattcgtaacgtatatttagtaagtttacgaagaagttattgtttaatacgttaacgcggttagtgaagacgtcgtttttgttgttatcgaagttggtatttagtatacgtatgtcgtttattaggagacgtatttaaaaaacggttatttttagttgttgtgttttgtcgattagtagtgattcggtggtggaaacgtttagacgagcgcgatagttacggaaatcgttagtaattggttttagtagtttaaatattttaatgttagtttgattttgacgcgtattaacgcgattcggcgtaaacggtatatgaatgtttaaatttgcggcgtttgcggtttttttaatattaattatattagttagtattatgatattcgttagcgaggttttattagattttttttggattttttttagaata

SEQ ID NO: 24206 - DNA, 550 bp, Artificial Sequence
  chemically treated genomic DNA (Homo sapiens) CpG-island No: 24206
tattctaaaaaaaatccaaaaaaaatctaataaaacctcgctaacgaatatcataatactaactaatataattaatattaaaaaaaccgcaaacgccgcaaatttaaacattcatataccgtttacgccgaatcgcgttaatacgcgtcaaaatcaaactaacattaaaatatttaaactactaaaaccaattactaacgatttccgtaactatcgcgctcgtctaaacgtttccaccaccgaatcactactaatcgacaaaacacaacaactaaaaataaccgttttttaaatacgtctcctaataaacgacatacgtatactaaataccaacttcgataacaacaaaaacgacgtcttcactaaccgcgttaacgtattaaacaataacttcttcgtaaacttactaaatatacgttacgaataaaaaacgaccgacgaatcgaaattaaatataaataacgtctaatctattaatatacttttatatatatattaaaacgacgttcgctcgtatttaacgattatcgaataaatctctatttatcgt

SEQ ID NO: 24207 - DNA, 550 bp, Artificial Sequence
  chemically treated genomic DNA (Homo sapiens) CpG-island No: 24207
tgttttggagaaaatttagaaagagtttggtaaagtttcgttggcggatattatagtgttggttggtgtggttggtgttgagaaagtcgtaagcgtcgtaggtttgagtatttatgtatcgtttgcgtcgggtcgcgttgatgcgcgttaggattagattgatattgagatgtttgagttgttggagttaattgttgacggttttcgtaattatcgcgttcgtttggacgtttttattatcgagttattgttgatcgataaagtatagtaattgaggatgatcgttttttaaatgcgttttttggtgggcggtatgcgtgtattgggtgttaatttcgatggtagtaaaaacggcgtttttattgatcgcgttggcgtattgagtaatgattttttcgtgaatttgttggatatgcgttacgagtggaaagcgatcgacgaatcggggttgggtgtgggtggcgtttggtttattggtgtgtttttgtgtgtatgttggggcggcgttcgttcgtgtttagcggttgtcgggtgggtttttgtttgtcgt

SEQ ID NO: 24208 - DNA, 550 bp, Artificial Sequence
  chemically treated genomic DNA (Homo sapiens) CpG-island No: 24208
acgacaaacaaaaacccacccgacaaccgctaaacacgaacgaacgccgccccaacatacacacaaaaacacaccaataaaccaaacgccacccacacccaaccccgattcgtcgatcgctttccactcgtaacgcatatccaacaaattcacgaaaaaatcattactcaatacgccaacgcgatcaataaaaacgccgtttttactaccatcgaaattaacacccaatacacgcataccgcccaccaaaaaacgcatttaaaaaacgatcatcctcaattactatactttatcgatcaacaataactcgataataaaaacgtccaaacgaacgcgataattacgaaaaccgtcaacaattaactccaacaactcaaacatctcaatatcaatctaatcctaacgcgcatcaacgcgacccgacgcaaacgatacataaatactcaaacctacgacgcttacgactttctcaacaccaaccacaccaaccaacactataatatccgccaacgaaactttaccaaactctttctaaattttctccaaaaca

SEQ ID NO: 24209 - DNA, 518 bp, Artificial Sequence
  chemically treated genomic DNA (Homo sapiens) CpG-island No: 24209
gtatcgatagtgtcgaggatggtttttattatggtttaggtttttagcgtttcggtttcggtcgcgtcggtaaatttatcgaataattagaaatcggcgtcgttaacgtggttgataataatcgaattattagcgatataaatcgatagcgtcgttatttgcgtatcggagtagtttagttgtttaataatcggtattattagttttatcgtcgttaaataggttacggtggtagaattttgaatgatgcgtattgtagttgttagtacgaagtaggtgatagtaatcggtaggtttatgtcggttaacgtttcgtttagtgtcggatttacgttagagttaattagtatttgtttgaatacgtcgttcgtattaattattagtagaatgattttcgtcggttgtagcgcgtgatcgtaaatttttattattttgttttttggtatgttttgacgtattgttagatcgtaaatcgttattagataagtaattagaatcgcggtaaacggatgatcgat

SEQ ID NO: 24210 - DNA, 518 bp, Artificial Sequence
  chemically treated genomic DNA (Homo sapiens) CpG-island No: 24210
atcgatcatccgtttaccgcgattctaattacttatctaataacgatttacgatctaacaatacgtcaaaacataccaaaaaacaaaataataaaaatttacgatcacgcgctacaaccgacgaaaatcattctactaataattaatacgaacgacgtattcaaacaaatactaattaactctaacgtaaatccgacactaaacgaaacgttaaccgacataaacctaccgattactatcacctacttcgtactaacaactacaatacgcatcattcaaaattctaccaccgtaacctatttaacgacgataaaactaataataccgattattaaacaactaaactactccgatacgcaaataacgacgctatcgatttatatcgctaataattcgattattatcaaccacgttaacgacgccgatttctaattattcgataaatttaccgacgcgaccgaaaccgaaacgctaaaaacctaaaccataataaaaaccatcctcgacactatcgatac

SEQ ID NO: 24211 - DNA, 518 bp, Artificial Sequence
  chemically treated genomic DNA (Homo sapiens) CpG-island No: 24211
atcggttattcgtttatcgcgattttggttgtttgtttggtggcgatttacggtttggtaatgcgttagggtatgttaaaagataaagtgatggagatttgcggttacgcgttgtaatcggcggggattattttgttggtgattggtgcgggcggcgtgtttaaataggtgttggttgattttggcgtaggttcggtattgggcgaagcgttaatcggtatgggtttgtcgattgttattatttgtttcgtgttggtagttgtagtgcgtattatttagggttttgttatcgtagtttgtttaacggcggtaggattggtgatgtcggttattgaataattgaattatttcggtgcgtaaatggcggcgttgtcgatttgtatcgttggtggttcgattgttgttagttacgttaacgacgtcggtttttggttgttcggtaaatttatcggcgcgatcgaagtcgaaacgttgaaaatttggattatgatggaaattattttcggtattgtcggtgt

SEQ ID NO: 24212 - DNA, 518 bp, Artificial Sequence
  chemically treated genomic DNA (Homo sapiens) CpG-island No: 24212
acaccgacaataccgaaaataatttccatcataatccaaattttcaacgtttcgacttcgatcgcgccgataaatttaccgaacaaccaaaaaccgacgtcgttaacgtaactaacaacaatcgaaccaccaacgatacaaatcgacaacgccgccatttacgcaccgaaataattcaattattcaataaccgacatcaccaatcctaccgccgttaaacaaactacgataacaaaaccctaaataatacgcactacaactaccaacacgaaacaaataataacaatcgacaaacccataccgattaacgcttcgcccaataccgaacctacgccaaaatcaaccaacacctatttaaacacgccgcccgcaccaatcaccaacaaaataatccccgccgattacaacgcgtaaccgcaaatctccatcactttatcttttaacataccctaacgcattaccaaaccgtaaatcgccaccaaacaaacaaccaaaatcgcgataaacgaataaccgat

SEQ ID NO: 24213 - DNA, 528 bp, Artificial Sequence
  chemically treated genomic DNA (Homo sapiens) CpG-island No: 24213
ttattatatatcgtattatttttacgtatatttaatattttttaatagttttataattttttatttttttatacggttgttttagcgtttatcgtgttttacgagaattatcgttaatatttggttgttggtggggacggcgttgggattgtagttgaatgagcgtcgtatttggtattattggcggatgcggcgtaaacgttttattcgttttacgcgttaaagagtcggtttgtaggtttgataagacgtattagcgtcgtattaggtattgtgttttattggcggacgcgtttaatggcggtgtttatgatttcggtttttttcgcgatgatcgttacgatcgcgttagtttttacgatagttacgtttatacgttttacgtttattttagttacggtggtagttattattatgacgttattaacggtttttgcgttatttataattgcgatgttagtagttacggtcgcgttagtgattatcgttttagtaattatcgtaatgatcgcgatcgttaatttgtaa

SEQ ID NO: 24214 - DNA, 528 bp, Artificial Sequence
  chemically treated genomic DNA (Homo sapiens) CpG-island No: 24214
ttacaaattaacgatcgcgatcattacgataattactaaaacgataatcactaacgcgaccgtaactactaacatcgcaattataaataacgcaaaaaccgttaataacgtcataataataactaccaccgtaactaaaataaacgtaaaacgtataaacgtaactatcgtaaaaactaacgcgatcgtaacgatcatcgcgaaaaaaaccgaaatcataaacaccgccattaaacgcgtccgccaataaaacacaatacctaatacgacgctaatacgtcttatcaaacctacaaaccgactctttaacgcgtaaaacgaataaaacgtttacgccgcatccgccaataataccaaatacgacgctcattcaactacaatcccaacgccgtccccaccaacaaccaaatattaacgataattctcgtaaaacacgataaacgctaaaacaaccgtataaaaaaataaaaaattataaaactattaaaaaatattaaatatacgtaaaaataatacgatatataataa

SEQ ID NO: 24215 - DNA, 528 bp, Artificial Sequence
  chemically treated genomic DNA (Homo sapiens) CpG-island No: 24215
ttataaattggcgatcgcgattattacggtaattattgggacggtggttattggcgcgatcgtgattattggtatcgtaattatgagtggcgtaaaaatcgttggtggcgttatgataatggttattatcgtggttgggataagcgtaaagcgtatgagcgtggttatcgtgaaggttggcgcgatcgtgacgattatcgcggaaaaggtcggggttatgggtatcgttattaaacgcgttcgttaatggagtataatgtttgatgcgacgttagtgcgttttattaggtttataaatcggttttttaacgcgtagggcggataaggcgtttacgtcgtattcgttaatagtgttagatgcgacgtttatttaattataattttagcgtcgtttttattaataattagatattggcggtggttttcgtgagatacggtggacgttggagtagtcgtgtgggagagtgggggattgtgggattattggggggtgttgggtgtgcgtgagggtggtgcggtgtgtggtgg

SEQ ID NO: 24216 - DNA, 528 bp, Artificial Sequence
  chemically treated genomic DNA (Homo sapiens) CpG-island No: 24216
ccaccacacaccgcaccaccctcacgcacacccaacaccccccaataatcccacaatcccccactctcccacacgactactccaacgtccaccgtatctcacgaaaaccaccgccaatatctaattattaataaaaacgacgctaaaattataattaaataaacgtcgcatctaacactattaacgaatacgacgtaaacgccttatccgccctacgcgttaaaaaaccgatttataaacctaataaaacgcactaacgtcgcatcaaacattatactccattaacgaacgcgtttaataacgatacccataaccccgaccttttccgcgataatcgtcacgatcgcgccaaccttcacgataaccacgctcatacgctttacgcttatcccaaccacgataataaccattatcataacgccaccaacgatttttacgccactcataattacgataccaataatcacgatcgcgccaataaccaccgtcccaataattaccgtaataatcgcgatcgccaatttataa

SEQ ID NO: 24217 - DNA, 887 bp, Artificial Sequence
  chemically treated genomic DNA (Homo sapiens) CpG-island No: 24217
  misc_feature (126)..(126): n is either a, c, g or t
  misc_feature (259)..(259): n is either a, c, g or t
cgtcgcgcgttgggatgaaggtgtaatttgcgatttgtttgaaggttatgcgtcgtataaatcgcgttatgttttattcgattacgttcgtattttggcgaacggattcgaatggttggagttggnaggcgcgtagattttgatgtcggtttttttttgttgattatttttatttttacgtatcgtcggttatttcggtgtcggtttatttggggtatttggtgcgatgtttgtatcgttttgtgggttttttatttangtcgggttcgatgtcggtataatcgtttttggcgttttttcgtcgagattttgttagacggtttttttgggcggttaatgtcggttcgtttggttggttcgtttttcgcgcgattttttagttttgttttcggtttggaggcgttcggtttcgggaaagatagtttgttggcggaatttcgtttgcgggaataaatttagttattggtggcgtatcgttatattacgcgcgatgttagcgtcggaagtgaaaattatatcgttttgagcgagtaggagttttttattcgcgcggggtaaaatttgttggttttaagttggtacgttaacggtttgtattatggcgtcggcgtcgagattgatttttggttgtacgtcggattcgacgtgttggttaacggtttacgcgtttatttgtcgtaggcgcgggcgcgttattaatcggtagttttgcggttacgtgattatcgcgtttgtcgtacggagttatcgtttgattagtaaatttattgtcgtcgggtagaaggcgttgttttcgttgaatattatttatatcgtcgtttcgtattttgaggtattgattatcggcgagagtgatattaaaaatttcgttagtcgtgagacgatta

SEQ ID NO: 24218 - DNA, 887 bp, Artificial Sequence
  chemically treated genomic DNA (Homo sapiens) CpG-island No: 24218
  misc_feature (629)..(629): n is either a, c, g or t
  misc_feature (762)..(762): n is either a, c, g or t
taatcgtctcacgactaacgaaatttttaatatcactctcgccgataatcaatacctcaaaatacgaaacgacgatataaataatattcaacgaaaacaacgccttctacccgacgacaataaatttactaatcaaacgataactccgtacgacaaacgcgataatcacgtaaccgcaaaactaccgattaataacgcgcccgcgcctacgacaaataaacgcgtaaaccgttaaccaacacgtcgaatccgacgtacaaccaaaaatcaatctcgacgccgacgccataatacaaaccgttaacgtaccaacttaaaaccaacaaattttaccccgcgcgaataaaaaactcctactcgctcaaaacgatataattttcacttccgacgctaacatcgcgcgtaatataacgatacgccaccaataactaaatttattcccgcaaacgaaattccgccaacaaactatctttcccgaaaccgaacgcctccaaaccgaaaacaaaactaaaaaatcgcgcgaaaaacgaaccaaccaaacgaaccgacattaaccgcccaaaaaaaccgtctaacaaaatctcgacgaaaaaacgccaaaaacgattataccgacatcgaacccgacntaaataaaaaacccacaaaacgatacaaacatcgcaccaaataccccaaataaaccgacaccgaaataaccgacgatacgtaaaaataaaaataatcaacaaaaaaaaaccgacatcaaaatctacgcgcctnccaactccaaccattcgaatccgttcgccaaaatacgaacgtaatcgaataaaacataacgcgatttatacgacgcataaccttcaaacaaatcgcaaattacaccttcatcccaacgcgcgacg

SEQ ID NO: 24219 - DNA, 887 bp, Artificial Sequence
  chemically treated genomic DNA (Homo sapiens) CpG-island No: 24219
  misc_feature (629)..(629): n is either a, c, g or t
  misc_feature (762)..(762): n is either a, c, g or t
tgatcgttttacgattagcgaagtttttggtgttattttcgtcgatgattagtgttttaagatgcggagcggcgatatgaatgatatttagcgaagatagcgttttttgttcgacggtaataaatttgttggttaggcgataatttcgtgcggtaggcgcggtggttacgtagtcgtaggattgtcgattgatagcgcgttcgcgtttgcggtagatgggcgcgtgagtcgttgattagtacgtcgaattcggcgtgtagttagagattaatttcgacgtcgacgttataatatagatcgttagcgtgttagtttaaggttaatagattttgtttcgcgcgggtaaaaaatttttgttcgtttagggcgatatggtttttattttcggcgttggtatcgcgcgtgatgtagcgatgcgttattagtaattgagtttgttttcgtaggcggagtttcgttagtaggttgtttttttcggagtcggacgtttttaaatcgagaataggattgaagaatcgcgcggagaacgggttaattaaacgggtcgatattggtcgtttaaaaaggtcgtttggtaaggtttcggcgagggaacgttagaaacggttatatcgatatcgaattcggtntgggtaagaagtttataaaacggtgtaaatatcgtattaagtgttttaggtagatcggtatcgaggtgatcgacggtacgtgggggtaaagatggttagtagagagaggtcggtattaagatttgcgcgtttnttagttttagttattcggattcgttcgttagaatacgggcgtaatcgggtaagatatagcgcggtttgtacggcgtatgatttttaaatagatcgtagattatatttttattttagcgcgcggcg

SEQ ID NO: 24220 - DNA, 887 bp, Artificial Sequence
  chemically treated genomic DNA (Homo sapiens) CpG-island No: 24220
  misc_feature (126)..(126): n is either a, c, g or t
  misc_feature (259)..(259): n is either a, c, g or t
cgccgcgcgctaaaataaaaatataatctacgatctatttaaaaatcatacgccgtacaaaccgcgctatatcttacccgattacgcccgtattctaacgaacgaatccgaataactaaaactaanaaacgcgcaaatcttaataccgacctctctctactaaccatctttacccccacgtaccgtcgatcacctcgataccgatctacctaaaacacttaatacgatatttacaccgttttataaacttcttacccanaccgaattcgatatcgatataaccgtttctaacgttccctcgccgaaaccttaccaaacgacctttttaaacgaccaatatcgacccgtttaattaacccgttctccgcgcgattcttcaatcctattctcgatttaaaaacgtccgactccgaaaaaaacaacctactaacgaaactccgcctacgaaaacaaactcaattactaataacgcatcgctacatcacgcgcgataccaacgccgaaaataaaaaccatatcgccctaaacgaacaaaaattttttacccgcgcgaaacaaaatctattaaccttaaactaacacgctaacgatctatattataacgtcgacgtcgaaattaatctctaactacacgccgaattcgacgtactaatcaacgactcacgcgcccatctaccgcaaacgcgaacgcgctatcaatcgacaatcctacgactacgtaaccaccgcgcctaccgcacgaaattatcgcctaaccaacaaatttattaccgtcgaacaaaaaacgctatcttcgctaaatatcattcatatcgccgctccgcatcttaaaacactaatcatcgacgaaaataacaccaaaaacttcgctaatcgtaaaacgatca

SEQ ID NO: 24221 - DNA, 600 bp, Artificial Sequence
  chemically treated genomic DNA (Homo sapiens) CpG-island No: 24221
  misc_feature (495)..(495): n is either a, c, g or t
atgtcgatcgggtaggatgcgtcgtgacgtggtagacggataacgcgaatgtcgtgcgcgaagtatttatcgttaaattgcgcgttaagatcgagtttttgggttttttttagtagtttttgttttagttggatatcgcggaattttgattatgttcgttttttttcgtcggtagtttatcgtaatagtgagcgtttgttaatttgacggtttttaggttggttttcgtagacgtatcgttaattataaacgcgatatggtacggcgggtaggttgtagtatcgagggtacgtattttttcgacgaggaagttttttagtttgtcgggagttagtagggttttggttttttggtagagatacgttttgttggtagagcgtcgtttttcgtaacgtaaaggaatttgtatttatcgttatttatcgcgtataggtcgatttgcgcgagtaggttagtgtttgtgttgatttttttgtatatgtttagcgtcgtatnttttgttgacgtttttcggttttagtaatttaggtttatatagcgtatattggaatatcgtttttttaaaaaagcgtatttttttcgggcgatggcgatttataa

SEQ ID NO: 24222 - DNA, 600 bp, Artificial Sequence
  chemically treated genomic DNA (Homo sapiens) CpG-island No: 24222
  misc_feature (106)..(106): n is either a, c, g or t
ttataaatcgccatcgcccgaaaaaaatacgcttttttaaaaaaacgatattccaatatacgctatataaacctaaattactaaaaccgaaaaacgtcaacaaaanatacgacgctaaacatatacaaaaaaatcaacacaaacactaacctactcgcgcaaatcgacctatacgcgataaataacgataaatacaaattcctttacgttacgaaaaacgacgctctaccaacaaaacgtatctctaccaaaaaaccaaaaccctactaactcccgacaaactaaaaaacttcctcgtcgaaaaaatacgtaccctcgatactacaacctacccgccgtaccatatcgcgtttataattaacgatacgtctacgaaaaccaacctaaaaaccgtcaaattaacaaacgctcactattacgataaactaccgacgaaaaaaaacgaacataatcaaaattccgcgatatccaactaaaacaaaaactactaaaaaaaacccaaaaactcgatcttaacgcgcaatttaacgataaatacttcgcgcacgacattcgcgttatccgtctaccacgtcacgacgcatcctacccgatcgacat

SEQ ID NO: 24223 - DNA, 600 bp, Artificial Sequence
  chemically treated genomic DNA (Homo sapiens) CpG-island No: 24223
  misc_feature (106)..(106): n is either a, c, g or t
ttatgaatcgttatcgttcggaagagatgcgtttttttaaagaagcggtgttttaatatgcgttgtatgagtttggattattggagtcggaaggcgttagtaaagnatgcggcgttggatatgtataaagaggttaatataggtattaatttgttcgcgtaaatcgatttgtacgcggtagatggcgatgagtataaatttttttgcgttgcgaaaggcggcgttttgttaataaaacgtatttttattaggaaattaaagttttgttgattttcggtaaattgaaaaattttttcgtcgagaaaatgcgtattttcggtattgtagtttgttcgtcgtattatatcgcgtttgtgattggcggtacgtttgcggaaattaatttgaaaatcgttaagttagtaagcgtttattattacgatgaattgtcgacggaagggaacgaatatggttagggtttcgcgatgtttagttggaataggaattgttggaagaggtttagaaattcggttttggcgcgtagtttggcggtaaatatttcgcgtacgatattcgcgttattcgtttgttacgttacggcgtattttgttcggtcggtat

SEQ ID NO: 24224 - DNA, 600 bp, Artificial Sequence
  chemically treated genomic DNA (Homo sapiens) CpG-island No: 24224
  misc_feature (495)..(495): n is either a, c, g or t
ataccgaccgaacaaaatacgccgtaacgtaacaaacgaataacgcgaatatcgtacgcgaaatatttaccgccaaactacgcgccaaaaccgaatttctaaacctcttccaacaattcctattccaactaaacatcgcgaaaccctaaccatattcgttcccttccgtcgacaattcatcgtaataataaacgcttactaacttaacgattttcaaattaatttccgcaaacgtaccgccaatcacaaacgcgatataatacgacgaacaaactacaataccgaaaatacgcattttctcgacgaaaaaatttttcaatttaccgaaaatcaacaaaactttaatttcctaataaaaatacgttttattaacaaaacgccgcctttcgcaacgcaaaaaaatttatactcatcgccatctaccgcgtacaaatcgatttacgcgaacaaattaatacctatattaacctctttatacatatccaacgccgcatnctttactaacgccttccgactccaataatccaaactcatacaacgcatattaaaacaccgcttctttaaaaaaacgcatctcttccgaacgataacgattcataa

SEQ ID NO: 24225 - DNA, 597 bp, Artificial Sequence
  chemically treated genomic DNA (Homo sapiens) CpG-island No: 24225
gttcgcggagtgtcgtggataaattatcgtattattgtattgcgagattgttttatgtaagatcgaacgtcgtagtcgttaacggtagggattcgatatttttcgttagataatggtttgcggtatttttttggcgtgtttgaataagtattggcggcgagagatttaaggtcgttatttgcgcgtgacgttttcgttagtggcggtttatttagttaggtttataattcgcgtttagtacgtgggtgtatttacgttgtggaagtattgttagtaaggcgttatatttttggcgttgtagatttgtatgttgtttatagtgtgcggttgttcgattaaatgtcgttgtaatggtttgtttattaatcgttgttatgtagtatttttagtagacggtcgatattttgtattttatgcgtacgggttagcgttaagcgtagtcgcgtagtattagcgggtacggttggcgggcgaatcgtcgtgatttagtagttttgttgacgtagtttttttgttagttgtaacgtacggttgttattatcgataattaatggttggatggcgttgtatgaattagtaagcgtaaacggtaaattt

SEQ ID NO: 24226 - DNA, 597 bp, Artificial Sequence
  chemically treated genomic DNA (Homo sapiens) CpG-island No: 24226
aaatttaccgtttacgcttactaattcatacaacgccatccaaccattaattatcgataataacaaccgtacgttacaactaacaaaaaaactacgtcaacaaaactactaaatcacgacgattcgcccgccaaccgtacccgctaatactacgcgactacgcttaacgctaacccgtacgcataaaatacaaaatatcgaccgtctactaaaaatactacataacaacgattaataaacaaaccattacaacgacatttaatcgaacaaccgcacactataaacaacatacaaatctacaacgccaaaaatataacgccttactaacaatacttccacaacgtaaatacacccacgtactaaacgcgaattataaacctaactaaataaaccgccactaacgaaaacgtcacgcgcaaataacgaccttaaatctctcgccgccaatacttattcaaacacgccaaaaaaataccgcaaaccattatctaacgaaaaatatcgaatccctaccgttaacgactacgacgttcgatcttacataaaacaatctcgcaatacaataatacgataatttatccacgacactccgcgaac

SEQ ID NO: 24227 - DNA, 597 bp, Artificial Sequence
  chemically treated genomic DNA (Homo sapiens) CpG-island No: 24227
ggatttgtcgtttacgtttgttgatttatgtagcgttatttagttattgattgtcggtgataatagtcgtgcgttataattggtagaaaaattgcgttagtaaggttgttgggttacggcgattcgttcgttaatcgtattcgttggtattgcgcgattgcgtttaacgttaattcgtgcgtatgaaatgtaggatatcgatcgtttgttggaggtgttgtatggtaacggttaataaataagttattgtagcggtatttggtcgggtagtcgtatattatgagtaatatgtagatttatagcgttagagatgtgacgttttattggtaatgtttttatagcgtaaatatatttacgtattggacgcgggttgtggatttggttggatgagtcgttattggcgggaacgttacgcgtaggtgacggttttagatttttcgtcgttaatgtttgtttaggtacgttagaaggatgtcgtagattattatttggcgggagatatcgaatttttgtcgttagcgattgcgacgttcgattttgtatggagtaatttcgtagtgtagtggtgcggtaatttatttacggtatttcgcgagt

SEQ ID NO: 24228 - DNA, 597 bp, Artificial Sequence
  chemically treated genomic DNA (Homo sapiens) CpG-island No: 24228
actcgcgaaataccgtaaataaattaccgcaccactacactacgaaattactccatacaaaatcgaacgtcgcaatcgctaacgacaaaaattcgatatctcccgccaaataataatctacgacatccttctaacgtacctaaacaaacattaacgacgaaaaatctaaaaccgtcacctacgcgtaacgttcccgccaataacgactcatccaaccaaatccacaacccgcgtccaatacgtaaatatatttacgctataaaaacattaccaataaaacgtcacatctctaacgctataaatctacatattactcataatatacgactacccgaccaaataccgctacaataacttatttattaaccgttaccatacaacacctccaacaaacgatcgatatcctacatttcatacgcacgaattaacgttaaacgcaatcgcgcaataccaacgaatacgattaacgaacgaatcgccgtaacccaacaaccttactaacgcaatttttctaccaattataacgcacgactattatcaccgacaatcaataactaaataacgctacataaatcaacaaacgtaaacgacaaatcc

SEQ ID NO: 24229 - DNA, 534 bp, Artificial Sequence
  chemically treated genomic DNA (Homo sapiens) CpG-island No: 24229
tagtagttgtcgcgtttttgtttttcgataacgttcgtgtcgtgggtattatcgattattaattagcgattgtgttgttgcgttatttgttggattttcgttagtggcgtagtatcgtcgtttatgttgaatacgcgttttgttattattatttgttgtttcggatagggggaagtaagtaatcgcgttaaatgagtgatatcgttatgagtaaaacggcgaagttgcgacgggtttaaattggtagtttttagtaatgaggtatggttaagtcggtcggtagtaatacggttttttttcgttattatcgcggtaataattgtttgattagcgacgaaattagagatatttagtagtgttcgttaatagttaagttattcggttagttttttttttagtgtttgatgtattacgttataatcgttgacgtgatcggagtcgtcgttatcgatgttaaattgttcgttttttgttgttaggtacggataatttgcggatgatggtttaaatttaaataatcgttattggaaaagt

SEQ ID NO: 24230 - DNA, 534 bp, Artificial Sequence
  chemically treated genomic DNA (Homo sapiens) CpG-island No: 24230
acttttccaataacgattatttaaatttaaaccatcatccgcaaattatccgtacctaacaacaaaaaacgaacaatttaacatcgataacgacgactccgatcacgtcaacgattataacgtaatacatcaaacactaaaaaaaaaactaaccgaataacttaactattaacgaacactactaaatatctctaatttcgtcgctaatcaaacaattattaccgcgataataacgaaaaaaaaccgtattactaccgaccgacttaaccatacctcattactaaaaactaccaatttaaacccgtcgcaacttcgccgttttactcataacgatatcactcatttaacgcgattacttacttccccctatccgaaacaacaaataataataacaaaacgcgtattcaacataaacgacgatactacgccactaacgaaaatccaacaaataacgcaacaacacaatcgctaattaataatcgataatacccacgacacgaacgttatcgaaaaacaaaaacgcgacaactacta

SEQ ID NO: 24231 - DNA, 534 bp, Artificial Sequence
  chemically treated genomic DNA (Homo sapiens) CpG-island No: 24231
atttttttagtaacgattatttaggtttaagttattattcgtaaattattcgtgtttggtagtagggggcggataatttggtatcggtagcggcggtttcggttacgttagcggttatagcgtggtgtattaggtattggaagaagagttggtcgagtggtttggttattggcgggtattgttgaatatttttggtttcgtcgttaattaggtagttattgtcgcgatgatggcgaaagaggatcgtattgttgtcgatcggtttagttatgttttattgttggaagttgttagtttaagttcgtcgtagtttcgtcgttttgtttataacgatgttatttatttggcgcgattgtttgtttttttttgttcggggtagtaaatggtggtgatagaacgcgtgtttagtatggacggcgatattgcgttattggcggaaatttagtaggtaacgtaatagtataatcgttggttgatggtcgatgatgtttacggtacgggcgttatcggggagtaggggcgcggtagttgttg

SEQ ID NO: 24232 - DNA, 534 bp, Artificial Sequence
  chemically treated genomic DNA (Homo sapiens) CpG-island No: 24232
caacaactaccgcgcccctactccccgataacgcccgtaccgtaaacatcatcgaccatcaaccaacgattatactattacgttacctactaaatttccgccaataacgcaatatcgccgtccatactaaacacgcgttctatcaccaccatttactaccccgaacaaaaaaaaacaaacaatcgcgccaaataaataacatcgttataaacaaaacgacgaaactacgacgaacttaaactaacaacttccaacaataaaacataactaaaccgatcgacaacaatacgatcctctttcgccatcatcgcgacaataactacctaattaacgacgaaaccaaaaatattcaacaatacccgccaataaccaaaccactcgaccaactcttcttccaatacctaatacaccacgctataaccgctaacgtaaccgaaaccgccgctaccgataccaaattatccgccccctactaccaaacacgaataatttacgaataataacttaaacctaaataatcgttactaaaaaaat

SEQ ID NO: 24233 - DNA, 1050 bp, Artificial Sequence
  chemically treated genomic DNA (Homo sapiens) CpG-island No: 24233
tggtcgtcgatcgttttagtggtgaagttcgtgcgatggtcggaggttttgagtcgtagtttgcgggttataatcgtgcgatgtaggcgcgtcgttcgattggtttttttgtaaaattagcgatttatttgacggttttaagttagtcgaaaatttatcgtttgaatacgtggattgcggatgcgttaattgcgttgcgttatcgaatggttaggtttggttatcgtagaatgatgatcgtcgttatagcgaaagcgttagagtgatgttggtggatgcgttgattcgttcgatgaacgtgtcgacggtaaatttggggatggcgttggggttgtttgcggttacggagatttggattaaattgggcgtatcgaaagattagttgtattcggtttcggtaatgttgttgggggcgttgaatttaacgttaatcgaagtggcgtaggtattttagattatcgttagcggtggtaatcgtgtatcgttttttgcgttgcgttcggtaatcgcggaagatggtaaagtgttgtattagagtttttcgtaggcggaacgcgttgtttcggcgtaggcggcgtatttgatattatggattatgtagtaggtggtataacgcggtacgggtcgttagtttggggcgaaatattcgaatttgtatttggtagggaaaatagggattattaataataacgtagatatttggtttgcgggtattgacggtagtacggtgattattatttgggtcggtcgtgataataattagtcgattaaattgtatggtgttagcggggtaatgtcgatttattagcgttatttggttaattagacgttaacgtcgttgaattttgtttcgttagaagatattgtagatatgggcgtggattacgacggtaattttgtttgtagcggtggtatgcgtattttgtcggtttggattagcgattcgtaatcgttgtgttagtagagcgagatgtagtagtagtcgttaggtaattcgtttgattagtttttttagtcgtagtaatagtcgtaatagtaatttgtttagta

SEQ ID NO: 24234 - DNA, 1050 bp, Artificial Sequence
  chemically treated genomic DNA (Homo sapiens) CpG-island No: 24234
tactaaacaaattactattacgactattactacgactaaaaaaactaatcaaacgaattacctaacgactactactacatctcgctctactaacacaacgattacgaatcgctaatccaaaccgacaaaatacgcataccaccgctacaaacaaaattaccgtcgtaatccacgcccatatctacaatatcttctaacgaaacaaaattcaacgacgttaacgtctaattaaccaaataacgctaataaatcgacattaccccgctaacaccatacaatttaatcgactaattattatcacgaccgacccaaataataatcaccgtactaccgtcaatacccgcaaaccaaatatctacgttattattaataatccctattttccctaccaaatacaaattcgaatatttcgccccaaactaacgacccgtaccgcgttataccacctactacataatccataatatcaaatacgccgcctacgccgaaacaacgcgttccgcctacgaaaaactctaatacaacactttaccatcttccgcgattaccgaacgcaacgcaaaaaacgatacacgattaccaccgctaacgataatctaaaatacctacgccacttcgattaacgttaaattcaacgcccccaacaacattaccgaaaccgaatacaactaatctttcgatacgcccaatttaatccaaatctccgtaaccgcaaacaaccccaacgccatccccaaatttaccgtcgacacgttcatcgaacgaatcaacgcatccaccaacatcactctaacgctttcgctataacgacgatcatcattctacgataaccaaacctaaccattcgataacgcaacgcaattaacgcatccgcaatccacgtattcaaacgataaattttcgactaacttaaaaccgtcaaataaatcgctaattttacaaaaaaaccaatcgaacgacgcgcctacatcgcacgattataacccgcaaactacgactcaaaacctccgaccatcgcacgaacttcaccactaaaacgatcgacgacca

SEQ ID NO: 24235 - DNA, 1050 bp, Artificial Sequence
  chemically treated genomic DNA (Homo sapiens) CpG-island No: 24235
tgttgagtaggttgttgttgcggttgttgttgcggttgagaagattgattaaacggattgtttgacggttgttgttgtatttcgttttgttggtatagcgattgcggatcgttggtttagatcggtaagatacgtatgttatcgttgtaaataaagttgtcgtcgtagtttacgtttatatttgtaatattttttggcggaataagatttagcggcgttggcgtttggttagttagataacgttgataaatcgatattgtttcgttggtattatatagtttggtcggttggttgttattacggtcgatttaagtgatggttatcgtgttgtcgttaatgttcgtaaattaggtatttacgttattgttggtagtttttgttttttttgttagatgtaggttcgggtatttcgttttaagttgacgattcgtatcgcgttgtattatttgttgtatggtttatagtgttagatacgtcgtttgcgtcggaatagcgcgtttcgtttgcgggaagttttgatatagtattttgttatttttcgcgattatcgaacgtagcgtagaaagcggtgtacggttattatcgttggcgatggtttggaatgtttgcgttatttcgattggcgttaagtttaacgtttttagtagtattgtcggaatcggatgtaattgatttttcggtacgtttagtttaatttaggttttcgtaatcgtaggtagttttagcgttatttttagatttatcgtcggtacgtttatcgaacgggttaacgtatttattagtattattttgacgttttcgttataacgacggttattattttgcggtgattagatttggttattcggtgacgtagcgtaattggcgtattcgtaatttacgtatttagacgatagattttcggttggtttaaggtcgttagataagtcgttggttttgtaagggaattaatcgaacgacgcgtttgtatcgtacggttgtagttcgtaaattgcggtttagaattttcgattatcgtacgaattttattattaaagcggtcgacgatta

SEQ ID NO: 24236 - DNA, 1050 bp, Artificial Sequence
  chemically treated genomic DNA (Homo sapiens) CpG-island No: 24236
taatcgtcgaccgctttaataataaaattcgtacgataatcgaaaattctaaaccgcaatttacgaactacaaccgtacgatacaaacgcgtcgttcgattaattcccttacaaaaccaacgacttatctaacgaccttaaaccaaccgaaaatctatcgtctaaatacgtaaattacgaatacgccaattacgctacgtcaccgaataaccaaatctaatcaccgcaaaataataaccgtcgttataacgaaaacgtcaaaataatactaataaatacgttaacccgttcgataaacgtaccgacgataaatctaaaaataacgctaaaactacctacgattacgaaaacctaaattaaactaaacgtaccgaaaaatcaattacatccgattccgacaatactactaaaaacgttaaacttaacgccaatcgaaataacgcaaacattccaaaccatcgccaacgataataaccgtacaccgctttctacgctacgttcgataatcgcgaaaaataacaaaatactatatcaaaacttcccgcaaacgaaacgcgctattccgacgcaaacgacgtatctaacactataaaccatacaacaaataatacaacgcgatacgaatcgtcaacttaaaacgaaatacccgaacctacatctaacaaaaaaaacaaaaactaccaacaataacgtaaatacctaatttacgaacattaacgacaacacgataaccatcacttaaatcgaccgtaataacaaccaaccgaccaaactatataataccaacgaaacaatatcgatttatcaacgttatctaactaaccaaacgccaacgccgctaaatcttattccgccaaaaaatattacaaatataaacgtaaactacgacgacaactttatttacaacgataacatacgtatcttaccgatctaaaccaacgatccgcaatcgctataccaacaaaacgaaatacaacaacaaccgtcaaacaatccgtttaatcaatcttctcaaccgcaacaacaaccgcaacaacaacctactcaaca

SEQ ID NO: 24237 - DNA, 749 bp, Artificial Sequence
  chemically treated genomic DNA (Homo sapiens) CpG-island No: 24237
tgttcggagatttttatcgttaggtatagtttaggttttagtattaggttggagatatcgatatagcgttcgtgttttatttatttttcgtttttcgttatcggacgagaataggttaatttcgtatttatcgttttgtaaagttgttttgttagcgtaatgttttttttgttgttaatatcgcgatcgacgttgattattagacgggttttgtcgagatcgacgttgttgttttggcgcgtttgggttgtcgtgcgggtaatcgttatagtcggagtttgttattttacggtgtgcgtttcgttagtgcgtgacgcgtttggttgagtcgtatcgaacgtgtcgttgttgatggttagtatcgtatacggcgtggtaatgcgtttttcgttaatcgttagattatcgtaaattatgtgttttattgtcgttttatcgttttgtacgttgacggtgttggtatcgttagatatcgtcgttttaaggcgataatttagttttgtcgttagtaatttgtcgcgacgggtgtttggtagtagtattaggtcgtttgcgtcgtgttggcgaatagtgttagttatgatatcggcgtaattttcgattattcgatcgttcgggttgtcggttaattttagatatgattagcgcgattggattgttgtgcgcgtcggattatgaggataaggtgtgattgaatagttaagttgcgtacgttattattcgtaacgaaaaggttcgtgatattagtt

SEQ ID NO: 24238 - DNA, 749 bp, Artificial Sequence
  chemically treated genomic DNA (Homo sapiens) CpG-island No: 24238
aactaatatcacgaaccttttcgttacgaataataacgtacgcaacttaactattcaatcacaccttatcctcataatccgacgcgcacaacaatccaatcgcgctaatcatatctaaaattaaccgacaacccgaacgatcgaataatcgaaaattacgccgatatcataactaacactattcgccaacacgacgcaaacgacctaatactactaccaaacacccgtcgcgacaaattactaacgacaaaactaaattatcgccttaaaacgacgatatctaacgataccaacaccgtcaacgtacaaaacgataaaacgacaataaaacacataatttacgataatctaacgattaacgaaaaacgcattaccacgccgtatacgatactaaccatcaacaacgacacgttcgatacgactcaaccaaacgcgtcacgcactaacgaaacgcacaccgtaaaataacaaactccgactataacgattacccgcacgacaacccaaacgcgccaaaacaacaacgtcgatctcgacaaaacccgtctaataatcaacgtcgatcgcgatattaacaacaaaaaaaacattacgctaacaaaacaactttacaaaacgataaatacgaaattaacctattctcgtccgataacgaaaaacgaaaaataaataaaacacgaacgctatatcgatatctccaacctaatactaaaacctaaactatacctaacgataaaaatctccgaaca

SEQ ID NO: 24239 - DNA, 749 bp, Artificial Sequence
  chemically treated genomic DNA (Homo sapiens) CpG-island No: 24239
agttggtattacgaattttttcgttgcgaatgatgacgtgcgtagtttagttatttaattatattttgtttttatgattcgacgcgtatagtaatttagtcgcgttaattatgtttgagattaatcggtaattcggacgatcggatgatcgaagattacgtcggtgttatggttgatattattcgttagtacggcgtagacggtttggtgttgttgttaaatattcgtcgcggtaaattattggcggtaaaattgggttatcgttttaaagcggcggtgtttaacgatgttagtatcgttagcgtataggacggtaaagcgatagtgaaatatatggtttacggtggtttggcgattggcgaagaacgtattgttacgtcgtatgcggtattgattattagtagcggtacgttcgatgcggtttagttagacgcgttacgtattggcgaaacgtatatcgtggagtggtaggtttcggttgtggcgattattcgtacggtaatttaggcgcgttagagtaatagcgtcgatttcgataaagttcgtttggtggttagcgtcggtcgcggtattggtagtaaagagaatattgcgttggtagaatagttttgtaaggcgataggtgcggagttggtttgttttcgttcggtggcggaaaacgaaaaatggatggagtacgaacgttatgtcggtatttttaatttgatgttgaaatttgaattgtatttggcggtggggattttcgggta

SEQ ID NO: 24240 - DNA, 749 bp, Artificial Sequence
  chemically treated genomic DNA (Homo sapiens) CpG-island No: 24240
tacccgaaaatccccaccgccaaatacaattcaaatttcaacatcaaattaaaaataccgacataacgttcgtactccatccatttttcgttttccgccaccgaacgaaaacaaaccaactccgcacctatcgccttacaaaactattctaccaacgcaatattctctttactaccaataccgcgaccgacgctaaccaccaaacgaactttatcgaaatcgacgctattactctaacgcgcctaaattaccgtacgaataatcgccacaaccgaaacctaccactccacgatatacgtttcgccaatacgtaacgcgtctaactaaaccgcatcgaacgtaccgctactaataatcaataccgcatacgacgtaacaatacgttcttcgccaatcgccaaaccaccgtaaaccatatatttcactatcgctttaccgtcctatacgctaacgatactaacatcgttaaacaccgccgctttaaaacgataacccaattttaccgccaataatttaccgcgacgaatatttaacaacaacaccaaaccgtctacgccgtactaacgaataatatcaaccataacaccgacgtaatcttcgatcatccgatcgtccgaattaccgattaatctcaaacataattaacgcgactaaattactatacgcgtcgaatcataaaaacaaaatataattaaataactaaactacgcacgtcatcattcgcaacgaaaaaattcgtaataccaact

SEQ ID NO: 24241 - DNA, 569 bp, Artificial Sequence
  chemically treated genomic DNA (Homo sapiens) CpG-island No: 24241
ttttcggttttgtcggttaacggacgtacggtttattaggggtatttgttcgtaatgaattaattgttggtcgaattcgggatgcgttattattcggaaatttttttgatcgatagtatatttttttcgtttggtagaagcgtaatttatagggcgttgcggcgtcgtttcggtatatgttttcgaataaggtgtggatgtcgttcgttaagagttggttcgtttatagtaaagagggatagcgatacgcggtgtttgatgcgttgatcgaatattatttggaaatttagggagaagttttgcgcgatgttttattggtaacgggcggttttggtttggcgattggtttggttcggtagtgggcgtaagaaaacggtaattaggttcgtaaagtagggcgttcgttcgttgggcgcggcgtagtgtttttcggtttatgtttttaaatgattaatcgttaggtagtatattatcgttaaattgtattagttcgtgaagttgatgtggtacgttgttttttaattgaaattttggtcgtttatgtatacgaattggtagagtgggttttg

SEQ ID NO: 24242 - DNA, 569 bp, Artificial Sequence
  chemically treated genomic DNA (Homo sapiens) CpG-island No: 24242
caaaacccactctaccaattcgtatacataaacgaccaaaatttcaattaaaaaacaacgtaccacatcaacttcacgaactaatacaatttaacgataatatactacctaacgattaatcatttaaaaacataaaccgaaaaacactacgccgcgcccaacgaacgaacgccctactttacgaacctaattaccgttttcttacgcccactaccgaaccaaaccaatcgccaaaccaaaaccgcccgttaccaataaaacatcgcgcaaaacttctccctaaatttccaaataatattcgatcaacgcatcaaacaccgcgtatcgctatccctctttactataaacgaaccaactcttaacgaacgacatccacaccttattcgaaaacatataccgaaacgacgccgcaacgccctataaattacgcttctaccaaacgaaaaaaatatactatcgatcaaaaaaatttccgaataataacgcatcccgaattcgaccaacaattaattcattacgaacaaatacccctaataaaccgtacgtccgttaaccgacaaaaccgaaaa

SEQ ID NO: 24243 - DNA, 569 bp, Artificial Sequence
  chemically treated genomic DNA (Homo sapiens) CpG-island No: 24243
tagaatttattttgttagttcgtgtgtataagcggttagagttttaattgagaggtagcgtgttatattaattttacgggttggtgtaatttgacggtaatgtgttatttggcggttggttatttgagagtatgaatcggagagtattacgtcgcgtttagcgagcggacgttttgttttgcgagtttggttatcgtttttttgcgtttattgtcgggttaggttaatcgttagattagaatcgttcgttattagtggggtatcgcgtaaggtttttttttgaatttttagatggtgttcggttagcgtattaagtatcgcgtatcgttatttttttttgttgtaagcgagttaatttttgacgaacggtatttatattttgttcgaaaatatgtgtcgaaacgacgtcgtagcgttttgtggattgcgtttttattagacggggaagatatgttgtcggttaagggaattttcgggtgatggcgtatttcggattcggttagtagttgatttattacgaataaatatttttgataaatcgtacgttcgttgatcggtagggtcggaga

SEQ ID NO: 24244 - DNA, 569 bp, Artificial Sequence
  chemically treated genomic DNA (Homo sapiens) CpG-island No: 24244
tctccgaccctaccgatcaacgaacgtacgatttatcaaaaatatttattcgtaataaatcaactactaaccgaatccgaaatacgccatcacccgaaaattcccttaaccgacaacatatcttccccgtctaataaaaacgcaatccacaaaacgctacgacgtcgtttcgacacatattttcgaacaaaatataaataccgttcgtcaaaaattaactcgcttacaacaaaaaaaaataacgatacgcgatacttaatacgctaaccgaacaccatctaaaaattcaaaaaaaaaccttacgcgataccccactaataacgaacgattctaatctaacgattaacctaacccgacaataaacgcaaaaaaacgataaccaaactcgcaaaacaaaacgtccgctcgctaaacgcgacgtaatactctccgattcatactctcaaataaccaaccgccaaataacacattaccgtcaaattacaccaacccgtaaaattaatataacacgctacctctcaattaaaactctaaccgcttatacacacgaactaacaaaataaattcta

SEQ ID NO: 24245 - DNA, 545 bp, Artificial Sequence
  chemically treated genomic DNA (Homo sapiens) CpG-island No: 24245
  misc_feature (168)..(168): n is either a, c, g or t
  misc_feature (178)..(178): n is either a, c, g or t
  misc_feature (192)..(192): n is either a, c, g or t
  misc_feature (226)..(226): n is either a, c, g or t
  misc_feature (237)..(238): n is either a, c, g or t
  misc_feature (247)..(247): n is either a, c, g or t
  misc_feature (254)..(254): n is either a, c, g or t
  misc_feature (276)..(276): n is either a, c, g or t
  misc_feature (289)..(289): n is either a, c, g or t
  misc_feature (322)..(322): n is either a, c, g or t
gaatcgggcggtaaagtttaggtttcgggtatgggtagtcggtttcggtcgcgagtcgtagcgttagtagcgttagtagcgttagtagcgttagattcgggacgtcgttcggcgggttagagacgagacgttagcgtcgaagttgcggtcgggatatagtagtaggtnttagcgggtncggagtgggttttntatcgtttgggtgggcggggtttgttgcgcgttnggggtaggaanngggtcgggnaaaattncggaaaggtcgggaagggcggngaagggtcggaangggtcgggtttatcggggcgggcgtggaaagtncgggtttcgaacgttttcgggttttataggtgggtgaagttaagtggttgttggagcgtttcgggggatagttagtgtttgcggcgtcgagagggtcgttcgtggatttaaatgggtattattttcgatcgtttatagtttttttaatagtttgtatttcgttttgtcgtggttggtcgtgtattttttgtggagtttgaaggtataaggggatttttaaaat

SEQ ID NO: 24246 - DNA, 545 bp, Artificial Sequence
  chemically treated genomic DNA (Homo sapiens) CpG-island No: 24246
  misc_feature (224)..(224): n is either a, c, g or t
  misc_feature (257)..(257): n is either a, c, g or t
  misc_feature (270)..(270): n is either a, c, g or t
  misc_feature (292)..(292): n is either a, c, g or t
  misc_feature (299)..(299): n is either a, c, g or t
  misc_feature (308)..(309): n is either a, c, g or t
  misc_feature (320)..(320): n is either a, c, g or t
  misc_feature (354)..(354): n is either a, c, g or t
  misc_feature (368)..(368): n is either a, c, g or t
  misc_feature (378)..(378): n is either a, c, g or t
attttaaaaatccccttataccttcaaactccacaaaaaatacacgaccaaccacgacaaaacgaaatacaaactattaaaaaaactataaacgatcgaaaataatacccatttaaatccacgaacgaccctctcgacgccgcaaacactaactatcccccgaaacgctccaacaaccacttaacttcacccacctataaaacccgaaaacgttcgaaacccgnactttccacgcccgccccgataaacccgacccnttccgacccttcnccgcccttcccgacctttccgnaattttncccgacccnnttcctaccccnaacgcgcaacaaaccccgcccacccaaacgatanaaaacccactccgnacccgctaanacctactactatatcccgaccgcaacttcgacgctaacgtctcgtctctaacccgccgaacgacgtcccgaatctaacgctactaacgctactaacgctactaacgctacgactcgcgaccgaaaccgactacccatacccgaaacctaaactttaccgcccgattc

SEQ ID NO: 24247 - DNA, 545 bp, Artificial Sequence
  chemically treated genomic DNA (Homo sapiens) CpG-island No: 24247
  misc_feature (224)..(224): n is either a, c, g or t
  misc_feature (257)..(257): n is either a, c, g or t
  misc_feature (270)..(270): n is either a, c, g or t
  misc_feature (292)..(292): n is either a, c, g or t
  misc_feature (299)..(299): n is either a, c, g or t
  misc_feature (308)..(309): n is either a, c, g or t
  misc_feature (320)..(320): n is either a, c, g or t
  misc_feature (354)..(354): n is either a, c, g or t
  misc_feature (368)..(368): n is either a, c, g or t
  misc_feature (378)..(378): n is either a, c, g or t
attttggggatttttttgtatttttagattttataaggagtatacgattagttacgataaaacgagatgtagattattgggaggattataaacggtcgggggtgatatttatttgagtttacgaacggttttttcggcgtcgtagatattggttgtttttcgagacgttttagtagttatttaattttatttatttgtagggttcggggacgttcgaagttcgnattttttacgttcgtttcggtgggttcggtttntttcggttttttntcgtttttttcggttttttcgnaattttnttcggtttnntttttgttttngacgcgtagtaggtttcgtttatttaggcggtanggaatttatttcgngttcgttagnatttgttgttatgtttcggtcgtagtttcgacgttggcgtttcgtttttagttcgtcgagcggcgtttcgggtttagcgttgttggcgttgttggcgttgttggcgttgcggttcgcggtcgggatcgattgtttatgttcggagtttgagttttgtcgttcgattt

SEQ ID NO: 24248 - DNA, 545 bp, Artificial Sequence
  chemically treated genomic DNA (Homo sapiens) CpG-island No: 24248
  misc_feature (168)..(168): n is either a, c, g or t
  misc_feature (178)..(178): n is either a, c, g or t
  misc_feature (192)..(192): n is either a, c, g or t
  misc_feature (226)..(226): n is either a, c, g or t
  misc_feature (237)..(238): n is either a, c, g or t
  misc_feature (247)..(247): n is either a, c, g or t
  misc_feature (254)..(254): n is either a, c, g or t
  misc_feature (276)..(276): n is either a, c, g or t
  misc_feature (289)..(289): n is either a, c, g or t
  misc_feature (322)..(322): n is either a, c, g or t
aaatcgaacgacaaaactcaaactccgaacataaacaatcgatcccgaccgcgaaccgcaacgccaacaacgccaacaacgccaacaacgctaaacccgaaacgccgctcgacgaactaaaaacgaaacgccaacgtcgaaactacgaccgaaacataacaacaaatnctaacgaacncgaaataaattccntaccgcctaaataaacgaaacctactacgcgtcnaaaacaaaaannaaaccgaanaaaattncgaaaaaaccgaaaaaaacganaaaaaaccgaaanaaaccgaacccaccgaaacgaacgtaaaaaatncgaacttcgaacgtccccgaaccctacaaataaataaaattaaataactactaaaacgtctcgaaaaacaaccaatatctacgacgccgaaaaaaccgttcgtaaactcaaataaatatcacccccgaccgtttataatcctcccaataatctacatctcgttttatcgtaactaatcgtatactccttataaaatctaaaaatacaaaaaaatccccaaaat

SEQ ID NO: 24249 - DNA, 976 bp, Artificial Sequence
  chemically treated genomic DNA (Homo sapiens) CpG-island No: 24249
  misc_feature (224)..(224): n is either a, c, g or t
ttcggacgttgtaggcgttagaagggggcggggagtagaaaacggtcgggtgaattattgggcgtaataggtgtcgtagtcgtagttgcgttcgtagcgcgcgcggatcgtagggataaggtttttttttttttcgggtttttttggaggtaaggaggagattatcgaggtttttattcgataaatgtaggttacggttgtttatcgtttagtaattggcggangttaatgggaggcggcggggtttgcggcgtcggcgcgcgggggcggggtgggaatttcggaaatttgcggaggtcgggaggcggttgtaaggggcggggaaggcgggagttcgtagcggaggaggggtcgcgggcgggaggcgttgcgaggcgttgttggttttcgggttgcgggagtcgggttaggacgtcgagcggtgatttttcgtcgttttcgggggtcgtgacggtgagtagtagcgtttcgcgtcggggattgtgacgcgttttcgttaggaaggggcgggcgggggtgggcgtcggtaaggggcgggcgcgcgcggaggtgagagtcggtatttggtttagcgtttcgttgttcggcgggaggtttcgcgcggttgttggggtcgttgtagggtgcgggcgagcgtcgattcgggtcgtttttggaggaggaggtgggaggtaggtgttggtttcgggatcgttttcgttggcgttcgcggagttgcgtttgcggagcgttttgattcggggagttttaaattttttttgggatggagtaaggttggcgttcggcgttgggggacgagtagcgcggggacgtgggggaggaggggatggtcgatttggggttgtagagttttagtagcggtcgtggggtatgcggggtttggcgatttgttagtgtagtcgtaagaggtagtttttaaaacgagttattgggtggtcgttgtagtggaagagaatttcgatagtggtttagtaaa

SEQ ID NO: 24250 - DNA, 976 bp, Artificial Sequence
  chemically treated genomic DNA (Homo sapiens) CpG-island No: 24250
  misc_feature (753)..(753): n is either a, c, g or t
tttactaaaccactatcgaaattctcttccactacaacgaccacccaataactcgttttaaaaactacctcttacgactacactaacaaatcgccaaaccccgcataccccacgaccgctactaaaactctacaaccccaaatcgaccatcccctcctcccccacgtccccgcgctactcgtcccccaacgccgaacgccaaccttactccatcccaaaaaaaatttaaaactccccgaatcaaaacgctccgcaaacgcaactccgcgaacgccaacgaaaacgatcccgaaaccaacacctacctcccacctcctcctccaaaaacgacccgaatcgacgctcgcccgcaccctacaacgaccccaacaaccgcgcgaaacctcccgccgaacaacgaaacgctaaaccaaataccgactctcacctccgcgcgcgcccgccccttaccgacgcccacccccgcccgccccttcctaacgaaaacgcgtcacaatccccgacgcgaaacgctactactcaccgtcacgacccccgaaaacgacgaaaaatcaccgctcgacgtcctaacccgactcccgcaacccgaaaaccaacaacgcctcgcaacgcctcccgcccgcgacccctcctccgctacgaactcccgccttccccgccccttacaaccgcctcccgacctccgcaaatttccgaaattcccaccccgcccccgcgcgccgacgccgcaaaccccgccgcctcccattaacntccgccaattactaaacgataaacaaccgtaacctacatttatcgaataaaaacctcgataatctcctccttacctccaaaaaaacccgaaaaaaaaaaaaaccttatccctacgatccgcgcgcgctacgaacgcaactacgactacgacacctattacgcccaataattcacccgaccgttttctactccccgcccccttctaacgcctacaacgtccgaa

SEQ ID NO: 24251 - DNA, 976 bp, Artificial Sequence
  chemically treated genomic DNA (Homo sapiens) CpG-island No: 24251
  misc_feature (753)..(753): n is either a, c, g or t
tttattagattattatcggggtttttttttattgtagcggttatttaataattcgttttaaagattgttttttgcggttgtattagtaaatcgttaaatttcgtatgttttacggtcgttgttgagattttgtagttttaaatcggttattttttttttttttacgttttcgcgttgttcgttttttaacgtcgggcgttaattttgttttattttagagagggtttggggtttttcgggttagagcgtttcgtaggcgtagtttcgcgaacgttagcgagagcggtttcggggttagtatttattttttatttttttttttaggagcggttcgggtcgacgttcgttcgtattttgtaacggttttaatagtcgcgcggagtttttcgtcgaataacggggcgttgagttaggtgtcggtttttattttcgcgcgcgttcgttttttgtcggcgtttattttcgttcgtttttttttggcgggggcgcgttataattttcgacgcgaggcgttgttgtttatcgttacggttttcgggagcggcggggagttatcgttcggcgttttagttcggttttcgtagttcgagggttagtagcgtttcgtagcgtttttcgttcgcggtttttttttcgttgcgggttttcgtttttttcgttttttgtagtcgtttttcggttttcgtaggttttcgaggtttttatttcgttttcgcgcgtcggcgtcgtaggtttcgtcgttttttattggtnttcgttagttgttaggcgatgaataatcgtggtttgtatttgtcgggtgggggtttcggtagttttttttttatttttaaaaaaattcggagaaaaagaagattttatttttgcggttcgcgcgcgttgcgggcgtagttgcggttgcggtatttgttacgtttagtgatttattcggtcgttttttgtttttcgtttttttttgacgtttgtagcgttcggg

SEQ ID NO: 24252 - DNA, 976 bp, Artificial Sequence
  chemically treated genomic DNA (Homo sapiens) CpG-island No: 24252
  misc_feature (224)..(224): n is either a, c, g or t
cccgaacgctacaaacgtcaaaaaaaaacgaaaaacaaaaaacgaccgaataaatcactaaacgtaacaaataccgcaaccgcaactacgcccgcaacgcgcgcgaaccgcaaaaataaaatcttctttttctccgaatttttttaaaaataaaaaaaaaactaccgaaacccccacccgacaaatacaaaccacgattattcatcgcctaacaactaacgaanaccaataaaaaacgacgaaacctacgacgccgacgcgcgaaaacgaaataaaaacctcgaaaacctacgaaaaccgaaaaacgactacaaaaaacgaaaaaaacgaaaacccgcaacgaaaaaaaaaccgcgaacgaaaaacgctacgaaacgctactaaccctcgaactacgaaaaccgaactaaaacgccgaacgataactccccgccgctcccgaaaaccgtaacgataaacaacaacgcctcgcgtcgaaaattataacgcgcccccgccaaaaaaaaacgaacgaaaataaacgccgacaaaaaacgaacgcgcgcgaaaataaaaaccgacacctaactcaacgccccgttattcgacgaaaaactccgcgcgactattaaaaccgttacaaaatacgaacgaacgtcgacccgaaccgctcctaaaaaaaaaaataaaaaataaatactaaccccgaaaccgctctcgctaacgttcgcgaaactacgcctacgaaacgctctaacccgaaaaaccccaaaccctctctaaaataaaacaaaattaacgcccgacgttaaaaaacgaacaacgcgaaaacgtaaaaaaaaaaaaaataaccgatttaaaactacaaaatctcaacaacgaccgtaaaacatacgaaatttaacgatttactaatacaaccgcaaaaaacaatctttaaaacgaattattaaataaccgctacaataaaaaaaaaccccgataataatctaataaa

SEQ ID NO: 24253 - DNA, 612 bp, Artificial Sequence
  chemically treated genomic DNA (Homo sapiens) CpG-island No: 24253
  misc_feature (477)..(477): n is either a, c, g or t
  misc_feature (585)..(585): n is either a, c, g or t
  misc_feature (611)..(611): n is either a, c, g or t
cggtagttagtagtagtatcgtttcgcggggttaggggttcggagcggtcgggcgggggtcgtcgggtaaggcgcgtagggttgggttgcggcgaggcgagaattacgcgcggcgggcgggcgtttggagtgtttgggtttgcgggtcggggcgggtcgcggcggaggggaagaggaggagtcggcgcgcgcgttatttaggcggggcggtgtttttagggggcgagtaggtcgttatcgttatcgttatcgttattattgttagaatcgtttttcgggggtcgtcgggtgttttttattttttcggtttcgggacggggttcgtagttcgtagtttttttcgtggaaatcgggtttttcgtttttgtgcgtcgcgagcgggtttcggatagcgttagatgcgagcgcgtcgggaagggttgcgaagattcgtttttcgggagttcgaatggttttttaggatttcgtagggcgggntttttaggtttgttacggtttttagtgtgggcgtgacgagcgtttttttttggagtttagttttcggtttgggattgttcgttgggttgttcggaggtttcggagtantcggaaagggcggttggaggtttttng

SEQ ID NO: 24254 - DNA, 612 bp, Artificial Sequence
  chemically treated genomic DNA (Homo sapiens) CpG-island No: 24254
  misc_feature (2)..(2): n is either a, c, g or t
  misc_feature (28)..(28): n is either a, c, g or t
  misc_feature (136)..(136): n is either a, c, g or t
cnaaaaacctccaaccgccctttccgantactccgaaacctccgaacaacccaacgaacaatcccaaaccgaaaactaaactccaaaaaaaaacgctcgtcacgcccacactaaaaaccgtaacaaacctaaaaancccgccctacgaaatcctaaaaaaccattcgaactcccgaaaaacgaatcttcgcaacccttcccgacgcgctcgcatctaacgctatccgaaacccgctcgcgacgcacaaaaacgaaaaacccgatttccacgaaaaaaactacgaactacgaaccccgtcccgaaaccgaaaaaataaaaaacacccgacgacccccgaaaaacgattctaacaataataacgataacgataacgataacgacctactcgccccctaaaaacaccgccccgcctaaataacgcgcgcgccgactcctcctcttcccctccgccgcgacccgccccgacccgcaaacccaaacactccaaacgcccgcccgccgcgcgtaattctcgcctcgccgcaacccaaccctacgcgccttacccgacgacccccgcccgaccgctccgaacccctaaccccgcgaaacgatactactactaactaccg

SEQ ID NO: 24255 - DNA, 612 bp, Artificial Sequence
  chemically treated genomic DNA (Homo sapiens) CpG-island No: 24255
  misc_feature (2)..(2): n is either a, c, g or t
  misc_feature (28)..(28): n is either a, c, g or t
  misc_feature (136)..(136): n is either a, c, g or t
tngggagtttttagtcgtttttttcgantgtttcggggttttcgagtaatttagcgggtagttttaagtcgagggttgaattttagggaggagcgttcgttacgtttatattggaggtcgtggtaggtttggaaanttcgttttgcggggttttaagaagttattcgagttttcgaagagcgagttttcgtagtttttttcggcgcgttcgtatttggcgttgttcggagttcgttcgcgacgtatagggacgggaggttcggtttttacgggagaggttgcggattgcgggtttcgtttcgaggtcgggggagtgggagatattcggcgattttcgagaggcgattttggtagtggtggcggtggcggtggcggtggcggtttattcgttttttggaagtatcgtttcgtttgggtggcgcgcgcgtcggtttttttttttttttttcgtcgcggttcgtttcggttcgtaaatttaaatattttaggcgttcgttcgtcgcgcgtgattttcgtttcgtcgtagtttagttttgcgcgttttgttcggcggttttcgttcggtcgtttcgggtttttggtttcgcggagcgatgttgttgttggttgtcg

SEQ ID NO: 24256 - DNA, 612 bp, Artificial Sequence
  chemically treated genomic DNA (Homo sapiens) CpG-island No: 24256
  misc_feature (477)..(477): n is either a, c, g or t
  misc_feature (585)..(585): n is either a, c, g or t
  misc_feature (611)..(611): n is either a, c, g or t
cgacaaccaacaacaacatcgctccgcgaaaccaaaaacccgaaacgaccgaacgaaaaccgccgaacaaaacgcgcaaaactaaactacgacgaaacgaaaatcacgcgcgacgaacgaacgcctaaaatatttaaatttacgaaccgaaacgaaccgcgacgaaaaaaaaaaaaaaaaaccgacgcgcgcgccacccaaacgaaacgatacttccaaaaaacgaataaaccgccaccgccaccgccaccgccaccactaccaaaatcgcctctcgaaaatcgccgaatatctcccactcccccgacctcgaaacgaaacccgcaatccgcaacctctcccgtaaaaaccgaacctcccgtccctatacgtcgcgaacgaactccgaacaacgccaaatacgaacgcgccgaaaaaaactacgaaaactcgctcttcgaaaactcgaataacttcttaaaaccccgcaaaacgaantttccaaacctaccacgacctccaatataaacgtaacgaacgctcctccctaaaattcaaccctcgacttaaaactacccgctaaattactcgaaaaccccgaaacantcgaaaaaaacgactaaaaactcccna

SEQ ID NO: 24257 - DNA, 540 bp, Artificial Sequence
  chemically treated genomic DNA (Homo sapiens) CpG-island No: 24257
  misc_feature (191)..(191): n is either a, c, g or t
  misc_feature (239)..(239): n is either a, c, g or t
tttatcgaatttaaagaaggttataatttttttttagtttatttcgtttttgaagagtttttttattatcgtggtaaagcgttttcgcgcggtgaagggcgttaggtgtagttggttggatatttcggcgaagtcgcggcggtagcggcgggagaagtcgtcgtcggtttggcggagggttaggtggattnataggtggtatcgggttgagcgtaggtttcgcggcggcgtcgggggtnagtcggggtttgtagcggcgaggttttggcgatcgggtttcgggatgcggttggatggggcgtgtgttcgggttgggaggagaagatgttcggtgcgggggcggttttcgggggcgcggcgtttatatttttcgtattttattcgtagtttttttgcgatagtttataatggatgtattttattattatttttcggttatcgtattttgtttttttagcgtgcgttattttttttagaggaaaagtaacgggggttaacggtatttttcgttttagtttttattttacggtttttagagaa

SEQ ID NO: 24258 - DNA, 540 bp, Artificial Sequence
  chemically treated genomic DNA (Homo sapiens) CpG-island No: 24258
  misc_feature (302)..(302): n is either a, c, g or t
  misc_feature (350)..(350): n is either a, c, g or t
ttctctaaaaaccgtaaaataaaaactaaaacgaaaaataccgttaacccccgttacttttcctctaaaaaaaataacgcacgctaaaaaaacaaaatacgataaccgaaaaataataataaaatacatccattataaactatcgcaaaaaaactacgaataaaatacgaaaaatataaacgccgcgcccccgaaaaccgcccccgcaccgaacatcttctcctcccaacccgaacacacgccccatccaaccgcatcccgaaacccgatcgccaaaacctcgccgctacaaaccccgactnacccccgacgccgccgcgaaacctacgctcaacccgataccacctatnaatccacctaaccctccgccaaaccgacgacgacttctcccgccgctaccgccgcgacttcgccgaaatatccaaccaactacacctaacgcccttcaccgcgcgaaaacgctttaccacgataataaaaaaactcttcaaaaacgaaataaactaaaaaaaaattataaccttctttaaattcgataaa

SEQ ID NO: 24259 - DNA, 540 bp, Artificial Sequence
  chemically treated genomic DNA (Homo sapiens) CpG-island No: 24259
  misc_feature (302)..(302): n is either a, c, g or t
  misc_feature (350)..(350): n is either a, c, g or t
ttttttgggggtcgtggggtgggagttggggcgagaggtgtcgttggttttcgttgttttttttttgggaaggatggcgtacgttgggagaatagggtacgataatcgggagatagtgatgaagtatatttattataagttgtcgtagaggggttacgagtgggatgcgggagatgtgggcgtcgcgttttcgggggtcgttttcgtatcgggtattttttttttttagttcgggtatacgttttatttagtcgtatttcgggattcggtcgttaggatttcgtcgttgtagatttcggttngttttcggcgtcgtcgcggggtttgcgtttagttcggtgttatttgtnggtttatttgatttttcgttaggtcggcgacgatttttttcgtcgttatcgtcgcgatttcgtcgagatgtttagttagttgtatttgacgttttttatcgcgcggggacgttttgttacggtggtggaggagttttttagggacggggtgaattgggggaggattgtggttttttttgagttcggtggg

SEQ ID NO: 24260 - DNA, 540 bp, Artificial Sequence
  chemically treated genomic DNA (Homo sapiens) CpG-island No: 24260
  misc_feature (191)..(191): n is either a, c, g or t
  misc_feature (239)..(239): n is either a, c, g or t
cccaccgaactcaaaaaaaaccacaatcctcccccaattcaccccgtccctaaaaaactcctccaccaccgtaacaaaacgtccccgcgcgataaaaaacgtcaaatacaactaactaaacatctcgacgaaatcgcgacgataacgacgaaaaaaatcgtcgccgacctaacgaaaaatcaaataaaccnacaaataacaccgaactaaacgcaaaccccgcgacgacgccgaaaacnaaccgaaatctacaacgacgaaatcctaacgaccgaatcccgaaatacgactaaataaaacgtatacccgaactaaaaaaaaaaaatacccgatacgaaaacgacccccgaaaacgcgacgcccacatctcccgcatcccactcgtaacccctctacgacaacttataataaatatacttcatcactatctcccgattatcgtaccctattctcccaacgtacgccatccttcccaaaaaaaaaacaacgaaaaccaacgacacctctcgccccaactcccaccccacgacccccaaaaaa

SEQ ID NO: 24261 - DNA, 531 bp, Artificial Sequence
  chemically treated genomic DNA (Homo sapiens) CpG-island No: 24261
cggaacgcgtttttttcggttacgagatgaggggtacgtagacggacgcgtttttcggtgagtgtgcgtgtattagtgtatgatttttttatttcgtttatagggtttgggtattcgttattatttacggttgtttggttagtaaataatagtagattcgataatcgttagttatttcgacggtttacgtttatcgttagtttttagtttttcgtagatcggaagtttttttgtttcggttcgtaggtttacgttttattgatagtaggaatcggaagtttttttgtttcgatcgtttgcgcgcggtttcgttggtcgtataggcgtagtggagttcgggcggagttgtgggagtggaggaggaagaggcggtagggggtacgggggttggttttagaagatggcggaggcgggggtgagttgggggtttttcggcgaagcgcgggtgacgtggtgttgaggaaagcggtttgaggaggagggtggtttttgggaagaagaattatttgtgtttttgtagtttgggaattt

SEQ ID NO: 24262 - DNA, 531 bp, Artificial Sequence
  chemically treated genomic DNA (Homo sapiens) CpG-island No: 24262
aaattcccaaactacaaaaacacaaataattcttcttcccaaaaaccaccctcctcctcaaaccgctttcctcaacaccacgtcacccgcgcttcgccgaaaaacccccaactcacccccgcctccgccatcttctaaaaccaacccccgtaccccctaccgcctcttcctcctccactcccacaactccgcccgaactccactacgcctatacgaccaacgaaaccgcgcgcaaacgatcgaaacaaaaaaacttccgattcctactatcaataaaacgtaaacctacgaaccgaaacaaaaaaacttccgatctacgaaaaactaaaaactaacgataaacgtaaaccgtcgaaataactaacgattatcgaatctactattatttactaaccaaacaaccgtaaataataacgaatacccaaaccctataaacgaaataaaaaaatcatacactaatacacgcacactcaccgaaaaacgcgtccgtctacgtacccctcatctcgtaaccgaaaaaaacgcgttccg

SEQ ID NO: 24263 - DNA, 531 bp, Artificial Sequence
  chemically treated genomic DNA (Homo sapiens) CpG-island No: 24263
gggtttttaggttgtaaaaatataagtagtttttttttttaagggttatttttttttttaggtcgttttttttagtattacgttattcgcgtttcgtcgggagatttttaatttattttcgttttcgttattttttgggattagttttcgtattttttatcgttttttttttttttatttttataatttcgttcgagttttattgcgtttgtgcggttaacgaggtcgcgcgtaggcgatcggggtagaagagttttcggtttttgttgttaataagacgtggatttgcgagtcggggtaaaagggttttcggtttgcgggaaattggaggttagcggtgggcgtggatcgtcgaggtgattggcggttgtcggatttgttgttgtttgttgattaggtagtcgtaggtaatgacggatgtttagattttgtgggcggagtaaaggaattatgtattgatatacgtatatttatcgaggggcgcgttcgtttgcgtgttttttatttcgtagtcgaaaggagcgcgtttcg

SEQ ID NO: 24264 - DNA, 531 bp, Artificial Sequence
  chemically treated genomic DNA (Homo sapiens) CpG-island No: 24264
cgaaacgcgctcctttcgactacgaaataaaaaacacgcaaacgaacgcgcccctcgataaatatacgtatatcaatacataattcctttactccgcccacaaaatctaaacatccgtcattacctacgactacctaatcaacaaacaacaacaaatccgacaaccgccaatcacctcgacgatccacgcccaccgctaacctccaatttcccgcaaaccgaaaacccttttaccccgactcgcaaatccacgtcttattaacaacaaaaaccgaaaactcttctaccccgatcgcctacgcgcgacctcgttaaccgcacaaacgcaataaaactcgaacgaaattataaaaataaaaaaaaaaaaaacgataaaaaatacgaaaactaatcccaaaaaataacgaaaacgaaaataaattaaaaatctcccgacgaaacgcgaataacgtaatactaaaaaaaacgacctaaaaaaaaaaataacccttaaaaaaaaaaactacttatatttttacaacctaaaaaccc

SEQ ID NO: 24265 - DNA, 604 bp, Artificial Sequence
  chemically treated genomic DNA (Homo sapiens) CpG-island No: 24265
tcgtagaatagtcggatcgggtggaaggatcgttttttttttcgtagtttttaagggagttggaataaaaaacgaaattaaaatttgtttgttcgtttttttttttatcgtttgcgtttcgttggttgtgggttttttgcggtcgttgagggcgcgtttttttttcgttatggtaagttgtttttgttttgggttttgcggtgtaggttcgtgtttgtatcgtcgttatggttttttagaagggcgcggaatcgggcgcgacgggttagggtgtagggttgcgcgggagggggcggcgtacggaggggttttagggattcgggggttttcgtagagtcgtttatttcggcgggtaaatttaggttagtttcgttgtattttttttaggtggcggtattgcgcgtttttgaaatttacgtacggcggtgtagtataggttcgttttagaggtttaggattaggttgttattttttatatttattgtttaggcgacggggacgtcgtcgttcgtcgaggagttgtttcgtaggttgttagggtttaattgttgtttttttacgtttcggggggaataaaagtggtttgattagttagaaatggagg

SEQ ID NO: 24266 - DNA, 604 bp, Artificial Sequence
  chemically treated genomic DNA (Homo sapiens) CpG-island No: 24266
cctccatttctaactaatcaaaccacttttattccccccgaaacgtaaaaaaacaacaattaaaccctaacaacctacgaaacaactcctcgacgaacgacgacgtccccgtcgcctaaacaataaatataaaaaataacaacctaatcctaaacctctaaaacgaacctatactacaccgccgtacgtaaatttcaaaaacgcgcaataccgccacctaaaaaaaatacaacgaaactaacctaaatttacccgccgaaataaacgactctacgaaaacccccgaatccctaaaacccctccgtacgccgccccctcccgcgcaaccctacaccctaacccgtcgcgcccgattccgcgcccttctaaaaaaccataacgacgatacaaacacgaacctacaccgcaaaacccaaaacaaaaacaacttaccataacgaaaaaaaaacgcgccctcaacgaccgcaaaaaacccacaaccaacgaaacgcaaacgataaaaaaaaaaacgaacaaacaaattttaatttcgttttttattccaactcccttaaaaactacgaaaaaaaaaacgatccttccacccgatccgactattctacga

SEQ ID NO: 24267 - DNA, 604 bp, Artificial Sequence
  chemically treated genomic DNA (Homo sapiens) CpG-island No: 24267
tttttatttttggttaattaggttatttttgtttttttcgaggcgtgggaggataatagttaagttttaatagtttgcgaagtagtttttcgacgaacggcggcgttttcgtcgtttgggtagtgggtgtgggaggtgatagtttagttttgagtttttggagcgggtttatattgtatcgtcgtacgtgaattttaggagcgcgtaatgtcgttatttgggaagggtgtagcgaggttgatttgagtttgttcgtcggggtggacggttttacgggaattttcgggtttttggggttttttcgtgcgtcgttttttttcgcgtagttttgtattttggttcgtcgcgttcggtttcgcgtttttttaggggattatggcgacggtataggtacggatttgtatcgtaaaatttaaagtaaaagtaatttgttatggcggaggggagacgcgtttttagcggtcgtagaaagtttataattagcggaacgtaggcgatggggagaggagcgagtaggtaggttttggtttcgttttttgttttagtttttttggaggttacgaagaaaagggcggtttttttattcgattcggttgttttgcga

SEQ ID NO: 24268 - DNA, 604 bp, Artificial Sequence
  chemically treated genomic DNA (Homo sapiens) CpG-island No: 24268
tcgcaaaacaaccgaatcgaataaaaaaaccgcccttttcttcgtaacctccaaaaaaactaaaacaaaaaacgaaaccaaaacctacctactcgctcctctccccatcgcctacgttccgctaattataaactttctacgaccgctaaaaacgcgtctcccctccgccataacaaattacttttactttaaattttacgatacaaatccgtacctataccgtcgccataatcccctaaaaaaacgcgaaaccgaacgcgacgaaccaaaatacaaaactacgcgaaaaaaaacgacgcacgaaaaaaccccaaaaacccgaaaattcccgtaaaaccgtccaccccgacgaacaaactcaaatcaacctcgctacacccttcccaaataacgacattacgcgctcctaaaattcacgtacgacgatacaatataaacccgctccaaaaactcaaaactaaactatcacctcccacacccactacccaaacgacgaaaacgccgccgttcgtcgaaaaactacttcgcaaactattaaaacttaactattatcctcccacgcctcgaaaaaaacaaaaataacctaattaaccaaaaataaaaa

SEQ ID NO: 24269 - DNA, 775 bp, Artificial Sequence
  chemically treated genomic DNA (Homo sapiens) CpG-island No: 24269
  misc_feature (728)..(728): n is either a, c, g or t
  misc_feature (732)..(732): n is either a, c, g or t
ttttgtttcggtcgttgtattttcgcgggcgtttaggtgggacgtgggtaggtgcgcgagcgtcgtgtgtgtcggtgtggatttgtgtgtgtgtttgcgtgtgtgcgtgtgcgtgtgtcgcgggttggtttcgggatattgaggattttcgggtcggtttaggtttgttcgattttgttgttttcgtcgttcgttcggttttatttttcggcgggtcggttttttatttggacgcgtcgcgttttttttttttagcgggagcgtcgtattgatattgtagatggagtttatgtcgttgtttttcgtttttttttgaacgtgtgcgtgtgcgcgcgtgtggttgttttttttagttttagtttcgaacgtaaatattttatcgaggtatagggaagtcgggagtagtcgaggaacgcggagggcgtcgaattagagtttgcggggtttgatagttttttttgcggcgtataaggtgggcgtaatagtataataaaaaggtcggaaaatggggatcgatttcgaatattttttttttttttttagattcggagttcgagtagcggcggcggttttcgggggttgcggtggcgacgtcgggttgtggtttttcgtttttattttcgcgggttgtatgtttttgatgttaagcgggtatagcggcgttatttcgcgtcgtttatgttcgttcggtcgggtcgtttgtcgggcgcggggagtgcgcgtgggantcgncggggagcgttttcggcgtttttgcgcgtttttttggtagcgg

SEQ ID NO: 24270 - DNA, 775 bp, Artificial Sequence
  chemically treated genomic DNA (Homo sapiens) CpG-island No: 24270
  misc_feature (44)..(44): n is either a, c, g or t
  misc_feature (48)..(48): n is either a, c, g or t
ccgctaccaaaaaaacgcgcaaaaacgccgaaaacgctccccgncgantcccacgcgcactccccgcgcccgacaaacgacccgaccgaacgaacataaacgacgcgaaataacgccgctatacccgcttaacatcaaaaacatacaacccgcgaaaataaaaacgaaaaaccacaacccgacgtcgccaccgcaacccccgaaaaccgccgccgctactcgaactccgaatctaaaaaaaaaaaaaaaatattcgaaatcgatccccattttccgacctttttattatactattacgcccaccttatacgccgcaaaaaaaactatcaaaccccgcaaactctaattcgacgccctccgcgttcctcgactactcccgacttccctatacctcgataaaatatttacgttcgaaactaaaactaaaaaaaacaaccacacgcgcgcacacgcacacgttcaaaaaaaaacgaaaaacaacgacataaactccatctacaatatcaatacgacgctcccgctaaaaaaaaaaaacgcgacgcgtccaaataaaaaaccgacccgccgaaaaataaaaccgaacgaacgacgaaaacaacaaaatcgaacaaacctaaaccgacccgaaaatcctcaatatcccgaaaccaacccgcgacacacgcacacgcacacacgcaaacacacacacaaatccacaccgacacacacgacgctcgcgcacctacccacgtcccacctaaacgcccgcgaaaatacaacgaccgaaacaaaa

SEQ ID NO: 24271 - DNA, 775 bp, Artificial Sequence
  chemically treated genomic DNA (Homo sapiens) CpG-island No: 24271
  misc_feature (44)..(44): n is either a, c, g or t
  misc_feature (48)..(48): n is either a, c, g or t
tcgttattagagaggcgcgtagaggcgtcgagagcgtttttcgncggnttttacgcgtatttttcgcgttcggtaagcggttcgatcgggcgagtatgggcggcgcggagtgacgtcgttgtgttcgtttggtattaaggatatgtagttcgcgggggtgggaacgaagggttatagttcggcgtcgttatcgtagttttcgagagtcgtcgtcgttgttcgggtttcgggtttgggaggagaaaaggggtgttcggaatcgatttttatttttcgatttttttgttgtattattacgtttattttgtacgtcgtaagagaagttgttaagtttcgtaggttttgattcggcgtttttcgcgtttttcggttgttttcggtttttttgtgtttcggtggagtatttgcgttcggggttggggttggaggaggtagttatacgcgcgtatacgtatacgtttagaggagggcgagaggtagcggtataggttttatttgtagtgttaatgcggcgttttcgttgaaggagggaaacgcggcgcgtttaggtaaggagtcggttcgtcggggagtggggtcgggcgggcggcgagggtagtaaggtcggatagatttgggtcgattcgggagtttttagtgtttcggagttagttcgcggtatacgtatacgtatatacgtaggtatatatatagatttatatcggtatatacggcgttcgcgtatttgtttacgttttatttggacgttcgcggaggtgtagcggtcggagtaggg

SEQ ID NO: 24272 - DNA, 775 bp, Artificial Sequence
  chemically treated genomic DNA (Homo sapiens) CpG-island No: 24272
  misc_feature (728)..(728): n is either a, c, g or t
  misc_feature (732)..(732): n is either a, c, g or t
ccctactccgaccgctacacctccgcgaacgtccaaataaaacgtaaacaaatacgcgaacgccgtatataccgatataaatctatatatatacctacgtatatacgtatacgtataccgcgaactaactccgaaacactaaaaactcccgaatcgacccaaatctatccgaccttactaccctcgccgcccgcccgaccccactccccgacgaaccgactccttacctaaacgcgccgcgtttccctccttcaacgaaaacgccgcattaacactacaaataaaacctataccgctacctctcgccctcctctaaacgtatacgtatacgcgcgtataactacctcctccaaccccaaccccgaacgcaaatactccaccgaaacacaaaaaaaccgaaaacaaccgaaaaacgcgaaaaacgccgaatcaaaacctacgaaacttaacaacttctcttacgacgtacaaaataaacgtaataatacaacaaaaaaatcgaaaaataaaaatcgattccgaacaccccttttctcctcccaaacccgaaacccgaacaacgacgacgactctcgaaaactacgataacgacgccgaactataacccttcgttcccacccccgcgaactacatatccttaataccaaacgaacacaacgacgtcactccgcgccgcccatactcgcccgatcgaaccgcttaccgaacgcgaaaaatacgcgtaaaanccgncgaaaaacgctctcgacgcctctacgcgcctctctaataacga

SEQ ID NO: 24273 - DNA, 658 bp, Artificial Sequence
  chemically treated genomic DNA (Homo sapiens) CpG-island No: 24273
  misc_feature (26)..(26): n is either a, c, g or t
  misc_feature (47)..(47): n is either a, c, g or t
  misc_feature (61)..(61): n is either a, c, g or t
  misc_feature (105)..(105): n is either a, c, g or t
  misc_feature (112)..(112): n is either a, c, g or t
  misc_feature (140)..(140): n is either a, c, g or t
  misc_feature (153)..(154): n is either a, c, g or t
  misc_feature (263)..(263): n is either a, c, g or t
  misc_feature (306)..(306): n is either a, c, g or t
  misc_feature (338)..(338): n is either a, c, g or t
  misc_feature (390)..(390): n is either a, c, g or t
  misc_feature (399)..(400): n is either a, c, g or t
  misc_feature (418)..(418): n is either a, c, g or t
  misc_feature (423)..(423): n is either a, c, g or t
  misc_feature (430)..(430): n is either a, c, g or t
  misc_feature (434)..(434): n is either a, c, g or t
  misc_feature (542)..(542): n is either a, c, g or t
  misc_feature (546)..(546): n is either a, c, g or t
  misc_feature (558)..(558): n is either a, c, g or t
  misc_feature (614)..(614): n is either a, c, g or t
  misc_feature (638)..(638): n is either a, c, g or t
gcgatagcgcgcgtttttattttatncgttaataagtcgaagttttnttaaaggaatttgnatcggcggggttgtcgtggtacgatcggtcgttaaggttatttntgcgggncgtttcgatttcggttgatcgtcgttgngttttttgggaanntcgcgtgtcggtcgtaggagaaggtagattttcgggagtttcggcgtttatcgcggtattaatcgcgtttgcgtttcgttttttttttttttgggtttcgttcgcgttntgcgtagttgcggggtttcgcgtcgtcggagtttgagaggttnggaaatgttttttaacgggtgggggaagttgngtaggtacgggcggtttcgtagtgatcggattcgggggaggtgagtgatttngtttaagtnnaaaagggaaagataattngagtngtttttnggtnagttggtttacgtatgcgttcgttaggtcggttgggagtcggtaagggaaagtcgagcgggttttattgggggaaaggggttagttatttttcggaagaggcggggtngcgncgggttcggcgnttggattcgaaacgttttttggtgtttttgggtttggcggttgagttcggggagtntagtttttgtttgggtaaagaaangaggattttttttttttttt

SEQ ID NO: 24274 - DNA, 658 bp, Artificial Sequence
  chemically treated genomic DNA (Homo sapiens) CpG-island No: 24274
  misc_feature (21)..(21): n is either a, c, g or t
  misc_feature (45)..(45): n is either a, c, g or t
  misc_feature (101)..(101): n is either a, c, g or t
  misc_feature (113)..(113): n is either a, c, g or t
  misc_feature (117)..(117): n is either a, c, g or t
  misc_feature (225)..(225): n is either a, c, g or t
  misc_feature (229)..(229): n is either a, c, g or t
  misc_feature (236)..(236): n is either a, c, g or t
  misc_feature (241)..(241): n is either a, c, g or t
  misc_feature (259)..(260): n is either a, c, g or t
  misc_feature (269)..(269): n is either a, c, g or t
  misc_feature (321)..(321): n is either a, c, g or t
  misc_feature (353)..(353): n is either a, c, g or t
  misc_feature (396)..(396): n is either a, c, g or t
  misc_feature (505)..(506): n is either a, c, g or t
  misc_feature (519)..(519): n is either a, c, g or t
  misc_feature (547)..(547): n is either a, c, g or t
  misc_feature (554)..(554): n is either a, c, g or t
  misc_feature (598)..(598): n is either a, c, g or t
  misc_feature (612)..(612): n is either a, c, g or t
  misc_feature (633)..(633): n is either a, c, g or t
aaaaaaaaaaaaaaatcctcntttctttacccaaacaaaaactanactccccgaactcaaccgccaaacccaaaaacaccaaaaaacgtttcgaatccaancgccgaacccgncgcnaccccgcctcttccgaaaaataactaacccctttcccccaataaaacccgctcgactttcccttaccgactcccaaccgacctaacgaacgcatacgtaaaccaactnaccnaaaaacnactcnaattatctttcccttttnnacttaaacnaaatcactcacctcccccgaatccgatcactacgaaaccgcccgtacctacncaacttcccccacccgttaaaaaacatttccnaacctctcaaactccgacgacgcgaaaccccgcaactacgcanaacgcgaacgaaacccaaaaaaaaaaaaaacgaaacgcaaacgcgattaataccgcgataaacgccgaaactcccgaaaatctaccttctcctacgaccgacacgcgannttcccaaaaaacncaacgacgatcaaccgaaatcgaaacgncccgcanaaataaccttaacgaccgatcgtaccacgacaaccccgccgatncaaattcctttaanaaaacttcgacttattaacgnataaaataaaaacgcgcgctatcgc

SEQ ID NO: 24275 - DNA, 658 bp, Artificial Sequence
  chemically treated genomic DNA (Homo sapiens) CpG-island No: 24275
  misc_feature (21)..(21): n is either a, c, g or t
  misc_feature (45)..(45): n is either a, c, g or t
  misc_feature (101)..(101): n is either a, c, g or t
  misc_feature (113)..(113): n is either a, c, g or t
  misc_feature (117)..(117): n is either a, c, g or t
  misc_feature (225)..(225): n is either a, c, g or t
  misc_feature (229)..(229): n is either a, c, g or t
  misc_feature (236)..(236): n is either a, c, g or t
  misc_feature (241)..(241): n is either a, c, g or t
  misc_feature (259)..(260): n is either a, c, g or t
  misc_feature (269)..(269): n is either a, c, g or t
  misc_feature (321)..(321): n is either a, c, g or t
  misc_feature (353)..(353): n is either a, c, g or t
  misc_feature (396)..(396): n is either a, c, g or t
  misc_feature (505)..(506): n is either a, c, g or t
  misc_feature (519)..(519): n is either a, c, g or t
  misc_feature (547)..(547): n is either a, c, g or t
  misc_feature (554)..(554): n is either a, c, g or t
  misc_feature (598)..(598): n is either a, c, g or t
  misc_feature (612)..(612): n is either a, c, g or t
  misc_feature (633)..(633): n is either a, c, g or t
aaaaaaaaaggaaagtttttntttttttatttaagtaaagattangtttttcgggtttaatcgttaggtttaggagtattaggaagcgtttcgaatttagncgtcgggttcgncgtngtttcgtttttttcgggaagtgattgattttttttttttaatggggttcgttcggtttttttttgtcggtttttagtcggtttagcggacgtatgcgtagattagttngttngggggtngtttnaattattttttttttttnnatttaggtnaaattatttatttttttcgagttcggttattgcggagtcgttcgtgtttatntagttttttttattcgttaaggggtatttttnggttttttagatttcggcggcgcgaaatttcgtaattgcgtanggcgcgggcggagtttaaaggaagggagggcggggcgtaggcgcggttagtatcgcggtgggcgtcggggttttcgggaatttatttttttttgcggtcggtacgcggnntttttagggggtntagcggcggttagtcgaggtcgagacgnttcgtangggtggttttagcggtcggtcgtattacggtagtttcgtcgatntaggtttttttggngagatttcgatttgttggcgngtagggtgaaggcgcgcgttgtcgt

SEQ ID NO: 24276 - DNA, 658 bp, Artificial Sequence
  chemically treated genomic DNA (Homo sapiens) CpG-island No: 24276
  misc_feature (26)..(26): n is either a, c, g or t
  misc_feature (47)..(47): n is either a, c, g or t
  misc_feature (61)..(61): n is either a, c, g or t
  misc_feature (105)..(105): n is either a, c, g or t
  misc_feature (112)..(112): n is either a, c, g or t
  misc_feature (140)..(140): n is either a, c, g or t
  misc_feature (153)..(154): n is either a, c, g or t
  misc_feature (263)..(263): n is either a, c, g or t
  misc_feature (306)..(306): n is either a, c, g or t
  misc_feature (338)..(338): n is either a, c, g or t
  misc_feature (390)..(390): n is either a, c, g or t
  misc_feature (399)..(400): n is either a, c, g or t
  misc_feature (418)..(418): n is either a, c, g or t
  misc_feature (423)..(423): n is either a, c, g or t
  misc_feature (430)..(430): n is either a, c, g or t
  misc_feature (434)..(434): n is either a, c, g or t
  misc_feature (542)..(542): n is either a, c, g or t
  misc_feature (546)..(546): n is either a, c, g or t
  misc_feature (558)..(558): n is either a, c, g or t
  misc_feature (614)..(614): n is either a, c, g or t
  misc_feature (638)..(638): n is either a, c, g or t
acgacaacgcgcgccttcaccctacncgccaacaaatcgaaatctcnccaaaaaaacctanatcgacgaaactaccgtaatacgaccgaccgctaaaaccacccntacgaancgtctcgacctcgactaaccgccgctanaccccctaaaaannccgcgtaccgaccgcaaaaaaaaataaattcccgaaaaccccgacgcccaccgcgatactaaccgcgcctacgccccgccctcccttcctttaaactccgcccgcgccntacgcaattacgaaatttcgcgccgccgaaatctaaaaaaccnaaaaataccccttaacgaataaaaaaaactanataaacacgaacgactccgcaataaccgaactcgaaaaaaataaataatttnacctaaatnnaaaaaaaaaaaataattnaaacnacccccnaacnaactaatctacgcatacgtccgctaaaccgactaaaaaccgacaaaaaaaaaccgaacgaaccccattaaaaaaaaaaaatcaatcacttcccgaaaaaaacgaaacnacgncgaacccgacgnctaaattcgaaacgcttcctaatactcctaaacctaacgattaaacccgaaaaacntaatctttacttaaataaaaaaanaaaaactttccttttttttt

SEQ ID NO: 24277 - DNA, 640 bp, Artificial Sequence
  chemically treated genomic DNA (Homo sapiens) CpG-island No: 24277
  misc_feature (146)..(146): n is either a, c, g or t
aggcgttttcgggtgcgtttcgaggttttattcgggaagttgtttcggtttggagattaaggttaagtcggtggtttcgggaagtttacgtttgttacgggcggttggttttgaaagttcgggttacggggtttgttaagtttggnagaggggttttttacgtcgtagtataaaaatgttagaggaagggttgcgttcgtttttttatttatttttcggaattacgtcgtttttcgcgcgttttcgtagattgtaggagtttagggcgtttggggattgtgacggcgtttaaggcgggggatgtggcggttttgggtcgtcgttttttgttttcgtttttgtgaggtttttcgaggtagtgtttgtgtttggggtagcgacgtcgacggcgttgggggcgcgaaagggtttacgtttttgcgtttttttggcgtcgagagaaaagcgggcgaagatagggtttcggaaggggataggcgaaaaacgtttttttgtttttttttcggtcggggttcgggtcgatttattcggtttttatttacggcgtttttataatttataaaaacgggtgaggaaaaagatcggtttcgttttttttacgttagagattaaaattagtagaataaaaatagttttaaaa

SEQ ID NO: 24278 - DNA, 640 bp, Artificial Sequence
  chemically treated genomic DNA (Homo sapiens) CpG-island No: 24278
  misc_feature (495)..(495): n is either a, c, g or t
ttttaaaactatttttattctactaattttaatctctaacgtaaaaaaaacgaaaccgatctttttcctcacccgtttttataaattataaaaacgccgtaaataaaaaccgaataaatcgacccgaaccccgaccgaaaaaaaaacaaaaaaacgtttttcgcctatccccttccgaaaccctatcttcgcccgcttttctctcgacgccaaaaaaacgcaaaaacgtaaaccctttcgcgcccccaacgccgtcgacgtcgctaccccaaacacaaacactacctcgaaaaacctcacaaaaacgaaaacaaaaaacgacgacccaaaaccgccacatcccccgccttaaacgccgtcacaatccccaaacgccctaaactcctacaatctacgaaaacgcgcgaaaaacgacgtaattccgaaaaataaataaaaaaacgaacgcaacccttcctctaacatttttatactacgacgtaaaaaacccctctnccaaacttaacaaaccccgtaacccgaactttcaaaaccaaccgcccgtaacaaacgtaaacttcccgaaaccaccgacttaaccttaatctccaaaccgaaacaacttcccgaataaaacctcgaaacgcacccgaaaacgcct

SEQ ID NO: 24279 - DNA, 640 bp, Artificial Sequence
  chemically treated genomic DNA (Homo sapiens) CpG-island No: 24279
  misc_feature (495)..(495): n is either a, c, g or t
ttttggggttgtttttgttttgttggttttggtttttggcgtggggggggcggggtcggtttttttttttattcgtttttgtgggttgtgggggcgtcgtgggtgggggtcgggtgagtcggttcgagtttcggtcgggggggaggtaaggaagcgtttttcgtttattttttttcgggattttgttttcgttcgtttttttttcggcgttaggggaacgtaggagcgtgagttttttcgcgtttttagcgtcgtcggcgtcgttgttttagatatagatattgtttcgagaggttttatagaggcgggggtagaaggcggcgatttagagtcgttatatttttcgttttgggcgtcgttatagtttttagacgttttggatttttgtagtttacgaagacgcgcgggggacggcgtggtttcgagaggtaggtgaggaggcgggcgtagttttttttttggtatttttgtattgcggcgtgaaaggtttttttnttaagtttggtagatttcgtggttcgagtttttaggattaatcgttcgtggtaggcgtgggtttttcggggttatcggtttaattttgatttttagatcgaggtagtttttcgggtagggtttcggggcgtattcgaaaacgttt

SEQ ID NO: 24280 - DNA, 640 bp, Artificial Sequence
  chemically treated genomic DNA (Homo sapiens) CpG-island No: 24280
  misc_feature (146)..(146): n is either a, c, g or t
aaacgttttcgaatacgccccgaaaccctacccgaaaaactacctcgatctaaaaatcaaaattaaaccgataaccccgaaaaacccacgcctaccacgaacgattaatcctaaaaactcgaaccacgaaatctaccaaacttaanaaaaaaacctttcacgccgcaatacaaaaataccaaaaaaaaaactacgcccgcctcctcacctacctctcgaaaccacgccgtcccccgcgcgtcttcgtaaactacaaaaatccaaaacgtctaaaaactataacgacgcccaaaacgaaaaatataacgactctaaatcgccgccttctacccccgcctctataaaacctctcgaaacaatatctatatctaaaacaacgacgccgacgacgctaaaaacgcgaaaaaactcacgctcctacgttcccctaacgccgaaaaaaaaacgaacgaaaacaaaatcccgaaaaaaaataaacgaaaaacgcttccttacctcccccccgaccgaaactcgaaccgactcacccgacccccacccacgacgcccccacaacccacaaaaacgaataaaaaaaaaaaccgaccccgccccccccacgccaaaaaccaaaaccaacaaaacaaaaacaaccccaaaa

SEQ ID NO: 24281 - DNA, 717 bp, Artificial Sequence
  chemically treated genomic DNA (Homo sapiens) CpG-island No: 24281
  misc_feature (79)..(79): n is either a, c, g or t
  misc_feature (573)..(573): n is either a, c, g or t
  misc_feature (688)..(688): n is either a, c, g or t
tagtaaagcgagcggttttggggtgggggcgggggtggggtggcgaggaaggggagaggtgatattggttttggaggantggggtagttcgaattgaggttgggttgagtatacggttcgttatgacgtcgagtttgttttttttgtagatggtttgggattgtcggaggttggtggcggcggggcgcgtaggttgcgtacggtttatattaatacgtagttgttggaattggagaaggaattttattttaataagtatttgtgtcggttacgtcgcgtcgagatcgcggttttgttggattttatcgaaaggtaggttaaagtttggttttagaatcggcgtatgaagtataagcggtagacgtagtattcgagagtcgtcggatgggggagtttgttttgttcgggagtttttggaggatatttgcgattttgtcgaggaattttcggttagttcgggcggttttttcgtttcgcgggcggcgggggaagtttgttgttattcgtcggaagtggtgtcgggggttttaagcgcggatttttcgtttttagttcgttttttagaaggcgtangcgcgttgaagtttcggttgcgcgtttgtcggggtcgggggttggagttcgggttatttgtcgaaaaattttttttggggcgttaggatttaattttttttttcgatttaaattnttggcgggttattttttgtttttatttat

SEQ ID NO: 24282 - DNA, 717 bp, Artificial Sequence
  chemically treated genomic DNA (Homo sapiens) CpG-island No: 24282
  misc_feature (30)..(30): n is either a, c, g or t
  misc_feature (145)..(145): n is either a, c, g or t
  misc_feature (639)..(639): n is either a, c, g or t
ataaataaaaacaaaaaataacccgccaanaatttaaatcgaaaaaaaaaattaaatcctaacgccccaaaaaaaatttttcgacaaataacccgaactccaacccccgaccccgacaaacgcgcaaccgaaacttcaacgcgcntacgccttctaaaaaacgaactaaaaacgaaaaatccgcgcttaaaacccccgacaccacttccgacgaataacaacaaacttcccccgccgcccgcgaaacgaaaaaaccgcccgaactaaccgaaaattcctcgacaaaatcgcaaatatcctccaaaaactcccgaacaaaacaaactcccccatccgacgactctcgaatactacgtctaccgcttatacttcatacgccgattctaaaaccaaactttaacctacctttcgataaaatccaacaaaaccgcgatctcgacgcgacgtaaccgacacaaatacttattaaaataaaattccttctccaattccaacaactacgtattaatataaaccgtacgcaacctacgcgccccgccgccaccaacctccgacaatcccaaaccatctacaaaaaaaacaaactcgacgtcataacgaaccgtatactcaacccaacctcaattcgaactaccccantcctccaaaaccaatatcacctctccccttcctcgccaccccacccccgcccccaccccaaaaccgctcgctttacta

SEQ ID NO: 24283 - DNA, 717 bp, Artificial Sequence
  chemically treated genomic DNA (Homo sapiens) CpG-island No: 24283
  misc_feature (30)..(30): n is either a, c, g or t
  misc_feature (145)..(145): n is either a, c, g or t
  misc_feature (639)..(639): n is either a, c, g or t
ataggtggaaataaggaatggttcgttaanaatttaggtcgggaaggaaagttgaattttggcgttttaagaaaaatttttcggtaaatggttcgggttttagttttcggtttcggtaagcgcgtagtcggaattttaacgcgtntgcgttttttaaggaacgggttaaaggcggggggttcgcgtttaaggttttcggtattattttcggcgggtgatagtaggtttttttcgtcgttcgcgaggcggaggggtcgttcgggttggtcgggggtttttcggtagggtcgtagatgttttttaagggttttcgggtaaggtaggtttttttattcggcggttttcgggtgttgcgtttgtcgtttgtgttttatgcgtcggttttgaaattagattttgatttgtttttcggtgaggtttagtaaggtcgcgatttcgacgcggcgtggtcggtataggtatttattaaagtggaattttttttttagttttagtagttgcgtgttggtgtaagtcgtgcgtagtttgcgcgtttcgtcgttattagttttcggtagttttaggttatttgtagggaaaataggttcggcgttatagcgggtcgtgtatttagtttaattttagttcggattattttanttttttaaaattagtattattttttttttttttcgttattttattttcgtttttattttaaagtcgttcgttttattg

SEQ ID NO: 24284 - DNA, 717 bp, Artificial Sequence
  chemically treated genomic DNA (Homo sapiens) CpG-island No: 24284
  misc_feature (79)..(79): n is either a, c, g or t
  misc_feature (573)..(573): n is either a, c, g or t
  misc_feature (688)..(688): n is either a, c, g or t
caataaaacgaacgactttaaaataaaaacgaaaataaaataacgaaaaaaaaaaaaaataatactaattttaaaaaantaaaataatccgaactaaaattaaactaaatacacgacccgctataacgccgaacctattttccctacaaataacctaaaactaccgaaaactaataacgacgaaacgcgcaaactacgcacgacttacaccaacacgcaactactaaaactaaaaaaaaaattccactttaataaatacctataccgaccacgccgcgtcgaaatcgcgaccttactaaacctcaccgaaaaacaaatcaaaatctaatttcaaaaccgacgcataaaacacaaacgacaaacgcaacacccgaaaaccgccgaataaaaaaacctaccttacccgaaaacccttaaaaaacatctacgaccctaccgaaaaacccccgaccaacccgaacgacccctccgcctcgcgaacgacgaaaaaaacctactatcacccgccgaaaataataccgaaaaccttaaacgcgaaccccccgcctttaacccgttccttaaaaaacgcanacgcgttaaaattccgactacgcgcttaccgaaaccgaaaactaaaacccgaaccatttaccgaaaaatttttcttaaaacgccaaaattcaactttccttcccgacctaaattnttaacgaaccattccttatttccacctat

SEQ ID NO: 24285 - DNA, 570 bp, Artificial Sequence
  chemically treated genomic DNA (Homo sapiens) CpG-island No: 24285
  misc_feature (21)..(21): n is either a, c, g or t
  misc_feature (42)..(42): n is either a, c, g or t
  misc_feature (63)..(63): n is either a, c, g or t
  misc_feature (158)..(158): n is either a, c, g or t
  misc_feature (527)..(527): n is either a, c, g or t
tcggtgtgttcgtttttcgtntatggcgttttcggcgttttnttacgtttcgtcgtgtttttngttagttgtcgtttttttcgtttggtaatttggttcgtttttaaagttcgagtttagttcggtgttagacgagttcggggttttcgtagttttgncgcggttcggacggagtgggagttttttaggaaattggcgtttgtcgcgttcggagtgttagattcgcgcgtttttggggttttggaggtcgaataaagtcgggggcgggggcgggggcggggtgggggcgagcgtattcgggttttttttttagttcggcgggacgttcgggggttgttgggggttgttgcgggttgagcgattaggatgcggttggttgcggcggcggagttttagtttgggtcgagggttcggggtttggtagtcggttttcgcgcgtatttagcgttcggtcgttcgtcgttgttcgcgttttagcggaagatcgtataggtaagtgtggggtgcggagtcggggcgttcggggntttggcgggggtgtagaggtgggtggttgagattttcgttttt

SEQ ID NO: 24286 - DNA, 570 bp, Artificial Sequence
  chemically treated genomic DNA (Homo sapiens) CpG-island No: 24286
  misc_feature (44)..(44): n is either a, c, g or t
  misc_feature (413)..(413): n is either a, c, g or t
  misc_feature (508)..(508): n is either a, c, g or t
  misc_feature (529)..(529): n is either a, c, g or t
  misc_feature (550)..(550): n is either a, c, g or t
aaaaacgaaaatctcaaccacccacctctacacccccgccaaanccccgaacgccccgactccgcaccccacacttacctatacgatcttccgctaaaacgcgaacaacgacgaacgaccgaacgctaaatacgcgcgaaaaccgactaccaaaccccgaaccctcgacccaaactaaaactccgccgccgcaaccaaccgcatcctaatcgctcaacccgcaacaacccccaacaacccccgaacgtcccgccgaactaaaaaaaaaacccgaatacgctcgcccccaccccgcccccgcccccgcccccgactttattcgacctccaaaaccccaaaaacgcgcgaatctaacactccgaacgcgacaaacgccaatttcctaaaaaactcccactccgtccgaaccgcgncaaaactacgaaaaccccgaactcgtctaacaccgaactaaactcgaactttaaaaacgaaccaaattaccaaacgaaaaaaacgacaactaacnaaaaacacgacgaaacgtaanaaaacgccgaaaacgccatanacgaaaaacgaacacaccga

SEQ ID NO: 24287 - DNA, 570 bp, Artificial Sequence
  chemically treated genomic DNA (Homo sapiens) CpG-island No: 24287
  misc_feature (44)..(44): n is either a, c, g or t
  misc_feature (413)..(413): n is either a, c, g or t
  misc_feature (508)..(508): n is either a, c, g or t
  misc_feature (529)..(529): n is either a, c, g or t
  misc_feature (550)..(550): n is either a, c, g or t
gggggcgggggttttagttatttatttttgtattttcgttaggntttcgagcgtttcggtttcgtattttatatttatttgtgcggtttttcgttagggcgcgggtaacggcgggcggtcgggcgttgggtgcgcgcgggggtcgattgttaggtttcggattttcggtttaggttggggtttcgtcgtcgtagttagtcgtattttagtcgtttaattcgtagtaatttttagtaattttcgagcgtttcgtcgagttgggggagaggttcggatgcgttcgtttttatttcgttttcgttttcgttttcggttttgttcggtttttagggttttaggagcgcgcggatttggtatttcgggcgcggtagacgttagttttttgagaagtttttatttcgttcgggtcgcgntagggttgcgggaatttcgggttcgtttggtatcgagttgaattcgggttttgagagcgggttaagttgttaggcgagaggagcggtaattgatnaggggtacggcgaggcgtagnggagcgtcgggggcgttatgngcggaaggcgggtatatcgg

SEQ ID NO: 24288 - DNA, 570 bp, Artificial Sequence
  chemically treated genomic DNA (Homo sapiens) CpG-island No: 24288
  misc_feature (21)..(21): n is either a, c, g or t
  misc_feature (42)..(42): n is either a, c, g or t
  misc_feature (63)..(63): n is either a, c, g or t
  misc_feature (158)..(158): n is either a, c, g or t
  misc_feature (527)..(527): n is either a, c, g or t
ccgatatacccgccttccgcncataacgcccccgacgctccnctacgcctcgccgtacccctnatcaattaccgctcctctcgcctaacaacttaacccgctctcaaaacccgaattcaactcgataccaaacgaacccgaaattcccgcaaccctancgcgacccgaacgaaataaaaacttctcaaaaaactaacgtctaccgcgcccgaaataccaaatccgcgcgctcctaaaaccctaaaaaccgaacaaaaccgaaaacgaaaacgaaaacgaaataaaaacgaacgcatccgaacctctcccccaactcgacgaaacgctcgaaaattactaaaaattactacgaattaaacgactaaaatacgactaactacgacgacgaaaccccaacctaaaccgaaaatccgaaacctaacaatcgacccccgcgcgcacccaacgcccgaccgcccgccgttacccgcgccctaacgaaaaaccgcacaaataaatataaaatacgaaaccgaaacgctcgaaancctaacgaaaatacaaaaataaataactaaaacccccgccccc

SEQ ID NO: 24289 - DNA, 605 bp, Artificial Sequence
  chemically treated genomic DNA (Homo sapiens) CpG-island No: 24289
  misc_feature (236)..(236): n is either a, c, g or t
  misc_feature (252)..(252): n is either a, c, g or t
cgacgggaagttttatttattgttgtacgaatttattcgttgtatttacgggtagatcggagtggagtatttttgtttttttgtttcgtcgaatacgtttttgttttgcgcgtagttcgattttcgcggttcggggtggaacgggggttgttcgtcggcgtcggagagtgcgtaggtcgattttttttcgcggtagaaggtcggcgtcggttcgtagtcgtagggcgtcgttcggntcgtagttatcgtttngtcggcgggtaataggaggaagtggtaaagtttttgttttggttcggttttggttcgtagggcgcggggtaatgttttagcgggttcgtatagttcgacgaatagagcggtagttggtttaggaaggatttttgttcgttggttagagtgacggggaaggtggagtttacgaaataggaatttattgggaggggaggcgcgcgcggtcgttgttgtttcgtcgggtttatgatttgttgtgttttatagttcgagcgtcgcgtttattagtagtatattcgagattgggttttagttgaggggggatggcgaggtgttagtgagggttagaaggaaatataattatttgattt

SEQ ID NO: 24290 - DNA, 605 bp, Artificial Sequence
  chemically treated genomic DNA (Homo sapiens) CpG-island No: 24290
  misc_feature (354)..(354): n is either a, c, g or t
  misc_feature (370)..(370): n is either a, c, g or t
aaatcaaataattatatttccttctaaccctcactaacacctcgccatcccccctcaactaaaacccaatctcgaatatactactaataaacgcgacgctcgaactataaaacacaacaaatcataaacccgacgaaacaacaacgaccgcgcgcgcctcccctcccaataaattcctatttcgtaaactccaccttccccgtcactctaaccaacgaacaaaaatccttcctaaaccaactaccgctctattcgtcgaactatacgaacccgctaaaacattaccccgcgccctacgaaccaaaaccgaaccaaaacaaaaactttaccacttcctcctattacccgccgacnaaacgataactacganccgaacgacgccctacgactacgaaccgacgccgaccttctaccgcgaaaaaaaatcgacctacgcactctccgacgccgacgaacaacccccgttccaccccgaaccgcgaaaatcgaactacgcgcaaaacaaaaacgtattcgacgaaacaaaaaaacaaaaatactccactccgatctacccgtaaatacaacgaataaattcgtacaacaataaataaaacttcccgtcg

SEQ ID NO: 24291 - DNA, 605 bp, Artificial Sequence
  chemically treated genomic DNA (Homo sapiens) CpG-island No: 24291
  misc_feature (354)..(354): n is either a, c, g or t
  misc_feature (370)..(370): n is either a, c, g or t
ggattagatggttgtatttttttttggtttttattggtatttcgttatttttttttagttaaaatttaatttcggatatattattaataggcgcggcgttcggattataaaatataataaattataaattcggcggagtagtagcggtcgcgcgcgtttttttttttaatgagtttttatttcgtgaattttatttttttcgttattttggttagcgggtaggagttttttttgggttagttatcgttttattcgtcgggttatgcggattcgttgagatattatttcgcgttttacgggttagggtcgggttaggataagggttttgttatttttttttattattcgtcggtngggcggtggttacggntcgagcggcgttttgcgattacgggtcggcgtcggttttttatcgcgagaaagagtcggtttgcgtatttttcggcgtcgacgagtagttttcgttttatttcgagtcgcggaagtcggattgcgcgtaggataagagcgtgttcggcgagatagaagagtagaagtgttttatttcggtttattcgtggatgtagcggatgaattcgtgtaatagtgagtgagatttttcgtcg

SEQ ID NO: 24292 - DNA, 605 bp, Artificial Sequence
  chemically treated genomic DNA (Homo sapiens) CpG-island No: 24292
  misc_feature (236)..(236): n is either a, c, g or t
  misc_feature (252)..(252): n is either a, c, g or t
cgacgaaaaatctcactcactattacacgaattcatccgctacatccacgaataaaccgaaataaaacacttctactcttctatctcgccgaacacgctcttatcctacgcgcaatccgacttccgcgactcgaaataaaacgaaaactactcgtcgacgccgaaaaatacgcaaaccgactctttctcgcgataaaaaaccgacgccgacccgtaatcgcaaaacgccgctcganccgtaaccaccgcccnaccgacgaataataaaaaaaaataacaaaacccttatcctaacccgaccctaacccgtaaaacgcgaaataatatctcaacgaatccgcataacccgacgaataaaacgataactaacccaaaaaaaactcctacccgctaaccaaaataacgaaaaaaataaaattcacgaaataaaaactcattaaaaaaaaaaacgcgcgcgaccgctactactccgccgaatttataatttattatattttataatccgaacgccgcgcctattaataatatatccgaaattaaattttaactaaaaaaaaataacgaaataccaataaaaaccaaaaaaaaatacaaccatctaatcc

SEQ ID NO: 24293 - DNA, 826 bp, Artificial Sequence
  chemically treated genomic DNA (Homo sapiens) CpG-island No: 24293
ggtttcgcgggggagcgggtttggagttaaatcggtcggtcgtaggttggagtagcgggcgtcggagcgcgcggtggggatgttcgaaaaggagttagaggtttagtcggagagttcgagaatacgagggatgtttattttgtaatatggttttaagtttttttttgtttacgcggaagcgtttttcgttttatttcgggttgtgtagggtcgtttcggcgattaagtcgttttcggagtcgggtattggggagtcggtgttgcgttcgttgttggagtcggggttcgattgcgtcgttaggtagtcgggttttttttgggcggttatggtgggcgcgtagcgttcgggttttcgttgtcgtcgtcgttttgtttgcgttgtcgttttcgttcgtcggtcgggtttaattggtttttagcgtcgcggcgttagttcgtttttttgtagtcgtcgacgttatcgttaacgtcgtcgtcgttattgagttttcggcgtattttagtttcgggcgtcgtttacgttattcgttatttcgggtcgcggtttcggttcgggtttagtggttgcgtcgtttttcgttagtaacgttcgcgcggaatgagcgcgtcgcgttgttcgcgtttttattcgtagggttcggcgtttttttttcgttcgtcgtttttatagtcgcgcgtttattggttcggttagtttacggggagtcgcggcgggcgggcggtttttggcgtttatatattcgcgcgcgtatatatatattacgtatatattgttattttttgtatttatacgtataaattttttttatatatgtatttttatagt

SEQ ID NO: 24294 - DNA, 826 bp, Artificial Sequence
  chemically treated genomic DNA (Homo sapiens) CpG-island No: 24294
actataaaaatacatatataaaaaaaatttatacgtataaatacaaaaaataacaatatatacgtaatatatatatacgcgcgcgaatatataaacgccaaaaaccgcccgcccgccgcgactccccgtaaactaaccgaaccaataaacgcgcgactataaaaacgacgaacgaaaaaaaaacgccgaaccctacgaataaaaacgcgaacaacgcgacgcgctcattccgcgcgaacgttactaacgaaaaacgacgcaaccactaaacccgaaccgaaaccgcgacccgaaataacgaataacgtaaacgacgcccgaaactaaaatacgccgaaaactcaataacgacgacgacgttaacgataacgtcgacgactacaaaaaaacgaactaacgccgcgacgctaaaaaccaattaaacccgaccgacgaacgaaaacgacaacgcaaacaaaacgacgacgacaacgaaaacccgaacgctacgcgcccaccataaccgcccaaaaaaaacccgactacctaacgacgcaatcgaaccccgactccaacaacgaacgcaacaccgactccccaatacccgactccgaaaacgacttaatcgccgaaacgaccctacacaacccgaaataaaacgaaaaacgcttccgcgtaaacaaaaaaaaacttaaaaccatattacaaaataaacatccctcgtattctcgaactctccgactaaacctctaactccttttcgaacatccccaccgcgcgctccgacgcccgctactccaacctacgaccgaccgatttaactccaaacccgctcccccgcgaaacc

SEQ ID NO: 24295 - DNA, 826 bp, Artificial Sequence
  chemically treated genomic DNA (Homo sapiens) CpG-island No: 24295
gttatgaaagtgtatgtatggaaaggatttatacgtgtaagtgtagaaagtggtagtgtgtacgtggtgtgtgtgtgcgcgcgcgagtgtgtgagcgttaggggtcgttcgttcgtcgcggtttttcgtgggttggtcgggttaatgagcgcgcggttgtaggggcggcgggcggggagggggcgtcgagttttgcggatggaggcgcgggtagcgcggcgcgtttatttcgcgcgggcgttgttggcggggggcggcgtagttattggattcggatcggggtcgcgattcggggtggcgggtggcgtgggcggcgttcggggttgggatgcgtcgggggtttagtggcggcggcggcgttggcggtggcgtcggcggttgtagggggacgagttagcgtcgcggcgttgggagttagttgagttcggtcggcgagcggaggcggtagcgtaggtagagcggcggcggtagcgggagttcgagcgttgcgcgtttattatggtcgtttagggagagttcggttatttggcggcgtagtcggatttcggttttaatagcgagcgtagtatcgattttttagtgttcggtttcgaggacgatttggtcgtcggggcgattttgtatagttcggagtggagcgaggagcgttttcgcgtggataggaagaaatttgaggttatgttataaggtaggtatttttcgtgttttcggatttttcgattgagtttttaattttttttcggatatttttatcgcgcgtttcggcgttcgttattttagtttacggtcggtcggtttagttttaggttcgttttttcgcggagtt

SEQ ID NO: 24296 - DNA, 826 bp, Artificial Sequence
  chemically treated genomic DNA (Homo sapiens) CpG-island No: 24296
aactccgcgaaaaaacgaacctaaaactaaaccgaccgaccgtaaactaaaataacgaacgccgaaacgcgcgataaaaatatccgaaaaaaaattaaaaactcaatcgaaaaatccgaaaacacgaaaaatacctaccttataacataacctcaaatttcttcctatccacgcgaaaacgctcctcgctccactccgaactatacaaaatcgccccgacgaccaaatcgtcctcgaaaccgaacactaaaaaatcgatactacgctcgctattaaaaccgaaatccgactacgccgccaaataaccgaactctccctaaacgaccataataaacgcgcaacgctcgaactcccgctaccgccgccgctctacctacgctaccgcctccgctcgccgaccgaactcaactaactcccaacgccgcgacgctaactcgtccccctacaaccgccgacgccaccgccaacgccgccgccgccactaaacccccgacgcatcccaaccccgaacgccgcccacgccacccgccaccccgaatcgcgaccccgatccgaatccaataactacgccgccccccgccaacaacgcccgcgcgaaataaacgcgccgcgctacccgcgcctccatccgcaaaactcgacgccccctccccgcccgccgcccctacaaccgcgcgctcattaacccgaccaacccacgaaaaaccgcgacgaacgaacgacccctaacgctcacacactcgcgcgcgcacacacacaccacgtacacactaccactttctacacttacacgtataaatcctttccatacatacactttcataac

SEQ ID NO: 24297 - DNA, 689 bp, Artificial Sequence
  chemically treated genomic DNA (Homo sapiens) CpG-island No: 24297
gttttcgtatcgtagttttcgtcgttatttcgcgtttcgttattttcgcgtacgtcgttttcggcgtttgagtttcggtcgtattcggcgtcgtttatttgtttttggatgtttcgtacgcgttgttcgtgtaggcggcgacgtgttgagtttgaatattatttaggcgcgtacgtagtagtagatatcgaagataagcgagagcggtaggaggaagaggtatacgaatatttagcgttggtggatgagtacgaattttagtttttttaggcgtatttatagtaggaagagtagcgcgtatacggttagcgatacggcgggttttatggtgcggcgtcgcgcggtaagcgttgcgggttcgcgttttttgttattgtcgttagtttcgcgtttggttcgttttgcgtttgtagtttatagttcggggagttcgggatcgttcgtcgtttcgcgattggttcgggtcgtcgaggttcggtgggtcgagattcgggcggcgattaatggcgagtcgcgtcggggatcggattaggaattcgtagtttttattggttgcgggagtcggatcgttttattttttttttttcgtcgtcgcgcgaggcgggggtgttagggattgggtgtcggtggggttcgttgcgaatattgggggtgggtagttgggatttagggttttaggttttcggggt

SEQ ID NO: 24298 - DNA, 689 bp, Artificial Sequence
  chemically treated genomic DNA (Homo sapiens) CpG-island No: 24298
accccgaaaacctaaaaccctaaatcccaactacccacccccaatattcgcaacgaaccccaccgacacccaatccctaacacccccgcctcgcgcgacgacgaaaaaaaaaaaataaaacgatccgactcccgcaaccaataaaaactacgaattcctaatccgatccccgacgcgactcgccattaatcgccgcccgaatctcgacccaccgaacctcgacgacccgaaccaatcgcgaaacgacgaacgatcccgaactccccgaactataaactacaaacgcaaaacgaaccaaacgcgaaactaacgacaataacaaaaaacgcgaacccgcaacgcttaccgcgcgacgccgcaccataaaacccgccgtatcgctaaccgtatacgcgctactcttcctactataaatacgcctaaaaaaactaaaattcgtactcatccaccaacgctaaatattcgtatacctcttcctcctaccgctctcgcttatcttcgatatctactactacgtacgcgcctaaataatattcaaactcaacacgtcgccgcctacacgaacaacgcgtacgaaacatccaaaaacaaataaacgacgccgaatacgaccgaaactcaaacgccgaaaacgacgtacgcgaaaataacgaaacgcgaaataacgacgaaaactacgatacgaaaac

SEQ ID NO: 24299 - DNA, 689 bp, Artificial Sequence
  chemically treated genomic DNA (Homo sapiens) CpG-island No: 24299
gtttcgagggtttggggttttgagttttaattgtttatttttagtattcgtagcggattttatcggtatttagtttttggtattttcgtttcgcgcggcggcggggagaaaagggtggagcggttcgattttcgtagttaatgaaagttgcgggtttttggttcgattttcggcgcggttcgttattggtcgtcgttcgggtttcggtttatcgaatttcggcgattcgagttaatcgcgaggcggcgggcgatttcgggtttttcgggttgtgggttataggcgtagagcgggttaggcgcggagttggcggtagtgataggaggcgcgaattcgtagcgtttatcgcgcggcgtcgtattatggagttcgtcgtgtcgttggtcgtgtgcgcgttgttttttttgttgtgggtgcgtttgaaggggttggagttcgtgtttatttattagcgttgggtgttcgtgtgttttttttttttgtcgttttcgtttattttcgatatttattattacgtgcgcgtttgggtggtgtttaagtttagtacgtcgtcgtttgtacgagtagcgcgtgcgggatatttagaagtaggtgagcggcgtcgggtgcggtcgggatttaggcgtcggaggcggcgtgcgcggggatagcgggacgcgaggtggcgacgggagttgcggtgcgggggt

SEQ ID NO: 24300 - DNA, 689 bp, Artificial Sequence
  chemically treated genomic DNA (Homo sapiens) CpG-island No: 24300
acccccgcaccgcaactcccgtcgccacctcgcgtcccgctatccccgcgcacgccgcctccgacgcctaaatcccgaccgcacccgacgccgctcacctacttctaaatatcccgcacgcgctactcgtacaaacgacgacgtactaaacttaaacaccacccaaacgcgcacgtaataataaatatcgaaaataaacgaaaacgacaaaaaaaaaaaacacacgaacacccaacgctaataaataaacacgaactccaaccccttcaaacgcacccacaacaaaaaaaacaacgcgcacacgaccaacgacacgacgaactccataatacgacgccgcgcgataaacgctacgaattcgcgcctcctatcactaccgccaactccgcgcctaacccgctctacgcctataacccacaacccgaaaaacccgaaatcgcccgccgcctcgcgattaactcgaatcgccgaaattcgataaaccgaaacccgaacgacgaccaataacgaaccgcgccgaaaatcgaaccaaaaacccgcaactttcattaactacgaaaatcgaaccgctccacccttttctccccgccgccgcgcgaaacgaaaataccaaaaactaaataccgataaaatccgctacgaatactaaaaataaacaattaaaactcaaaaccccaaaccctcgaaac

SEQ ID NO: 24301 - DNA, 587 bp, Artificial Sequence
  chemically treated genomic DNA (Homo sapiens) CpG-island No: 24301
tttcgcgttcggcgtcggtcgcggtgatggggtaggtttagggtttgggtagtttttttcgtcgttcgggtttttttcgtcggtacgaagtcgttttttgtttgcgcgcgtcgtagggacgtggcggtttttagaggtcgggatagcgggcgtagcgtggagtttgggggtcgaggcgcgggtttagatattttcgggtaagtttcgcggcggcggtcgcgataacggtaaaaatgcgttcgcgatcggttttttgttcgcgttttcgtagttcggttgtttttttcggttttgcgttgtttttttttcgtttgttttttttttttttgggtttttcgtttgtttttattgatttcgacgtcgattttattttttggatgaaaggggtcggatcgtttcgggaaattttttttcggcggcggggttgaaggagcgggcgcgtttgcgtttcgttttagtcggacggtgcgcgaggagggcgggtcggcgcgttatattttcggtttgttagttagggtcgtttttattttttttacgggtcggtggttaatagtttcgaggtttttaagtttttttttggtcgttaa

SEQ ID NO: 24302 - DNA, 587 bp, Artificial Sequence
  chemically treated genomic DNA (Homo sapiens) CpG-island No: 24302
ttaacgaccaaaaaaaaacttaaaaacctcgaaactattaaccaccgacccgtaaaaaaaataaaaacgaccctaactaacaaaccgaaaatataacgcgccgacccgccctcctcgcgcaccgtccgactaaaacgaaacgcaaacgcgcccgctccttcaaccccgccgccgaaaaaaaatttcccgaaacgatccgacccctttcatccaaaaaataaaatcgacgtcgaaatcaataaaaacaaacgaaaaacccaaaaaaaaaaaaaacaaacgaaaaaaaaacaacgcaaaaccgaaaaaaacaaccgaactacgaaaacgcgaacaaaaaaccgatcgcgaacgcatttttaccgttatcgcgaccgccgccgcgaaacttacccgaaaatatctaaacccgcgcctcgacccccaaactccacgctacgcccgctatcccgacctctaaaaaccgccacgtccctacgacgcgcgcaaacaaaaaacgacttcgtaccgacgaaaaaaacccgaacgacgaaaaaaactacccaaaccctaaacctaccccatcaccgcgaccgacgccgaacgcgaaa

SEQ ID NO: 24303 - DNA, 587 bp, Artificial Sequence
  chemically treated genomic DNA (Homo sapiens) CpG-island No: 24303
ttggcggttaaggggaaatttgggagtttcgggattgttggttatcggttcgtgggaggagtaaaggcggttttggttggtaggtcgagggtgtgacgcgtcggttcgtttttttcgcgtatcgttcggttagggcgaggcgtaggcgcgttcgtttttttagtttcgtcgtcggggaggggtttttcgggacgattcggttttttttatttaggaagtgaaatcgacgtcggggttaatgaaaataaacggggagtttagggggaaggaaggtaggcgaggaagaggtagcgtagggtcggagggagtagtcgggttgcggaagcgcgagtaggaggtcggtcgcgggcgtatttttgtcgttgtcgcggtcgtcgtcgcgaggtttattcgggaatgtttgggttcgcgtttcggtttttaagttttacgttgcgttcgttgtttcggtttttaaaggtcgttacgtttttgcggcgcgcgtaggtagaaagcggtttcgtgtcggcggagggggttcgggcggcgggaggggttgtttaggttttgggtttattttattatcgcggtcggcgtcgggcgcgagg

SEQ ID NO: 24304 - DNA, 587 bp, Artificial Sequence
  chemically treated genomic DNA (Homo sapiens) CpG-island No: 24304
cctcgcgcccgacgccgaccgcgataataaaataaacccaaaacctaaacaacccctcccgccgcccgaaccccctccgccgacacgaaaccgctttctacctacgcgcgccgcaaaaacgtaacgacctttaaaaaccgaaacaacgaacgcaacgtaaaacttaaaaaccgaaacgcgaacccaaacattcccgaataaacctcgcgacgacgaccgcgacaacgacaaaaatacgcccgcgaccgacctcctactcgcgcttccgcaacccgactactccctccgaccctacgctacctcttcctcgcctaccttccttccccctaaactccccgtttattttcattaaccccgacgtcgatttcacttcctaaataaaaaaaaccgaatcgtcccgaaaaacccctccccgacgacgaaactaaaaaaacgaacgcgcctacgcctcgccctaaccgaacgatacgcgaaaaaaacgaaccgacgcgtcacaccctcgacctaccaaccaaaaccgcctttactcctcccacgaaccgataaccaacaatcccgaaactcccaaatttccccttaaccgccaa

SEQ ID NO: 24305 - DNA, 625 bp, Artificial Sequence
  chemically treated genomic DNA (Homo sapiens) CpG-island No: 24305
gggcgcggggtcggttaggattttcgcgttcggattttcgggtgtttgacgtttattttgttcggtatttttttaatatttttcggtttacgtcgtcgcgcgcgtcgggttttcgcggtcgcggagggaggttcgtttagagtttggggtcgcgtcgtcgtcgtttcggttttttttttttttttttttttttttttttgggtttcgagtcgcgtagtggttcggaaaagtttggttcgggttgttttttatcgtttttttttttgggattggtttgtttgcgttttttgtatcgggggttattcgttatgatcggttgttttattgataagagcggattagatggtagttcgtatggattcggcgttttgtttcggtagtacgtaggttcgatttagtaattaaatatagcgataatgtgggtatcgcgcgtttattgaaacgcgcgcgggtcgtttagggtttacgttatcgtttcggcgagtattttttcgcgttttttaattttaaagcgaaatttcggtcgtcgtttttttcgttttttatttttagttttggtttcgaggcgttttgtgtttgttattgtttggtgtgttgtattcgcgaggggattagagagataaga

SEQ ID NO: 24306 - DNA, 625 bp, Artificial Sequence
  chemically treated genomic DNA (Homo sapiens) CpG-island No: 24306
tcttatctctctaatcccctcgcgaatacaacacaccaaacaataacaaacacaaaacgcctcgaaaccaaaactaaaaataaaaaacgaaaaaaacgacgaccgaaatttcgctttaaaattaaaaaacgcgaaaaaatactcgccgaaacgataacgtaaaccctaaacgacccgcgcgcgtttcaataaacgcgcgatacccacattatcgctatatttaattactaaatcgaacctacgtactaccgaaacaaaacgccgaatccatacgaactaccatctaatccgctcttatcaataaaacaaccgatcataacgaataacccccgatacaaaaaacgcaaacaaaccaatcccaaaaaaaaaaacgataaaaaacaacccgaaccaaacttttccgaaccactacgcgactcgaaacccaaaaaaaaaaaaaaaaaaaaaaaaaaaaaaccgaaacgacgacgacgcgaccccaaactctaaacgaacctccctccgcgaccgcgaaaacccgacgcgcgcgacgacgtaaaccgaaaaatattaaaaaaataccgaacaaaataaacgtcaaacacccgaaaatccgaacgcgaaaatcctaaccgaccccgcgccc

SEQ ID NO: 24307 - DNA, 625 bp, Artificial Sequence
  chemically treated genomic DNA (Homo sapiens) CpG-island No: 24307
ttttgtttttttgattttttcgcgggtgtaatatattaaatagtaataaatataaagcgtttcggggttaaggttgggggtggggggcgggaagagcggcggtcgaagtttcgttttggggttggggggcgcggagaggtgttcgtcggggcggtggcgtgggttttgggcggttcgcgcgcgttttaatgggcgcgcgatgtttatattgtcgttgtgtttggttgttagatcgagtttgcgtgttgtcgaagtagggcgtcgagtttatgcgaattgttatttgattcgtttttattaatgaagtagtcgattatggcggatggttttcggtgtaagaggcgtaaataagttaattttaggaggaaaaacggtaagaagtagttcgaattaaattttttcgggttattacgcggttcgagatttagggagaaggagggggaaagggaaaaggaatcgaggcggcggcggcgcggttttaggttttaggcgagttttttttcgcggtcgcgggagttcggcgcgcgcggcggcgtggatcggggggtgttggggaagtgtcgggtaaagtgagcgttaggtattcgggggttcgagcgcgggggttttggtcggtttcgcgttt

SEQ ID NO: 24308 - DNA, 625 bp, Artificial Sequence
  chemically treated genomic DNA (Homo sapiens) CpG-island No: 24308
aaacgcgaaaccgaccaaaacccccgcgctcgaacccccgaatacctaacgctcactttacccgacacttccccaacaccccccgatccacgccgccgcgcgcgccgaactcccgcgaccgcgaaaaaaaactcgcctaaaacctaaaaccgcgccgccgccgcctcgattccttttccctttccccctccttctccctaaatctcgaaccgcgtaataacccgaaaaaatttaattcgaactacttcttaccgtttttcctcctaaaattaacttatttacgcctcttacaccgaaaaccatccgccataatcgactacttcattaataaaaacgaatcaaataacaattcgcataaactcgacgccctacttcgacaacacgcaaactcgatctaacaaccaaacacaacgacaatataaacatcgcgcgcccattaaaacgcgcgcgaaccgcccaaaacccacgccaccgccccgacgaacacctctccgcgccccccaaccccaaaacgaaacttcgaccgccgctcttcccgccccccacccccaaccttaaccccgaaacgctttatatttattactatttaatatattacacccgcgaaaaaatcaaaaaaacaaaa

SEQ ID NO: 24309 - DNA, 720 bp, Artificial Sequence
  chemically treated genomic DNA (Homo sapiens) CpG-island No: 24309
aaacgagcgagcgtttaagaggagaggaggaggaatagagcgcgacggcgaagggtcgagggagtgtaagttaggtcgcggttagagcgcgggcggaataagtatgcgcgatagaaggatattttcgtaggcgaatttgtcggtatttttgtaatacgttaacgattacgtaatttaggaagggcggcggcgggttgtgaggtggcggttgaggcggttggggtaatttttgtattagttataggcggcggcggcgttacgcgattagtaaatattatcgcgaggtttttgcgttttcggtaacggcggcggcggtcgacggcgagtacggcgcggcgagtatgtagcgtttcgggggagggatttgttaggggttggagggagtgggtgtatggggaaggagcgagcgcgtagggaagagattagagcgtcgggtcgtttttgtcgtatttcgggttcgtcgcgcggcgcgggagttcggggttgtcggattcgcgtgcgcgggggtagggttttcgcgtcggtcggagggaggcgcgttttcgtcgcgtcgttcgggttttagcgtcgttgttatttgattttttttgtttttcgcggaagcgcgttttttttttgatttatatttaatacggggagaaatgttgttgttttcgtttagttgtcgtttttcgggagtttaatgtgatcgttttttaaaatggaattgaaaagttgaga

SEQ ID NO: 24310 - DNA, 720 bp, Artificial Sequence
  chemically treated genomic DNA (Homo sapiens) CpG-island No: 24310
tctcaacttttcaattccattttaaaaaacgatcacattaaactcccgaaaaacgacaactaaacgaaaacaacaacatttctccccgtattaaatataaatcaaaaaaaaaacgcgcttccgcgaaaaacaaaaaaaatcaaataacaacgacgctaaaacccgaacgacgcgacgaaaacgcgcctccctccgaccgacgcgaaaaccctacccccgcgcacgcgaatccgacaaccccgaactcccgcgccgcgcgacgaacccgaaatacgacaaaaacgacccgacgctctaatctcttccctacgcgctcgctccttccccatacacccactccctccaacccctaacaaatccctcccccgaaacgctacatactcgccgcgccgtactcgccgtcgaccgccgccgccgttaccgaaaacgcaaaaacctcgcgataatatttactaatcgcgtaacgccgccgccgcctataactaatacaaaaattaccccaaccgcctcaaccgccacctcacaacccgccgccgcccttcctaaattacgtaatcgttaacgtattacaaaaataccgacaaattcgcctacgaaaatatccttctatcgcgcatacttattccgcccgcgctctaaccgcgacctaacttacactccctcgacccttcgccgtcgcgctctattcctcctcctctcctcttaaacgctcgctcgttt

SEQ ID NO: 24311 - DNA, 720 bp, Artificial Sequence
  chemically treated genomic DNA (Homo sapiens) CpG-island No: 24311
ttttaattttttagttttattttgagaaacgattatattgaattttcgagaagcggtagttgagcgagagtagtagtattttttttcgtgttgggtgtgggttaggagagaggcgcgttttcgcgggagatagggggagttaggtggtagcggcgttggagttcgagcggcgcggcgggggcgcgttttttttcggtcggcgcggggattttgttttcgcgtacgcgagttcggtaatttcgggttttcgcgtcgcgcggcgaattcggggtgcggtaggggcggttcggcgttttagttttttttttgcgcgttcgttttttttttatgtatttattttttttagtttttggtaggtttttttttcgaagcgttgtatattcgtcgcgtcgtgttcgtcgtcggtcgtcgtcgtcgttatcggaggcgtaggagtttcgcgatagtgtttgttgatcgcgtgacgtcgtcgtcgtttgtaattgatgtagaggttattttagtcgttttagtcgttattttatagttcgtcgtcgttttttttgggttacgtggtcgttgacgtattgtagaggtgtcggtaggttcgtttgcggaagtgtttttttgtcgcgtatgtttgtttcgttcgcgttttgatcgcggtttggtttgtattttttcgatttttcgtcgtcgcgttttgtttttttttttttttttttgggcgttcgttcgttt

SEQ ID NO: 24312 - DNA, 720 bp, Artificial Sequence
  chemically treated genomic DNA (Homo sapiens) CpG-island No: 24312
aaacgaacgaacgcccaaaaaaaaaaaaaaaaaaacaaaacgcgacgacgaaaaatcgaaaaaatacaaaccaaaccgcgatcaaaacgcgaacgaaacaaacatacgcgacaaaaaaacacttccgcaaacgaacctaccgacacctctacaatacgtcaacgaccacgtaacccaaaaaaaacgacgacgaactataaaataacgactaaaacgactaaaataacctctacatcaattacaaacgacgacgacgtcacgcgatcaacaaacactatcgcgaaactcctacgcctccgataacgacgacgacgaccgacgacgaacacgacgcgacgaatatacaacgcttcgaaaaaaaaacctaccaaaaactaaaaaaaataaatacataaaaaaaaaacgaacgcgcaaaaaaaaaactaaaacgccgaaccgcccctaccgcaccccgaattcgccgcgcgacgcgaaaacccgaaattaccgaactcgcgtacgcgaaaacaaaatccccgcgccgaccgaaaaaaaacgcgcccccgccgcgccgctcgaactccaacgccgctaccacctaactccccctatctcccgcgaaaacgcgcctctctcctaacccacacccaacacgaaaaaaaatactactactctcgctcaactaccgcttctcgaaaattcaatataatcgtttctcaaaataaaactaaaaaattaaaa

SEQ ID NO: 24313 - DNA, 593 bp, Artificial Sequence
  chemically treated genomic DNA (Homo sapiens) CpG-island No: 24313
tcgttttcggaattaacgtcgcgtacgcgtcggaggtatggtttcgtttcgatttcgtttggcggtttatttcgtaggtcggtatagtacggttgttcgcggtagtagaagaggaagatgtagcggtggaaggcgttcgggcggttaggtagcggcgtatatatttgtagtaggaaggagagcgggcggtttatagttcgtaggttagggttggggtttcggtagttcggtcgcgtttagttatgtcggtcgttcgtttattttgttggggaattgttcgttgcgtagtcgttacgtcggcgtcgattcgcgaagtttagttttataggtttggtttcggcggtagttatgcggggcgcgggttggcgtggcgtagtttatagttgggtcggaaggcggaaatcgggcgtcgggtcggaaggtaagaggcgggtattttttcggaggataggaggcggaaacgcgtttgacgggagcggttgtaggattaatgcgagggaacggggtagaggaaatttttcggtattagtttcgtttttggcgtttttgttttcgagtcgtttttttggtgttttcgggtgttttgggatggt

SEQ ID NO: 24314 - DNA, 593 bp, Artificial Sequence
  chemically treated genomic DNA (Homo sapiens) CpG-island No: 24314
accatcccaaaacacccgaaaacaccaaaaaaacgactcgaaaacaaaaacgccaaaaacgaaactaataccgaaaaatttcctctaccccgttccctcgcattaatcctacaaccgctcccgtcaaacgcgtttccgcctcctatcctccgaaaaaatacccgcctcttaccttccgacccgacgcccgatttccgccttccgacccaactataaactacgccacgccaacccgcgccccgcataactaccgccgaaaccaaacctataaaactaaacttcgcgaatcgacgccgacgtaacgactacgcaacgaacaattccccaacaaaataaacgaacgaccgacataactaaacgcgaccgaactaccgaaaccccaaccctaacctacgaactataaaccgcccgctctccttcctactacaaatatatacgccgctacctaaccgcccgaacgccttccaccgctacatcttcctcttctactaccgcgaacaaccgtactataccgacctacgaaataaaccgccaaacgaaatcgaaacgaaaccatacctccgacgcgtacgcgacgttaattccgaaaacga

SEQ ID NO: 24315 - DNA, 593 bp, Artificial Sequence
  chemically treated genomic DNA (Homo sapiens) CpG-island No: 24315
attattttagagtattcggaggtattaggaaagcggttcggaggtagaggcgttaggggcggggttgatgtcgagaggttttttttgtttcgttttttcgtattggttttgtaatcgttttcgttagacgcgttttcgttttttgtttttcggaaaggtgttcgttttttgtttttcggttcggcgttcgattttcgtttttcgatttagttgtgggttgcgttacgttagttcgcgtttcgtatggttgtcgtcggggttaggtttgtggagttgggtttcgcgagtcggcgtcggcgtggcgattgcgtagcgagtagttttttagtaaggtgggcgggcggtcggtatggttgggcgcggtcgggttgtcggggttttagttttggtttgcgagttgtgggtcgttcgtttttttttttgttgtaggtgtatgcgtcgttgtttggtcgttcggacgttttttatcgttgtattttttttttttgttgtcgcgagtagtcgtgttgtgtcggtttgcgaggtgagtcgttaaacggggtcggaacggggttatgttttcgacgcgtgcgcggcgttaatttcgggagcga

SEQ ID NO: 24316 - DNA, 593 bp, Artificial Sequence
  chemically treated genomic DNA (Homo sapiens) CpG-island No: 24316
tcgctcccgaaattaacgccgcgcacgcgtcgaaaacataaccccgttccgaccccgtttaacgactcacctcgcaaaccgacacaacacgactactcgcgacaacaaaaaaaaaaaatacaacgataaaaaacgtccgaacgaccaaacaacgacgcatacacctacaacaaaaaaaaaaacgaacgacccacaactcgcaaaccaaaactaaaaccccgacaacccgaccgcgcccaaccataccgaccgcccgcccaccttactaaaaaactactcgctacgcaatcgccacgccgacgccgactcgcgaaacccaactccacaaacctaaccccgacgacaaccatacgaaacgcgaactaacgtaacgcaacccacaactaaatcgaaaaacgaaaatcgaacgccgaaccgaaaaacaaaaaacgaacacctttccgaaaaacaaaaaacgaaaacgcgtctaacgaaaacgattacaaaaccaatacgaaaaaacgaaacaaaaaaaacctctcgacatcaaccccgcccctaacgcctctacctccgaaccgctttcctaatacctccgaatactctaaaataat

SEQ ID NO: 24317 - DNA, 821 bp, Artificial Sequence
  chemically treated genomic DNA (Homo sapiens) CpG-island No: 24317
cgggcgggcgggcggggcgtagggtaggttcgggaaaggcggggtcgtattgtcgggttttttatcgttcgtatcgtttttagtttcgtttttagttattcgggtttcgcggtagttttgtagttttcgcgcgattgtagcgcgcgttcggattttttttcgtagtcgttttttttttgttgcgcgatttttagtatttatttgttttgtaaatcggggcgttggggtttttttttttcggcgagtttcggttttgtttcggagatttttttcgatgtcggacgcgggttgggggtggggtcgcgtttatttcgtcggtttataggtgggtgggcgacgagttgggcgacgatacggtgtttagtagcggcggcggcggcggcggtcgtgggggttttcgcgagttttaggcgcggcgttgcgcgtggggttggtgtttcgcgtggacgtcgcggacgcgttcgttttgcgttggtttatcgtggggttggtgcgcgcgtcgcgttttcgtcgtcgcgcgtggggttggtttgcgcgagtaggtgcgcggttatcgtcgtcgtcgtcgtttgcggggtttgaggcgttattatagtagttatcgttgttgttgtcgtcgtcgtcgttcgcgttcgcgtggggttgttatgttgttgttgttgttgttgttttagttggaacggaatcgtcgtttttatgggttgtaagcggttttcgggtttttcggtcgtggttatcgtattatttttaagggagtcggtcggcgtgggggatttattgcgttttattcgttgggatatggtttttttttttttcggtga

SEQ ID NO: 24318 - DNA, 821 bp, Artificial Sequence
  chemically treated genomic DNA (Homo sapiens) CpG-island No: 24318
tcaccgaaaaaaaaaaaaaccatatcccaacgaataaaacgcaataaatcccccacgccgaccgactcccttaaaaataatacgataaccacgaccgaaaaacccgaaaaccgcttacaacccataaaaacgacgattccgttccaactaaaacaacaacaacaacaacaacataacaaccccacgcgaacgcgaacgacgacgacgacaacaacaacgataactactataataacgcctcaaaccccgcaaacgacgacgacgacgataaccgcgcacctactcgcgcaaaccaaccccacgcgcgacgacgaaaacgcgacgcgcgcaccaaccccacgataaaccaacgcaaaacgaacgcgtccgcgacgtccacgcgaaacaccaaccccacgcgcaacgccgcgcctaaaactcgcgaaaacccccacgaccgccgccgccgccgccgctactaaacaccgtatcgtcgcccaactcgtcgcccacccacctataaaccgacgaaataaacgcgaccccacccccaacccgcgtccgacatcgaaaaaaatctccgaaacaaaaccgaaactcgccgaaaaaaaaaaaccccaacgccccgatttacaaaacaaataaatactaaaaatcgcgcaacaaaaaaaaaacgactacgaaaaaaaatccgaacgcgcgctacaatcgcgcgaaaactacaaaactaccgcgaaacccgaataactaaaaacgaaactaaaaacgatacgaacgataaaaaacccgacaatacgaccccgcctttcccgaacctaccctacgccccgcccgcccgcccg

SEQ ID NO: 24319 - DNA, 821 bp, Artificial Sequence
  chemically treated genomic DNA (Homo sapiens) CpG-island No: 24319
ttatcggggaggggggggattatgttttagcgggtgaggcgtaatgggttttttacgtcggtcggtttttttgggggtggtgcggtggttacggtcgggggattcgggagtcgtttgtagtttatgagggcgacggtttcgttttagttgaagtagtagtagtagtagtaatatggtagttttacgcggacgcggacggcggcggcggtaataataacggtggttgttgtggtggcgttttaggtttcgtaggcggcggcggcggcggtggtcgcgtatttgttcgcgtagattagttttacgcgcggcggcgggaacgcgacgcgcgtattagttttacggtgggttaacgtagaacgggcgcgttcgcgacgtttacgcgaggtattagttttacgcgtagcgtcgcgtttggagttcgcgggagtttttacggtcgtcgtcgtcgtcgtcgttgttgggtatcgtgtcgtcgtttagttcgtcgtttatttatttgtggatcggcgaggtgagcgcggttttatttttagttcgcgttcggtatcggaggaggttttcggagtagagtcgaagttcgtcggagaagaggagttttagcgtttcggtttgtaaagtaggtaagtgttgggggtcgcgtagtaagggggaggcggttgcgggaaggggttcgggcgcgcgttgtaatcgcgcggggattgtagagttgtcgcggagttcgggtggttgggggcggggttgggggcggtgcgggcggtgggggattcggtagtgcggtttcgtttttttcgggtttattttacgtttcgttcgttcgttcg

SEQ ID NO: 24320 - DNA, 821 bp, Artificial Sequence
  chemically treated genomic DNA (Homo sapiens) CpG-island No: 24320
cgaacgaacgaacgaaacgtaaaataaacccgaaaaaaacgaaaccgcactaccgaatcccccaccgcccgcaccgcccccaaccccgcccccaaccacccgaactccgcgacaactctacaatccccgcgcgattacaacgcgcgcccgaaccccttcccgcaaccgcctcccccttactacgcgacccccaacacttacctactttacaaaccgaaacgctaaaactcctcttctccgacgaacttcgactctactccgaaaacctcctccgataccgaacgcgaactaaaaataaaaccgcgctcacctcgccgatccacaaataaataaacgacgaactaaacgacgacacgatacccaacaacgacgacgacgacgacgaccgtaaaaactcccgcgaactccaaacgcgacgctacgcgtaaaactaatacctcgcgtaaacgtcgcgaacgcgcccgttctacgttaacccaccgtaaaactaatacgcgcgtcgcgttcccgccgccgcgcgtaaaactaatctacgcgaacaaatacgcgaccaccgccgccgccgccgcctacgaaacctaaaacgccaccacaacaaccaccgttattattaccgccgccgccgtccgcgtccgcgtaaaactaccatattactactactactactacttcaactaaaacgaaaccgtcgccctcataaactacaaacgactcccgaatcccccgaccgtaaccaccgcaccacccccaaaaaaaccgaccgacgtaaaaaacccattacgcctcacccgctaaaacataatcccccccctccccgataa

SEQ ID NO: 24321 - DNA, 640 bp, Artificial Sequence
  chemically treated genomic DNA (Homo sapiens) CpG-island No: 24321
tgtgggcggggattcggcgttcgggagggaaggggttggtttagagattatagacgggcggggatcgtttcggttcgggtttttagcgttcggcgttcgtatattcgttagtttagttgtcggtacgtcggttagttagtcgttgtcgtttattagtggcgtttcgttgatttttcgggggtagttttttaacggttttcgtagttagagtattatttcgcggtggggtatttttagttcgttcgtagttttcggttttcgtcgcgtcgttattttcgcgagaagttaggaagttcgcgaagtggggggaggaggagtagggaggggtatttaacggtggtggttggttttgcgtcggattcgggagaggggcgggcgttattgtgtttcgttgtcgattgtatttttttagttacgggtttagaattttaaggagaaaggcggcggtgcgtgttgttgcgagtgggacgcgtattggtcggtgcggtttaggagtcggggtaatgagttgcggagttagttttttttcgttttgggcgttagttcgggattaggtcgcgagtgggggaggggaggaaacgaagaggtttggggaacgggaggtcgtttttttttagggggattttttagagtgatcgta

SEQ ID NO: 24322 - DNA, 640 bp, Artificial Sequence
  chemically treated genomic DNA (Homo sapiens) CpG-island No: 24322
tacgatcactctaaaaaatccccctaaaaaaaaacgacctcccgttccccaaacctcttcgtttcctcccctcccccactcgcgacctaatcccgaactaacgcccaaaacgaaaaaaaactaactccgcaactcattaccccgactcctaaaccgcaccgaccaatacgcgtcccactcgcaacaacacgcaccgccgcctttctccttaaaattctaaacccgtaactaaaaaaatacaatcgacaacgaaacacaataacgcccgcccctctcccgaatccgacgcaaaaccaaccaccaccgttaaatacccctccctactcctcctccccccacttcgcgaacttcctaacttctcgcgaaaataacgacgcgacgaaaaccgaaaactacgaacgaactaaaaataccccaccgcgaaataatactctaactacgaaaaccgttaaaaaactacccccgaaaaatcaacgaaacgccactaataaacgacaacgactaactaaccgacgtaccgacaactaaactaacgaatatacgaacgccgaacgctaaaaacccgaaccgaaacgatccccgcccgtctataatctctaaaccaaccccttccctcccgaacgccgaatccccgcccaca

SEQ ID NO: 24323 - DNA, 640 bp, Artificial Sequence
  chemically treated genomic DNA (Homo sapiens) CpG-island No: 24323
tgcggttattttagaggatttttttgagaggaagcggtttttcgttttttaggttttttcgttttttttttttttttattcgcggtttggtttcgaattagcgtttaagacggagaagaattagtttcgtagtttattatttcggtttttgagtcgtatcgattagtgcgcgttttattcgtagtaatacgtatcgtcgtttttttttttggagttttaggttcgtgattgaggaaatgtagtcggtagcgaagtataatggcgttcgtttttttttcggattcggcgtagaattagttattatcgttaagtgtttttttttgttttttttttttttatttcgcggattttttggtttttcgcgagagtggcggcgcggcggggatcgagagttgcgggcgggttggaggtattttatcgcggggtggtgttttgattgcgggaatcgttgaagagttgttttcggggagttagcgaggcgttattggtaagcggtagcggttggttggtcggcgtgtcggtagttgggttggcgagtgtgcgggcgtcgggcgttggaggttcgggtcggggcggttttcgttcgtttatagtttttgagttagttttttttttttcgggcgtcgggttttcgtttata

SEQ ID NO: 24324 - DNA, 640 bp, Artificial Sequence
  chemically treated genomic DNA (Homo sapiens) CpG-island No: 24324
tataaacgaaaacccgacgcccgaaaaaaaaaaaactaactcaaaaactataaacgaacgaaaaccgccccgacccgaacctccaacgcccgacgcccgcacactcgccaacccaactaccgacacgccgaccaaccaaccgctaccgcttaccaataacgcctcgctaactccccgaaaacaactcttcaacgattcccgcaatcaaaacaccaccccgcgataaaatacctccaacccgcccgcaactctcgatccccgccgcgccgccactctcgcgaaaaaccaaaaaatccgcgaaataaaaaaaaaaaaaacaaaaaaaaacacttaacgataataactaattctacgccgaatccgaaaaaaaaacgaacgccattatacttcgctaccgactacatttcctcaatcacgaacctaaaactccaaaaaaaaaaacgacgatacgtattactacgaataaaacgcgcactaatcgatacgactcaaaaaccgaaataataaactacgaaactaattcttctccgtcttaaacgctaattcgaaaccaaaccgcgaataaaaaaaaaaaaaaaacgaaaaaacctaaaaaacgaaaaaccgcttcctctcaaaaaaatcctctaaaataaccgca

SEQ ID NO: 24325 - DNA, 534 bp, Artificial Sequence
  chemically treated genomic DNA (Homo sapiens) CpG-island No: 24325
gttgacgttgggggcgtttcgtttagcgcgcgcgtttgaaggtcggaagtgtttttttttttttcggtttatcgtgttcgaggtttttttagaattcgtggtaggcgtttagggcgtacgagattttttttagtttattagttttttttcggagttcggtcgggagtatcgatttttttttttcgttgtcggtagttgcgcgtcgggaaggttttttttttcgttttttttttcgttttgcgtcgtcgtttttgtggatagatttttcgttttcgacgtttgttaggagttgcggtatttggtttaggttttttttttgcgattcgttatttgttattttagtttttttttcgttttcgtcgacgacgataggggtcggtttatggtcgtattgggggtttcgttattttagtcggattttgcgcgagataaggcggcggtagggattttcgtttttgttgttagcgttcggtcgggtagggggtttcggggagttgaagcgggcgtcggaggaggaggaggaggaggagggga

SEQ ID NO: 24326 - DNA, 534 bp, Artificial Sequence
  chemically treated genomic DNA (Homo sapiens) CpG-island No: 24326
tcccctcctcctcctcctcctcctccgacgcccgcttcaactccccgaaaccccctacccgaccgaacgctaacaacaaaaacgaaaatccctaccgccgccttatctcgcgcaaaatccgactaaaataacgaaacccccaatacgaccataaaccgacccctatcgtcgtcgacgaaaacgaaaaaaaaactaaaataacaaataacgaatcgcaaaaaaaaaacctaaaccaaataccgcaactcctaacaaacgtcgaaaacgaaaaatctatccacaaaaacgacgacgcaaaacgaaaaaaaaaacgaaaaaaaaaaccttcccgacgcgcaactaccgacaacgaaaaaaaaaaatcgatactcccgaccgaactccgaaaaaaaactaataaactaaaaaaaatctcgtacgccctaaacgcctaccacgaattctaaaaaaacctcgaacacgataaaccgaaaaaaaaaaaaacacttccgaccttcaaacgcgcgcgctaaacgaaacgcccccaacgtcaac

SEQ ID NO: 24327 - DNA, 534 bp, Artificial Sequence
  chemically treated genomic DNA (Homo sapiens) CpG-island No: 24327
tttttttttttttttttttttttttcggcgttcgttttagtttttcggggttttttgttcggtcgggcgttgatagtaagggcgggggtttttgtcgtcgttttgtttcgcgtagggttcggttggggtagcggagtttttagtgcggttatggatcggtttttgtcgtcgtcggcggaggcggaggaggaattggagtggtaagtggcgagtcgtaggaggaaggtttgggttaagtgtcgtagtttttggtaagcgtcggagacggaggatttgtttatagaagcgacgacgtaggacgaggaggaggacgagggggaggattttttcggcgcgtagttgtcggtagcggggggaagaggtcggtgttttcggtcgggtttcggggggaggttggtgggttggggagagtttcgtgcgttttgggcgtttgttacgagttttgggagagtttcgggtacggtaggtcgaggggagaggggatattttcgatttttaaacgcgcgcgttgaacgaggcgtttttagcgttaat

SEQ ID NO: 24328 - DNA, 534 bp, Artificial Sequence
  chemically treated genomic DNA (Homo sapiens) CpG-island No: 24328
attaacgctaaaaacgcctcgttcaacgcgcgcgtttaaaaatcgaaaatatcccctctcccctcgacctaccgtacccgaaactctcccaaaactcgtaacaaacgcccaaaacgcacgaaactctccccaacccaccaacctccccccgaaacccgaccgaaaacaccgacctcttccccccgctaccgacaactacgcgccgaaaaaatcctccccctcgtcctcctcctcgtcctacgtcgtcgcttctataaacaaatcctccgtctccgacgcttaccaaaaactacgacacttaacccaaaccttcctcctacgactcgccacttaccactccaattcctcctccgcctccgccgacgacgacaaaaaccgatccataaccgcactaaaaactccgctaccccaaccgaaccctacgcgaaacaaaacgacgacaaaaacccccgcccttactatcaacgcccgaccgaacaaaaaaccccgaaaaactaaaacgaacgccgaaaaaaaaaaaaaaaaaaaaaaaaa

SEQ ID NO: 24329 - DNA, 582 bp, Artificial Sequence
  chemically treated genomic DNA (Homo sapiens) CpG-island No: 24329
gtaaattcgttttcgtattttatcgagagggaaaaacgtcgcgttttttttttttaaaatcgttcgggttcggtgtttaaggcgttttcgagggtgcgggttcgtaggcgtaggaatgatcgttcgtttttatttggagtggtggttgtacgcgaaagtcgttcgcgttcgtcgtcgttttttggaatcgcgaggggtgtgggtgcgagggtgtagaaagggagggtgcggggtgggtcggggtgtagtgcggagcggggtcgggcggttagggcggttttttattcggcgtttttaagaatttgggagcgcgtagagttgataggtgttggcgtcggcggaggcgcgcggcgtagggcgaggtgggaatcgatcgagtattgggaaaagttttttttataagggcggtaggcgggggcgatcgttagatattcggaggcggacgttagaggagagtggtgttagggcgtgtgttagggacgttgttttcgcgaggagggtgggtgtgcgggatgcgaaggaaacggggtttaaggagttggggggtaggttgggttttggttcgcgttgttagttatggta

SEQ ID NO: 24330 - DNA, 582 bp, Artificial Sequence
  chemically treated genomic DNA (Homo sapiens) CpG-island No: 24330
taccataactaacaacgcgaaccaaaacccaacctaccccccaactccttaaaccccgtttccttcgcatcccgcacacccaccctcctcgcgaaaacaacgtccctaacacacgccctaacaccactctcctctaacgtccgcctccgaatatctaacgatcgcccccgcctaccgcccttataaaaaaaacttttcccaatactcgatcgattcccacctcgccctacgccgcgcgcctccgccgacgccaacacctatcaactctacgcgctcccaaattcttaaaaacgccgaataaaaaaccgccctaaccgcccgaccccgctccgcactacaccccgacccaccccgcaccctccctttctacaccctcgcacccacacccctcgcgattccaaaaaacgacgacgaacgcgaacgactttcgcgtacaaccaccactccaaataaaaacgaacgatcattcctacgcctacgaacccgcaccctcgaaaacgccttaaacaccgaacccgaacgattttaaaaaaaaaaaacgcgacgtttttccctctcgataaaatacgaaaacgaatttac

SEQ ID NO: 24331 - DNA, 582 bp, Artificial Sequence
  chemically treated genomic DNA (Homo sapiens) CpG-island No: 24331
tattatggttggtagcgcggattagagtttagtttgttttttagttttttgggtttcgtttttttcgtatttcgtatatttatttttttcgcgagggtagcgtttttagtatacgttttagtattatttttttttgacgttcgttttcggatgtttgacgatcgttttcgtttgtcgtttttataaaggggattttttttaatattcgatcgatttttatttcgttttgcgtcgcgcgttttcgtcggcgttaatatttgttaattttgcgcgtttttaggtttttggagacgtcgagtgaggagtcgttttgatcgttcggtttcgtttcgtattgtatttcgatttatttcgtattttttttttttgtattttcgtatttatatttttcgcggttttagggggcggcggcgagcgcggacggttttcgcgtgtagttattattttaggtaggagcggacggttatttttgcgtttacgggttcgtattttcggaaacgttttgggtatcgagttcgggcggttttagaggggagggacgcggcgtttttttttttcggtgggatgcgagggcgggtttgt

SEQ ID NO: 24332 - DNA, 582 bp, Artificial Sequence
  chemically treated genomic DNA (Homo sapiens) CpG-island No: 24332
acaaacccgccctcgcatcccaccgaaaaaaaaaaacgccgcgtccctcccctctaaaaccgcccgaactcgatacccaaaacgtttccgaaaatacgaacccgtaaacgcaaaaataaccgtccgctcctacctaaaataataactacacgcgaaaaccgtccgcgctcgccgccgccccctaaaaccgcgaaaaatataaatacgaaaatacaaaaaaaaaaaatacgaaataaatcgaaatacaatacgaaacgaaaccgaacgatcaaaacgactcctcactcgacgtctccaaaaacctaaaaacgcgcaaaattaacaaatattaacgccgacgaaaacgcgcgacgcaaaacgaaataaaaatcgatcgaatattaaaaaaaatcccctttataaaaacgacaaacgaaaacgatcgtcaaacatccgaaaacgaacgtcaaaaaaaaataatactaaaacgtatactaaaaacgctaccctcgcgaaaaaaataaatatacgaaatacgaaaaaaacgaaacccaaaaaactaaaaaacaaactaaactctaatccgcgctaccaaccataata

SEQ ID NO: 24333 - DNA, 791 bp, Artificial Sequence
  chemically treated genomic DNA (Homo sapiens) CpG-island No: 24333
gtttcgttcgcggggagggttttatttattcgttttttcgtattacgttgttgttttcgtagtcgtaggcgttttcggtttggttgcggaatatgttgaagtcgtgttcggtgtggtcgttttggtggaagtattcggcgtatagcgatatgtagggcgagatgtcgtacgttcggtagcggtaggttacgaagttggttgtttagattaggtcgtagagcgtcgcgggatcgtaggttcgtatcgtcgcgtagaattcgtcgtagtcgtcgtcgttcgttagaaggtatttatattattttagggtttttttttcggtcgttttcggatcgttttcgttttcggtcgtcgtcgcgttttcgtcgtcggtagtcgcggttagcggtcgttcggcgtttagtattcgttttagtagcgtttgtagttttttagtatttgcgcggttgttcggtcggttgagggtcgttttgaggtgcgcgggggtggtcgttttggttagggttagtttcggcgcgggtagttcgggttgtgacggttgttggttttcgacggtcgtcgcggtcgtcgtcgtatgatgagagtttagaatttggagagtttagggttagcggttttttagggagagtgagggaatagattgttgcgattgttcggttcgtttaattttcgcgatattcggagcgttcgcgttttttcgttcgtagtttcgtttttatatacgttttttcgggttgtagagtttttttttcgttttttttttttgggcgtttgtggattaagttaggttttta

SEQ ID NO: 24334 - DNA, 791 bp, Artificial Sequence
  chemically treated genomic DNA (Homo sapiens) CpG-island No: 24334
taaaaacctaacttaatccacaaacgcccaaaaaaaaaaaacgaaaaaaaaactctacaacccgaaaaaacgtatataaaaacgaaactacgaacgaaaaaacgcgaacgctccgaatatcgcgaaaattaaacgaaccgaacaatcgcaacaatctattccctcactctccctaaaaaaccgctaaccctaaactctccaaattctaaactctcatcatacgacgacgaccgcgacgaccgtcgaaaaccaacaaccgtcacaacccgaactacccgcgccgaaactaaccctaaccaaaacgaccacccccgcgcacctcaaaacgaccctcaaccgaccgaacaaccgcgcaaatactaaaaaactacaaacgctactaaaacgaatactaaacgccgaacgaccgctaaccgcgactaccgacgacgaaaacgcgacgacgaccgaaaacgaaaacgatccgaaaacgaccgaaaaaaaaaccctaaaataatataaataccttctaacgaacgacgacgactacgacgaattctacgcgacgatacgaacctacgatcccgcgacgctctacgacctaatctaaacaaccaacttcgtaacctaccgctaccgaacgtacgacatctcgccctacatatcgctatacgccgaatacttccaccaaaacgaccacaccgaacacgacttcaacatattccgcaaccaaaccgaaaacgcctacgactacgaaaacaacaacgtaatacgaaaaaacgaataaataaaaccctccccgcgaacgaaac

SEQ ID NO: 24335 - DNA, 791 bp, Artificial Sequence
  chemically treated genomic DNA (Homo sapiens) CpG-island No: 24335
tgggagtttagtttggtttataggcgtttaggagagaggggcgggaggaaggttttgtagttcgagggggcgtgtgtaggggcggggttgcgggcggaggagcgcggacgtttcgggtatcgcgagagttgggcgggtcgagtaatcgtagtagtttatttttttattttttttggaggatcgttggttttggattttttaaattttgagtttttattatgcggcggcggtcgcggcggtcgtcgggggttagtagtcgttatagttcgagttgttcgcgtcggggttggttttagttaaggcggttattttcgcgtattttaaggcggtttttagtcggtcggataatcgcgtaggtgttgaggagttgtaggcgttgttggagcgggtgttgagcgtcgagcggtcgttggtcgcggttgtcggcggcgaggacgcggcggcggtcggaggcgggggcggttcgggggcggtcgaggaggaggttttggagtggtgtaagtgttttttggcgggcggcggcggttacgacgagttttgcgcggcggtgcgggtttacgatttcgcggcgttttgcggtttggtttggatagttaatttcgtggtttatcgttgtcggacgtgcggtatttcgttttgtatgtcgttgtgcgtcgagtgtttttattagggcgattatatcggatacgattttaatatgtttcgtagttaggtcgggggcgtttgcgattgcggggatagtaacgtgatgcgggagagcgggtgagtggagtttttttcgcgggcgaggt

SEQ ID NO: 24336 - DNA, 791 bp, Artificial Sequence
  chemically treated genomic DNA (Homo sapiens) CpG-island No: 24336
acctcgcccgcgaaaaaaactccactcacccgctctcccgcatcacgttactatccccgcaatcgcaaacgcccccgacctaactacgaaacatattaaaatcgtatccgatataatcgccctaataaaaacactcgacgcacaacgacatacaaaacgaaataccgcacgtccgacaacgataaaccacgaaattaactatccaaaccaaaccgcaaaacgccgcgaaatcgtaaacccgcaccgccgcgcaaaactcgtcgtaaccgccgccgcccgccaaaaaacacttacaccactccaaaacctcctcctcgaccgcccccgaaccgcccccgcctccgaccgccgccgcgtcctcgccgccgacaaccgcgaccaacgaccgctcgacgctcaacacccgctccaacaacgcctacaactcctcaacacctacgcgattatccgaccgactaaaaaccgccttaaaatacgcgaaaataaccgccttaactaaaaccaaccccgacgcgaacaactcgaactataacgactactaacccccgacgaccgccgcgaccgccgccgcataataaaaactcaaaatttaaaaaatccaaaaccaacgatcctccaaaaaaaataaaaaaataaactactacgattactcgacccgcccaactctcgcgatacccgaaacgtccgcgctcctccgcccgcaaccccgcccctacacacgccccctcgaactacaaaaccttcctcccgcccctctctcctaaacgcctataaaccaaactaaactccca

SEQ ID NO: 24337 - DNA, 723 bp, Artificial Sequence
  chemically treated genomic DNA (Homo sapiens) CpG-island No: 24337
ttaacgtcgttttcgggtcggggcgcgtcgttagagtttagatttttttagaatgtttttaggaaatcgtcgggtggggcggagatttgtttttcgtagcggtttttttatttgtcgtttcgtttgtgttttttggaaatgagtttttgtttttttaaggtcgtggggtagtcggattcgagtttggggcgaaacgggagttgaagttggcgtttaggaagagggattgggcgattattcggagtcggatcgggagttcgagcggggttagttagagtcggaggggaagtcggagtcgggtcggggttagacggcgtagttcgaggtttgggttcgggtcggtggaggtttcggggtgggattaaggatcgaatcgaggtcggtttgggcgttagggtagttttcggagcggcgatcgttgttggataaggggtcgtagttatttcggcgtgggttggaaggacgtatttttgttggggcgaaatttcgaattcgtagtcgtttgttcgcgattgttaagtcgatcgtttgaaagggtcgttgtttcgcgttttttagtggttggggtggtggtgggtatttcgatttttttttggcgtttatgatgttgtcggtcgcgttgggtttcggttttttttatttgttcgaggacgaagaaggtttggaggagtcgtgcgtttaggggagttcggttaaggttgagtgggttttatgcggggttat

SEQ ID NO: 24338 - DNA, 723 bp, Artificial Sequence
  chemically treated genomic DNA (Homo sapiens) CpG-island No: 24338
ataaccccgcataaaacccactcaaccttaaccgaactcccctaaacgcacgactcctccaaaccttcttcgtcctcgaacaaataaaaaaaaccgaaacccaacgcgaccgacaacatcataaacgccaaaaaaaaatcgaaatacccaccaccaccccaaccactaaaaaacgcgaaacaacgaccctttcaaacgatcgacttaacaatcgcgaacaaacgactacgaattcgaaatttcgccccaacaaaaatacgtccttccaacccacgccgaaataactacgaccccttatccaacaacgatcgccgctccgaaaactaccctaacgcccaaaccgacctcgattcgatccttaatcccaccccgaaacctccaccgacccgaacccaaacctcgaactacgccgtctaaccccgacccgactccgacttcccctccgactctaactaaccccgctcgaactcccgatccgactccgaataatcgcccaatccctcttcctaaacgccaacttcaactcccgtttcgccccaaactcgaatccgactaccccacgaccttaaaaaaacaaaaactcatttccaaaaaacacaaacgaaacgacaaataaaaaaaccgctacgaaaaacaaatctccgccccacccgacgatttcctaaaaacattctaaaaaaatctaaactctaacgacgcgccccgacccgaaaacgacgttaa

SEQ ID NO: 24339 - DNA, 723 bp, Artificial Sequence
  chemically treated genomic DNA (Homo sapiens) CpG-island No: 24339
atggtttcgtatgaagtttatttagttttggtcgggtttttttgggcgtacggtttttttagatttttttcgttttcgggtaggtaaaggaagtcggagtttagcgcggtcggtagtattatgggcgttagaggaagatcggggtgtttattattattttagttattggaaggcgcgggatagcggtttttttaggcggtcggtttggtagtcgcgggtagacggttacggattcggggtttcgttttagtaggggtgcgtttttttaatttacgtcggggtggttgcggttttttatttagtaacgatcgtcgtttcgagggttgttttgacgtttagatcggtttcgattcggtttttggttttatttcgggatttttatcgattcggatttagatttcgagttgcgtcgtttggtttcggttcggtttcggtttttttttcgattttgattgatttcgttcggattttcggttcgatttcgggtagtcgtttagtttttttttttgggcgttaattttagttttcgtttcgttttaggttcgggttcggttgttttacgattttagaggaatagaaatttatttttaggaagtataggcgggacggtaggtgaaaaagtcgttgcggggagtagattttcgttttattcgacggttttttggaggtattttaggggagtttgagttttggcggcgcgtttcgattcggaggcggcgttgg

SEQ ID NO: 24340 - DNA, 723 bp, Artificial Sequence
  chemically treated genomic DNA (Homo sapiens) CpG-island No: 24340
ccaacgccgcctccgaatcgaaacgcgccgccaaaactcaaactcccctaaaatacctccaaaaaaccgtcgaataaaacgaaaatctactccccgcaacgactttttcacctaccgtcccgcctatacttcctaaaaataaatttctattcctctaaaatcgtaaaacaaccgaacccgaacctaaaacgaaacgaaaactaaaattaacgcccaaaaaaaaaaactaaacgactacccgaaatcgaaccgaaaatccgaacgaaatcaatcaaaatcgaaaaaaaaaccgaaaccgaaccgaaaccaaacgacgcaactcgaaatctaaatccgaatcgataaaaatcccgaaataaaaccaaaaaccgaatcgaaaccgatctaaacgtcaaaacaaccctcgaaacgacgatcgttactaaataaaaaaccgcaaccaccccgacgtaaattaaaaaaacgcacccctactaaaacgaaaccccgaatccgtaaccgtctacccgcgactaccaaaccgaccgcctaaaaaaaccgctatcccgcgccttccaataactaaaataataataaacaccccgatcttcctctaacgcccataatactaccgaccgcgctaaactccgacttcctttacctacccgaaaacgaaaaaaatctaaaaaaaccgtacgcccaaaaaaacccgaccaaaactaaataaacttcatacgaaaccat

SEQ ID NO: 24341 - DNA, 851 bp, Artificial Sequence
  chemically treated genomic DNA (Homo sapiens) CpG-island No: 24341
gaaggggaaggcggcggcgcgcgttgttttttggggaagtagttttatttgttgtggggggcgtcgttggggaggggtcgagtcgtgtttacgtttgtacgtttcgtttcgttcgtcgtacggttcggcgacgggggagttttcgcgagtggtttcgcgtttagatcgtgcggggggttgttcgggtggaggcgggggagtcgtcgggatattaaaataggagttgtttgtggggtggagcggtattagttggcggttttcgagcgttttttttaaagatggttagaggggtcggaggcgttttcgttttcgttcgttattagttcgcgggttagcgtcgcgtttcgagtttcggcgggaggtaggtgcggtgtggattcgtagttcgaggtcggtttgttgggagcgagcggggtcgggcgcggggagtcggggtcgggcgcgggtagcggggtcgggcgcgggtagcgaggtcgcgcgggagaggagcgtagataatggtcgcgcgggcgtcgggtcgggtcgaacgcgttgcgttggggttgtttgcggcgttttttttatatttgcgcggagcgtcgggtagagggacgcgggtatcgggttcgcgggcggtacgcggcgttttcgagtttagtttcgtttttggtttcggggcggggcggttttcgggcgggaacgtgggtcggggtttaggcgcggggcgcgcggaaatttttgcggcgggcgcggcggagggggcgagggttgtaagggttgcgtcgagttgttttgttttttttttttttttaagcgaaagggttcgggatttttttttttcgagatttttttttgtttatttatatttttat

SEQ ID NO: 24342 - DNA, 851 bp, Artificial Sequence
  chemically treated genomic DNA (Homo sapiens) CpG-island No: 24342
ataaaaatataaataaacaaaaaaaaatctcgaaaaaaaaaaatcccgaaccctttcgcttaaaaaaaaaaaaaaaacaaaacaactcgacgcaacccttacaaccctcgccccctccgccgcgcccgccgcaaaaatttccgcgcgccccgcgcctaaaccccgacccacgttcccgcccgaaaaccgccccgccccgaaaccaaaaacgaaactaaactcgaaaacgccgcgtaccgcccgcgaacccgatacccgcgtccctctacccgacgctccgcgcaaatataaaaaaaacgccgcaaacaaccccaacgcaacgcgttcgacccgacccgacgcccgcgcgaccattatctacgctcctctcccgcgcgacctcgctacccgcgcccgaccccgctacccgcgcccgaccccgactccccgcgcccgaccccgctcgctcccaacaaaccgacctcgaactacgaatccacaccgcacctacctcccgccgaaactcgaaacgcgacgctaacccgcgaactaataacgaacgaaaacgaaaacgcctccgacccctctaaccatctttaaaaaaaacgctcgaaaaccgccaactaataccgctccaccccacaaacaactcctattttaatatcccgacgactcccccgcctccacccgaacaaccccccgcacgatctaaacgcgaaaccactcgcgaaaactcccccgtcgccgaaccgtacgacgaacgaaacgaaacgtacaaacgtaaacacgactcgacccctccccaacgacgccccccacaacaaataaaactacttccccaaaaaacaacgcgcgccgccgccttccccttc

SEQ ID NO: 24343 - DNA, 851 bp, Artificial Sequence
  chemically treated genomic DNA (Homo sapiens) CpG-island No: 24343
atggaaatataaatggataagaagaggtttcggaaaagggaaatttcgagttttttcgtttaaggaaggagagaaagtaaggtagttcggcgtagtttttgtagttttcgtttttttcgtcgcgttcgtcgtaggggttttcgcgcgtttcgcgtttgggtttcggtttacgttttcgttcggagatcgtttcgtttcggggttaggagcggggttggattcgagggcgtcgcgtgtcgttcgcgggttcggtgttcgcgtttttttgttcggcgtttcgcgtaggtgtgggaaggacgtcgtaggtagttttagcgtaacgcgttcggttcggttcggcgttcgcgcggttattgtttgcgtttttttttcgcgcggtttcgttgttcgcgttcggtttcgttgttcgcgttcggtttcggtttttcgcgttcggtttcgttcgtttttagtaggtcggtttcgggttgcgggtttatatcgtatttatttttcgtcggggttcgggacgcggcgttggttcgcgggttagtagcgagcgggagcggggacgttttcggtttttttgattatttttggaagaggcgttcggaagtcgttagttagtgtcgttttattttataagtagtttttattttggtgtttcggcggttttttcgtttttattcgaatagtttttcgtacggtttgggcgcgaggttattcgcgggaattttttcgtcgtcgggtcgtgcggcgagcggggcggggcgtgtaggcgtgagtacggttcggtttttttttagcggcgttttttatagtaggtgggattgtttttttaggagatagcgcgcgtcgtcgttttttttttt

SEQ ID NO: 24344 - DNA, 851 bp, Artificial Sequence
  chemically treated genomic DNA (Homo sapiens) CpG-island No: 24344
aaaaaaaaaaacgacgacgcgcgctatctcctaaaaaaacaatcccacctactataaaaaacgccgctaaaaaaaaaccgaaccgtactcacgcctacacgccccgccccgctcgccgcacgacccgacgacgaaaaaattcccgcgaataacctcgcgcccaaaccgtacgaaaaactattcgaataaaaacgaaaaaaccgccgaaacaccaaaataaaaactacttataaaataaaacgacactaactaacgacttccgaacgcctcttccaaaaataatcaaaaaaaccgaaaacgtccccgctcccgctcgctactaacccgcgaaccaacgccgcgtcccgaaccccgacgaaaaataaatacgatataaacccgcaacccgaaaccgacctactaaaaacgaacgaaaccgaacgcgaaaaaccgaaaccgaacgcgaacaacgaaaccgaacgcgaacaacgaaaccgcgcgaaaaaaaaacgcaaacaataaccgcgcgaacgccgaaccgaaccgaacgcgttacgctaaaactacctacgacgtccttcccacacctacgcgaaacgccgaacaaaaaaacgcgaacaccgaacccgcgaacgacacgcgacgccctcgaatccaaccccgctcctaaccccgaaacgaaacgatctccgaacgaaaacgtaaaccgaaacccaaacgcgaaacgcgcgaaaacccctacgacgaacgcgacgaaaaaaacgaaaactacaaaaactacgccgaactaccttactttctctccttccttaaacgaaaaaactcgaaatttcccttttccgaaacctcttcttatccatttatatttccat

SEQ ID NO: 24345 - DNA, 1060 bp, Artificial Sequence
  chemically treated genomic DNA (Homo sapiens) CpG-island No: 24345
acggacgatttttcgtttttggattgtcgtagttttttttttagattaattgttttaagagaggggggcggatatatttaattagtacgatataggttttttgattgacgttcgggttttcgcgttggcgtgttgtgttttgaggcgggaggaggaggaggagcggggaggaaaatttgagttaattttagtagtttgcgcgggaggttaatcgaacgtcgcgttttggagcgattatttaattcgcgaaagggggtagggcgtatttttgttaggaattaatagaaagtttttaagggttaggagcgacgtttagcgggagtaatgattggtttatattcgggattcgggggcgggtcggcgttagagacgagaagagaggaggggaggtttttttcgtcgtcgttattttggacgggttcggttagtttcgcggagttatcgtagacgcgcggttttttttgagttcgatttcgtcgttagataatttcggtttattttttaattttattttcgttcgcgcgtatcgcgatacgttcgggtttcggggcgcgagaaaaaggcggcgggcgttcgtttttttcgtttgtcgcgatacgttttttagcggcggcgttagtttttgtggtgagagcgttaggttcgattgggtcggatttttttttttttttttttcgcgttatcggtcgtttttttcgtcgtttttcgttttggcgatatcgtcgtttgtcgcgatatggttttttttcgtttgttttttgtttcgtttttgtagcgcgggtttcggcggggggcggtttttttttttttcgtttttcgttttttgcgttttttttacgttttttagcgttttcgggtgttttttcgcgatttggattcgtgttttcgttcgtcgtcgttttttcgcgtggtatcgcgtcgggttttcggtaggggtgtgagggtgcgaagttttttcgggcgcgaggtgttcgttttttttcgcgtcggtattggtttttggttggaaggatggaggcgtttttggttttaggtgttcgtttttcggggtttaggtgtt

SEQ ID NO: 24346 - DNA, 1060 bp, Artificial Sequence
  chemically treated genomic DNA (Homo sapiens) CpG-island No: 24346
aacacctaaaccccgaaaaacgaacacctaaaaccaaaaacgcctccatccttccaaccaaaaaccaataccgacgcgaaaaaaaacgaacacctcgcgcccgaaaaaacttcgcaccctcacacccctaccgaaaacccgacgcgataccacgcgaaaaaacgacgacgaacgaaaacacgaatccaaatcgcgaaaaaacacccgaaaacgctaaaaaacgtaaaaaaaacgcaaaaaacgaaaaacgaaaaaaaaaaaaaccgccccccgccgaaacccgcgctacaaaaacgaaacaaaaaacaaacgaaaaaaaaccatatcgcgacaaacgacgatatcgccaaaacgaaaaacgacgaaaaaaacgaccgataacgcgaaaaaaaaaaaaaaaaaaatccgacccaatcgaacctaacgctctcaccacaaaaactaacgccgccgctaaaaaacgtatcgcgacaaacgaaaaaaacgaacgcccgccgcctttttctcgcgccccgaaacccgaacgtatcgcgatacgcgcgaacgaaaataaaattaaaaaataaaccgaaattatctaacgacgaaatcgaactcaaaaaaaaccgcgcgtctacgataactccgcgaaactaaccgaacccgtccaaaataacgacgacgaaaaaaacctcccctcctctcttctcgtctctaacgccgacccgcccccgaatcccgaatataaaccaatcattactcccgctaaacgtcgctcctaacccttaaaaactttctattaattcctaacaaaaatacgccctaccccctttcgcgaattaaataatcgctccaaaacgcgacgttcgattaacctcccgcgcaaactactaaaattaactcaaattttcctccccgctcctcctcctcctcccgcctcaaaacacaacacgccaacgcgaaaacccgaacgtcaatcaaaaaacctatatcgtactaattaaatatatccgcccccctctcttaaaacaattaatctaaaaaaaaaactacgacaatccaaaaacgaaaaatcgtccgt

SEQ ID NO: 24347 - DNA, 1060 bp, Artificial Sequence
  chemically treated genomic DNA (Homo sapiens) CpG-island No: 24347
ggtatttgagtttcgagaagcgagtatttgggattaggggcgtttttatttttttagttaggagttaatatcgacgcggagaggggcgggtatttcgcgttcggggaggtttcgtatttttatatttttatcgggggttcgacgcgatgttacgcggggaggcggcggcgggcggggatacgggtttaggtcgcggaaggatattcggaagcgttgaggaacgtgaaagaagcgtagaaaacggagggcgagagggagggagatcgtttttcgtcggagttcgcgttgtagaggcggggtagggggtaggcgaggggaggttatgtcgcgatagacggcggtgtcgttagggcgggaggcggcggggagggcggtcgatggcgcggggggaggaagggaaggggttcggtttagtcgagtttgacgtttttattataggagttggcgtcgtcgttgaggagcgtatcgcgataggcgggggaggcgagcgttcgtcgtttttttttcgcgtttcggggttcgggcgtatcgcgatacgcgcgaacggaagtggggttggggagtgggtcggggttgtttgacgacggggtcgggtttaagggaggtcgcgcgtttgcgatggtttcgcggaattgatcgggttcgtttaagatggcggcggcggaggaggttttttttttttttttttcgtttttggcgtcgattcgttttcgagtttcgaatataggttagttattgttttcgttgaacgtcgtttttgatttttggaggttttttattggtttttggtagggatgcgttttgttttttttcgcggattgggtgatcgttttaaggcgcggcgttcgattggtttttcgcgtaggttgttaggattggtttaggttttttttttcgttttttttttttttttcgttttagggtataatacgttagcgcgaggattcgaacgttaattaagagatttgtgtcgtgttgattggatgtattcgttttttttttttaaaataattggtttgggggaggagttacgatagtttaggggcgggaagtcgttcgt

SEQ ID NO: 24348 - DNA, 1060 bp, Artificial Sequence
  chemically treated genomic DNA (Homo sapiens) CpG-island No: 24348
acgaacgacttcccgcccctaaactatcgtaactcctcccccaaaccaattattttaaaaaaaaaaaacgaatacatccaatcaacacgacacaaatctcttaattaacgttcgaatcctcgcgctaacgtattataccctaaaacgaaaaaaaaaaaaaaaacgaaaaaaaaaacctaaaccaatcctaacaacctacgcgaaaaaccaatcgaacgccgcgccttaaaacgatcacccaatccgcgaaaaaaaacaaaacgcatccctaccaaaaaccaataaaaaacctccaaaaatcaaaaacgacgttcaacgaaaacaataactaacctatattcgaaactcgaaaacgaatcgacgccaaaaacgaaaaaaaaaaaaaaaaaacctcctccgccgccgccatcttaaacgaacccgatcaattccgcgaaaccatcgcaaacgcgcgacctcccttaaacccgaccccgtcgtcaaacaaccccgacccactccccaaccccacttccgttcgcgcgtatcgcgatacgcccgaaccccgaaacgcgaaaaaaaaacgacgaacgctcgcctcccccgcctatcgcgatacgctcctcaacgacgacgccaactcctataataaaaacgtcaaactcgactaaaccgaaccccttcccttcctccccccgcgccatcgaccgccctccccgccgcctcccgccctaacgacaccgccgtctatcgcgacataacctcccctcgcctaccccctaccccgcctctacaacgcgaactccgacgaaaaacgatctccctccctctcgccctccgttttctacgcttctttcacgttcctcaacgcttccgaatatccttccgcgacctaaacccgtatccccgcccgccgccgcctccccgcgtaacatcgcgtcgaacccccgataaaaatataaaaatacgaaacctccccgaacgcgaaatacccgcccctctccgcgtcgatattaactcctaactaaaaaaataaaaacgcccctaatcccaaatactcgcttctcgaaactcaaatacc

SEQ ID NO: 24349 - DNA, 602 bp, Artificial Sequence
  chemically treated genomic DNA (Homo sapiens) CpG-island No: 24349
tttcggaagtttcgggttttagagttttcgatttttttaatttgtaggttaagtcgttcgtaaaattatttgttttattaggtttagtagtcgaggacggcgggacgtggttttaggttttgtgggagttgtagttttttgttttcggtttcgtttcggtttatttttacgtttatttcgaatttttgtttaaaggttttgtttttttgtttaacgtcgtaattagttttttgagttgttaacgtttttttttttgtttcgacgtttcgtcgttcggttatagcgattttttgtttagtaggatcggtttatagcgggacgtgagttatttttttttcgcggtttatcgtttttttcgtttagtgttaggtgttaataaagttgttgttttaaatgcggttaggaatatcgcgagcggggattaattagagagtagttttgtttttataacggcgcgagagtgagacgttatcggtgagcgattaacgttagaaatagtggtgcgcggagaggagaggtgagtgtgatggagattacggggagcgggaggttgggtttttgggtttgggagaagaagtgtgtgaggaaaaaggcgggttttt

SEQ ID NO: 24350 - DNA, 602 bp, Artificial Sequence
  chemically treated genomic DNA (Homo sapiens) CpG-island No: 24350
aaaaacccgcctttttcctcacacacttcttctcccaaacccaaaaacccaacctcccgctccccgtaatctccatcacactcacctctcctctccgcgcaccactatttctaacgttaatcgctcaccgataacgtctcactctcgcgccgttataaaaacaaaactactctctaattaatccccgctcgcgatattcctaaccgcatttaaaacaacaactttattaacacctaacactaaacgaaaaaaacgataaaccgcgaaaaaaaaataactcacgtcccgctataaaccgatcctactaaacaaaaaatcgctataaccgaacgacgaaacgtcgaaacaaaaaaaaaaacgttaacaactcaaaaaactaattacgacgttaaacaaaaaaacaaaacctttaaacaaaaattcgaaataaacgtaaaaataaaccgaaacgaaaccgaaaacaaaaaactacaactcccacaaaacctaaaaccacgtcccgccgtcctcgactactaaacctaataaaacaaataattttacgaacgacttaacctacaaattaaaaaaatcgaaaactctaaaacccgaaacttccgaaa

SEQ ID NO: 24351 - DNA, 602 bp, Artificial Sequence
  chemically treated genomic DNA (Homo sapiens) CpG-island No: 24351
aaagattcgtttttttttttatatatttttttttttagatttaggagtttagtttttcgtttttcgtggtttttattatatttatttttttttttcgcgtattattgtttttagcgttagtcgtttatcgatgacgttttattttcgcgtcgttatagaggtaaagttattttttgattggttttcgttcgcgatgtttttggtcgtatttgaaataataattttattagtatttggtattaggcggagagagcggtaagtcgcgaggaggaaatgatttacgtttcgttgtggatcgattttgttaagtagagaatcgttgtggtcggacgacggggcgtcgagataagaagaaagacgttggtaatttagaggattggttgcggcgttagataagaaagtaaggtttttaagtagggattcggggtggacgtgggggtgggtcgaagcgaagtcggaaataggaaattataatttttataaggtttagggttacgtttcgtcgttttcggttgttgagtttgatgggataagtagttttgcgaacggtttaatttatagattgaagaggtcggaagttttgaggttcggggttttcggag

SEQ ID NO: 24352 - DNA, 602 bp, Artificial Sequence
  chemically treated genomic DNA (Homo sapiens) CpG-island No: 24352
ctccgaaaaccccgaacctcaaaacttccgacctcttcaatctataaattaaaccgttcgcaaaactacttatcccatcaaactcaacaaccgaaaacgacgaaacgtaaccctaaaccttataaaaattataatttcctatttccgacttcgcttcgacccacccccacgtccaccccgaatccctacttaaaaaccttactttcttatctaacgccgcaaccaatcctctaaattaccaacgtctttcttcttatctcgacgccccgtcgtccgaccacaacgattctctacttaacaaaatcgatccacaacgaaacgtaaatcatttcctcctcgcgacttaccgctctctccgcctaataccaaatactaataaaattattatttcaaatacgaccaaaaacatcgcgaacgaaaaccaatcaaaaaataactttacctctataacgacgcgaaaataaaacgtcatcgataaacgactaacgctaaaaacaataatacgcgaaaaaaaaaaataaatataataaaaaccacgaaaaacgaaaaactaaactcctaaatctaaaaaaaaaaatatataaaaaaaaaaacgaatcttt

SEQ ID NO: 24353 - DNA, 500 bp, Artificial Sequence
  chemically treated genomic DNA (Homo sapiens) CpG-island No: 24353
tttttcgtcggttttgtttttttttttttttcgattttatcggttataagatgatgtggtttaatttttttttgtaagaggagaatcggcggcggggggtcgcgggtcggcggcgggcgtacgggtagggtaggtcggggttgacgttcgagcgcgaggggaaggtgaagttggcgttgttgttggtcgtcggtgggcgttacgttggcggtgttgttcgtgggtatcgagttttgggtggagtttaatatttataaggttaacggtagcgtcgtgtgcgaagcggttttatttggggttgtggaaggcgtgtattaagcggttgtggtaggcggacgtgttcgtggatagggatatttgcggtttcgcggagttgttcggaggtgagtagtcgtcgtttcgagcgtagggtttgcgttttacggatagggagggagaggggttcgtgttcgaggagaaaattcgttttagggataaaagtttgagttcggaggagatag

SEQ ID NO: 24354 - DNA, 500 bp, Artificial Sequence
  chemically treated genomic DNA (Homo sapiens) CpG-island No: 24354
ctatctcctccgaactcaaacttttatccctaaaacgaattttctcctcgaacacgaacccctctccctccctatccgtaaaacgcaaaccctacgctcgaaacgacgactactcacctccgaacaactccgcgaaaccgcaaatatccctatccacgaacacgtccgcctaccacaaccgcttaatacacgccttccacaaccccaaataaaaccgcttcgcacacgacgctaccgttaaccttataaatattaaactccacccaaaactcgatacccacgaacaacaccgccaacgtaacgcccaccgacgaccaacaacaacgccaacttcaccttcccctcgcgctcgaacgtcaaccccgacctaccctacccgtacgcccgccgccgacccgcgaccccccgccgccgattctcctcttacaaaaaaaaattaaaccacatcatcttataaccgataaaatcgaaaaaaaaaaaaaaacaaaaccgacgaaaaa

SEQ ID NO: 24355 - DNA, 500 bp, Artificial Sequence
  chemically treated genomic DNA (Homo sapiens) CpG-island No: 24355
ttgtttttttcgggtttaggtttttgtttttggggcgggtttttttttcggatacgggtttttttttttttttgttcgtgggacgtaagttttgcgttcggggcggcggttgtttattttcgggtagtttcgcggggtcgtaggtgtttttgtttacgggtacgttcgtttgttatagtcgtttggtgtacgttttttatagttttaggtggggtcgtttcgtatacggcgttgtcgttggttttgtaggtgttgagttttatttagaattcggtgtttacggatagtatcgttagcgtggcgtttatcggcggttagtagtagcgttagttttatttttttttcgcgttcgggcgttagtttcgatttgttttgttcgtgcgttcgtcgtcggttcgcggtttttcgtcgtcggttttttttttgtaggaagaagttggattatattattttatggtcggtggggtcgggaagggggaggaggtagagtcggcgaaggg

SEQ ID NO: 24356 - DNA, 500 bp, Artificial Sequence
  chemically treated genomic DNA (Homo sapiens) CpG-island No: 24356
cccttcgccgactctacctcctcccccttcccgaccccaccgaccataaaataatataatccaacttcttcctacaaaaaaaaaaccgacgacgaaaaaccgcgaaccgacgacgaacgcacgaacaaaacaaatcgaaactaacgcccgaacgcgaaaaaaaaataaaactaacgctactactaaccgccgataaacgccacgctaacgatactatccgtaaacaccgaattctaaataaaactcaacacctacaaaaccaacgacaacgccgtatacgaaacgaccccacctaaaactataaaaaacgtacaccaaacgactataacaaacgaacgtacccgtaaacaaaaacacctacgaccccgcgaaactacccgaaaataaacaaccgccgccccgaacgcaaaacttacgtcccacgaacaaaaaaaaaaaaaaacccgtatccgaaaaaaaaacccgccccaaaaacaaaaacctaaacccgaaaaaaacaa

SEQ ID NO: 24357 - DNA, 798 bp, Artificial Sequence
  chemically treated genomic DNA (Homo sapiens) CpG-island No: 24357
cgtttggtttcgaattttatacggggtatattgagtttgcgtaaagttttcgttttcggtttttaatcgtcgtttgcgcgttgggtttcggagcgtcgtttgtcggttttcgagtttattttttgttgagttagtagtattattcgttacgttttttttttttttttcgggtttgggtttcgttacgtcgtacgcgggcgatattgtttttgtttcggacgtgttagttttttttgggtaagatatttatggcgtcgtagttgtttagggattggtacgttcgtttttttgtattttcgattggcgagaggatgttttttttttttttgtttttatttcgatcgcggattggtttcgaattagttggtacggttttttggtttgtagcgataggtgattggttgagacgttttttattatagcgaatgttaggcgttcggttcgtggtattttttagtaatcgttttttgttatagatttgaattaattataagttggttcgtttttgatgttattagatgcggtcgtcgattggtcgatatgatcgataagtttttttgcggaagagcgttttgtatcgataaatatgttcgtatatttgattggtttttgtttcgttgtagttttgtttttatttttaggacgtagattttaaagcgcgtttagtaatttcggttgtatttattgatataaggaagattattcgagagttagggacgtggcggcgaggggttttggaaatttttagatattaaagttggaagggcgtggagttttttttagtttttttagtttata

SEQ ID NO: 24358 - DNA, 798 bp, Artificial Sequence
  chemically treated genomic DNA (Homo sapiens) CpG-island No: 24358
tataaactaaaaaaactaaaaaaaactccacgcccttccaactttaatatctaaaaatttccaaaacccctcgccgccacgtccctaactctcgaataatcttccttatatcaataaatacaaccgaaattactaaacgcgctttaaaatctacgtcctaaaaataaaaacaaaactacaacgaaacaaaaaccaatcaaatatacgaacatatttatcgatacaaaacgctcttccgcaaaaaaacttatcgatcatatcgaccaatcgacgaccgcatctaataacatcaaaaacgaaccaacttataattaattcaaatctataacaaaaaacgattactaaaaaataccacgaaccgaacgcctaacattcgctataataaaaaacgtctcaaccaatcacctatcgctacaaaccaaaaaaccgtaccaactaattcgaaaccaatccgcgatcgaaataaaaacaaaaaaaaaaaaaacatcctctcgccaatcgaaaatacaaaaaaacgaacgtaccaatccctaaacaactacgacgccataaatatcttacccaaaaaaaactaacacgtccgaaacaaaaacaatatcgcccgcgtacgacgtaacgaaacccaaacccgaaaaaaaaaaaaaaaacgtaacgaataatactactaactcaacaaaaaataaactcgaaaaccgacaaacgacgctccgaaacccaacgcgcaaacgacgattaaaaaccgaaaacgaaaactttacgcaaactcaatataccccgtataaaattcgaaaccaaacg

SEQ ID NO: 24359 - DNA, 798 bp, Artificial Sequence
  chemically treated genomic DNA (Homo sapiens) CpG-island No: 24359
tgtaaattaggagaattggagaagattttacgtttttttagttttggtatttggagatttttagggtttttcgtcgttacgtttttgattttcgggtgattttttttgtattaataaatatagtcgaggttgttgagcgcgttttgaaatttgcgttttgaaggtgggggtagggttatagcggggtaggagttaattaaatgtacgggtatgtttgtcggtgtagagcgttttttcgtaaggagatttgtcggttatgtcggttaatcgacggtcgtatttggtagtattaggggcgggttaatttatgattggtttagatttgtgataagaggcggttgttaggggatattacgagtcgaacgtttagtattcgttgtgataaagggcgttttagttaattatttgtcgttataggttagggggtcgtattaattaattcggaattaattcgcggtcgaagtagggataagaaaaaggggggtattttttcgttaatcggaagtgtaaagaggcgggcgtgttagtttttggatagttacgacgttatgaatattttgtttaagaagagttggtacgttcggaataaggataatgtcgttcgcgtgcgacgtgacgaggtttaggttcgggaggaggagaaggagcgtgacgagtggtgttgttggtttagtaagaggtaagttcggaagtcggtaggcggcgtttcggggtttagcgcgtaggcggcggttgggggtcggaagcggaggttttgcgtaggtttaatgtgtttcgtgtgaaattcgggattaggcg

SEQ ID NO: 24360 - DNA, 798 bp, Artificial Sequence
  chemically treated genomic DNA (Homo sapiens) CpG-island No: 24360
cgcctaatcccgaatttcacacgaaacacattaaacctacgcaaaacctccgcttccgacccccaaccgccgcctacgcgctaaaccccgaaacgccgcctaccgacttccgaacttacctcttactaaaccaacaacaccactcgtcacgctccttctcctcctcccgaacctaaacctcgtcacgtcgcacgcgaacgacattatccttattccgaacgtaccaactcttcttaaacaaaatattcataacgtcgtaactatccaaaaactaacacgcccgcctctttacacttccgattaacgaaaaaatacccccctttttcttatccctacttcgaccgcgaattaattccgaattaattaatacgaccccctaacctataacgacaaataattaactaaaacgccctttatcacaacgaatactaaacgttcgactcgtaatatcccctaacaaccgcctcttatcacaaatctaaaccaatcataaattaacccgcccctaatactaccaaatacgaccgtcgattaaccgacataaccgacaaatctccttacgaaaaaacgctctacaccgacaaacatacccgtacatttaattaactcctaccccgctataaccctacccccaccttcaaaacgcaaatttcaaaacgcgctcaacaacctcgactatatttattaatacaaaaaaaatcacccgaaaatcaaaaacgtaacgacgaaaaaccctaaaaatctccaaataccaaaactaaaaaaacgtaaaatcttctccaattctcctaatttaca

SEQ ID NO: 24361 - DNA, 783 bp, Artificial Sequence
  chemically treated genomic DNA (Homo sapiens) CpG-island No: 24361
tttaacgcgttttcggggtcgtttcgtattcgttagttcgtagagattttgtcgtcgtgtaatttcgtttcgttattgggcgtcgtattttggtttatttgagttgttcgtcgggtaggaggcggtcgagtagttttagttcgtttgtagtcgtagtttcggttacgtttttttcgtttagcgcgtattcgcgtcgtttgttttttttgggcgtacgtcggcgtgcgtagattaggtcggggaagaagttacggttagggttcgggcgggtagggaagaagtttcggagtagaagtcgagagcgcgagtcggtaacgggattcgagtttaggtttatattgggattcgagtttcgagtacgtgaaggggcgggtttcgggttcggaataaggaggagttaaaagttttggattcgaaggggaatagacgggttttggaaaggaggcggggtttggagttcggcgtgaggaatgaggcggggttttttcgggtttttcgggtataatcgggagtttgagtttttcggaagcggggttataaatttcggtttatttcggtaatagtcgagaacggagagttgaggttattgtggcggagttatatgtttcggtttttttcggaggtagtcgagtttttagggttattgtttcgatgtgggcggggttatagattcggtcggatgtgggtggggttataagtttcggtttatttcgtagatagttgggtataagtgacgttaggatgataggcggagttaataggttcgttagatatttatgagta

SEQ ID NO: 24362 - DNA, 783 bp, Artificial Sequence
  chemically treated genomic DNA (Homo sapiens) CpG-island No: 24362
tactcataaatatctaacgaacctattaactccgcctatcatcctaacgtcacttatacccaactatctacgaaataaaccgaaacttataaccccacccacatccgaccgaatctataaccccgcccacatcgaaacaataaccctaaaaactcgactacctccgaaaaaaaccgaaacatataactccgccacaataacctcaactctccgttctcgactattaccgaaataaaccgaaatttataaccccgcttccgaaaaactcaaactcccgattatacccgaaaaacccgaaaaaaccccgcctcattcctcacgccgaactccaaaccccgcctcctttccaaaacccgtctattccccttcgaatccaaaacttttaactcctccttattccgaacccgaaacccgccccttcacgtactcgaaactcgaatcccaatataaacctaaactcgaatcccgttaccgactcgcgctctcgacttctactccgaaacttcttccctacccgcccgaaccctaaccgtaacttcttccccgacctaatctacgcacgccgacgtacgcccaaaaaaaacaaacgacgcgaatacgcgctaaacgaaaaaaacgtaaccgaaactacgactacaaacgaactaaaactactcgaccgcctcctacccgacgaacaactcaaataaaccaaaatacgacgcccaataacgaaacgaaattacacgacgacaaaatctctacgaactaacgaatacgaaacgaccccgaaaacgcgttaaa

SEQ ID NO: 24363 - DNA, 783 bp, Artificial Sequence
  chemically treated genomic DNA (Homo sapiens) CpG-island No: 24363
tatttatgggtgtttggcgaatttgttgatttcgtttattattttagcgttatttgtatttaattatttacgaagtaaatcgaagtttgtggttttatttatattcggtcgagtttgtggtttcgtttatatcggaatagtgattttaaggattcgattattttcgaagaaagtcgaaatatgtggtttcgttatagtggttttagtttttcgttttcgattattgtcgaagtgagtcgaagtttgtggtttcgttttcggagaatttaagttttcgattgtgttcgaagaattcgaagagatttcgttttattttttacgtcgagttttagatttcgttttttttttagagttcgtttgttttttttcgggtttaaagtttttggtttttttttgtttcgagttcgaagttcgtttttttacgtattcggagttcggattttagtgtggatttggattcgaatttcgttgtcgattcgcgttttcggtttttgtttcggggttttttttttgttcgttcgggttttgatcgtggtttttttttcggtttgatttgcgtacgtcggcgtgcgtttagaaggagtaggcggcgcgggtgcgcgttgggcgggggaggcgtggtcggagttgcggttgtaagcgggttgggattgttcggtcgttttttgttcggcgagtagtttaggtgggttagggtgcggcgtttagtggcgaggcgaggttatacggcggtagggtttttgcgggttggcgggtgcggggcggtttcggaggcgcgttgga

SEQ ID NO: 24364 - DNA, 783 bp, Artificial Sequence
  chemically treated genomic DNA (Homo sapiens) CpG-island No: 24364
tccaacgcgcctccgaaaccgccccgcacccgccaacccgcaaaaaccctaccgccgtataacctcgcctcgccactaaacgccgcaccctaacccacctaaactactcgccgaacaaaaaacgaccgaacaatcccaacccgcttacaaccgcaactccgaccacgcctcccccgcccaacgcgcacccgcgccgcctactccttctaaacgcacgccgacgtacgcaaatcaaaccgaaaaaaaaaccacgatcaaaacccgaacgaacaaaaaaaaaaccccgaaacaaaaaccgaaaacgcgaatcgacaacgaaattcgaatccaaatccacactaaaatccgaactccgaatacgtaaaaaaacgaacttcgaactcgaaacaaaaaaaaaccaaaaactttaaacccgaaaaaaaacaaacgaactctaaaaaaaaaacgaaatctaaaactcgacgtaaaaaataaaacgaaatctcttcgaattcttcgaacacaatcgaaaacttaaattctccgaaaacgaaaccacaaacttcgactcacttcgacaataatcgaaaacgaaaaactaaaaccactataacgaaaccacatatttcgactttcttcgaaaataatcgaatccttaaaatcactattccgatataaacgaaaccacaaactcgaccgaatataaataaaaccacaaacttcgatttacttcgtaaataattaaatacaaataacgctaaaataataaacgaaatcaacaaattcgccaaacacccataaata

SEQ ID NO: 24365 - DNA, 923 bp, Artificial Sequence
  chemically treated genomic DNA (Homo sapiens) CpG-island No: 24365
gggcggggcgaaagcgatttgtttttaaaggggcggaatttcgagggtcggcgtgcgtttacgggatcgggttagggtgacgatttttaagtttttaagtagaggagaggaagcggtagagggaggtgcgtttagtggggcggagttaaggtggttttcgcgggaggagggcggggtttcggttttgcgaggggcgggatttgatttttcgcggcgttgatggggcgggatgacgaagttgacgagggtgtcggtatgagggggtggagtaaggagcgcgtggcggtgcgtagtgggtggttttatttcgattgcgaattattgtttatgaggtgattcgttggttttatcggtggatagtgggatattttgaagggaggtaaggaggcggattgagcgtttttaattggggtgagttcgttcgagcgagagtggacggcgggtgtttagggggcggggttttcggttgtggggttcggtcgtagggcgggaattttttaattggggtgcgttggcgttcggagggggcggggttatagcgcgagcgtgtcgggagtcgatgacgttcgaacgtcgaatttattgcgttcgggaggaggcggggttacggattcggtcgagtcgagaatattcgaacgttaaattgttggcgttcgagaagggggcggggttgcggattcggtggagtcgaggacgttcgaacgtcgaattttttgtgttcgggagggggtagggttttgtattgtgggagtttgagagcgaggaggttcgaaagtcgaattatagtcgttcggaaagaggaggagcgaaggttcgagcgttcggaagagggtgtggtttcggcggtgttttagtttttagagtttttgatcgttgacgggaatattcgaagggggacgtttattttgtaagagggtggtgtt

SEQ ID NO: 24366 - DNA, 923 bp, Artificial Sequence
  chemically treated genomic DNA (Homo sapiens) CpG-island No: 24366
aacaccaccctcttacaaaataaacgtcccccttcgaatattcccgtcaacgatcaaaaactctaaaaactaaaacaccgccgaaaccacaccctcttccgaacgctcgaaccttcgctcctcctctttccgaacgactataattcgactttcgaacctcctcgctctcaaactcccacaatacaaaaccctaccccctcccgaacacaaaaaattcgacgttcgaacgtcctcgactccaccgaatccgcaaccccgcccccttctcgaacgccaacaatttaacgttcgaatattctcgactcgaccgaatccgtaaccccgcctcctcccgaacgcaataaattcgacgttcgaacgtcatcgactcccgacacgctcgcgctataaccccgccccctccgaacgccaacgcaccccaattaaaaaattcccgccctacgaccgaaccccacaaccgaaaaccccgccccctaaacacccgccgtccactctcgctcgaacgaactcaccccaattaaaaacgctcaatccgcctccttacctcccttcaaaatatcccactatccaccgataaaaccaacgaatcacctcataaacaataattcgcaatcgaaataaaaccacccactacgcaccgccacgcgctccttactccaccccctcataccgacaccctcgtcaacttcgtcatcccgccccatcaacgccgcgaaaaatcaaatcccgcccctcgcaaaaccgaaaccccgccctcctcccgcgaaaaccaccttaactccgccccactaaacgcacctccctctaccgcttcctctcctctacttaaaaacttaaaaatcgtcaccctaacccgatcccgtaaacgcacgccgaccctcgaaattccgcccctttaaaaacaaatcgctttcgccccgccc

SEQ ID NO: 24367 - DNA, 923 bp, Artificial Sequence
  chemically treated genomic DNA (Homo sapiens) CpG-island No: 24367
ggtattatttttttgtaaagtgggcgttttttttcgggtgttttcgttagcggttagaagttttggaggttaaggtatcgtcgaggttatattttttttcggacgttcgagttttcgtttttttttttttcgaacgattgtgattcggttttcggattttttcgtttttagatttttatagtataaaattttgttttttttcgagtataggaagttcggcgttcgggcgttttcggttttatcgaattcgtagtttcgtttttttttcgaacgttagtaatttgacgttcgggtgttttcggttcggtcgaattcgtagtttcgttttttttcggacgtaataggttcggcgttcgggcgttatcggttttcggtacgttcgcgttgtggtttcgtttttttcgagcgttagcgtattttagttggggagttttcgttttacgatcgaattttatagtcgaaagtttcgttttttggatattcgtcgtttattttcgttcgggcgggtttattttaattgggagcgtttagttcgtttttttgtttttttttagaatgttttattgtttatcgatagaattagcgagttattttataaatagtaattcgtagtcgaggtggagttatttattgcgtatcgttacgcgttttttgttttatttttttatgtcgatattttcgttaatttcgttatttcgttttattagcgtcgcgggaagttaggtttcgtttttcgtaggatcgaagtttcgtttttttttcgcgggggttattttggtttcgttttattgagcgtatttttttttgtcgtttttttttttttatttgggaatttgaggatcgttattttggttcggtttcgtaggcgtacgtcggttttcggggtttcgtttttttgagggtaagtcgttttcgtttcgttt

SEQ ID NO: 24368 - DNA, 923 bp, Artificial Sequence
  chemically treated genomic DNA (Homo sapiens) CpG-island No: 24368
aaacgaaacgaaaacgacttaccctcaaaaaaacgaaaccccgaaaaccgacgtacgcctacgaaaccgaaccaaaataacgatcctcaaattcccaaataaaaaaaaaaaaacgacaaaaaaaaatacgctcaataaaacgaaaccaaaataacccccgcgaaaaaaaaacgaaacttcgatcctacgaaaaacgaaacctaacttcccgcgacgctaataaaacgaaataacgaaattaacgaaaatatcgacataaaaaaataaaacaaaaaacgcgtaacgatacgcaataaataactccacctcgactacgaattactatttataaaataactcgctaattctatcgataaacaataaaacattctaaaaaaaaacaaaaaaacgaactaaacgctcccaattaaaataaacccgcccgaacgaaaataaacgacgaatatccaaaaaacgaaactttcgactataaaattcgatcgtaaaacgaaaactccccaactaaaatacgctaacgctcgaaaaaaacgaaaccacaacgcgaacgtaccgaaaaccgataacgcccgaacgccgaacctattacgtccgaaaaaaaacgaaactacgaattcgaccgaaccgaaaacacccgaacgtcaaattactaacgttcgaaaaaaaaacgaaactacgaattcgataaaaccgaaaacgcccgaacgccgaacttcctatactcgaaaaaaaacaaaattttatactataaaaatctaaaaacgaaaaaatccgaaaaccgaatcacaatcgttcgaaaaaaaaaaaaacgaaaactcgaacgtccgaaaaaaaatataacctcgacgataccttaacctccaaaacttctaaccgctaacgaaaacacccgaaaaaaaacgcccactttacaaaaaaataatacc

SEQ ID NO: 24369 - DNA, 695 bp, Artificial Sequence
  chemically treated genomic DNA (Homo sapiens) CpG-island No: 24369
cgtgtcgcgcgtttgcggaggtttgttttttacgttttaaggcgtaatggtaggtacggtagtgcgggtatagagcgggtgtcgatcgtaggttataagggtagagcgggattttgggggtttggcgaggggcgagggtcgggggtttgttttcggcgtttcgttttcggcggtcgcgacgtggtggggatcgttcgggggggagtttggcgttcgggtttagtaggtggtgaacggcggttgagcgaggtttcgttttttgaggtttaggggcggggtttcgtcgagatttcggaggttttgggtgcgttgtagcggttcgcggcgcgtagttgtttcggtaattgttttgtttttcggttttcgtaggaggatgttggtggtggaggtggcgaacggtcgttttttggtgtggggagtcgaggcggtgtaggtttttcgggagcgtttgggtgtggggggtcgtacggtaggcgttttgtttcgcggtttcgttagaattcgcgtttgggtttttcgttgttgttgatgttcgaagaggcgcggtttttggcgagatcggcgtcgtgattttggttagcgtttcgcgtttagattttcggtattatagtttggtaagggggcggggttcgaattcgggttcggtgggagcgggatttgggagttaagttttttggtttttgaagggattataa

SEQ ID NO: 24370 - DNA, 695 bp, Artificial Sequence
  chemically treated genomic DNA (Homo sapiens) CpG-island No: 24370
ttataatcccttcaaaaaccaaaaaacttaactcccaaatcccgctcccaccgaacccgaattcgaaccccgcccccttaccaaactataataccgaaaatctaaacgcgaaacgctaaccaaaatcacgacgccgatctcgccaaaaaccgcgcctcttcgaacatcaacaacaacgaaaaacccaaacgcgaattctaacgaaaccgcgaaacaaaacgcctaccgtacgaccccccacacccaaacgctcccgaaaaacctacaccgcctcgactccccacaccaaaaaacgaccgttcgccacctccaccaccaacatcctcctacgaaaaccgaaaaacaaaacaattaccgaaacaactacgcgccgcgaaccgctacaacgcacccaaaacctccgaaatctcgacgaaaccccgcccctaaacctcaaaaaacgaaacctcgctcaaccgccgttcaccacctactaaacccgaacgccaaactcccccccgaacgatccccaccacgtcgcgaccgccgaaaacgaaacgccgaaaacaaacccccgaccctcgcccctcgccaaacccccaaaatcccgctctacccttataacctacgatcgacacccgctctatacccgcactaccgtacctaccattacgccttaaaacgtaaaaaacaaacctccgcaaacgcgcgacacg

SEQ ID NO: 24371 - DNA, 695 bp, Artificial Sequence
  chemically treated genomic DNA (Homo sapiens) CpG-island No: 24371
ttatggtttttttagaagttaggaaatttgatttttaggtttcgtttttatcgaattcgagttcgagtttcgtttttttattaggttgtggtgtcgagagtttggacgcggggcgttgattagagttacggcgtcgatttcgttaagagtcgcgttttttcgggtattagtagtagcgggaggtttaggcgcgagttttggcggggtcgcggggtagggcgtttatcgtgcggttttttatatttaggcgttttcggagggtttgtatcgtttcggttttttatattagggagcggtcgttcgttatttttattattagtatttttttgcgggagtcgggaggtaaagtagttatcgaaatagttgcgcgtcgcggatcgttgtagcgtatttaaagttttcggggtttcggcgaagtttcgtttttaggttttaggaggcggggtttcgtttagtcgtcgtttattatttgttgggttcgagcgttaggttttttttcgggcgatttttattacgtcgcggtcgtcggagacgagacgtcggagataagttttcgattttcgtttttcgttaagtttttagggtttcgttttatttttgtgatttgcggtcggtattcgttttgtgttcgtattgtcgtatttattattgcgttttggagcgtgaaaaataaattttcgtaagcgcgcgatacg

SEQ ID NO: 24372 - DNA, 695 bp, Artificial Sequence
  chemically treated genomic DNA (Homo sapiens) CpG-island No: 24372
cgtatcgcgcgcttacgaaaatttatttttcacgctccaaaacgcaataataaatacgacaatacgaacacaaaacgaataccgaccgcaaatcacaaaaataaaacgaaaccctaaaaacttaacgaaaaacgaaaatcgaaaacttatctccgacgtctcgtctccgacgaccgcgacgtaataaaaatcgcccgaaaaaaaacctaacgctcgaacccaacaaataataaacgacgactaaacgaaaccccgcctcctaaaacctaaaaacgaaacttcgccgaaaccccgaaaactttaaatacgctacaacgatccgcgacgcgcaactatttcgataactactttacctcccgactcccgcaaaaaaatactaataataaaaataacgaacgaccgctccctaatataaaaaaccgaaacgatacaaaccctccgaaaacgcctaaatataaaaaaccgcacgataaacgccctaccccgcgaccccgccaaaactcgcgcctaaacctcccgctactactaatacccgaaaaaacgcgactcttaacgaaatcgacgccgtaactctaatcaacgccccgcgtccaaactctcgacaccacaacctaataaaaaaacgaaactcgaactcgaattcgataaaaacgaaacctaaaaatcaaatttcctaacttctaaaaaaaccataa

SEQ ID NO: 24373 - DNA, 659 bp, Artificial Sequence
  chemically treated genomic DNA (Homo sapiens) CpG-island No: 24373
gttcgtcggattttatcgtattgaagggattgcgcgtgcgcgagttaggtgacgattcgtttttataggttttagaattttcgagatttttcgcgtttgtttttcgttttttttttttagattttcggtttgttcgttgggggcgcgcgcggtgtgtggtaggcggtacggcgttggcggtcgagtgcgtttgttacgcgtggcggtgcgtggttgttaggggcgtttgaggttgtcgggtagtttagtaggtcgagggaggaagtagcgtggagtcggtgtcgagtcggggcgaagttggattttttaggtgagtgcggttgcggagttaggggagtcgattttagatatttcgtcggttttacgttttcgatttttttttatttgagttttttcgcgcgggtttttagtttttcggttatttttattttagtttcgttttttttcgttattttttatttttcgggaggttagggagtcgcggttttttattcggtcgggatttcgcgttttttcggagtttttttttttttcgttacgtttcgcgaatttagtcggtttcgttttcgggtgttcgaatattgttttattttttagttatggttttcgagttttttttgttttgtcgcgttgaggtttaaattttttttgggtgtgag

SEQ ID NO: 24374 - DNA, 659 bp, Artificial Sequence
  chemically treated genomic DNA (Homo sapiens) CpG-island No: 24374
ctcacacccaaaaaaaatttaaacctcaacgcgacaaaacaaaaaaaactcgaaaaccataactaaaaaataaaacaatattcgaacacccgaaaacgaaaccgactaaattcgcgaaacgtaacgaaaaaaaaaaaaactccgaaaaaacgcgaaatcccgaccgaataaaaaaccgcgactccctaacctcccgaaaaataaaaaataacgaaaaaaaacgaaactaaaataaaaataaccgaaaaactaaaaacccgcgcgaaaaaactcaaataaaaaaaaatcgaaaacgtaaaaccgacgaaatatctaaaatcgactcccctaactccgcaaccgcactcacctaaaaaatccaacttcgccccgactcgacaccgactccacgctacttcctccctcgacctactaaactacccgacaacctcaaacgcccctaacaaccacgcaccgccacgcgtaacaaacgcactcgaccgccaacgccgtaccgcctaccacacaccgcgcgcgcccccaacgaacaaaccgaaaatctaaaaaaaaaaaacgaaaaacaaacgcgaaaaatctcgaaaattctaaaacctataaaaacgaatcgtcacctaactcgcgcacgcgcaatcccttcaatacgataaaatccgacgaac

SEQ ID NO: 24375 - DNA, 659 bp, Artificial Sequence
  chemically treated genomic DNA (Homo sapiens) CpG-island No: 24375
tttatatttagagggaatttaaattttagcgcggtaggatagaggaagttcggaggttataattaggggatgaggtagtgttcgggtattcggaggcgaggtcgattaagttcgcggggcgtggcggagaggagaagggtttcgaggaggcgcgaagtttcggtcgggtaggaggtcgcggttttttggtttttcgggggatgagaggtggcgggaggaagcggggttagggtgagagtggtcggagggttggggattcgcgcgaaaggatttaggtagagggaggtcgggagcgtgggatcggcggagtgtttggggtcggtttttttggtttcgtagtcgtatttatttaggggatttagtttcgtttcggttcggtatcggttttacgttattttttttttcggtttgttgggttattcggtagttttaggcgtttttagtaattacgtatcgttacgcgtgataagcgtattcggtcgttagcgtcgtgtcgtttgttatatatcgcgcgcgtttttagcggatagatcgagagtttggaagaagagggcgggaggtaagcgcggggaatttcgggggttttggggtttgtaggggcgggtcgttatttgattcgcgtacgcgtagtttttttagtgcggtgggattcggcgagt

SEQ ID NO: 24376 - DNA, 659 bp, Artificial Sequence
  chemically treated genomic DNA (Homo sapiens) CpG-island No: 24376
actcgccgaatcccaccgcactaaaaaaactacgcgtacgcgaatcaaataacgacccgcccctacaaaccccaaaacccccgaaattccccgcgcttacctcccgccctcttcttccaaactctcgatctatccgctaaaaacgcgcgcgatatataacaaacgacacgacgctaacgaccgaatacgcttatcacgcgtaacgatacgtaattactaaaaacgcctaaaactaccgaataacccaacaaaccgaaaaaaaaaataacgtaaaaccgataccgaaccgaaacgaaactaaatcccctaaataaatacgactacgaaaccaaaaaaaccgaccccaaacactccgccgatcccacgctcccgacctccctctacctaaatcctttcgcgcgaatccccaaccctccgaccactctcaccctaaccccgcttcctcccgccacctctcatcccccgaaaaaccaaaaaaccgcgacctcctacccgaccgaaacttcgcgcctcctcgaaacccttctcctctccgccacgccccgcgaacttaatcgacctcgcctccgaatacccgaacactacctcatcccctaattataacctccgaacttcctctatcctaccgcgctaaaatttaaattccctctaaatataaa

SEQ ID NO: 24377 - DNA, 669 bp, Artificial Sequence
  chemically treated genomic DNA (Homo sapiens) CpG-island No: 24377
tttgttttcgattttaggcggtcgcgagcggcggggggttttaagttcgagagaggcgaggcgagggggcgaagttgcgggttttatagttcgaagcgcgttgggatttcgtttcggtattttcgttttcgtttttcgttgcgtttcgttatgcgtttcggggcgtacggttcgttttcgagagtttcgttgtttgattgtcgtaattgttattttttttcggttttttgtttttcgttttcgtttcggtttcgttttttttttattttcgtttcggttttgattttttttttcgagcgagtcgtaggagatataggcgttggttgtttcgttcgtttttcgtttcgtcgcgtttttttcgttcgggatgggttttttcgtcgtcgtcggatttttcgttttcgtcgtcgtttgttttgtcgcgttcgtattgaagttcgggttttcgcgcgtcgcggttcgtttcgtagtttcgttttttgtttattcgggcggtcgtagggcggttacgatgttgtcgtttttattttttcgtttcgggttgttgttgttgttgtttttgtgttcggcgtacgtcggcggattgtggtggtgagttcggttgttttggcgcggttttggattttggagggtggggatttcgggatttaggatagattggggtgtttt

SEQ ID NO: 24378 - DNA, 669 bp, Artificial Sequence
  chemically treated genomic DNA (Homo sapiens) CpG-island No: 24378
aaaacaccccaatctatcctaaatcccgaaatccccaccctccaaaatccaaaaccgcgccaaaacaaccgaactcaccaccacaatccgccgacgtacgccgaacacaaaaacaacaacaacaacaacccgaaacgaaaaaataaaaacgacaacatcgtaaccgccctacgaccgcccgaataaacaaaaaacgaaactacgaaacgaaccgcgacgcgcgaaaacccgaacttcaatacgaacgcgacaaaacaaacgacgacgaaaacgaaaaatccgacgacgacgaaaaaacccatcccgaacgaaaaaaacgcgacgaaacgaaaaacgaacgaaacaaccaacgcctatatctcctacgactcgctcgaaaaaaaaaatcaaaaccgaaacgaaaataaaaaaaaaacgaaaccgaaacgaaaacgaaaaacaaaaaaccgaaaaaaaataacaattacgacaatcaaacaacgaaactctcgaaaacgaaccgtacgccccgaaacgcataacgaaacgcaacgaaaaacgaaaacgaaaataccgaaacgaaatcccaacgcgcttcgaactataaaacccgcaacttcgccccctcgcctcgcctctctcgaacttaaaaccccccgccgctcgcgaccgcctaaaatcgaaaacaaa

SEQ ID NO: 24379 - DNA, 669 bp, Artificial Sequence
  chemically treated genomic DNA (Homo sapiens) CpG-island No: 24379
ggaatattttagtttgttttgggtttcggggtttttattttttagggtttagagtcgcgttaggatagtcggatttattattatagttcgtcgacgtgcgtcgggtataggagtagtagtagtagtagttcgaggcgggagggtaagggcggtagtatcgtgatcgttttacggtcgttcgggtgggtagggggcgaggttgcggggcgaatcgcggcgcgcgagggttcgggttttagtgcgagcgcggtagaataggcggcggcgggagcgagggattcggcggcggcgggggggtttatttcgggcgaggagggcgcggcggagcggagagcggacggggtagttagcgtttgtgttttttgcggttcgttcgggagaagaaattagagtcggggcggaggtgggaggggagcggggtcgaggcgggggcggggggtagggggtcggagggaggtggtagttgcgatagttaggtagcgggattttcgggagcgagtcgtgcgtttcggggcgtatggcggagcgtagcggagggcgggagcgggggtgtcggggcggggttttagcgcgtttcgggttgtgggattcgtagtttcgttttttcgtttcgtttttttcggatttggagtttttcgtcgttcgcggtcgtttggagtcgggggtaag

SEQ ID NO: 24380 - DNA, 669 bp, Artificial Sequence
  chemically treated genomic DNA (Homo sapiens) CpG-island No: 24380
cttacccccgactccaaacgaccgcgaacgacgaaaaactccaaatccgaaaaaaacgaaacgaaaaaacgaaactacgaatcccacaacccgaaacgcgctaaaaccccgccccgacacccccgctcccgccctccgctacgctccgccatacgccccgaaacgcacgactcgctcccgaaaatcccgctacctaactatcgcaactaccacctccctccgaccccctaccccccgcccccgcctcgaccccgctcccctcccacctccgccccgactctaatttcttctcccgaacgaaccgcaaaaaacacaaacgctaactaccccgtccgctctccgctccgccgcgccctcctcgcccgaaataaacccccccgccgccgccgaatccctcgctcccgccgccgcctattctaccgcgctcgcactaaaacccgaaccctcgcgcgccgcgattcgccccgcaacctcgccccctacccacccgaacgaccgtaaaacgatcacgatactaccgcccttaccctcccgcctcgaactactactactactactcctatacccgacgcacgtcgacgaactataataataaatccgactatcctaacgcgactctaaaccctaaaaaataaaaaccccgaaacccaaaacaaactaaaatattcc

SEQ ID NO: 24381 - DNA, 751 bp, Artificial Sequence
  chemically treated genomic DNA (Homo sapiens) CpG-island No: 24381
gtcgttaattcgtcgtataaagcgggtcgttgttttttttttttttcgcgttcgggtttagcgtggcgtttaattgttgatcggttttggaacgttttagtagcgcgtcgggggttttcggtgtttatttagcgggttgcgggttgcgtcgggggttttttggagagtcggttcgcgtcgttcgcgcgttcgcgttagagtagttatgtatcggcgtagttacgttttttagattcgtaaggagtagtacgagtacgtcgacgaggtttcgcgcgtcgtcgagttcgagcgttcggtcgacgagggttgggttggggtaacgagtttggcggcgttgtaggggttcggcgagcgcgtggtcgtttacgtttagcgggttcgcgttttcgagtagcgttatgtcgggtttcggaggtagttggatgttttttagcgtttgggcgagttggtcgggttcgaggacgttttcgttcgttaagtcgagagtaatcgttagcgcgttcgggatttggaggtcgagcgcgttcggttggagcgttagggtatcgaggcgtagcgcgcgttcgacgagtttcgaagtaagtaagcggcggttatcgggggaaatcgaggtagggcgtgggtcgtttcggcggcgcggggttgggagtacgttgttattatgtaggggtggagcgtcgtttttggttttttgtcgatcgatgattttatttttgtacgtaggtggtatatttttttaagttaagattgg

SEQ ID NO: 24382 - DNA, 751 bp, Artificial Sequence
  chemically treated genomic DNA (Homo sapiens) CpG-island No: 24382
ccaatcttaacttaaaaaaatataccacctacgtacaaaaataaaatcatcgatcgacaaaaaaccaaaaacgacgctccacccctacataataacaacgtactcccaaccccgcgccgccgaaacgacccacgccctacctcgatttcccccgataaccgccgcttacttacttcgaaactcgtcgaacgcgcgctacgcctcgataccctaacgctccaaccgaacgcgctcgacctccaaatcccgaacgcgctaacgattactctcgacttaacgaacgaaaacgtcctcgaacccgaccaactcgcccaaacgctaaaaaacatccaactacctccgaaacccgacataacgctactcgaaaacgcgaacccgctaaacgtaaacgaccacgcgctcgccgaacccctacaacgccgccaaactcgttaccccaacccaaccctcgtcgaccgaacgctcgaactcgacgacgcgcgaaacctcgtcgacgtactcgtactactccttacgaatctaaaaaacgtaactacgccgatacataactactctaacgcgaacgcgcgaacgacgcgaaccgactctccaaaaaacccccgacgcaacccgcaacccgctaaataaacaccgaaaacccccgacgcgctactaaaacgttccaaaaccgatcaacaattaaacgccacgctaaacccgaacgcgaaaaaaaaaaaaaacaacgacccgctttatacgacgaattaacgac

SEQ ID NO: 24383 - DNA, 751 bp, Artificial Sequence
  chemically treated genomic DNA (Homo sapiens) CpG-island No: 24383
ttagttttagtttaaggaaatgtgttatttgcgtgtagggatgaggttatcgatcgataggggattagagacggcgttttatttttgtatggtagtagcgtgtttttagtttcgcgtcgtcgggacggtttacgttttgtttcggtttttttcgatggtcgtcgtttatttgtttcggaattcgtcgagcgcgcgttgcgtttcggtgttttggcgttttagtcgggcgcgttcggtttttaggtttcggacgcgttggcggttgttttcgatttggcgggcgagggcgttttcgggttcggttagttcgtttaggcgttggaaggtatttagttgttttcggagttcggtatggcgttgttcgagggcgcgggttcgttggacgtgggcggttacgcgttcgtcgagtttttgtagcgtcgttaggttcgttgttttagtttagttttcgtcggtcgggcgttcgggttcggcggcgcgcgaagtttcgtcggcgtgttcgtattgttttttgcgggtttggaagacgtagttgcgtcggtatatggttgttttggcgcgggcgcgcgggcggcgcgagtcggttttttaggaggttttcggcgtagttcgtagttcgttaaataaatatcggaggttttcggcgcgttgttgggacgttttagagtcgattagtagttgggcgttacgttgggttcgggcgcgggagaagaaaagagtagcggttcgttttgtgcggcggattagcggt

SEQ ID NO: 24384 - DNA, 751 bp, Artificial Sequence
  chemically treated genomic DNA (Homo sapiens) CpG-island No: 24384
accgctaatccgccgcacaaaacgaaccgctactcttttcttctcccgcgcccgaacccaacgtaacgcccaactactaatcgactctaaaacgtcccaacaacgcgccgaaaacctccgatatttatttaacgaactacgaactacgccgaaaacctcctaaaaaaccgactcgcgccgcccgcgcgcccgcgccaaaacaaccatataccgacgcaactacgtcttccaaacccgcaaaaaacaatacgaacacgccgacgaaacttcgcgcgccgccgaacccgaacgcccgaccgacgaaaactaaactaaaacaacgaacctaacgacgctacaaaaactcgacgaacgcgtaaccgcccacgtccaacgaacccgcgccctcgaacaacgccataccgaactccgaaaacaactaaataccttccaacgcctaaacgaactaaccgaacccgaaaacgccctcgcccgccaaatcgaaaacaaccgccaacgcgtccgaaacctaaaaaccgaacgcgcccgactaaaacgccaaaacaccgaaacgcaacgcgcgctcgacgaattccgaaacaaataaacgacgaccatcgaaaaaaaccgaaacaaaacgtaaaccgtcccgacgacgcgaaactaaaaacacgctactaccatacaaaaataaaacgccgtctctaatcccctatcgatcgataacctcatccctacacgcaaataacacatttccttaaactaaaactaa

SEQ ID NO: 24385 - DNA, 1470 bp, Artificial Sequence
  chemically treated genomic DNA (Homo sapiens) CpG-island No: 24385
gtcgagataacgggaaggcggttagtcgtattaattagtagcgtttaagtttcgttagcgtagatttgttgttcgcggttaggtcgggtatttgtatgattttcgggttatttttttaaagtttaggtagagcgcgggtgggaagcgtgcgaggagagttgagttagggagttgcggggaggagaaggtaagaatgttttagagaaaaagtcggagagggttgtaaattggttggttcggttggcggggttcggcgcggcggaacgggagcgagaggggaacgaaggggaggggagcggaggaggttagcgttttaaagtttcgcgttacggcgtcgttgattagtggttgtttatttaatatgagcgtggtttaggttcggtcgcgtttcgcgcgtatgtttagcgtttagtagtcgggcgttaggcgtttttatggtcgttttcgggcggtttgttcggttcggggtttttttttttgttcgcgggtttttgcgttcggggataggggcgcgcgttcgggtttcggtttttcggcgtcgacgttcgacgttttttttagcggcgattgtgaggcgcggggtggttggggcggtttgggagtcgtttttcggtgtttgtttcgcgtttgtaggattattttggtatagtcgcgttcgttcgttgcgtcgttcggacggcggttagagaacggcgggttggttgggcggttgggcgtagtttattttttagcgggcgggcgggcggagggtggagggcgggttcgtttttttcgcgggtcgggaggcggggagatcgtggaggtcgggcggttgttgtttggttggtagtatcgcgggaggcgcgtcggatttgttagttcgtcgtcgttgtcgtcgtttcggttgttacggcgatcgcggaacgtcggggggcgggggcggggatattttgcgagcggtcgcggtttcgtttcgtcgtttttttgcgtcggacgcgcgttttaggtcggttagcgcgcgcggattttcggcgtaggcggggttcgatttttttggcgttcggttatttatattttttcggcgtcgcgcggggttcggtcggtgcgaggacgcgggggcggacggtttttcggaggcggtcgtttttttattgtgggagtgatggggtcgaaggaagagttttttcgggatcggggcgttgatttaagtttcggagtttgttaaggttgcgtttggagttcgcgtaggcgagacgcggcggggtagggagaaggcgttcggagcggttatttaggggcgttgtgcgttgcgtttgggcgttggtcggttttatcgatgtgaagcgcgcgggtggtaattaagttatcgttttcgtttatttttcgtagtgtggtcgcgtaatttggagcgtagttttttatttatcgataagaagaacgggtgcgattcgatttaagatagtaatagagtattaaaatagtagtttggaa

SEQ ID NO: 24386 - DNA, 1470 bp, Artificial Sequence
  chemically treated genomic DNA (Homo sapiens) CpG-island No: 24386
ttccaaactactattttaatactctattactatcttaaatcgaatcgcacccgttcttcttatcgataaataaaaaactacgctccaaattacgcgaccacactacgaaaaataaacgaaaacgataacttaattaccacccgcgcgcttcacatcgataaaaccgaccaacgcccaaacgcaacgcacaacgcccctaaataaccgctccgaacgccttctccctaccccgccgcgtctcgcctacgcgaactccaaacgcaaccttaacaaactccgaaacttaaatcaacgccccgatcccgaaaaaactcttccttcgaccccatcactcccacaataaaaaaacgaccgcctccgaaaaaccgtccgcccccgcgtcctcgcaccgaccgaaccccgcgcgacgccgaaaaaatataaataaccgaacgccaaaaaaatcgaaccccgcctacgccgaaaatccgcgcgcgctaaccgacctaaaacgcgcgtccgacgcaaaaaaacgacgaaacgaaaccgcgaccgctcgcaaaatatccccgcccccgccccccgacgttccgcgatcgccgtaacaaccgaaacgacgacaacgacgacgaactaacaaatccgacgcgcctcccgcgatactaccaaccaaacaacaaccgcccgacctccacgatctccccgcctcccgacccgcgaaaaaaacgaacccgccctccaccctccgcccgcccgcccgctaaaaaataaactacgcccaaccgcccaaccaacccgccgttctctaaccgccgtccgaacgacgcaacgaacgaacgcgactataccaaaataatcctacaaacgcgaaacaaacaccgaaaaacgactcccaaaccgccccaaccaccccgcgcctcacaatcgccgctaaaaaaaacgtcgaacgtcgacgccgaaaaaccgaaacccgaacgcgcgcccctatccccgaacgcaaaaacccgcgaacaaaaaaaaaaaccccgaaccgaacaaaccgcccgaaaacgaccataaaaacgcctaacgcccgactactaaacgctaaacatacgcgcgaaacgcgaccgaacctaaaccacgctcatattaaataaacaaccactaatcaacgacgccgtaacgcgaaactttaaaacgctaacctcctccgctcccctccccttcgttcccctctcgctcccgttccgccgcgccgaaccccgccaaccgaaccaaccaatttacaaccctctccgactttttctctaaaacattcttaccttctcctccccgcaactccctaactcaactctcctcgcacgcttcccacccgcgctctacctaaactttaaaaaaataacccgaaaatcatacaaatacccgacctaaccgcgaacaacaaatctacgctaacgaaacttaaacgctactaattaatacgactaaccgccttcccgttatctcgac

SEQ ID NO: 24387 - DNA, 1470 bp, Artificial Sequence
  chemically treated genomic DNA (Homo sapiens) CpG-island No: 24387
ttttaggttgttattttaatattttgttattattttaaatcgggtcgtattcgttttttttgtcggtgagtgaggggttgcgttttaagttgcgcgattatattgcggggagtaaacggagacggtgatttgattgttattcgcgcgttttatatcggtggggtcgattagcgtttaggcgtagcgtatagcgtttttaagtggtcgtttcgggcgttttttttttgtttcgtcgcgtttcgtttgcgcgggttttaagcgtagttttaataggtttcgaaatttgaattagcgtttcgatttcgagagggtttttttttcggttttattatttttataatggaagggcggtcgttttcggaaggtcgttcgttttcgcgttttcgtatcggtcgagtttcgcgcggcgtcgaagaggtgtgggtagtcgggcgttagaggggtcgggtttcgtttgcgtcggaagttcgcgcgcgttggtcggtttggagcgcgcgttcggcgtagaggggcggcggggcggggtcgcggtcgttcgtagggtgttttcgttttcgtttttcggcgtttcgcggtcgtcgtgataatcggagcggcggtaacggcggcgggttagtaagttcggcgcgtttttcgcggtattgttagttaggtagtagtcgttcggtttttacgattttttcgtttttcggttcgcgggagggacgagttcgttttttatttttcgttcgttcgttcgttggagagtgagttgcgtttagtcgtttagttagttcgtcgttttttggtcgtcgttcgggcggcgtagcgagcgggcgcgattatgttaagatggttttgtaggcgcggaataagtatcgggaggcggtttttaagtcgttttagttatttcgcgttttatagtcgtcgttgaggggggcgtcggacgtcggcgtcggggagtcggggttcgagcgcgcgtttttgttttcgggcgtaagggttcgcgggtaggaagagggatttcgagtcggatagatcgttcgggggcggttatgggggcgtttggcgttcggttgttgggcgttgggtatgcgcgcggggcgcggtcggatttggattacgtttatgttaggtgagtagttattagttagcgacgtcgtgacgcggaattttgaggcgttggtttttttcgtttttttttttttcgtttttttttcgttttcgtttcgtcgcgtcgagtttcgttagtcggattagttagtttgtagtttttttcgattttttttttgggatatttttattttttttttttcgtaattttttggtttagtttttttcgtacgttttttattcgcgttttgtttgggttttaaaagaatggttcggggattatataagtgttcggtttggtcgcgggtagtaggtttgcgttaacgagatttgagcgttgttgattggtacgattggtcgttttttcgttatttcggt

SEQ ID NO: 24388 - DNA, 1470 bp, Artificial Sequence
  chemically treated genomic DNA (Homo sapiens) CpG-island No: 24388
accgaaataacgaaaaaacgaccaatcgtaccaatcaacaacgctcaaatctcgttaacgcaaacctactacccgcgaccaaaccgaacacttatataatccccgaaccattcttttaaaacccaaacaaaacgcgaataaaaaacgtacgaaaaaaactaaaccaaaaaattacgaaaaaaaaaaaataaaaatatcccaaaaaaaaaatcgaaaaaaactacaaactaactaatccgactaacgaaactcgacgcgacgaaacgaaaacgaaaaaaaaacgaaaaaaaaaaaaacgaaaaaaaccaacgcctcaaaattccgcgtcacgacgtcgctaactaataactactcacctaacataaacgtaatccaaatccgaccgcgccccgcgcgcatacccaacgcccaacaaccgaacgccaaacgcccccataaccgcccccgaacgatctatccgactcgaaatccctcttcctacccgcgaacccttacgcccgaaaacaaaaacgcgcgctcgaaccccgactccccgacgccgacgtccgacgcccccctcaacgacgactataaaacgcgaaataactaaaacgacttaaaaaccgcctcccgatacttattccgcgcctacaaaaccatcttaacataatcgcgcccgctcgctacgccgcccgaacgacgaccaaaaaacgacgaactaactaaacgactaaacgcaactcactctccaacgaacgaacgaacgaaaaataaaaaacgaactcgtccctcccgcgaaccgaaaaacgaaaaaatcgtaaaaaccgaacgactactacctaactaacaataccgcgaaaaacgcgccgaacttactaacccgccgccgttaccgccgctccgattatcacgacgaccgcgaaacgccgaaaaacgaaaacgaaaacaccctacgaacgaccgcgaccccgccccgccgcccctctacgccgaacgcgcgctccaaaccgaccaacgcgcgcgaacttccgacgcaaacgaaacccgacccctctaacgcccgactacccacacctcttcgacgccgcgcgaaactcgaccgatacgaaaacgcgaaaacgaacgaccttccgaaaacgaccgcccttccattataaaaataataaaaccgaaaaaaaaaccctctcgaaatcgaaacgctaattcaaatttcgaaacctattaaaactacgcttaaaacccgcgcaaacgaaacgcgacgaaacaaaaaaaaaacgcccgaaacgaccacttaaaaacgctatacgctacgcctaaacgctaatcgaccccaccgatataaaacgcgcgaataacaatcaaatcaccgtctccgtttactccccgcaatataatcgcgcaacttaaaacgcaacccctcactcaccgacaaaaaaaacgaatacgacccgatttaaaataataacaaaatattaaaataacaacctaaaa

SEQ ID NO: 24389 - DNA, 715 bp, Artificial Sequence
  chemically treated genomic DNA (Homo sapiens) CpG-island No: 24389
tagggtttcgtagtaaggcgttaaagttgggggaagcgtatttttgttttttcgcgagtacgacgcggtgttttttagttttttttcggtttttttttttcgttttttcggttcgcgagcgttcgggttttttttagtggttcgcggtaggtggcgttgtttgcggcgtcgtagcggttcgggttgtagtagagacgatttttcggcggttgtgcggttcggtttttcggcggtagcgagtgttacgttttaagtgttacgcggaggattagagtaggcggtgcgttgggggcgggagtagcgcggagttcggttcggttatatcgatcgttcgtcgttatgggtttttcgtaaagcgtcgagatttcgggcgggggtatcgagggttattacgttttgcgggtaagggtttcgacggcggtcggggagttgcgggttggaggcggggtcggtcgcggggaggcggaggttttatgggtttttttacggggtagttaggttcgatttcgcgaaggagcggcggtcgcggcgttgttttggtcgaggttggtttcggaggtcgttcgtattttattttcgcggagcgttttgggtacggggttcgcggttgtaggaggacgggttggagttggaggcggttgtcggcgattcggttagggggcggttttgggaaggggggataattttgtttttttttcgtacggttttttttttt

SEQ ID NO: 24390 - DNA, 715 bp, Artificial Sequence
  chemically treated genomic DNA (Homo sapiens) CpG-island No: 24390
aaaaaaaaaaaccgtacgaaaaaaaaacaaaattatccccccttcccaaaaccgccccctaaccgaatcgccgacaaccgcctccaactccaacccgtcctcctacaaccgcgaaccccgtacccaaaacgctccgcgaaaataaaatacgaacgacctccgaaaccaacctcgaccaaaacaacgccgcgaccgccgctccttcgcgaaatcgaacctaactaccccgtaaaaaaacccataaaacctccgcctccccgcgaccgaccccgcctccaacccgcaactccccgaccgccgtcgaaacccttacccgcaaaacgtaataaccctcgatacccccgcccgaaatctcgacgctttacgaaaaacccataacgacgaacgatcgatataaccgaaccgaactccgcgctactcccgcccccaacgcaccgcctactctaatcctccgcgtaacacttaaaacgtaacactcgctaccgccgaaaaaccgaaccgcacaaccgccgaaaaatcgtctctactacaacccgaaccgctacgacgccgcaaacaacgccacctaccgcgaaccactaaaaaaaacccgaacgctcgcgaaccgaaaaaacgaaaaaaaaaaaccgaaaaaaaactaaaaaacaccgcgtcgtactcgcgaaaaaacaaaaatacgcttcccccaactttaacgccttactacgaaacccta

SEQ ID NO: 24391 - DNA, 715 bp, Artificial Sequence
  chemically treated genomic DNA (Homo sapiens) CpG-island No: 24391
gagagagaaggtcgtgcggaaaaagagtaaggttgttttttttttttagggtcgttttttggtcgagtcgtcggtagtcgtttttagttttagttcgtttttttatagtcgcggatttcgtgtttagggcgtttcgcggaggtgggatgcgagcggttttcggaattagtttcgattaaggtagcgtcgcgatcgtcgttttttcgcgggatcgggtttggttgtttcgtgaaggagtttatggggttttcgttttttcgcggtcggtttcgtttttagttcgtagtttttcggtcgtcgtcggagtttttattcgtagaacgtggtagttttcggtgttttcgttcgggatttcgacgttttgcgaggagtttatggcggcgggcgatcggtgtggtcgagtcgggtttcgcgttgttttcgtttttagcgtatcgtttgttttaatttttcgcgtagtatttgggacgtggtattcgttgtcgtcggagagtcgggtcgtatagtcgtcgggagatcgtttttgttgtagttcgggtcgttgcgacgtcgtagatagcgttatttgtcgcgagttattggaaggggttcgagcgttcgcgggtcgggagggcggagagggagggtcggaggaggattgggaggtatcgcgtcgtgttcgcgagagaatagaaatgcgttttttttagttttggcgttttgttacggggttttg

SEQ ID NO: 24392 - DNA, 715 bp, Artificial Sequence
  chemically treated genomic DNA (Homo sapiens) CpG-island No: 24392
caaaaccccgtaacaaaacgccaaaactaaaaaaaacgcatttctattctctcgcgaacacgacgcgatacctcccaatcctcctccgaccctccctctccgccctcccgacccgcgaacgctcgaaccccttccaataactcgcgacaaataacgctatctacgacgtcgcaacgacccgaactacaacaaaaacgatctcccgacgactatacgacccgactctccgacgacaacgaataccacgtcccaaatactacgcgaaaaattaaaacaaacgatacgctaaaaacgaaaacaacgcgaaacccgactcgaccacaccgatcgcccgccgccataaactcctcgcaaaacgtcgaaatcccgaacgaaaacaccgaaaactaccacgttctacgaataaaaactccgacgacgaccgaaaaactacgaactaaaaacgaaaccgaccgcgaaaaaacgaaaaccccataaactccttcacgaaacaaccaaacccgatcccgcgaaaaaacgacgatcgcgacgctaccttaatcgaaactaattccgaaaaccgctcgcatcccacctccgcgaaacgccctaaacacgaaatccgcgactataaaaaaacgaactaaaactaaaaacgactaccgacgactcgaccaaaaaacgaccctaaaaaaaaaaaacaaccttactctttttccgcacgaccttctctctc

SEQ ID NO: 24393 - DNA, 501 bp, Artificial Sequence
  chemically treated genomic DNA (Homo sapiens) CpG-island No: 24393
gttatgttcggggcgttcgtaggttcgcggcggagttcgggttgcgggagttatttgtcgggaaagtttttagttttttagcgcggttttttatatttagggtcgggtttcggggcgaggttagttcggcgtttcgcggttgtttttttttcggttttcgaggcggtcgtcgttttagtagttgttatagtaaagttttcgtttcggttcgttttttcgttttgttcggtttatatcggggttttattggtagcgcgaattttcgtttttgcgcgtgttttcgaaggtatttttttttcgcgcgttcgtttcggtcgcgtttttcgcgttttttttcgtttcgggttgcggcggatttagggatcggttggagcgcggagcgcgaatttttcgcggggtttgggcgcgaggtttttttgtttcgtttttcggcgttaggttcgggtttgaagtattttattatttttttgggtatcgggtttttcgggttgcgtttaggtt

SEQ ID NO: 24394 - DNA, 501 bp, Artificial Sequence
  chemically treated genomic DNA (Homo sapiens) CpG-island No: 24394
aacctaaacgcaacccgaaaaacccgatacccaaaaaaataataaaatacttcaaacccgaacctaacgccgaaaaacgaaacaaaaaaacctcgcgcccaaaccccgcgaaaaattcgcgctccgcgctccaaccgatccctaaatccgccgcaacccgaaacgaaaaaaaacgcgaaaaacgcgaccgaaacgaacgcgcgaaaaaaaaataccttcgaaaacacgcgcaaaaacgaaaattcgcgctaccaataaaaccccgatataaaccgaacaaaacgaaaaaacgaaccgaaacgaaaactttactataacaactactaaaacgacgaccgcctcgaaaaccgaaaaaaaaacaaccgcgaaacgccgaactaacctcgccccgaaacccgaccctaaatataaaaaaccgcgctaaaaaactaaaaactttcccgacaaataactcccgcaacccgaactccgccgcgaacctacgaacgccccgaacataac

SEQ ID NO: 24395 - DNA, 501 bp, Artificial Sequence
  chemically treated genomic DNA (Homo sapiens) CpG-island No: 24395
ggtttaggcgtagttcgggggattcggtgtttagagggatggtagggtgttttaggttcggatttggcgtcgagaggcgggataaggggatttcgcgtttaagtttcgcggaaagttcgcgtttcgcgttttagtcggtttttggattcgtcgtagttcggggcggggaggggcgcgggaggcgcggtcggggcgggcgcgcgagaggaaggtgttttcgggaatacgcgtaagggcggggattcgcgttgttaatgaggtttcggtgtgggtcgagtaaggcggggggacgggtcggagcggaggttttgttgtggtagttgttggagcggcggtcgtttcgggagtcggaggagaggtagtcgcggagcgtcgagttggtttcgtttcgaggttcggttttgggtgtggggaatcgcgttgaggagttggaaattttttcggtaggtaattttcgtagttcggatttcgtcgcgggtttgcgagcgtttcgggtatggt

SEQ ID NO: 24396 - DNA, 501 bp, Artificial Sequence
  chemically treated genomic DNA (Homo sapiens) CpG-island No: 24396
accatacccgaaacgctcgcaaacccgcgacgaaatccgaactacgaaaattacctaccgaaaaaatttccaactcctcaacgcgattccccacacccaaaaccgaacctcgaaacgaaaccaactcgacgctccgcgactacctctcctccgactcccgaaacgaccgccgctccaacaactaccacaacaaaacctccgctccgacccgtccccccgccttactcgacccacaccgaaacctcattaacaacgcgaatccccgcccttacgcgtattcccgaaaacaccttcctctcgcgcgcccgccccgaccgcgcctcccgcgcccctccccgccccgaactacgacgaatccaaaaaccgactaaaacgcgaaacgcgaactttccgcgaaacttaaacgcgaaatccccttatcccgcctctcgacgccaaatccgaacctaaaacaccctaccatccctctaaacaccgaatcccccgaactacgcctaaacc

SEQ ID NO: 24397 - DNA, 596 bp, Artificial Sequence
  chemically treated genomic DNA (Homo sapiens) CpG-island No: 24397
gtaacgttcgtttttttcgtttgtttttacgaggtttaagtcgtagttacggcgggagtgtcggggtcgggattagagtcgttgcgcgtttttaggtcggttgcgcggggtacggagcgggtcgttttttagtagtaggagtttattcgcggattttaggcggcggttttatttcgtcggggtagttgttttcgagttcgtagcggtttttgagattttttattattaaattttgtttcggtggtttgacgattttcggttttatagtatatagtaatcgtattagttttttcgggaatcgcgtttattaaattcgcggcgttacgcggtcgtagtgcgttacgacgtgttagatttcgttttttcgaggtacgtacggcggtagggaaagggcggggcggggcgattcggagattgtagttcggtttgttagcgcgttttttaagtttttcgtgttagtattatatatttcgtaattgagtagtattgtattttttcgcgatagttttgtttcggttgtttgggtgttacgggttgaggggtatcgaggtttcgtatttgtttgtagcgtttcgttttagttttatttaatttgt

SEQ ID NO: 24398 - DNA, 596 bp, Artificial Sequence
  chemically treated genomic DNA (Homo sapiens) CpG-island No: 24398
acaaattaaataaaactaaaacgaaacgctacaaacaaatacgaaacctcgatacccctcaacccgtaacacccaaacaaccgaaacaaaactatcgcgaaaaaatacaatactactcaattacgaaatatataatactaacacgaaaaacttaaaaaacgcgctaacaaaccgaactacaatctccgaatcgccccgccccgccctttccctaccgccgtacgtacctcgaaaaaacgaaatctaacacgtcgtaacgcactacgaccgcgtaacgccgcgaatttaataaacgcgattcccgaaaaaactaatacgattactatatactataaaaccgaaaatcgtcaaaccaccgaaacaaaatttaataataaaaaatctcaaaaaccgctacgaactcgaaaacaactaccccgacgaaataaaaccgccgcctaaaatccgcgaataaactcctactactaaaaaacgacccgctccgtaccccgcgcaaccgacctaaaaacgcgcaacgactctaatcccgaccccgacactcccgccgtaactacgacttaaacctcgtaaaaacaaacgaaaaaaacgaacgttac

SEQ ID NO: 24399 - DNA, 596 bp, Artificial Sequence
  chemically treated genomic DNA (Homo sapiens) CpG-island No: 24399
ataggttaaatggagttggagcggagcgttgtaggtaggtgcggggtttcggtgttttttaattcgtggtatttaggtagtcggggtaggattatcgcggggagatgtaatattatttagttacgaggtgtgtagtgttagtacgagaaatttggaggacgcgttgataagtcgggttgtagttttcgggtcgtttcgtttcgttttttttttgtcgtcgtgcgtgtttcgggggggcggggtttggtacgtcgtgacgtattgcggtcgcgtagcgtcgcgggtttgatgaacgcggttttcggggagattggtacggttgttgtgtgttatggagtcgagggtcgttaagttatcggggtaggatttagtagtggagagttttaaaagtcgttacggattcgggggtagttgtttcgacgaggtgaagtcgtcgtttgaggttcgcgggtgggtttttgttgttggggggcggttcgtttcgtgtttcgcgtagtcggtttgggggcgcgtagcggttttggtttcggtttcggtattttcgtcgtggttgcggtttgggtttcgtggaagtaggcgggaggggcgggcgttgt

SEQ ID NO: 24400 - DNA, 596 bp, Artificial Sequence
  chemically treated genomic DNA (Homo sapiens) CpG-island No: 24400
acaacgcccgcccctcccgcctacttccacgaaacccaaaccgcaaccacgacgaaaataccgaaaccgaaaccaaaaccgctacgcgcccccaaaccgactacgcgaaacacgaaacgaaccgccccccaacaacaaaaacccacccgcgaacctcaaacgacgacttcacctcgtcgaaacaactacccccgaatccgtaacgacttttaaaactctccactactaaatcctaccccgataacttaacgaccctcgactccataacacacaacaaccgtaccaatctccccgaaaaccgcgttcatcaaacccgcgacgctacgcgaccgcaatacgtcacgacgtaccaaaccccgcccccccgaaacacgcacgacgacaaaaaaaaaacgaaacgaaacgacccgaaaactacaacccgacttatcaacgcgtcctccaaatttctcgtactaacactacacacctcgtaactaaataatattacatctccccgcgataatcctaccccgactacctaaataccacgaattaaaaaacaccgaaaccccgcacctacctacaacgctccgctccaactccatttaacctat

SEQ ID NO: 24401 - DNA, 814 bp, Artificial Sequence
  chemically treated genomic DNA (Homo sapiens) CpG-island No: 24401
aagaaattcgtcgatatagtattcgggtgtttaagttttcgagaattaggtcgcgcgggtattacggggtgcgcgatcggttagaaagttcgggttaggggtgtttaggagcgagtatcgtcgggaataagcgtcgggaataagtcgggagaaagaggaagcgtcggcgttaaaggtttttcgtttatcgttgtttttttaggattttttatgcgtttgtaaggttacgtcgtttataggattgcgttagcggtcggcgttttaatagagcgcgttagggagtagcgtcgtcgggagttatgacgtttgagtagcgcgagtcgtcgttcggttaggtcgaggtcgtcggttttttcgagatttatttatttgtcgaggcgacggggtggagttttgtatcgaggcgatgtatcgttttacgttagttttgttgcgttttatcgcgtcgttaatttggttttcgaggcgcgtgagattagcgtttaggttcgtagtagtcgttatttttaagaggaaagcgtttgtaaattagtgacgtagcgtcgtagtcggcggaggattattgtgacgaatttgcggcgtagtcggcggaggattattgtgacgaatttgcgtattgcgttagtagtgtgcgttacgttggcgacgtcggcgttcgagttgtattcggttaggtttttggtagcgtcgcgtgttttgagggtgttttggtaagtcgggattagatttcggtcgttagtgtttatagtttagggcgtagatttttagtagataataatttgcgtgatgggtttttaagcgttttggttatttg

SEQ ID NO: 24402 - DNA, 814 bp, Artificial Sequence
  chemically treated genomic DNA (Homo sapiens) CpG-island No: 24402
caaataaccaaaacgcttaaaaacccatcacgcaaattattatctactaaaaatctacgccctaaactataaacactaacgaccgaaatctaatcccgacttaccaaaacaccctcaaaacacgcgacgctaccaaaaacctaaccgaatacaactcgaacgccgacgtcgccaacgtaacgcacactactaacgcaatacgcaaattcgtcacaataatcctccgccgactacgccgcaaattcgtcacaataatcctccgccgactacgacgctacgtcactaatttacaaacgctttcctcttaaaaataacgactactacgaacctaaacgctaatctcacgcgcctcgaaaaccaaattaacgacgcgataaaacgcaacaaaactaacgtaaaacgatacatcgcctcgatacaaaactccaccccgtcgcctcgacaaataaataaatctcgaaaaaaccgacgacctcgacctaaccgaacgacgactcgcgctactcaaacgtcataactcccgacgacgctactccctaacgcgctctattaaaacgccgaccgctaacgcaatcctataaacgacgtaaccttacaaacgcataaaaaatcctaaaaaaacaacgataaacgaaaaacctttaacgccgacgcttcctctttctcccgacttattcccgacgcttattcccgacgatactcgctcctaaacacccctaacccgaactttctaaccgatcgcgcaccccgtaatacccgcgcgacctaattctcgaaaacttaaacacccgaatactatatcgacgaatttctt

SEQ ID NO: 24403 - DNA, 814 bp, Artificial Sequence
  chemically treated genomic DNA (Homo sapiens) CpG-island No: 24403
taagtgattaaaacgtttaagagtttattacgtaaattgttatttgttggaaatttacgttttaggttgtggatattggcggtcgaaatttgatttcggtttgttaagatatttttagagtacgcggcgttgttaagagtttggtcgagtgtagttcgagcgtcgacgtcgttaacgtggcgtatattgttgacgtagtacgtaagttcgttatagtggtttttcgtcggttgcgtcgtaagttcgttatagtggtttttcgtcggttacggcgttgcgttattggtttgtaggcgttttttttttggaagtggcgattgttgcgggtttgagcgttggttttacgcgtttcgggagttaggttggcggcgcgatgaggcgtagtaaggttgacgtggagcggtatatcgtttcggtgtagggttttatttcgtcgtttcgataggtgagtgggtttcgaagagatcgacggtttcgatttggtcgggcggcggttcgcgttgtttaggcgttatggttttcgacggcgttgttttttggcgcgttttgttgaggcgtcggtcgttggcgtagttttgtgggcggcgtggttttgtaagcgtatgaagagttttggggggatagcggtgggcgggagatttttggcgtcggcgttttttttttttttcggtttgttttcgacgtttgttttcgacggtgttcgtttttgggtatttttggttcgggttttttggtcgatcgcgtatttcgtagtattcgcgcggtttagttttcgggggtttgggtattcgggtgttgtatcggcgggtttttt

SEQ ID NO: 24404 - DNA, 814 bp, Artificial Sequence
  chemically treated genomic DNA (Homo sapiens) CpG-island No: 24404
aaaaaacccgccgatacaacacccgaatacccaaacccccgaaaactaaaccgcgcgaatactacgaaatacgcgatcgaccaaaaaacccgaaccaaaaatacccaaaaacgaacaccgtcgaaaacaaacgtcgaaaacaaaccgaaaaaaaaaaaaaacgccgacgccaaaaatctcccgcccaccgctatccccccaaaactcttcatacgcttacaaaaccacgccgcccacaaaactacgccaacgaccgacgcctcaacaaaacgcgccaaaaaacaacgccgtcgaaaaccataacgcctaaacaacgcgaaccgccgcccgaccaaatcgaaaccgtcgatctcttcgaaacccactcacctatcgaaacgacgaaataaaaccctacaccgaaacgatataccgctccacgtcaaccttactacgcctcatcgcgccgccaacctaactcccgaaacgcgtaaaaccaacgctcaaacccgcaacaatcgccacttccaaaaaaaaaacgcctacaaaccaataacgcaacgccgtaaccgacgaaaaaccactataacgaacttacgacgcaaccgacgaaaaaccactataacgaacttacgtactacgtcaacaatatacgccacgttaacgacgtcgacgctcgaactacactcgaccaaactcttaacaacgccgcgtactctaaaaatatcttaacaaaccgaaatcaaatttcgaccgccaatatccacaacctaaaacgtaaatttccaacaaataacaatttacgtaataaactcttaaacgttttaatcactta

SEQ ID NO: 24405 - DNA, 927 bp, Artificial Sequence
  chemically treated genomic DNA (Homo sapiens) CpG-island No: 24405
ttcgttgcggatttgtgtttttttcgtcgtcgcggttttttgttcgtcgcgttttttgttatatattcgtcgtcgcgcgtttttgtttttttgtcgtcgcggttttttgtttttattttgtttcgggggggggttcgtcgcggttttttttttttattcgtcgttgttttttttgcgtttttatcgtcgtggttttttgttttatcgtcgtcgcggttttttgtttttatttcgtttcggttttttgttcgtcgcggttttttatttttcgtcgtcgcgcgtttttgttcgtcgcggttttgtgtttttttcgtcgtcgcggttttttgttcgtcgcgttttttgttatatatttttcgtcgcggttttttttttttttgtcgtcgcggttttttgttttatcgtcgatatagttttttgtatattcgtcgttttggttttttgtcgtcgcggttttttgttttttcgttgtcgcggttttttgttttttcgttatcgtcgtttttttttgttttatcgtcgtcgtggttttttgtttatcgcggttttttgttatcgcggttttttattcgttacggttttttattcgtcgcggttttttgcgtttcgttgttacggttttttgtttttttgtcgtagcgattttttcgtcgtcgcggtattttgttttcgtcgtcgtggttttttgtcgttgtcgtcgtcgttttttgttttcgtcgtagtggttttttgttttcgttatcgcggttttttgttgtcgcgattttttgtttcggttatcgtcgttttttgttatcgcgattttttgttttcgtcgtcgaggatttttgttttcgtcgttacggttttgagggcgggagcggtagattcggttgttagttttattggcgttttggtaagggtagcgttgaggggtgtttttggttt

SEQ ID NO: 24406 - DNA, 927 bp, Artificial Sequence
  chemically treated genomic DNA (Homo sapiens) CpG-island No: 24406
aaaccaaaaacacccctcaacgctacccttaccaaaacgccaataaaactaacaaccgaatctaccgctcccgccctcaaaaccgtaacgacgaaaacaaaaatcctcgacgacgaaaacaaaaaatcgcgataacaaaaaacgacgataaccgaaacaaaaaatcgcgacaacaaaaaaccgcgataacgaaaacaaaaaaccactacgacgaaaacaaaaaacgacgacgacaacgacaaaaaaccacgacgacgaaaacaaaataccgcgacgacgaaaaaatcgctacgacaaaaaaacaaaaaaccgtaacaacgaaacgcaaaaaaccgcgacgaataaaaaaccgtaacgaataaaaaaccgcgataacaaaaaaccgcgataaacaaaaaaccacgacgacgataaaacaaaaaaaaacgacgataacgaaaaaacaaaaaaccgcgacaacgaaaaaacaaaaaaccgcgacgacaaaaaaccaaaacgacgaatatacaaaaaactatatcgacgataaaacaaaaaaccgcgacgacaaaaaaaaaaaaaaccgcgacgaaaaatatataacaaaaaacgcgacgaacaaaaaaccgcgacgacgaaaaaaacacaaaaccgcgacgaacaaaaacgcgcgacgacgaaaaataaaaaaccgcgacgaacaaaaaaccgaaacgaaataaaaacaaaaaaccgcgacgacgataaaacaaaaaaccacgacgataaaaacgcaaaaaaaacaacgacgaataaaaaaaaaaaaccgcgacgaacccccccccgaaacaaaataaaaacaaaaaaccgcgacgacaaaaaaacaaaaacgcgcgacgacgaatatataacaaaaaacgcgacgaacaaaaaaccgcgacgacgaaaaaaacacaaatccgcaacgaa

SEQ ID NO: 24407 - DNA, 927 bp, Artificial Sequence
  chemically treated genomic DNA (Homo sapiens) CpG-island No: 24407
ggattaggagtattttttagcgttgtttttgttaggacgttagtagagttggtagtcgagtttgtcgttttcgtttttagagtcgtggcggcggggataaaaattttcggcggcgggggtaaaaagtcgcggtgataaaaagcggcggtgatcggggtaaaaagtcgcggtagtaaaaagtcgcggtggcggggataaaaagttattgcggcgggggtaaaaagcggcggcgatagcggtaaaaagttacggcggcgggggtaaaatgtcgcggcggcgaaaaagtcgttgcgataggggggtaaaaagtcgtgatagcggggcgtaaaaagtcgcggcgggtaaaaggtcgtggcgagtaaaaagtcgcgatggtaaaaagtcgcggtgggtaaaaagttacggcggcggtggggtaaaaaggagcggcggtggcggaggggtaaaaagtcgcggtagcgagggggtagaaagtcgcggcggtaaaaagttaaggcggcgagtgtgtaaaaagttgtgtcggcggtggggtaaaaagtcgcggcggtagagggggaaaaagtcgcggcggggggtgtgtggtagaaagcgcggcgggtaaaaagtcgcggcggcgaggggggtataaagtcgcggcgggtaaaaacgcgcggcggcggggggtaaaaagtcgcggcgggtaagaagtcgaggcggggtgggagtaaaaagtcgcggcggcggtggggtaaaaagttacggcggtgggggcgtaaaaagggtagcggcgggtgggggaagaaagtcgcggcgagttttttttcgaggtaaggtgggggtaaaaagtcgcggcggtagaggagtaaaaacgcgcggcggcgggtgtgtggtagaaagcgcggcgggtaaaaagtcgcggcggcgaggggggtataaattcgtagcggg

SEQ ID NO: 24408 - DNA, 927 bp, Artificial Sequence
  chemically treated genomic DNA (Homo sapiens) CpG-island No: 24408
cccgctacgaatttatacccccctcgccgccgcgactttttacccgccgcgctttctaccacacacccgccgccgcgcgtttttactcctctaccgccgcgactttttacccccaccttacctcgaaaaaaaactcgccgcgactttcttcccccacccgccgctaccctttttacgcccccaccgccgtaactttttaccccaccgccgccgcgactttttactcccaccccgcctcgacttcttacccgccgcgactttttaccccccgccgccgcgcgtttttacccgccgcgactttatacccccctcgccgccgcgactttttacccgccgcgctttctaccacacaccccccgccgcgactttttccccctctaccgccgcgactttttaccccaccgccgacacaactttttacacactcgccgccttaactttttaccgccgcgactttctaccccctcgctaccgcgactttttacccctccgccaccgccgctcctttttaccccaccgccgccgtaactttttacccaccgcgactttttaccatcgcgactttttactcgccacgaccttttacccgccgcgactttttacgccccgctatcacgactttttacccccctatcgcaacgactttttcgccgccgcgacattttacccccgccgccgtaactttttaccgctatcgccgccgctttttacccccgccgcaataactttttatccccgccaccgcgactttttactaccgcgactttttaccccgatcaccgccgctttttatcaccgcgactttttacccccgccgccgaaaatttttatccccgccgccacgactctaaaaacgaaaacgacaaactcgactaccaactctactaacgtcctaacaaaaacaacgctaaaaaatactcctaatcc

SEQ ID NO: 24409 - DNA, 870 bp, Artificial Sequence
  chemically treated genomic DNA (Homo sapiens) CpG-island No: 24409
gggggcgtttcgggcgcggagggggcgtgggtatttttttagcgtcgtttttgtttttggtgattggagtcgtttgtacgttcgggttttcgatttttcggttgggtcgtcgttcgggcggagtttacgcgaaggcgacgttttttaaagtttcgcggtcgggtgggggcggggagaggcgtagttacgtttaggttgttttcgttcgttttaatagcgcgtacgcggttatcgagttggaggaggcggcgggcgtgagatcgggaatgtttggggttttcgtttttttcgtagttatttagtattcggtgtacgtttcgcgaggttagcggttgttttttttcggggttattgttgttagtgtcgtgagtatcgtttagttattgtttttgtgttttcgttagtcgtgtcgagtcgcgtatttagaggcgagggcgcgtatggggagttttcgttgatgttgttcgttgtcgcgtcgtttttcgaggttgcgtttcggggagttcggtttttcgagcgtttcggtttggtcggcgtttcggatttgagtgttttttatggaggcgttcgggtttttaggcggtcgcggcggagagtaattttcgagaggtgacggaggatgtcgtcgattggacgttcgcgttttgttttagtttcgaggcgcggtcgtcggaggcgtttgtttatcgtttgtaggattgcgacgcgttggttattatgggtgagtgagtgcgcgcgggaattcggtttataggggttcgcggcgcggtcgggatttcgtagtaggataaagggtttcgggtgttcgttttttggggagggttttgtagcgggattttcgcgcggggttgtttttgcgttttgggtttt

SEQ ID NO: 24410 - DNA, 870 bp, Artificial Sequence
  chemically treated genomic DNA (Homo sapiens) CpG-island No: 24410
aaaacccaaaacgcaaaaacaaccccgcgcgaaaatcccgctacaaaaccctccccaaaaaacgaacacccgaaaccctttatcctactacgaaatcccgaccgcgccgcgaacccctataaaccgaattcccgcgcgcactcactcacccataataaccaacgcgtcgcaatcctacaaacgataaacaaacgcctccgacgaccgcgcctcgaaactaaaacaaaacgcgaacgtccaatcgacgacatcctccgtcacctctcgaaaattactctccgccgcgaccgcctaaaaacccgaacgcctccataaaaaacactcaaatccgaaacgccgaccaaaccgaaacgctcgaaaaaccgaactccccgaaacgcaacctcgaaaaacgacgcgacaacgaacaacatcaacgaaaactccccatacgcgccctcgcctctaaatacgcgactcgacacgactaacgaaaacacaaaaacaataactaaacgatactcacgacactaacaacaataaccccgaaaaaaaacaaccgctaacctcgcgaaacgtacaccgaatactaaataactacgaaaaaaacgaaaaccccaaacattcccgatctcacgcccgccgcctcctccaactcgataaccgcgtacgcgctattaaaacgaacgaaaacaacctaaacgtaactacgcctctccccgcccccacccgaccgcgaaactttaaaaaacgtcgccttcgcgtaaactccgcccgaacgacgacccaaccgaaaaatcgaaaacccgaacgtacaaacgactccaatcaccaaaaacaaaaacgacgctaaaaaaatacccacgccccctccgcgcccgaaacgccccc

SEQ ID NO: 24411 - DNA, 870 bp, Artificial Sequence
  chemically treated genomic DNA (Homo sapiens) CpG-island No: 24411
gagatttagggcgtaagggtagtttcgcgcggggatttcgttgtagggttttttttaggaagcgggtattcggggttttttgttttattacggggtttcggtcgcgtcgcgagtttttgtgggtcgagttttcgcgcgtatttatttatttatggtgattagcgcgtcgtagttttgtaggcggtaggtaggcgttttcggcgatcgcgtttcggggttggggtagagcgcgggcgtttagtcggcggtatttttcgttatttttcgggagttgtttttcgtcgcggtcgtttgggggttcgggcgtttttatggggagtatttaggttcggggcgtcggttaggtcggagcgttcgggaagtcggatttttcgggacgtagtttcggagggcggcgcggtagcgggtagtattaacggaggttttttatgcgcgttttcgtttttgggtgcgcggttcggtacggttgacggagatatagagataatggttgggcggtgtttacggtattagtagtaatagtttcgggagggagtagtcgttggtttcgcggggcgtgtatcgagtgttggatggttgcgaggaaggcgggggttttaagtattttcggttttacgttcgtcgttttttttagttcggtggtcgcgtgcgcgttgttggggcgggcggaagtagtttgggcgtgattacgttttttttcgtttttattcggtcgcggggttttggggggcgtcgttttcgcgtgggtttcgttcgggcggcgatttagtcgaggagtcggagattcgggcgtgtaggcgattttagttattaagggtaggggcggcgttggggaggtgtttacgtttttttcgcgttcggggcgttttt

SEQ ID NO: 24412 - DNA, 870 bp, Artificial Sequence
  chemically treated genomic DNA (Homo sapiens) CpG-island No: 24412
aaaaacgccccgaacgcgaaaaaaacgtaaacacctccccaacgccgcccctacccttaataactaaaatcgcctacacgcccgaatctccgactcctcgactaaatcgccgcccgaacgaaacccacgcgaaaacgacgccccccaaaaccccgcgaccgaataaaaacgaaaaaaaacgtaatcacgcccaaactacttccgcccgccccaacaacgcgcacgcgaccaccgaactaaaaaaaacgacgaacgtaaaaccgaaaatacttaaaacccccgccttcctcgcaaccatccaacactcgatacacgccccgcgaaaccaacgactactccctcccgaaactattactactaataccgtaaacaccgcccaaccattatctctatatctccgtcaaccgtaccgaaccgcgcacccaaaaacgaaaacgcgcataaaaaacctccgttaatactacccgctaccgcgccgccctccgaaactacgtcccgaaaaatccgacttcccgaacgctccgacctaaccgacgccccgaacctaaatactccccataaaaacgcccgaacccccaaacgaccgcgacgaaaaacaactcccgaaaaataacgaaaaataccgccgactaaacgcccgcgctctaccccaaccccgaaacgcgatcgccgaaaacgcctacctaccgcctacaaaactacgacgcgctaatcaccataaataaataaatacgcgcgaaaactcgacccacaaaaactcgcgacgcgaccgaaaccccgtaataaaacaaaaaaccccgaatacccgcttcctaaaaaaaaccctacaacgaaatccccgcgcgaaactacccttacgccctaaatctc

SEQ ID NO: 24413 - DNA, 746 bp, Artificial Sequence
  chemically treated genomic DNA (Homo sapiens) CpG-island No: 24413
cgtcgcgcgcgtttttagcgtcgtttttagtaatagcgttaggaggaaagtttgtcgggtttagttattgcgttttatgtcgtcgtcgtcgtcgtcgtcgtcgtcgtcgcgcgttttacgcgtcgttcgtttatttagttttggagacgtcgggacggaggagttacgcggagagaaggcgagaagaaggcggacgggagcggaacgggttcgggagcgggtttgggagcgggttttcgtcgagaagtttcgcgggagacggcggtttttaaagttattttgggtcgcgggagcgcgggatcggggttgcgggcgtcgagagcgcgtcgtttgtcgttttcgtgcgtcgtcgtcgtttttgcgcgacgtttttcggttaggtttgggaaagcgcgcgtttcgttttatatttttttaaagtttcgggcgtcgcgtttttttcgtcgtcgttatacgtgtttcggtcgttttttcgttttcgcgcgtcgtttcgttcgtttttcgttttttcgggttggttcggcggtatttcgcgcggcgaggggcgtacgcgttttcggagttttcggttagcgttcggttcgtattcgggaggatagggaggggcgtcgtcggggagcgggacggggacgttgtcgaggatcgttgagttcgcgatttttttgcgagggacgttaaagtttcgtagagggtatttttcgtttagttgtttgaaggggaaggttagtttttttggtcgttagtgt

SEQ ID NO: 24414 - DNA, 746 bp, Artificial Sequence
  chemically treated genomic DNA (Homo sapiens) CpG-island No: 24414
acactaacgaccaaaaaaactaaccttccccttcaaacaactaaacgaaaaataccctctacgaaactttaacgtccctcgcaaaaaaatcgcgaactcaacgatcctcgacaacgtccccgtcccgctccccgacgacgcccctccctatcctcccgaatacgaaccgaacgctaaccgaaaactccgaaaacgcgtacgcccctcgccgcgcgaaataccgccgaaccaacccgaaaaaacgaaaaacgaacgaaacgacgcgcgaaaacgaaaaaacgaccgaaacacgtataacgacgacgaaaaaaacgcgacgcccgaaactttaaaaaaatataaaacgaaacgcgcgctttcccaaacctaaccgaaaaacgtcgcgcaaaaacgacgacgacgcacgaaaacgacaaacgacgcgctctcgacgcccgcaaccccgatcccgcgctcccgcgacccaaaataactttaaaaaccgccgtctcccgcgaaacttctcgacgaaaacccgctcccaaacccgctcccgaacccgttccgctcccgtccgccttcttctcgccttctctccgcgtaactcctccgtcccgacgtctccaaaactaaataaacgaacgacgcgtaaaacgcgcgacgacgacgacgacgacgacgacgacgacataaaacgcaataactaaacccgacaaactttcctcctaacgctattactaaaaacgacgctaaaaacgcgcgcgacg

SEQ ID NO: 24415 - DNA, 746 bp, Artificial Sequence
  chemically treated genomic DNA (Homo sapiens) CpG-island No: 24415
atattgacggttaaaggggttggtttttttttttagatagttggacgggaggtgttttttgcggggttttgacgtttttcgtagaagagtcgcgggtttagcggttttcgatagcgttttcgtttcgtttttcggcggcgtttttttttgttttttcgggtgcgaatcgggcgttggtcggggatttcggggacgcgtgcgtttttcgtcgcgcgaggtgtcgtcgagttagttcgagagggcggggggcgggcggggcggcgcgcgggggcgggggagcggtcgggatacgtgtggcggcggcgggggggacgcggcgttcggggttttaagaaggtgtggagcggggcgcgcgtttttttaggtttggtcgaggggcgtcgcgtagaggcggcggcggcgtacggaggcggtagacgacgcgttttcggcgttcgtagtttcggtttcgcgttttcgcggtttaaagtaattttgggagtcgtcgtttttcgcggaatttttcggcgggggttcgtttttaggttcgttttcgagttcgtttcgttttcgttcgtttttttttcgtttttttttcgcgtggttttttcgtttcggcgtttttaaaattgaatgagcgagcggcgcgtagggcgcgcggcggcggcggcggcggcggcggcggcggtatggagcgtagtggttgggttcggtagattttttttttagcgttgttgttgggggcgacgttgagggcgcgcgcggcg

SEQ ID NO: 24416 - DNA, 746 bp, Artificial Sequence
  chemically treated genomic DNA (Homo sapiens) CpG-island No: 24416
cgccgcgcgcgccctcaacgtcgcccccaacaacaacgctaaaaaaaaaatctaccgaacccaaccactacgctccataccgccgccgccgccgccgccgccgccgccgcgcgccctacgcgccgctcgctcattcaattttaaaaacgccgaaacgaaaaaaccacgcgaaaaaaaaacgaaaaaaaaacgaacgaaaacgaaacgaactcgaaaacgaacctaaaaacgaacccccgccgaaaaattccgcgaaaaacgacgactcccaaaattactttaaaccgcgaaaacgcgaaaccgaaactacgaacgccgaaaacgcgtcgtctaccgcctccgtacgccgccgccgcctctacgcgacgcccctcgaccaaacctaaaaaaacgcgcgccccgctccacaccttcttaaaaccccgaacgccgcgtcccccccgccgccgccacacgtatcccgaccgctcccccgcccccgcgcgccgccccgcccgccccccgccctctcgaactaactcgacgacacctcgcgcgacgaaaaacgcacgcgtccccgaaatccccgaccaacgcccgattcgcacccgaaaaaacaaaaaaaaacgccgccgaaaaacgaaacgaaaacgctatcgaaaaccgctaaacccgcgactcttctacgaaaaacgtcaaaaccccgcaaaaaacacctcccgtccaactatctaaaaaaaaaaaccaacccctttaaccgtcaatat

SEQ ID NO: 24417 - DNA, 535 bp, Artificial Sequence
  chemically treated genomic DNA (Homo sapiens) CpG-island No: 24417
agcggtttatcgagtttattcgagtttttttcgcgttttcgtgttaaaaggtcgtaaaggaatttcgttcgttcgttcgtttattcgtttattcgtttattcgtttatttttaatttttgcgagtttatggtttttcgaggtcgggacgcggggttttggggattgtttcgtcgtagtttaaaggaagacgtagaatttagtttttttagttttcggacgttttagcgtttcgggtttagcgggaggggcggggttcgtcgcgattggttgtcggagggagaggcgggtttgtgtggcggggatcgtgttgtaatggagtaggggcggcggggattcggaggtgagggttgcgagggtcgttcgggagggttcgggttgggaaaaggttttcgtcggagagtgtagttggaaaaggaggttatattgggaaacggttgtttgaggatagtgggtgggcgggtcgaggaaatggaatttaggaataaaggaaacggagtatgaagaaggggaagtttgttttttgttattggttgt

SEQ ID NO: 24418 - DNA, 535 bp, Artificial Sequence
  chemically treated genomic DNA (Homo sapiens) CpG-island No: 24418
acaaccaataacaaaaaacaaacttccccttcttcatactccgtttcctttattcctaaattccatttcctcgacccgcccacccactatcctcaaacaaccgtttcccaatataacctccttttccaactacactctccgacgaaaaccttttcccaacccgaaccctcccgaacgaccctcgcaaccctcacctccgaatccccgccgcccctactccattacaacacgatccccgccacacaaacccgcctctccctccgacaaccaatcgcgacgaaccccgcccctcccgctaaacccgaaacgctaaaacgtccgaaaactaaaaaaactaaattctacgtcttcctttaaactacgacgaaacaatccccaaaaccccgcgtcccgacctcgaaaaaccataaactcgcaaaaattaaaaataaacgaataaacgaataaacgaataaacgaacgaacgaacgaaattcctttacgaccttttaacacgaaaacgcgaaaaaaactcgaataaactcgataaaccgct

SEQ ID NO: 24419 - DNA, 535 bp, Artificial Sequence
  chemically treated genomic DNA (Homo sapiens) CpG-island No: 24419
ataattagtgataggaaatagatttttttttttttatatttcgttttttttatttttgaattttattttttcggttcgtttatttattgtttttagatagtcgttttttagtgtgatttttttttttagttgtatttttcggcggaggtttttttttagttcggattttttcgggcgattttcgtagtttttattttcgggttttcgtcgtttttgttttattatagtacgattttcgttatataggttcgttttttttttcgatagttaatcgcggcggatttcgtttttttcgttgggttcggggcgttagagcgttcgagagttaggggagttgaattttgcgtttttttttaggttgcggcgagataatttttagagtttcgcgtttcggtttcggggagttatggattcgtaggaattgaaggtgagcgggtgagcgggtgagcgagtgagcgggcgggcgggcggagtttttttgcggttttttggtacgggggcgcggagggagttcgagtaggttcggtaggtcgtt

SEQ ID NO: 24420 - DNA, 535 bp, Artificial Sequence
  chemically treated genomic DNA (Homo sapiens) CpG-island No: 24420
aacgacctaccgaacctactcgaactccctccgcgcccccgtaccaaaaaaccgcaaaaaaactccgcccgcccgcccgctcactcgctcacccgctcacccgctcaccttcaattcctacgaatccataactccccgaaaccgaaacgcgaaactctaaaaattatctcgccgcaacctaaaaaaaaacgcaaaattcaactcccctaactctcgaacgctctaacgccccgaacccaacgaaaaaaacgaaatccgccgcgattaactatcgaaaaaaaaaacgaacctatataacgaaaatcgtactataataaaacaaaaacgacgaaaacccgaaaataaaaactacgaaaatcgcccgaaaaaatccgaactaaaaaaaaacctccgccgaaaaatacaactaaaaaaaaaaatcacactaaaaaacgactatctaaaaacaataaataaacgaaccgaaaaaataaaattcaaaaataaaaaaaacgaaatataaaaaaaaaaaaatctatttcctatcactaattat

SEQ ID NO: 24421 - DNA, 609 bp, Artificial Sequence
  chemically treated genomic DNA (Homo sapiens) CpG-island No: 24421
tgcgatcgagtggtcgacgtttttagtgggagtgaggtttagtacgcgagttcggtttttttttttggagttaggtgggtgcgcgtttttaggtttattcggcggcgtaagcgggagaagttaggtgtttttaataaatatggtcgttacgttagcgttaattcggttcgggaggtcgcgttgtcgtttgggaatcgtaggtttggcgttattcggttcggaattacgtgatgtaggaggtgttcgaggcggcggggttcgcgcgggtggagtcgtttcggcgttcgagcggggtgggggttgttcggttgagatttttcggcgggtttcggtttttgcgtgtacgcgtttgcgtgttcgcgttcgcggttttggcgttgtcggtgaggagtcggggagcgaggcggggaggttgggagcggggcgttttttttgaggttagagggggttgggtagggcggtcggcgggaagggggtcggtcgcgcgttattagcgtttggtttttgagtcgcggcgttggcggtgggggtttttcggttcggttttttttggtagggttcggttgtgtaggtggtcgggtagggcgagggtttcgtagtttatcgaga

SEQ ID NO: 24422 - DNA, 609 bp, Artificial Sequence
  chemically treated genomic DNA (Homo sapiens) CpG-island No: 24422
tctcgataaactacgaaaccctcgccctacccgaccacctacacaaccgaaccctaccaaaaaaaaccgaaccgaaaaacccccaccgccaacgccgcgactcaaaaaccaaacgctaataacgcgcgaccgacccccttcccgccgaccgccctacccaaccccctctaacctcaaaaaaaacgccccgctcccaacctccccgcctcgctccccgactcctcaccgacaacgccaaaaccgcgaacgcgaacacgcaaacgcgtacacgcaaaaaccgaaacccgccgaaaaatctcaaccgaacaacccccaccccgctcgaacgccgaaacgactccacccgcgcgaaccccgccgcctcgaacacctcctacatcacgtaattccgaaccgaataacgccaaacctacgattcccaaacgacaacgcgacctcccgaaccgaattaacgctaacgtaacgaccatatttattaaaaacacctaacttctcccgcttacgccgccgaataaacctaaaaacgcgcacccacctaactccaaaaaaaaaaaccgaactcgcgtactaaacctcactcccactaaaaacgtcgaccactcgatcgca

SEQ ID NO: 24423 - DNA, 609 bp, Artificial Sequence
  chemically treated genomic DNA (Homo sapiens) CpG-island No: 24423
tttcggtgggttgcggggttttcgttttgttcggttatttgtatagtcgggttttgttaggaggggtcgggtcgaaaagtttttatcgttagcgtcgcggtttagggattaggcgttgatagcgcgcggtcgatttttttttcgtcggtcgttttgtttagttttttttggttttagaagaggcgtttcgtttttagttttttcgtttcgtttttcggttttttatcggtagcgttagaatcgcgagcgcgagtacgtaggcgcgtgtacgtagaggtcgggattcgtcgggaaattttaatcgggtagtttttatttcgttcgaacgtcgaggcggttttattcgcgcgagtttcgtcgtttcgggtattttttgtattacgtggtttcgggtcgggtgacgttaaatttgcgatttttaagcggtagcgcggtttttcgagtcgggttgacgttggcgtggcggttatgtttattgagggtatttggtttttttcgtttgcgtcgtcgggtgagtttgaaggcgcgtatttatttggttttaggaagagggatcgagttcgcgtgttgggttttatttttattgggggcgtcggttattcgatcgta

SEQ ID NO: 24424 - DNA, 609 bp, Artificial Sequence
  chemically treated genomic DNA (Homo sapiens) CpG-island No: 24424
tacgatcgaataaccgacgcccccaataaaaataaaacccaacacgcgaactcgatccctcttcctaaaaccaaataaatacgcgccttcaaactcacccgacgacgcaaacgaaaaaaaccaaataccctcaataaacataaccgccacgccaacgtcaacccgactcgaaaaaccgcgctaccgcttaaaaatcgcaaatttaacgtcacccgacccgaaaccacgtaatacaaaaaatacccgaaacgacgaaactcgcgcgaataaaaccgcctcgacgttcgaacgaaataaaaactacccgattaaaatttcccgacgaatcccgacctctacgtacacgcgcctacgtactcgcgctcgcgattctaacgctaccgataaaaaaccgaaaaacgaaacgaaaaaactaaaaacgaaacgcctcttctaaaaccaaaaaaaactaaacaaaacgaccgacgaaaaaaaaatcgaccgcgcgctatcaacgcctaatccctaaaccgcgacgctaacgataaaaacttttcgacccgacccctcctaacaaaacccgactatacaaataaccgaacaaaacgaaaaccccgcaacccaccgaaa

SEQ ID NO: 24425 - DNA, 501 bp, Artificial Sequence
  chemically treated genomic DNA (Homo sapiens) CpG-island No: 24425
cgggcgggtttttttttttttaacggagtcggtttttggggcgcgtcgcgttacgggaatcgattttcgtcgcggacgcgttatttttcggttttcgtagttttcggttttatcgtcgcggttcgtcggaagttgttgtcgttggttttcggttttttgagattggggtttcgttcgttttcgattcggttgtaagtgttgcggtgggagaaagtcgcgttcgtatcggaggggaagcgtcgttatgtttaagtattatgaggataagtcgtagggcggcgcgtgcgcgggtttgaaggaggatttgggcgcgtgtttgttgtagtcggattgtgtggtttaggtagcgcggtcgggcgttttcggtggtgacgatttttgttttaggtaggtttggttcggcggagggtagcgggtcgttcgcggcggcggttggagttaattatttcgggcgtaggttatagttcgggtttattgaacgtgcgtagatttattgagttg

SEQ ID NO: 24426 - DNA, 501 bp, Artificial Sequence
  chemically treated genomic DNA (Homo sapiens) CpG-island No: 24426
caactcaataaatctacgcacgttcaataaacccgaactataacctacgcccgaaataattaactccaaccgccgccgcgaacgacccgctaccctccgccgaaccaaacctacctaaaacaaaaatcgtcaccaccgaaaacgcccgaccgcgctacctaaaccacacaatccgactacaacaaacacgcgcccaaatcctccttcaaacccgcgcacgcgccgccctacgacttatcctcataatacttaaacataacgacgcttcccctccgatacgaacgcgactttctcccaccgcaacacttacaaccgaatcgaaaacgaacgaaaccccaatctcaaaaaaccgaaaaccaacgacaacaacttccgacgaaccgcgacgataaaaccgaaaactacgaaaaccgaaaaataacgcgtccgcgacgaaaatcgattcccgtaacgcgacgcgccccaaaaaccgactccgttaaaaaaaaaaaaacccgcccg

SEQ ID NO: 24427 - DNA, 501 bp, Artificial Sequence
  chemically treated genomic DNA (Homo sapiens) CpG-island No: 24427
tagtttagtggatttgcgtacgtttagtgagttcgagttgtgatttacgttcgggatggttaattttaatcgtcgtcgcgggcgattcgttgtttttcgtcgagttaggtttgtttgggataggggtcgttattatcgggagcgttcggtcgcgttatttggattatatagttcgattgtagtagatacgcgtttaggtttttttttaggttcgcgtacgcgtcgttttgcggtttgtttttataatatttaggtatgacggcgtttttttttcgatgcggacgcgatttttttttatcgtaatatttgtaatcgggtcgggagcgagcgaggttttagttttaggggatcggaagttagcggtaataattttcggcgggtcgcggcggtagggtcgaggattacgggggtcgagaggtggcgcgttcgcggcggaagtcggttttcgtgacgcggcgcgttttaagggtcggtttcgttgagggaagggaagttcgttcg

SEQ ID NO: 24428 - DNA, 501 bp, Artificial Sequence
  chemically treated genomic DNA (Homo sapiens) CpG-island No: 24428
cgaacgaacttcccttccctcaacgaaaccgacccttaaaacgcgccgcgtcacgaaaaccgacttccgccgcgaacgcgccacctctcgacccccgtaatcctcgaccctaccgccgcgacccgccgaaaattattaccgctaacttccgatcccctaaaactaaaacctcgctcgctcccgacccgattacaaatattacgataaaaaaaaatcgcgtccgcatcgaaaaaaaaacgccgtcatacctaaatattataaaaacaaaccgcaaaacgacgcgtacgcgaacctaaaaaaaaacctaaacgcgtatctactacaatcgaactatataatccaaataacgcgaccgaacgctcccgataataacgacccctatcccaaacaaacctaactcgacgaaaaacaacgaatcgcccgcgacgacgattaaaattaaccatcccgaacgtaaatcacaactcgaactcactaaacgtacgcaaatccactaaacta

SEQ ID NO: 24429 - DNA, 705 bp, Artificial Sequence
  chemically treated genomic DNA (Homo sapiens) CpG-island No: 24429
aggtatcgcgtttgcgtttcgcggttacgcgttcgttcggtattcggttttttgttggggcggtcgcgtttttacggggttgggggtcggtcgggttcggattgtttttaaaagacgttatcgtaggtggattattggtatcgttaggtagtgtaatttttatgaaaatcgcgggcgtcgtttatattcgttttagcggggattttggacgcgttttcgcgttcgttgttcgttttcggtttcggttttcgcggcggtcgcgtcgttttttgttcggttcggtttatttatttggcgtttttcggttttcggcgttagtttcgttgtttcgtcgggttgcgcgttagagtttcgtagtagtagtagcgtcgtcgtttggttgtgaagtcgcgggttgcgggttcggttttaggtgttggtttttttgtttcggtttacggagttcgattcggcggtaaattagtagcgaattttttacgcgcgtcgtagttttagttagtcgtcgtcgttttagacgtcgggcgtagtttcgttttggtttcgtttttttgtcgcgtatgcgcgttgagggttcggttcgcgttttgcgattttcgttttattattagttcgagttgggttcgttttttgagatagtagggtcggtgatcgagttgttcgcgttaatttttattgttaggtttttataagattttattttatttt

SEQ ID NO: 24430 - DNA, 705 bp, Artificial Sequence
  chemically treated genomic DNA (Homo sapiens) CpG-island No: 24430
aaaataaaataaaatcttataaaaacctaacaataaaaattaacgcgaacaactcgatcaccgaccctactatctcaaaaaacgaacccaactcgaactaataataaaacgaaaatcgcaaaacgcgaaccgaaccctcaacgcgcatacgcgacaaaaaaacgaaaccaaaacgaaactacgcccgacgtctaaaacgacgacgactaactaaaactacgacgcgcgtaaaaaattcgctactaatttaccgccgaatcgaactccgtaaaccgaaacaaaaaaaccaacacctaaaaccgaacccgcaacccgcgacttcacaaccaaacgacgacgctactactactacgaaactctaacgcgcaacccgacgaaacaacgaaactaacgccgaaaaccgaaaaacgccaaataaataaaccgaaccgaacaaaaaacgacgcgaccgccgcgaaaaccgaaaccgaaaacgaacaacgaacgcgaaaacgcgtccaaaatccccgctaaaacgaatataaacgacgcccgcgattttcataaaaattacactacctaacgataccaataatccacctacgataacgtcttttaaaaacaatccgaacccgaccgacccccaaccccgtaaaaacgcgaccgccccaacaaaaaaccgaataccgaacgaacgcgtaaccgcgaaacgcaaacgcgatacct

SEQ ID NO: 24431 - DNA, 705 bp, Artificial Sequence
  chemically treated genomic DNA (Homo sapiens) CpG-island No: 24431
aggatagggtgggattttgtgggaatttagtagtaggaattggcgcgagtagttcggttatcggttttattgttttagagggcggatttagttcgggttggtagtggggcgggggtcgtagggcgcgggtcgggtttttagcgcgtatgcgcgataagggggcggggttagggcggggttgcgttcggcgtttagagcggcggcggttggttagggttgcggcgcgcgtggagggttcgttgttggtttgtcgtcgggtcgggtttcgtgggtcggggtaggaggattagtatttgaggtcgggttcgtagttcgcgattttatagttaggcggcggcgttgttgttgttgcggggttttggcgcgtagttcggcgggatagcggggttggcgtcgggggtcggggagcgttaggtaggtgggtcgggtcgggtaggaggcgacgcggtcgtcgcgggggtcggggtcggggacggatagcgggcgcgggggcgcgtttaaggttttcgttggggcggatgtggacggcgttcgcggtttttatggaaattgtattgtttaacggtgttagtggtttatttgcggtggcgttttttgagaataattcgagttcggtcgatttttagtttcgtgaagacgcggtcgttttagtagggagtcgggtgtcgagcgggcgcgtggtcgcgggacgtagacgcggtgttt

SEQ ID NO: 24432 - DNA, 705 bp, Artificial Sequence
  chemically treated genomic DNA (Homo sapiens) CpG-island No: 24432
aaacaccgcgtctacgtcccgcgaccacgcgcccgctcgacacccgactccctactaaaacgaccgcgtcttcacgaaactaaaaatcgaccgaactcgaattattctcaaaaaacgccaccgcaaataaaccactaacaccgttaaacaatacaatttccataaaaaccgcgaacgccgtccacatccgccccaacgaaaaccttaaacgcgcccccgcgcccgctatccgtccccgaccccgacccccgcgacgaccgcgtcgcctcctacccgacccgacccacctacctaacgctccccgacccccgacgccaaccccgctatcccgccgaactacgcgccaaaaccccgcaacaacaacaacgccgccgcctaactataaaatcgcgaactacgaacccgacctcaaatactaatcctcctaccccgacccacgaaacccgacccgacgacaaaccaacaacgaaccctccacgcgcgccgcaaccctaaccaaccgccgccgctctaaacgccgaacgcaaccccgccctaaccccgcccccttatcgcgcatacgcgctaaaaacccgacccgcgccctacgacccccgccccactaccaacccgaactaaatccgccctctaaaacaataaaaccgataaccgaactactcgcgccaattcctactactaaattcccacaaaatcccaccctatcct

SEQ ID NO: 24433 - DNA, 871 bp, Artificial Sequence
  chemically treated genomic DNA (Homo sapiens) CpG-island No: 24433
ggggtttcggtcgcgtcgcgagtttttgtgggtcgagttttcgcgcgtatttatttatttatggtgattagcgcgtcgtagttttgtaggcggtaggtaggcgttttcggcgatcgcgtttcggggttggggtagagcgcgggcgtttagtcggcggtatttttcgttatttttcgggagttgtttttcgtcgcggtcgtttgggtcggttcgggcgtttttatggggaggtatttaggttcggggcgtcgggttaggtcggagcgttcgggaagtcggatttttcgggacgtagtttcggagggcgcgcggtagtcgggtagttattaacggaggttttttatgcgcgtattcgtttttgggtgcgcggttcggtacggttgacggagatatagagataatggttgggcggtgtttacggtattagtagtaatagtttcgggatgagtagtcgttggtttcgcggggcgtgtatcgagtgttggatggttgcgaggaaggcgggggtttaagtattttcggttttacgttcgtcgttttttttagttcggtggtcgcgtgcgcgttgttggggcgggcggaagtagtttgggcgtgattacgttttttttcgtttttattcggtcgcggggttttggggggcgtcgttttcgcgtgggtttcgcgggcggcgatttagtcgaggagtcggagattcgggcgtgtaggcgattttagttattaagggtaggggcggcgttggggaggtgtttacgtttttttcgcgttcggggcgttttcggggtgggatttaggatgattttttttcggagtcgtattggcgggttattcgcgttgttgtatttaaattcggaagatggggaggttgggt

SEQ ID NO: 24434 - DNA, 871 bp, Artificial Sequence
  chemically treated genomic DNA (Homo sapiens) CpG-island No: 24434
acccaacctccccatcttccgaatttaaatacaacaacgcgaataacccgccaatacgactccgaaaaaaaatcatcctaaatcccaccccgaaaacgccccgaacgcgaaaaaaacgtaaacacctccccaacgccgcccctacccttaataactaaaatcgcctacacgcccgaatctccgactcctcgactaaatcgccgcccgcgaaacccacgcgaaaacgacgccccccaaaaccccgcgaccgaataaaaacgaaaaaaaacgtaatcacgcccaaactacttccgcccgccccaacaacgcgcacgcgaccaccgaactaaaaaaaacgacgaacgtaaaaccgaaaatacttaaacccccgccttcctcgcaaccatccaacactcgatacacgccccgcgaaaccaacgactactcatcccgaaactattactactaataccgtaaacaccgcccaaccattatctctatatctccgtcaaccgtaccgaaccgcgcacccaaaaacgaatacgcgcataaaaaacctccgttaataactacccgactaccgcgcgccctccgaaactacgtcccgaaaaatccgacttcccgaacgctccgacctaacccgacgccccgaacctaaatacctccccataaaaacgcccgaaccgacccaaacgaccgcgacgaaaaacaactcccgaaaaataacgaaaaataccgccgactaaacgcccgcgctctaccccaaccccgaaacgcgatcgccgaaaacgcctacctaccgcctacaaaactacgacgcgctaatcaccataaataaataaatacgcgcgaaaactcgacccacaaaaactcgcgacgcgaccgaaacccc

SEQ ID NO: 24435 - DNA, 871 bp, Artificial Sequence
  chemically treated genomic DNA (Homo sapiens) CpG-island No: 24435
atttagtttttttatttttcgggtttgggtgtagtaacgcgggtggttcgttagtgcgatttcggggagaagttattttgggttttatttcgggggcgtttcgggcgcggagggggcgtgggtatttttttagcgtcgtttttgtttttggtgattggagtcgtttgtacgttcgggttttcgatttttcggttgggtcgtcgttcgcggagtttacgcgaaggcgacgttttttaaagtttcgcggtcgggtgggggcggggagaggcgtagttacgtttaggttgttttcgttcgttttaatagcgcgtacgcggttatcgagttggaggaggcggcgggcgtgagatcgggaatgtttgggttttcgtttttttcgtagttatttagtattcggtgtacgtttcgcgaggttagcggttgtttatttcggggttattgttgttagtgtcgtgagtatcgtttagttattgtttttgtgttttcgttagtcgtgtcgagtcgcgtatttagaggcgagtgcgcgtatggggagttttcgttgatgattgttcggttgtcgcgcgtttttcgaggttgcgtttcggggagttcggtttttcgagcgtttcggtttggttcggcgtttcggatttgagtgtttttttatggaggcgttcgggtcggtttaggcggtcgcggcggagagtaattttcgagaggtgacggaggatgtcgtcgattgggcgttcgcgttttgttttagtttcgaggcgcggtcgtcggaggcgtttgtttatcgtttgtaggattgcgacgcgttggttattatgggtgagtgagtgcgcgcgggaattcggtttataggggttcgcggcgcggtcgggatttt

SEQ ID NO: 24436 - DNA, 871 bp, Artificial Sequence
  chemically treated genomic DNA (Homo sapiens) CpG-island No: 24436
aaaatcccgaccgcgccgcgaacccctataaaccgaattcccgcgcgcactcactcacccataataaccaacgcgtcgcaatcctacaaacgataaacaaacgcctccgacgaccgcgcctcgaaactaaaacaaaacgcgaacgcccaatcgacgacatcctccgtcacctctcgaaaattactctccgccgcgaccgcctaaaccgacccgaacgcctccataaaaaaacactcaaatccgaaacgccgaaccaaaccgaaacgctcgaaaaaccgaactccccgaaacgcaacctcgaaaaacgcgcgacaaccgaacaatcatcaacgaaaactccccatacgcgcactcgcctctaaatacgcgactcgacacgactaacgaaaacacaaaaacaataactaaacgatactcacgacactaacaacaataaccccgaaataaacaaccgctaacctcgcgaaacgtacaccgaatactaaataactacgaaaaaaacgaaaacccaaacattcccgatctcacgcccgccgcctcctccaactcgataaccgcgtacgcgctattaaaacgaacgaaaacaacctaaacgtaactacgcctctccccgcccccacccgaccgcgaaactttaaaaaacgtcgccttcgcgtaaactccgcgaacgacgacccaaccgaaaaatcgaaaacccgaacgtacaaacgactccaatcaccaaaaacaaaaacgacgctaaaaaaatacccacgccccctccgcgcccgaaacgcccccgaaataaaacccaaaataacttctccccgaaatcgcactaacgaaccacccgcgttactacacccaaacccgaaaaataaaaaaactaaat

SEQ ID NO: 24437 - DNA, 1182 bp, Artificial Sequence
  chemically treated genomic DNA (Homo sapiens) CpG-island No: 24437
attagttcggcgtcgggttttcgttcgcgttcgtgtttcggcgcgtttcggatttcgatatttttttcggttcgggattcgtcgtattttttttgtttgttttttcggggttagtcgcgtcgttttatttcgtagtcgcgcgcggtgtagcggtttcggtttttcgcgtttttttcgatttttgtagcgtcgtattcgtaggttttcgggtttttagtttcggcgtagcgcgagttgtcgtttcgtatttcgcgggcgcgaggttttagtttagttcgtttttttatagtttcggcggcggtcgtagatttttattttgtttattttttcgtcggagtaggggtcgtcgggaaggttttttgcggttttattttttcgtacgtttcggtttagttttttcggttgaggtagcggtagcgtttatttaggtttcggagttattttcgcggcgaacgttcgtagcgttcggttcgcgtcgttttttcgttcggtacgcgtagcgttcgttttcggcgcgagggcgcgagggcggagggcggagggcggatgggcgggcgcgcgtttagcgcgagcgcgcggtcgggggcgtggttttcgcgcgcggggagggggcgggagcggtcgagtaatttttttttatttcgttttcgcggtcgcgtttcgtttatcggtcgtcggcgggtttcgggtaggcgggaagttggttttatttaggtttttttcgttcgttggcgtcgggtcgggtgtttttttattcgtaggtattcgtcggcggggtgttcggttcgacgtgattattcgataaagaatgtaaagagttatttcgtgaattatttttcgcgtttgggttataagtttgtgttcgagtgattttcgtgaatttcgtaagttagtttagtcgcggcgtgcgtttcgcgttgtattaggtgtttgtgggcgtacgattacggttacggcgtttgggttcgaggcgttttaaatttagcggggaaaatagttatgtatataattaagttcgatgattcgtgtagagttaagttacggtgcgatgttggtatagaagttagagacgatttttgtttggacgtcgtagagggttagaggcggtatttatggttaatttcgaaggaagaaaaagaagttttaggaggaaaaagggaggatattagggttgggaaaata

SEQ ID NO: 24438 - DNA, 1182 bp, Artificial Sequence
  chemically treated genomic DNA (Homo sapiens) CpG-island No: 24438
tattttcccaaccctaatatcctccctttttcctcctaaaacttctttttcttccttcgaaattaaccataaataccgcctctaaccctctacgacgtccaaacaaaaatcgtctctaacttctataccaacatcgcaccgtaacttaactctacacgaatcatcgaacttaattatatacataactattttccccgctaaatttaaaacgcctcgaacccaaacgccgtaaccgtaatcgtacgcccacaaacacctaatacaacgcgaaacgcacgccgcgactaaactaacttacgaaattcacgaaaatcactcgaacacaaacttataacccaaacgcgaaaaataattcacgaaataactctttacattctttatcgaataatcacgtcgaaccgaacaccccgccgacgaatacctacgaataaaaaaacacccgacccgacgccaacgaacgaaaaaaacctaaataaaaccaacttcccgcctacccgaaacccgccgacgaccgataaacgaaacgcgaccgcgaaaacgaaataaaaaaaaattactcgaccgctcccgccccctccccgcgcgcgaaaaccacgcccccgaccgcgcgctcgcgctaaacgcgcgcccgcccatccgccctccgccctccgccctcgcgccctcgcgccgaaaacgaacgctacgcgtaccgaacgaaaaaacgacgcgaaccgaacgctacgaacgttcgccgcgaaaataactccgaaacctaaataaacgctaccgctacctcaaccgaaaaaactaaaccgaaacgtacgaaaaaataaaaccgcaaaaaaccttcccgacgacccctactccgacgaaaaaataaacaaaataaaaatctacgaccgccgccgaaactataaaaaaacgaactaaactaaaacctcgcgcccgcgaaatacgaaacgacaactcgcgctacgccgaaactaaaaacccgaaaacctacgaatacgacgctacaaaaatcgaaaaaaacgcgaaaaaccgaaaccgctacaccgcgcgcgactacgaaataaaacgacgcgactaaccccgaaaaaacaaacaaaaaaaatacgacgaatcccgaaccgaaaaaaatatcgaaatccgaaacgcgccgaaacacgaacgcgaacgaaaacccgacgccgaactaat

SEQ ID NO: 24439 - DNA, 1182 bp, Artificial Sequence
  chemically treated genomic DNA (Homo sapiens) CpG-island No: 24439
tgtttttttagttttaatgttttttttttttttttttaggattttttttttttttttcgaggttgattataaatgtcgtttttagttttttgcggcgtttaagtagaagtcgtttttagtttttgtgttagtatcgtatcgtggtttggttttgtacgggttatcggatttggttgtgtatatggttgtttttttcgttaagtttggggcgtttcgagtttaggcgtcgtgatcgtgatcgtgcgtttataggtatttggtgtagcgcggggcgtacgtcgcggttgggttagtttgcggagtttacgggggttattcgggtataggtttgtgatttaggcgcggagaatgatttacggggtggttttttgtattttttgtcgggtagttacgtcgggtcgggtatttcgtcgacggatatttgcggatggaaagatattcggttcgacgttagcgagcgggagaagtttggatggagttagtttttcgtttgttcggaattcgtcggcgatcggtgggcggggcgcggtcgcgggggcggggtggaggggggttgttcggtcgttttcgtttttttttcgcgcgcggaagttacgttttcggtcgcgcgttcgcgttgggcgcgcgttcgtttattcgtttttcgtttttcgttttcgcgttttcgcgtcgggggcgggcgttgcgcgtgtcgggcggagaagcggcgcgagtcgggcgttgcgaacgttcgtcgcgggggtggtttcggggtttgagtaggcgttgtcgttgttttagtcgagggggttgggtcggagcgtgcggaggagtgaggtcgtaggagattttttcgacgatttttgtttcggcggggaagtgagtaaggtgggggtttgcggtcgtcgtcggggttgtggggagacgagttgggttggagtttcgcgttcgcgaggtgcgggacggtagttcgcgttgcgtcgggattggggattcgggagtttgcgggtgcggcgttgtaggagtcggggagggcgcggggagtcggggtcgttgtatcgcgcgcggttgcgaggtgggacggcgcggttagtttcggagggataggtagaggggatgcggcggatttcgggtcgggaggggtatcggggttcggaacgcgtcggggtacgggcgcgagcgggggttcggcgtcgggttgat

SEQ ID NO: 24440 - DNA, 1182 bp, Artificial Sequence
  chemically treated genomic DNA (Homo sapiens) CpG-island No: 24440
atcaacccgacgccgaacccccgctcgcgcccgtaccccgacgcgttccgaaccccgatacccctcccgacccgaaatccgccgcatcccctctacctatccctccgaaactaaccgcgccgtcccacctcgcaaccgcgcgcgatacaacgaccccgactccccgcgccctccccgactcctacaacgccgcacccgcaaactcccgaatccccaatcccgacgcaacgcgaactaccgtcccgcacctcgcgaacgcgaaactccaacccaactcgtctccccacaaccccgacgacgaccgcaaacccccaccttactcacttccccgccgaaacaaaaatcgtcgaaaaaatctcctacgacctcactcctccgcacgctccgacccaaccccctcgactaaaacaacgacaacgcctactcaaaccccgaaaccacccccgcgacgaacgttcgcaacgcccgactcgcgccgcttctccgcccgacacgcgcaacgcccgcccccgacgcgaaaacgcgaaaacgaaaaacgaaaaacgaataaacgaacgcgcgcccaacgcgaacgcgcgaccgaaaacgtaacttccgcgcgcgaaaaaaaaacgaaaacgaccgaacaacccccctccaccccgcccccgcgaccgcgccccgcccaccgatcgccgacgaattccgaacaaacgaaaaactaactccatccaaacttctcccgctcgctaacgtcgaaccgaatatctttccatccgcaaatatccgtcgacgaaatacccgacccgacgtaactacccgacaaaaaatacaaaaaaccaccccgtaaatcattctccgcgcctaaatcacaaacctatacccgaataacccccgtaaactccgcaaactaacccaaccgcgacgtacgccccgcgctacaccaaatacctataaacgcacgatcacgatcacgacgcctaaactcgaaacgccccaaacttaacgaaaaaaacaaccatatacacaaccaaatccgataacccgtacaaaaccaaaccacgatacgatactaacacaaaaactaaaaacgacttctacttaaacgccgcaaaaaactaaaaacgacatttataatcaacctcgaaaaaaaaaaaaaaaatcctaaaaaaaaaaaaaaaaaacattaaaactaaaaaaaca

SEQ ID NO: 24441 - DNA, 1236 bp, Artificial Sequence
  chemically treated genomic DNA (Homo sapiens) CpG-island No: 24441
gttatatttcggggtaaatggcgcgggggaagagttttttttttagttttttcgttttcgatcgtttcgtaaattttagagcgaggtacgcgtttttaaaggtaggttcgcggtttttttacgttttggcgttcggtttttcgtatttagtgtttttatagttgtgttcgggtatagaggcgcggttagatcgtatttcgcgggttgtaggtgtttcggtttttggcggcgtcggtgcggttcggaggtgggagttcgcggagttattgtagtagttggagtttcgtcgagtttttagttttaaggtagggtaggagcgcgtatcggtcggaggtttatgttgagtatcgttcgcgtcggtgttcggtagtttttttaattgtgtggttttcgcgttggtagagaggtacggattgtaggtcgtgggtagttttattttttcgcgttttttttttttggcgttgttcgttgtttttcgttttttttttgtttttttttcgttttcgttttagcgtttcgttgatttcgtttttttttttttgttttttgtttttgtattttttttttttcggttttttgattttttcgtttttatttttttttttttttttttttttgttcgtttcgcgtttttttatcgttttcgtcgttttcgtcgtcgcggttgttatttcgtttttcgcgtcgtacggagttttagtaataatttcggcgcggcggcggagtcgttgtggggaattttttcgcgttttgtttgggtcgggttttttttgttcgttcgtacgttgtcggtcggggatttttcggtggtttttagtttttcggagcgtttttggatgaagtttcgcgcgcgcggatggcggggtttggcggcgttgtggatgttgttggcgtaggtggtcgagtaggtgagtttcgggcgtttttattagcgcggaaatcgcgggttcggatagttggaggcgagtttttcgcggtttttttttcgcggatttcgtcgttttatcgcgatgtcgtcgttgtttttcgtaggtatttgcgtgcgttatgggattcgtagcggtagcgtttgggagttcgagcgtttcgcgtttttttttattcgcggagcggtcgggttggatggaaaagggcggtaagttcgtgaggtgggggtttttaatttttgttatttagtagttcgtaattttcgtgtcgttggtttattaggtgtagtgaatgtttatgattttgtgg

SEQ ID NO: 24442 - DNA, 1236 bp, Artificial Sequence
  chemically treated genomic DNA (Homo sapiens) CpG-island No: 24442
ccacaaaatcataaacattcactacacctaataaaccaacgacacgaaaattacgaactactaaataacaaaaattaaaaacccccacctcacgaacttaccgcccttttccatccaacccgaccgctccgcgaataaaaaaaaacgcgaaacgctcgaactcccaaacgctaccgctacgaatcccataacgcacgcaaatacctacgaaaaacaacgacgacatcgcgataaaacgacgaaatccgcgaaaaaaaaaccgcgaaaaactcgcctccaactatccgaacccgcgatttccgcgctaataaaaacgcccgaaactcacctactcgaccacctacgccaacaacatccacaacgccgccaaaccccgccatccgcgcgcgcgaaacttcatccaaaaacgctccgaaaaactaaaaaccaccgaaaaatccccgaccgacaacgtacgaacgaacaaaaaaaacccgacccaaacaaaacgcgaaaaaattccccacaacgactccgccgccgcgccgaaattattactaaaactccgtacgacgcgaaaaacgaaataacaaccgcgacgacgaaaacgacgaaaacgataaaaaaacgcgaaacgaacaaaaaaaaaaaaaaaaaaaaaaataaaaacgaaaaaatcaaaaaaccgaaaaaaaaaaaatacaaaaacaaaaaacaaaaaaaaaaaaacgaaatcaacgaaacgctaaaacgaaaacgaaaaaaaaacaaaaaaaaaacgaaaaacaacgaacaacgccaaaaaaaaaaaacgcgaaaaaataaaactacccacgacctacaatccgtacctctctaccaacgcgaaaaccacacaattaaaaaaactaccgaacaccgacgcgaacgatactcaacataaacctccgaccgatacgcgctcctaccctaccttaaaactaaaaactcgacgaaactccaactactacaataactccgcgaactcccacctccgaaccgcaccgacgccgccaaaaaccgaaacacctacaacccgcgaaatacgatctaaccgcgcctctatacccgaacacaactataaaaacactaaatacgaaaaaccgaacgccaaaacgtaaaaaaaccgcgaacctacctttaaaaacgcgtacctcgctctaaaatttacgaaacgatcgaaaacgaaaaaactaaaaaaaaaactcttcccccgcgccatttaccccgaaatataac

SEQ ID NO: 24443 - DNA, 1236 bp, Artificial Sequence
  chemically treated genomic DNA (Homo sapiens) CpG-island No: 24443
ttatagagttatgaatatttattgtatttaataaattagcggtacggagattacgagttgttaaatggtaaggattagaagtttttattttacggatttatcgtttttttttatttagttcggtcgtttcgcgggtggaggaggacgcgggacgttcgggtttttaggcgttgtcgttgcgggttttatggcgtacgtaggtgtttgcggaaaatagcggcgatatcgcggtgagacggcggggttcgcgggagaggagtcgcgggggattcgtttttagttgttcggattcgcggttttcgcgttggtgggagcgttcgggatttatttgttcggttatttgcgttagtagtatttatagcgtcgttaagtttcgttattcgcgcgcgcggggttttatttaggagcgtttcgaggggttaggggttatcggagggttttcggtcggtagcgtgcgagcgggtagggaggattcgatttaggtagagcgcgggaggattttttatagcgatttcgtcgtcgcgtcggggttattattgaagtttcgtgcggcgcggggggcggagtggtagtcgcggcggcgggggcggcgggagcggtgggagagcgcggggcgggtaggggagagaggaggggaggaggtgagggcgggggggttagaggatcgaggaggggagagtgtagggataaagagtagaggggaggaggcgaggttagcggggcgttgaggcggaggcgagaggggagtagagggaaggcgggagatagcgggtagcgttagaggaggaggacgcgggaagatggagttgtttacggtttgtagttcgtgtttttttgttagcgcggggattatatagttggagaggttgtcgggtatcggcgcgggcgatgtttagtatggattttcggtcggtgcgcgtttttgttttgttttggggttggggattcggcgggattttagttattgtagtggtttcgcgggtttttattttcgggtcgtatcggcgtcgttagaggtcgggatatttgtagttcgcggagtgcggtttggtcgcgtttttgtgttcgggtatagttgtggggatattgggtgcggaaaatcgggcgttaggacgtgggagagtcgcggatttgtttttaaaggcgcgtgtttcgttttggagtttgcggagcgatcggagacggggaggttgaggaggaaatttttttttcgcgttatttgtttcgagatgtggt

SEQ ID NO: 24444 - DNA, 1236 bp, Artificial Sequence
  chemically treated genomic DNA (Homo sapiens) CpG-island No: 24444
accacatctcgaaacaaataacgcgaaaaaaaaatttcctcctcaacctccccgtctccgatcgctccgcaaactccaaaacgaaacacgcgcctttaaaaacaaatccgcgactctcccacgtcctaacgcccgattttccgcacccaatatccccacaactatacccgaacacaaaaacgcgaccaaaccgcactccgcgaactacaaatatcccgacctctaacgacgccgatacgacccgaaaataaaaacccgcgaaaccactacaataactaaaatcccgccgaatccccaaccccaaaacaaaacaaaaacgcgcaccgaccgaaaatccatactaaacatcgcccgcgccgatacccgacaacctctccaactatataatccccgcgctaacaaaaaaacacgaactacaaaccgtaaacaactccatcttcccgcgtcctcctcctctaacgctacccgctatctcccgccttccctctactcccctctcgcctccgcctcaacgccccgctaacctcgcctcctcccctctactctttatccctacactctcccctcctcgatcctctaacccccccgccctcacctcctcccctcctctctcccctacccgccccgcgctctcccaccgctcccgccgcccccgccgccgcgactaccactccgccccccgcgccgcacgaaacttcaataataaccccgacgcgacgacgaaatcgctataaaaaatcctcccgcgctctacctaaatcgaatcctccctacccgctcgcacgctaccgaccgaaaaccctccgataacccctaacccctcgaaacgctcctaaataaaaccccgcgcgcgcgaataacgaaacttaacgacgctataaatactactaacgcaaataaccgaacaaataaatcccgaacgctcccaccaacgcgaaaaccgcgaatccgaacaactaaaaacgaatcccccgcgactcctctcccgcgaaccccgccgtctcaccgcgatatcgccgctattttccgcaaacacctacgtacgccataaaacccgcaacgacaacgcctaaaaacccgaacgtcccgcgtcctcctccacccgcgaaacgaccgaactaaataaaaaaaaacgataaatccgtaaaataaaaacttctaatccttaccatttaacaactcgtaatctccgtaccgctaatttattaaatacaataaatattcataactctataa

SEQ ID NO: 24445 - DNA, 518 bp, Artificial Sequence
  chemically treated genomic DNA (Homo sapiens) CpG-island No: 24445
atgtcgttaacgtggttaacgattagcggaatttcggttttttttgtcgtttttagtagattttttgttagacgtgttgttagtttatttagcgtttcgtgaacgttcggttgcgcgattttatttagataggcgaaattcgttgttatcgtaatcgggttatcggaaagcgtattcgtttgatagatcggattcgtcggggttagcgtatttattatattacgacgattatcgaatgcgtttatcggtattttatcgtcgatgattttgtcgaggtaggttaaatttggtattacgtcgtaataattttgtgcgttagttagcgttacgcggaaatcggttattattttatcgatgattagtaacgcgttaaattcgtcgtatagcgcgcgtagatttggtaggaattttggtagcggcggaatatagtttatattgtttgttatcggttcgacgataatataggtaattttttgcgggtattgtttaaatgcggcgcgtatagaagttagattttt

SEQ ID NO: 24446 - DNA, 518 bp, Artificial Sequence
  chemically treated genomic DNA (Homo sapiens) CpG-island No: 24446
aaaaatctaacttctatacgcgccgcatttaaacaatacccgcaaaaaattacctatattatcgtcgaaccgataacaaacaatataaactatattccgccgctaccaaaattcctaccaaatctacgcgcgctatacgacgaatttaacgcgttactaatcatcgataaaataataaccgatttccgcgtaacgctaactaacgcacaaaattattacgacgtaataccaaatttaacctacctcgacaaaatcatcgacgataaaataccgataaacgcattcgataatcgtcgtaatataataaatacgctaaccccgacgaatccgatctatcaaacgaatacgctttccgataacccgattacgataacaacgaatttcgcctatctaaataaaatcgcgcaaccgaacgttcacgaaacgctaaataaactaacaacacgtctaacaaaaaatctactaaaaacgacaaaaaaaaccgaaattccgctaatcgttaaccacgttaacgacat

SEQ ID NO: 24447 - DNA, 518 bp, Artificial Sequence
  chemically treated genomic DNA (Homo sapiens) CpG-island No: 24447
agagatttggtttttgtacgcgtcgtatttgagtaatattcgtaagagattgtttgtattatcgtcgagtcggtggtaggtaatatgaattgtgtttcgtcgttgttagagtttttgttaggtttgcgcgcgttgtgcgacgaatttggcgcgttgttgattatcgatgaagtgatgatcggttttcgcgtagcgttagttggcgtataggattattacggcgtagtgttagatttaatttgtttcggtaaaattatcggcggtggaatgtcggtaggcgtattcggtggtcgtcgtgatgtaatggatgcgttggtttcgacgggttcggtttattaggcgggtacgtttttcggtaattcgattgcgatggtagcgggtttcgtttgtttgaatgaagtcgcgtagtcgggcgtttacgaaacgttggatgagttgataatacgtttggtagaaggtttgttggaagcggtagaagaagtcggaatttcgttggtcgttaattacgttggcggtat

SEQ ID NO: 24448 - DNA, 518 bp, Artificial Sequence
  chemically treated genomic DNA (Homo sapiens) CpG-island No: 24448
ataccgccaacgtaattaacgaccaacgaaattccgacttcttctaccgcttccaacaaaccttctaccaaacgtattatcaactcatccaacgtttcgtaaacgcccgactacgcgacttcattcaaacaaacgaaacccgctaccatcgcaatcgaattaccgaaaaacgtacccgcctaataaaccgaacccgtcgaaaccaacgcatccattacatcacgacgaccaccgaatacgcctaccgacattccaccgccgataattttaccgaaacaaattaaatctaacactacgccgtaataatcctatacgccaactaacgctacgcgaaaaccgatcatcacttcatcgataatcaacaacgcgccaaattcgtcgcacaacgcgcgcaaacctaacaaaaactctaacaacgacgaaacacaattcatattacctaccaccgactcgacgataatacaaacaatctcttacgaatattactcaaatacgacgcgtacaaaaaccaaatctct

SEQ ID NO: 24449 - DNA, 715 bp, Artificial Sequence
  chemically treated genomic DNA (Homo sapiens) CpG-island No: 24449
gttttgttgcgtagcgttgttggaattttatcgttgacgttgcgtaacgttggaagcggcgggcgattatattgcgcgtttggtatttgtttggaagagtagaaatcgttgtcgtggtacggcggtttgggaaatgtattgttaacgttacgatacgttagtaggtagcgaatggttggagagcgtgcgggtttatgagaaagaatattttgagtcgtcgcgggtaaatattgtcggatgcggcgtgaacgttttattcggtttacgggtcggtaatagttgtaggtttgataagacgcgttagcgtcgtattaggtattgattgtcggatgcggtataagtgttttattcggtttataggtcggtaatagttgtaggtttgataagacgttgatagcgtttgtattaggtattgattgtcggatgcggtataagtgttttattcggtttataggtcggtaatagttgtaggtttgataagacgcgatagcgtcgtatttaggtattgattgtcggatgcggtataagtgttttattaggtttataggtcggtaatagttgtaggtttgataagacgcgatagcgtcgtattaggtattgattgtcggatgcggcgcgagcgttttattcggtttacgggtcgtgtattcgataatatcgaatttataggaatatagaatatgtaaaatattatttagttttggtttgttttagg

SEQ ID NO: 24450 - DNA, 715 bp, Artificial Sequence
  chemically treated genomic DNA (Homo sapiens) CpG-island No: 24450
cctaaaacaaaccaaaactaaataatattttacatattctatattcctataaattcgatattatcgaatacacgacccgtaaaccgaataaaacgctcgcgccgcatccgacaatcaatacctaatacgacgctatcgcgtcttatcaaacctacaactattaccgacctataaacctaataaaacacttataccgcatccgacaatcaatacctaaatacgacgctatcgcgtcttatcaaacctacaactattaccgacctataaaccgaataaaacacttataccgcatccgacaatcaatacctaatacaaacgctatcaacgtcttatcaaacctacaactattaccgacctataaaccgaataaaacacttataccgcatccgacaatcaatacctaatacgacgctaacgcgtcttatcaaacctacaactattaccgacccgtaaaccgaataaaacgttcacgccgcatccgacaatatttacccgcgacgactcaaaatattctttctcataaacccgcacgctctccaaccattcgctacctactaacgtatcgtaacgttaacaatacatttcccaaaccgccgtaccacgacaacgatttctactcttccaaacaaataccaaacgcgcaatataatcgcccgccgcttccaacgttacgcaacgtcaacgataaaattccaacaacgctacgcaacaaaac

SEQ ID NO: 24451 - DNA, 715 bp, Artificial Sequence
  chemically treated genomic DNA (Homo sapiens) CpG-island No: 24451
tttgggataaattaggattgagtaatgttttgtatgttttgtgtttttgtaaattcggtgttgtcggatgtacgattcgtaggtcggataaggcgttcgcgtcgtattcggtaattaatgtttgatgcgacgttgtcgcgttttattaggtttataattattgtcgatttgtaggtttgataaggtatttgtgtcgtattcggtaattaatgtttagatgcgacgttgtcgcgttttattaggtttataattgttgtcgatttgtaggtcggataaggtatttgtgtcgtattcggtaattaatgtttgatgtagacgttgttagcgttttattaggtttataattattgtcgatttgtaggtcggataaggtatttgtgtcgtattcggtaattaatgtttgatgcgacgttgacgcgttttattaggtttataattgttgtcgattcgtaggtcggataaggcgtttacgtcgtattcggtagtgtttattcgcggcgatttaaaatatttttttttataagttcgtacgttttttagttattcgttatttgttggcgtatcgtgacgttggtaatatattttttagatcgtcgtgttacggtaacgatttttgtttttttagatagatgttagacgcgtagtgtaatcgttcgtcgtttttagcgttgcgtagcgttagcggtaggattttagtaacgttacgtagtagggt

SEQ ID NO: 24452 - DNA, 715 bp, Artificial Sequence
  chemically treated genomic DNA (Homo sapiens) CpG-island No: 24452
accctactacgtaacgttactaaaatcctaccgctaacgctacgcaacgctaaaaacgacgaacgattacactacgcgtctaacatctatctaaaaaaacaaaaatcgttaccgtaacacgacgatctaaaaaatatattaccaacgtcacgatacgccaacaaataacgaataactaaaaaacgtacgaacttataaaaaaaaatattttaaatcgccgcgaataaacactaccgaatacgacgtaaacgccttatccgacctacgaatcgacaacaattataaacctaataaaacgcgtcaacgtcgcatcaaacattaattaccgaatacgacacaaataccttatccgacctacaaatcgacaataattataaacctaataaaacgctaacaacgtctacatcaaacattaattaccgaatacgacacaaataccttatccgacctacaaatcgacaacaattataaacctaataaaacgcgacaacgtcgcatctaaacattaattaccgaatacgacacaaataccttatcaaacctacaaatcgacaataattataaacctaataaaacgcgacaacgtcgcatcaaacattaattaccgaatacgacgcgaacgccttatccgacctacgaatcgtacatccgacaacaccgaatttacaaaaacacaaaacatacaaaacattactcaatcctaatttatcccaaa

SEQ ID NO: 24453 - DNA, 500 bp, Artificial Sequence
  chemically treated genomic DNA (Homo sapiens) CpG-island No: 24453
ggcggggattagcgtaattgcgatttaattttgcgttggggattggagaaattaaaatttggggcgggtttttatcgcgagggtttcgtgtaagtgggtagaattaggttcgggcggagtcgggagatgtttacgtgttgcgtatttttatttcgttcgtaggggattagttgttgagtgttcgagtgtttttcgagaattttaagtacgaggacgtattacgtttgttgtaatgcgtcgagttttataaagtttttttttgtttgaagcgtattgtgtttatcggggatttggttttgcggttcgggatcgtgtttggttacgagattaagggttcgcgggttaaggtggttaagttggtacgcgtgtttagttcggtttcggttttggattgttttagcgattcggtttttgcgtcgtgagttttatttttcgttatcgtgggttagttttgttttttgttttgttattaatttaagttaattttattttttgttttt

SEQ ID NO: 24454 - DNA, 500 bp, Artificial Sequence
  chemically treated genomic DNA (Homo sapiens) CpG-island No: 24454
aaaaacaaaaaataaaattaacttaaattaataacaaaacaaaaaacaaaactaacccacgataacgaaaaataaaactcacgacgcaaaaaccgaatcgctaaaacaatccaaaaccgaaaccgaactaaacacgcgtaccaacttaaccaccttaacccgcgaacccttaatctcgtaaccaaacacgatcccgaaccgcaaaaccaaatccccgataaacacaatacgcttcaaacaaaaaaaaactttataaaactcgacgcattacaacaaacgtaatacgtcctcgtacttaaaattctcgaaaaacactcgaacactcaacaactaatcccctacgaacgaaataaaaatacgcaacacgtaaacatctcccgactccgcccgaacctaattctacccacttacacgaaaccctcgcgataaaaacccgccccaaattttaatttctccaatccccaacgcaaaattaaatcgcaattacgctaatccccgcc

SEQ ID NO: 24455 - DNA, 500 bp, Artificial Sequence
  chemically treated genomic DNA (Homo sapiens) CpG-island No: 24455
aggggtagagggtggaattagtttgggttagtgataagatagagggtaaggttggtttacgatggcggggaatggggtttacggcgtagagatcggatcgttggggtagtttagggtcggggtcgggttaagtacgcgtattagtttggttattttggttcgcgggtttttgatttcgtagttagatacggtttcgggtcgtagagttaggttttcggtgggtatagtgcgttttaggtagaaggagattttgtaaggttcggcgtattgtagtaggcgtagtgcgttttcgtatttgaagttttcgaagaatattcgggtatttagtagttggttttttgcgggcgaggtggaggtgcgtagtacgtgggtatttttcggtttcgttcgggtttagttttgtttatttgtacggagttttcgcggtgaggattcgttttaaattttagtttttttaatttttagcgtaggattaagtcgtagttacgttagttttcgtt

SEQ ID NO: 24456 - DNA, 500 bp, Artificial Sequence
  chemically treated genomic DNA (Homo sapiens) CpG-island No: 24456
aacgaaaactaacgtaactacgacttaatcctacgctaaaaattaaaaaaactaaaatttaaaacgaatcctcaccgcgaaaactccgtacaaataaacaaaactaaacccgaacgaaaccgaaaaatacccacgtactacgcacctccacctcgcccgcaaaaaaccaactactaaatacccgaatattcttcgaaaacttcaaatacgaaaacgcactacgcctactacaatacgccgaaccttacaaaatctccttctacctaaaacgcactatacccaccgaaaacctaactctacgacccgaaaccgtatctaactacgaaatcaaaaacccgcgaaccaaaataaccaaactaatacgcgtacttaacccgaccccgaccctaaactaccccaacgatccgatctctacgccgtaaaccccattccccgccatcgtaaaccaaccttaccctctatcttatcactaacccaaactaattccaccctctacccct

SEQ ID NO: 24457 - DNA, 527 bp, Artificial Sequence
  chemically treated genomic DNA (Homo sapiens) CpG-island No: 24457
tattttacgttttttatttcgagatttagttttatacgtattttttaggttgtattttcgtttgacggttttttttagtcgcgcgtaggcgtattacggttagattgtaggtcggcgggggttaggtatgcgttttttttattggtcgcgtcgtttgttagtttcgggcggaggggagcgtcgggtcgacggtgggcggttacgtgacggttacgattgtattttcgttggtgtcggtgggcggttacgtgatggttatggtcgtattttcgttggtggcggtttgttggggtagagcggtcgcggacgagttagtttagttttcggcggtgagaggatgttttcggggcgggtagttcgggtcgggggaggagtgtttgatagttggcgtcgtcgggagggagggcgggcggcgcgagtgggcgcgggttcggtgggttaggtgaggcgcgggtcgggggtggtgggattgggtcggttgcggtagggacgggtggcgttcgggtgtttggatttagttcgggttt

SEQ ID NO: 24458 - DNA, 527 bp, Artificial Sequence
  chemically treated genomic DNA (Homo sapiens) CpG-island No: 24458
aaacccgaactaaatccaaacacccgaacgccacccgtccctaccgcaaccgacccaatcccaccacccccgacccgcgcctcacctaacccaccgaacccgcgcccactcgcgccgcccgccctccctcccgacgacgccaactatcaaacactcctcccccgacccgaactacccgccccgaaaacatcctctcaccgccgaaaactaaactaactcgtccgcgaccgctctaccccaacaaaccgccaccaacgaaaatacgaccataaccatcacgtaaccgcccaccgacaccaacgaaaatacaatcgtaaccgtcacgtaaccgcccaccgtcgacccgacgctcccctccgcccgaaactaacaaacgacgcgaccaataaaaaaaacgcatacctaacccccgccgacctacaatctaaccgtaatacgcctacgcgcgactaaaaaaaaccgtcaaacgaaaatacaacctaaaaaatacgtataaaactaaatctcgaaataaaaaacgtaaaata

SEQ ID NO: 24459 - DNA, 527 bp, Artificial Sequence
  chemically treated genomic DNA (Homo sapiens) CpG-island No: 24459
gagttcgaattgagtttagatattcggacgttattcgtttttatcgtaatcggtttagttttattattttcggttcgcgttttatttggtttatcgggttcgcgtttattcgcgtcgttcgttttttttttcggcggcgttaattgttagatatttttttttcggttcgggttgttcgtttcggaagtatttttttatcgtcggaagttgaattgattcgttcgcggtcgttttattttaataggtcgttattagcgagagtgcggttataattattacgtgatcgtttatcgatattagcgagagtgtagtcgtaatcgttacgtgatcgtttatcgtcggttcggcgttttttttcgttcgaagttagtaagcggcgcggttaatgagaaaggcgtatgtttggttttcgtcggtttgtagtttagtcgtagtgcgtttgcgcgcggttaggaggggtcgttaggcggggatatagtttggaaggtgcgtgtggggttgggtttcggagtgggagacgtggagtg

SEQ ID NO: 24460 - DNA, 527 bp, Artificial Sequence
  chemically treated genomic DNA (Homo sapiens) CpG-island No: 24460
cactccacgtctcccactccgaaacccaaccccacacgcaccttccaaactatatccccgcctaacgacccctcctaaccgcgcgcaaacgcactacgactaaactacaaaccgacgaaaaccaaacatacgcctttctcattaaccgcgccgcttactaacttcgaacgaaaaaaaacgccgaaccgacgataaacgatcacgtaacgattacgactacactctcgctaatatcgataaacgatcacgtaataattataaccgcactctcgctaataacgacctattaaaataaaacgaccgcgaacgaatcaattcaacttccgacgataaaaaaatacttccgaaacgaacaacccgaaccgaaaaaaaaatatctaacaattaacgccgccgaaaaaaaaaacgaacgacgcgaataaacgcgaacccgataaaccaaataaaacgcgaaccgaaaataataaaactaaaccgattacgataaaaacgaataacgtccgaatatctaaactcaattcgaactc

SEQ ID NO: 24461 - DNA, 656 bp, Artificial Sequence
  chemically treated genomic DNA (Homo sapiens) CpG-island No: 24461
ggcgcgtcgatttcgggacgtttcgggttgttagcggagatcggagggaggtcggagaaagtgtattttgagcgattcggtcggtcgttgtttttcggatcggttttttatcgagcgttgggtacgtttatcggtttaaggtcgtcgtcgtcgtcggggtcggttagtacgttttcgtcgtattttttttttatttcggggtttacgagtcgtcgtcgttgtttttgtcgcggggtttttttatgtttcgtcgttgtcgcggaatagcgggtgtaggcgcgttatttttttatggtagagatttcgtcgggtttttgtaggtcgggtcgttattgtcgtcgtcgtcggtttcggtttattagtatatacgcgtcgggattaggtcgcgattagtttcggcggcgttaggttttcgggaagtagcggcggtagggacgttgttaagttacgttattaggtttagtaatttttattttcgggggagtgtttagttttgcgtttgcgtaagtagaatattcgttttttttcgttttttaggtttttttcgttacgttgtgtcgtattgaagtttcgttttttattagttttttcgggtggcgttttttgtgtatttatttgtttttatagtgttatttatgggtcgttagaagtatagt

SEQ ID NO: 24462 - DNA, 656 bp, Artificial Sequence
  chemically treated genomic DNA (Homo sapiens) CpG-island No: 24462
actatacttctaacgacccataaataacactataaaaacaaataaatacacaaaaaacgccacccgaaaaaactaataaaaaacgaaacttcaatacgacacaacgtaacgaaaaaaacctaaaaaacgaaaaaaaacgaatattctacttacgcaaacgcaaaactaaacactcccccgaaaataaaaattactaaacctaataacgtaacttaacaacgtccctaccgccgctacttcccgaaaacctaacgccgccgaaactaatcgcgacctaatcccgacgcgtatatactaataaaccgaaaccgacgacgacgacaataacgacccgacctacaaaaacccgacgaaatctctaccataaaaaaataacgcgcctacacccgctattccgcgacaacgacgaaacataaaaaaaccccgcgacaaaaacaacgacgacgactcgtaaaccccgaaataaaaaaaaaatacgacgaaaacgtactaaccgaccccgacgacgacgacgaccttaaaccgataaacgtacccaacgctcgataaaaaaccgatccgaaaaacaacgaccgaccgaatcgctcaaaatacactttctccgacctccctccgatctccgctaacaacccgaaacgtcccgaaatcgacgcgcc

SEQ ID NO: 24463 - DNA, 656 bp, Artificial Sequence
  chemically treated genomic DNA (Homo sapiens) CpG-island No: 24463
gttgtatttttgacggtttataggtggtattgtagggataggtaagtgtatagggagcgttattcggagaggttgataggaggcggagttttaatgcgatataacgtggcgggaggagtttaagggacgaggaaaggcgagtgttttgtttgcgtagacgtaaggttgggtattttttcgggagtgagggttgttgggtttgatgacgtggtttggtaacgtttttatcgtcgttgtttttcgggaatttggcgtcgtcggaattgatcgcggtttagtttcgacgcgtgtgtgttagtgagtcggagtcggcgacggcggtagtggcggttcggtttgtaggagttcgacggggtttttgttatgggggagtgacgcgtttgtattcgttgtttcgcggtagcggcgagatatgaggagatttcgcgataggggtagcggcggcggttcgtgagtttcgggatggaggagaaatacggcggggacgtgttggtcggtttcggcggcggcggcggttttgggtcggtggacgtatttagcgttcggtaagggatcgattcggaaggtagcgatcggtcgggtcgtttaggatgtatttttttcggttttttttcggttttcgttgatagttcgggacgtttcggggtcggcgcgtt

SEQ ID NO: 24464 - DNA, 656 bp, Artificial Sequence
  chemically treated genomic DNA (Homo sapiens) CpG-island No: 24464
aacgcgccgaccccgaaacgtcccgaactatcaacgaaaaccgaaaaaaaaccgaaaaaaatacatcctaaacgacccgaccgatcgctaccttccgaatcgatcccttaccgaacgctaaatacgtccaccgacccaaaaccgccgccgccgccgaaaccgaccaacacgtccccgccgtatttctcctccatcccgaaactcacgaaccgccgccgctacccctatcgcgaaatctcctcatatctcgccgctaccgcgaaacaacgaatacaaacgcgtcactcccccataacaaaaaccccgtcgaactcctacaaaccgaaccgccactaccgccgtcgccgactccgactcactaacacacacgcgtcgaaactaaaccgcgatcaattccgacgacgccaaattcccgaaaaacaacgacgataaaaacgttaccaaaccacgtcatcaaacccaacaaccctcactcccgaaaaaatacccaaccttacgtctacgcaaacaaaacactcgcctttcctcgtcccttaaactcctcccgccacgttatatcgcattaaaactccgcctcctatcaacctctccgaataacgctccctatacacttacctatccctacaataccacctataaaccgtcaaaaatacaac

SEQ ID NO: 24465 - DNA, 707 bp, Artificial Sequence
  chemically treated genomic DNA (Homo sapiens) CpG-island No: 24465
acgtgcgggcgtgtcggttttaatattacgaacgcggtggatatagttataatcgtgggcgtgacgattatcgtgacgtatatcgttatttttgatgcgattattatttagtttgttaaggatttgtttcggcgtttcgtttagattaatttttagatggtttattagcgttagtttgtcgtttttatttatacgcgcgaataacgatatttcggtatacgtcgggttacgttgtattagcgagtcgtcggagttgttataaatatcgtcgatgatcgatgcgtttatatacgatgatttaattattgagtgcggttcgcgttttagcggtttgagggttttttttagcgaatagagcgtggtgttcggataggttagtatttgttcgtttttgttaagaacgtgtagtttgtcgagacgtagggtgttgatgataacgatatcgcgattataatcgttatcgtttggcgtcgatttttcggttaggtttgtattggcggtttgtattagaataattttgtcggcggtgacgtaggtttttagtattcgttataattttagtagtgagttagggaaaacgatagttagcgcgtcgttttgattagaacggaagtttttgcgatagcgggtcgtttttgcgggatcggtgagtaggtgtgaagaatttattagacgagtaagtttatttaaaaaggttttattattag

SEQ ID NO: 24466 - DNA, 707 bp, Artificial Sequence
  chemically treated genomic DNA (Homo sapiens) CpG-island No: 24466
ctaataataaaacctttttaaataaacttactcgtctaataaattcttcacacctactcaccgatcccgcaaaaacgacccgctatcgcaaaaacttccgttctaatcaaaacgacgcgctaactatcgttttccctaactcactactaaaattataacgaatactaaaaacctacgtcaccgccgacaaaattattctaatacaaaccgccaatacaaacctaaccgaaaaatcgacgccaaacgataacgattataatcgcgatatcgttatcatcaacaccctacgtctcgacaaactacacgttcttaacaaaaacgaacaaatactaacctatccgaacaccacgctctattcgctaaaaaaaaccctcaaaccgctaaaacgcgaaccgcactcaataattaaatcatcgtatataaacgcatcgatcatcgacgatatttataacaactccgacgactcgctaatacaacgtaacccgacgtataccgaaatatcgttattcgcgcgtataaataaaaacgacaaactaacgctaataaaccatctaaaaattaatctaaacgaaacgccgaaacaaatccttaacaaactaaataataatcgcatcaaaaataacgatatacgtcacgataatcgtcacgcccacgattataactatatccaccgcgttcgtaatattaaaaccgacacgcccgcacgt

SEQ ID NO: 24467 - DNA, 707 bp, Artificial Sequence
  chemically treated genomic DNA (Homo sapiens) CpG-island No: 24467
ttgataataaagtttttttgaatgaatttgttcgtttggtgggttttttatatttgtttatcgatttcgtaaaaacggttcgttatcgtaagggttttcgttttggttagggcgacgcgttggttgtcgttttttttggtttattattagaattgtggcgggtgttgaaagtttgcgttatcgtcgataaaattattttgatgtaggtcgttaatataggtttgatcgaaggatcgacgttaaacggtaacgattatgatcgcgatgtcgttattattagtattttgcgtttcgataagttgtacgtttttggtaagggcgaataggtgttggtttattcgggtattacgttttattcgttggaaaaagtttttaaatcgttgggacgcgaatcgtatttagtgattggattatcgtgtataggcgtatcggttatcggcggtatttgtaataatttcggcggttcgttggtgtaacgtggttcggcgtatatcgaaatgtcgttattcgcgcgtataaatgaagacggtaaattgacgttggtgaattatttggggattgatttgggcgaaacgtcggagtagatttttagtaagttggatgatgatcgtattaaagatgacgatgtgcgttacgatggtcgttacgtttacgattatgattatgtttatcgcgttcgtgatattgaagtcgatacgttcgtacgt

SEQ ID NO: 24468 - DNA, 707 bp, Artificial Sequence
  chemically treated genomic DNA (Homo sapiens) CpG-island No: 24468
acgtacgaacgtatcgacttcaatatcacgaacgcgataaacataatcataatcgtaaacgtaacgaccatcgtaacgcacatcgtcatctttaatacgatcatcatccaacttactaaaaatctactccgacgtttcgcccaaatcaatccccaaataattcaccaacgtcaatttaccgtcttcatttatacgcgcgaataacgacatttcgatatacgccgaaccacgttacaccaacgaaccgccgaaattattacaaataccgccgataaccgatacgcctatacacgataatccaatcactaaatacgattcgcgtcccaacgatttaaaaactttttccaacgaataaaacgtaatacccgaataaaccaacacctattcgcccttaccaaaaacgtacaacttatcgaaacgcaaaatactaataataacgacatcgcgatcataatcgttaccgtttaacgtcgatccttcgatcaaacctatattaacgacctacatcaaaataattttatcgacgataacgcaaactttcaacacccgccacaattctaataataaaccaaaaaaaacgacaaccaacgcgtcgccctaaccaaaacgaaaacccttacgataacgaaccgtttttacgaaatcgataaacaaatataaaaaacccaccaaacgaacaaattcattcaaaaaaactttattatcaa

SEQ ID NO: 24469 - DNA, 549 bp, Artificial Sequence
  chemically treated genomic DNA (Homo sapiens) CpG-island No: 24469
ttgcgtacggtttgggcggaatgatcgttagcgatggtggttgtattacgtcgggcgatgtggcgaaagtttttggcggcggtgtgtcgatattcgttatgtttgtgcggtatgtttggcgggttacgacgacgacgcggcggtcgtttcgttgacggacgatatcggcgacgataattttatgtttgttttatcgggtattgacgtttcgacgttttgcgattgataacgttacgtttggcggcgttgcgggaattatttcgcgtacgtagatcggttaatattcgttaacgttggttcggtttgcgacgtgggtcgggtttgataaataatttgcgcgacgaattatatatggggcggggttggcgttttacggtttgtaatataacgtttggggggttatatcgtttttgataaagaaggttgagttaatatcgttatattacggttttacgtatcggtgttggtagggtataaggaaatacgtcggtttttttttatataattttgagtaaatttttttaaacgatttggggggatgtgaggatt

SEQ ID NO: 24470 - DNA, 549 bp, Artificial Sequence
  chemically treated genomic DNA (Homo sapiens) CpG-island No: 24470
aatcctcacatccccccaaatcgtttaaaaaaatttactcaaaattatataaaaaaaaaccgacgtatttccttataccctaccaacaccgatacgtaaaaccgtaatataacgatattaactcaaccttctttatcaaaaacgatataaccccccaaacgttatattacaaaccgtaaaacgccaaccccgccccatatataattcgtcgcgcaaattatttatcaaacccgacccacgtcgcaaaccgaaccaacgttaacgaatattaaccgatctacgtacgcgaaataattcccgcaacgccgccaaacgtaacgttatcaatcgcaaaacgtcgaaacgtcaatacccgataaaacaaacataaaattatcgtcgccgatatcgtccgtcaacgaaacgaccgccgcgtcgtcgtcgtaacccgccaaacataccgcacaaacataacgaatatcgacacaccgccgccaaaaactttcgccacatcgcccgacgtaatacaaccaccatcgctaacgatcattccgcccaaaccgtacgcaa

SEQ ID NO: 24471 - DNA, 549 bp, Artificial Sequence
  chemically treated genomic DNA (Homo sapiens) CpG-island No: 24471
ggtttttatatttttttaggtcgtttgggaagatttatttagggttgtgtggaagaaggtcggcgtgtttttttgtgttttgttaatatcggtacgtaaaatcgtggtgtggcggtgttggtttagttttttttgttaagggcggtatagttttttaaacgttatgttataagtcgtgaaacgttagtttcgttttatatatagttcgtcgcgtaggttatttgttaaattcggtttacgtcgtaagtcgggttagcgttaacgggtgttgatcggtttgcgtgcgcggagtagttttcgtaacgtcgttaaacgtgacgttgttagtcgtaagacgtcggagcgttaatgttcggtagaataagtataaagttgtcgtcgtcggtgtcgttcgttaacgaggcgatcgtcgcgtcgtcgtcgtggttcgttaagtatgtcgtataagtatgacgaatatcggtatatcgtcgttaaaggttttcgttatatcgttcggcgtggtgtagttattatcgttgacgattatttcgtttagatcgtgcgtag

SEQ ID NO: 24472 - DNA, 549 bp, Artificial Sequence
  chemically treated genomic DNA (Homo sapiens) CpG-island No: 24472
ctacgcacgatctaaacgaaataatcgtcaacgataataactacaccacgccgaacgatataacgaaaacctttaacgacgatataccgatattcgtcatacttatacgacatacttaacgaaccacgacgacgacgcgacgatcgcctcgttaacgaacgacaccgacgacgacaactttatacttattctaccgaacattaacgctccgacgtcttacgactaacaacgtcacgtttaacgacgttacgaaaactactccgcgcacgcaaaccgatcaacacccgttaacgctaacccgacttacgacgtaaaccgaatttaacaaataacctacgcgacgaactatatataaaacgaaactaacgtttcacgacttataacataacgtttaaaaaactataccgcccttaacaaaaaaaactaaaccaacaccgccacaccacgattttacgtaccgatattaacaaaacacaaaaaaacacgccgaccttcttccacacaaccctaaataaatcttcccaaacgacctaaaaaaatataaaaacc

SEQ ID NO: 24473 - DNA, 524 bp, Artificial Sequence
  chemically treated genomic DNA (Homo sapiens) CpG-island No: 24473
tatcgatcgggagttgacgatttgttagacggttaatttttaatatgtcgtaagagaatatcgatatcgatatatcgattatggtgatcggcgtggaaggaatggcgacgattagcgggttagtgtttatgcgatatttttttgcgttttacggcggtattacggcgatggagttggtttagtaaatgttaatatagttttttttcgtcgtttgttagtcgtagttgtcgtcgcgtatttagtggttggtattacgtagtgttatagattaatacgtgatcgggagttagttaatggcgttatttattattttgttcgttgttaggttatcgatcgaacgtcgggcgtttttcggtttatttgtttacgttgggttcggttgggtttgcgtggaatgtttttcggtatcgcgttgacgtatcgggattattattcgtgagttatcgtattcgggcgggttatttttaggttttatggttagcgttattattatagggttaggtagatttcgtttgttgtttggg

SEQ ID NO: 24474 - DNA, 524 bp, Artificial Sequence
  chemically treated genomic DNA (Homo sapiens) CpG-island No: 24474
cccaaacaacaaacgaaatctacctaaccctataataataacgctaaccataaaacctaaaaataacccgcccgaatacgataactcacgaataataatcccgatacgtcaacgcgataccgaaaaacattccacgcaaacccaaccgaacccaacgtaaacaaataaaccgaaaaacgcccgacgttcgatcgataacctaacaacgaacaaaataataaataacgccattaactaactcccgatcacgtattaatctataacactacgtaataccaaccactaaatacgcgacgacaactacgactaacaaacgacgaaaaaaaactatattaacatttactaaaccaactccatcgccgtaataccgccgtaaaacgcaaaaaaatatcgcataaacactaacccgctaatcgtcgccattccttccacgccgatcaccataatcgatatatcgatatcgatattctcttacgacatattaaaaattaaccgtctaacaaatcgtcaactcccgatcgata

SEQ ID NO: 24475 - DNA, 524 bp, Artificial Sequence
  chemically treated genomic DNA (Homo sapiens) CpG-island No: 24475
tttaggtaataggcgaggtttgtttaattttgtggtaataacgttaattatgagatttgaagatggttcgttcggatgcggtaatttacgggtaatggtttcggtgcgttaacgcggtatcgggaaatattttacgtaaatttaatcgaatttagcgtgggtaaatggatcgggagacgttcggcgttcgatcggtaatttgatagcgaataagatgatggatggcgttattgattggttttcgattacgtattggtttgtggtattacgtaatgttaattattggatgcgcggcgatagttacggttggtaggcggcggaaaaaggttatattggtatttgttggattaattttatcgtcgtaatgtcgtcgtggggcgtaaaagagtgtcgtataggtattaattcgttgatcgtcgttattttttttacgtcgattattatggtcgatatgtcgatgtcgatgtttttttacggtatgttagaagttaatcgtttggtaggtcgttagttttcggtcgatg

SEQ ID NO: 24476 - DNA, 524 bp, Artificial Sequence
  chemically treated genomic DNA (Homo sapiens) CpG-island No: 24476
catcgaccgaaaactaacgacctaccaaacgattaacttctaacataccgtaaaaaaacatcgacatcgacatatcgaccataataatcgacgtaaaaaaaataacgacgatcaacgaattaatacctatacgacactcttttacgccccacgacgacattacgacgataaaattaatccaacaaataccaatataacctttttccgccgcctaccaaccgtaactatcgccgcgcatccaataattaacattacgtaataccacaaaccaatacgtaatcgaaaaccaatcaataacgccatccatcatcttattcgctatcaaattaccgatcgaacgccgaacgtctcccgatccatttacccacgctaaattcgattaaatttacgtaaaatatttcccgataccgcgttaacgcaccgaaaccattacccgtaaattaccgcatccgaacgaaccatcttcaaatctcataattaacgttattaccacaaaattaaacaaacctcgcctattacctaaa

SEQ ID NO: 24477 - DNA, 563 bp, Artificial Sequence
  chemically treated genomic DNA (Homo sapiens) CpG-island No: 24477
tttatcgtcgtttgaatgttaaagttggaagaaagtatatatttatcgggtagattatttagcgtttaggttacgcggtttttagcgtttagtttttttagttcggcgttagttttcgttagcgttagaatgcgatttattttcggtagttcgtttagggcgtttagatcgagtttggatataagattttttattggtttgttttgtttgatgcgacgtttacgcgtttttattaggtttataagatcgggttgatggttaattttataaattacgcgtcggatcgagtatcgggcgaatgatgttcgtacgtatcgtaaagtcgtcgaagtttttattcgtttcgcgttttttcgtttagcgttttattagtttattaagcgacgttaggattttcggttcggtgatgttttttttatatattcgtgggatacgtgtttaatgcggttgtcgttaagatgtaggttgtagcgattcgggtttaattattaggttattttcgtaaatgcgcgatataatcgtcgggtagttgttaacgtatacgaatggttatggtgattatg

SEQ ID NO: 24478 - DNA, 563 bp, Artificial Sequence
  chemically treated genomic DNA (Homo sapiens) CpG-island No: 24478
cataatcaccataaccattcgtatacgttaacaactacccgacgattatatcgcgcatttacgaaaataacctaataattaaacccgaatcgctacaacctacatcttaacgacaaccgcattaaacacgtatcccacgaatatataaaaaaaacatcaccgaaccgaaaatcctaacgtcgcttaataaactaataaaacgctaaacgaaaaaacgcgaaacgaataaaaacttcgacgactttacgatacgtacgaacatcattcgcccgatactcgatccgacgcgtaatttataaaattaaccatcaacccgatcttataaacctaataaaaacgcgtaaacgtcgcatcaaacaaaacaaaccaataaaaaatcttatatccaaactcgatctaaacgccctaaacgaactaccgaaaataaatcgcattctaacgctaacgaaaactaacgccgaactaaaaaaactaaacgctaaaaaccgcgtaacctaaacgctaaataatctacccgataaatatatactttcttccaactttaacattcaaacgacgataaa

SEQ ID NO: 24479 - DNA, 563 bp, Artificial Sequence
  chemically treated genomic DNA (Homo sapiens) CpG-island No: 24479
tatggttattatgattattcgtatgcgttaatagttgttcgacggttgtgtcgcgtatttgcggaagtggtttggtggttaagttcgggtcgttataatttgtattttggcggtaatcgtattggatacgtattttacggatgtataaagaaaatattatcgagtcggaaattttggcgtcgtttgatgaattgatagggcgttgggcgaaagagcgcgaagcgggtgaaggtttcggcgattttacggtgcgtgcgggtattattcgttcggtgttcgattcggcgcgtgatttgtgggattaattattagttcggttttgtaggtttgataagaacgcgtgagcgtcgtattaggtaaggtaaattagtgaggaattttatgtttaaattcgatttaaacgttttgaacgaattgtcgaaggtagatcgtattttggcgttggcggaaattaacgtcgaattggaaaaattggacgttgaaggtcgcgtagtttgggcgttggataatttgttcggtgaatatgtatttttttttagttttggtatttaggcggcggtgag

SEQ ID NO: 24480 - DNA, 563 bp, Artificial Sequence
  chemically treated genomic DNA (Homo sapiens) CpG-island No: 24480
ctcaccgccgcctaaataccaaaactaaaaaaaaatacatattcaccgaacaaattatccaacgcccaaactacgcgaccttcaacgtccaatttttccaattcgacgttaatttccgccaacgccaaaatacgatctaccttcgacaattcgttcaaaacgtttaaatcgaatttaaacataaaattcctcactaatttaccttacctaatacgacgctcacgcgttcttatcaaacctacaaaaccgaactaataattaatcccacaaatcacgcgccgaatcgaacaccgaacgaataatacccgcacgcaccgtaaaatcgccgaaaccttcacccgcttcgcgctctttcgcccaacgccctatcaattcatcaaacgacgccaaaatttccgactcgataatattttctttatacatccgtaaaatacgtatccaatacgattaccgccaaaatacaaattataacgacccgaacttaaccaccaaaccacttccgcaaatacgcgacacaaccgtcgaacaactattaacgcatacgaataatcataataaccata

SEQ ID NO: 24481 - DNA, 552 bp, Artificial Sequence
  chemically treated genomic DNA (Homo sapiens) CpG-island No: 24481
aaattaaagtttagatcggtagagaaaacggtttcgcgcgtttataagtcggtttttagtttacgcggatagcggtagcggttcgttagtagtaggttatcggttatgtttttgagtattttttttttgttgcgttagtcgttttttagtgtgatgtattcggcggtgattagcggtgcgttttgttgggttatgcggaattgcgttagtaggtgttttatttttagcgaagtacggtaggttattgtttggttgagtaatttgcggtatttacggttattaagttgcgttattcgagttttcgtcgtcggaattgatggtgcgtttatgttgagtttatttagttttaagtcgattagtaacggtagtacggaatttttcgtttttagtttatcgtatagattaatttatttgttttggcgatgtatcgtttgtacggcgtaatcgagcgttcgtaagaatgtcggatttaggttgttgtagtgacgagtaattttaggcgtttcgcgatttatcgttagtagatattgcgttaggttattattattaata

SEQ ID NO: 24482 - DNA, 552 bp, Artificial Sequence
  chemically treated genomic DNA (Homo sapiens) CpG-island No: 24482
tattaataataataacctaacgcaatatctactaacgataaatcgcgaaacgcctaaaattactcgtcactacaacaacctaaatccgacattcttacgaacgctcgattacgccgtacaaacgatacatcgccaaaacaaataaattaatctatacgataaactaaaaacgaaaaattccgtactaccgttactaatcgacttaaaactaaataaactcaacataaacgcaccatcaattccgacgacgaaaactcgaataacgcaacttaataaccgtaaataccgcaaattactcaaccaaacaataacctaccgtacttcgctaaaaataaaacacctactaacgcaattccgcataacccaacaaaacgcaccgctaatcaccgccgaatacatcacactaaaaaacgactaacgcaacaaaaaaaaaatactcaaaaacataaccgataacctactactaacgaaccgctaccgctatccgcgtaaactaaaaaccgacttataaacgcgcgaaaccgttttctctaccgatctaaactttaattt

SEQ ID NO: 24483 - DNA, 552 bp, Artificial Sequence
  chemically treated genomic DNA (Homo sapiens) CpG-island No: 24483
tattggtagtaatgatttgacgtagtatttgttggcggtggatcgcgaaacgtttaaggttattcgttattataatagtttgaattcggtatttttgcgggcgttcgattacgtcgtgtaagcggtgtatcgttagggtaaatggattggtttgtgcggtgagttgggagcgaaaggtttcgtgttgtcgttgttggtcggtttagggttggatgaatttagtatgagcgtattattaatttcggcggcgaaagttcggatggcgtaatttgatagtcgtgagtgtcgtaagttgtttaattaggtaatggtttgtcgtatttcgttggaagtagaatatttgttggcgtaatttcgtatgatttaataagacgtatcgttggttatcgtcgagtgtattatattggaaagcgattggcgtagtaaagaagaagtgtttaaaggtatgatcgataatttgttgttggcgggtcgttgtcgttattcgcgtaaattggaagtcgatttgtgggcgcgcgaggtcgttttttttatcggtttgggttttagttt

SEQ ID NO: 24484 - DNA, 552 bp, Artificial Sequence
  chemically treated genomic DNA (Homo sapiens) CpG-island No: 24484
aaactaaaacccaaaccgataaaaaaaacgacctcgcgcgcccacaaatcgacttccaatttacgcgaataacgacaacgacccgccaacaacaaattatcgatcatacctttaaacacttcttctttactacgccaatcgctttccaatataatacactcgacgataaccaacgatacgtcttattaaatcatacgaaattacgccaacaaatattctacttccaacgaaatacgacaaaccattacctaattaaacaacttacgacactcacgactatcaaattacgccatccgaactttcgccgccgaaattaataatacgctcatactaaattcatccaaccctaaaccgaccaacaacgacaacacgaaacctttcgctcccaactcaccgcacaaaccaatccatttaccctaacgatacaccgcttacacgacgtaatcgaacgcccgcaaaaataccgaattcaaactattataataacgaataaccttaaacgtttcgcgatccaccgccaacaaatactacgtcaaatcattactaccaata

SEQ ID NO: 24485 - DNA, 604 bp, Artificial Sequence
  chemically treated genomic DNA (Homo sapiens) CpG-island No: 24485
tggcggtaggaattattattagcgcgggaattagcgttagatttagtaacgtttttttataatcgtttaaacggtaattgacgtagtacgcgagaacgttaattaagttgtcgataattagcgataacgtattatttgcggtatcgcgaaagttttttattagcgttagtaataggttgttttaggcgatttttatttgtattagcgttattaaacgtattagtttttgatagtcggtattattaaataatttttggttgattggcgtagttgttagtataaaaattagcgttattagcgtagagaaattaagtattatcgttgatgaagtgtcgattacgcggcgtagttgttgcggattattatggtattgggtaacgtatttggttatatcgttaaagatgttagtttcggtaagtacgtcgagtacggtaattaattggcggaaatttgtcgttagtttaagtttcgtcggattaaatgatatcgttagtaatttatcgattagtaattcggtattaattttgattagtgtattggtcgtcgtttataaggacgtttttgttaacgatatattaggaaaagtagtttaataaagtcgtaa

SEQ ID NO: 24486 - DNA, 604 bp, Artificial Sequence
  chemically treated genomic DNA (Homo sapiens) CpG-island No: 24486
ttacgactttattaaactacttttcctaatatatcgttaacaaaaacgtccttataaacgacgaccaatacactaatcaaaattaataccgaattactaatcgataaattactaacgatatcatttaatccgacgaaacttaaactaacgacaaatttccgccaattaattaccgtactcgacgtacttaccgaaactaacatctttaacgatataaccaaatacgttacccaataccataataatccgcaacaactacgccgcgtaatcgacacttcatcaacgataatacttaatttctctacgctaataacgctaatttttatactaacaactacgccaatcaaccaaaaattatttaataataccgactatcaaaaactaatacgtttaataacgctaatacaaataaaaatcgcctaaaacaacctattactaacgctaataaaaaactttcgcgataccgcaaataatacgttatcgctaattatcgacaacttaattaacgttctcgcgtactacgtcaattaccgtttaaacgattataaaaaaacgttactaaatctaacgctaattcccgcgctaataataattcctaccgcca

SEQ ID NO: 24487 - DNA, 604 bp, Artificial Sequence
  chemically treated genomic DNA (Homo sapiens) CpG-island No: 24487
ttgcgattttgttgaattattttttttgatatgtcgttggtaaaagcgtttttgtggacggcggttagtatattggttaagattggtgtcgggttattggtcggtaagttgttggcggtgttatttggttcggcggggtttgggttggcggtaaattttcgttagttgattatcgtgttcggcgtgtttgtcggggttggtatttttaacggtgtaattaaatacgttgtttagtattatgataattcgtaatagttgcgtcgcgtggtcggtattttattagcgatggtatttggtttttttacgttgatggcgttggtttttgtgttggtagttgcgttaattagttagggattgtttggtaatatcgattattaggggttggtgcgtttagtggcgttggtgtaaatggggatcgtttggggtaatttgttattggcgttgatgaaaggttttcgcgatgtcgtaggtaatgcgttatcgttgattgtcggtagtttgattggcgttttcgcgtattacgttagttatcgtttgggcggttatgaaggggcgttgttgggtttggcgttgattttcgcgttggtggtaatttttgtcgtta

SEQ ID NO: 24488 - DNA, 604 bp, Artificial Sequence
  chemically treated genomic DNA (Homo sapiens) CpG-island No: 24488
taacgacaaaaattaccaccaacgcgaaaatcaacgccaaacccaacaacgccccttcataaccgcccaaacgataactaacgtaatacgcgaaaacgccaatcaaactaccgacaatcaacgataacgcattacctacgacatcgcgaaaacctttcatcaacgccaataacaaattaccccaaacgatccccatttacaccaacgccactaaacgcaccaacccctaataatcgatattaccaaacaatccctaactaattaacgcaactaccaacacaaaaaccaacgccatcaacgtaaaaaaaccaaataccatcgctaataaaataccgaccacgcgacgcaactattacgaattatcataatactaaacaacgtatttaattacaccgttaaaaataccaaccccgacaaacacgccgaacacgataatcaactaacgaaaatttaccgccaacccaaaccccgccgaaccaaataacaccgccaacaacttaccgaccaataacccgacaccaatcttaaccaatatactaaccgccgtccacaaaaacgcttttaccaacgacatatcaaaaaaaataattcaacaaaatcgcaa

SEQ ID NO: 24489 - DNA, 690 bp, Artificial Sequence
  chemically treated genomic DNA (Homo sapiens) CpG-island No: 24489
tagttagatattgaattaataggcggtaatcgttagtaatttggttaatgttttaacgttcggttttcgcgcgtagttgaatgttttacgcgcggtgttagtggaagggttttttttgtttacgcgtacgttggttacggcgttaacgtcgggcgtagatatacgttcggtaaaatggattatatttcgcgttcgttggacgtcgcgttgtagtaggatggttggttggtcgtgtagatcgttgacggtagcgaagggtatacgcgtaatggtagtatttacgttgattttatcgggtaattgataatttaggggtattcggtgataggcgaggttgggttaattgttgtgtcggaaggggcggaaattattattgttgtcgattgtataatttcggcgtttaattcgggcgattcggcgaatacggttgcgtttagtagggcgttttaatattggtgaaagttacgggttagcggtaagtgttagttgcgtgtgtacgacggtaatttttttgtttaagcgtagaaatttaggttacgtttgggtcggtattgtacggtagatttaattttgcgtggtgatgtcgggggttttggaacgtagtaacgtcgatgtcgttgcggtaatgagcgatatgattgttagcgcgcggcgttttgaaatgtagattaatgttattagtagcgttta

SEQ ID NO: 24490 - DNA, 690 bp, Artificial Sequence
  chemically treated genomic DNA (Homo sapiens) CpG-island No: 24490
taaacgctactaataacattaatctacatttcaaaacgccgcgcgctaacaatcatatcgctcattaccgcaacgacatcgacgttactacgttccaaaacccccgacatcaccacgcaaaattaaatctaccgtacaataccgacccaaacgtaacctaaatttctacgcttaaacaaaaaaattaccgtcgtacacacgcaactaacacttaccgctaacccgtaactttcaccaatattaaaacgccctactaaacgcaaccgtattcgccgaatcgcccgaattaaacgccgaaattatacaatcgacaacaataataatttccgccccttccgacacaacaattaacccaacctcgcctatcaccgaatacccctaaattatcaattacccgataaaatcaacgtaaatactaccattacgcgtatacccttcgctaccgtcaacgatctacacgaccaaccaaccatcctactacaacgcgacgtccaacgaacgcgaaatataatccattttaccgaacgtatatctacgcccgacgttaacgccgtaaccaacgtacgcgtaaacaaaaaaaacccttccactaacaccgcgcgtaaaacattcaactacgcgcgaaaaccgaacgttaaaacattaaccaaattactaacgattaccgcctattaattcaatatctaacta

SEQ ID NO: 24491 - DNA, 690 bp, Artificial Sequence
  chemically treated genomic DNA (Homo sapiens) CpG-island No: 24491
tagacgttgttgataatattaatttgtattttaaaacgtcgcgcgttggtaattatgtcgtttattgtcgtaacggtatcgacgttattgcgttttagaattttcgatattattacgtaaggttggatttgtcgtgtagtatcggtttaagcgtggtttgggtttttgcgtttaaatagaaaaattgtcgtcgtatatacgtagttagtatttatcgttgattcgtggtttttattagtattaagacgttttattaggcgtaatcgtattcgtcggatcgttcggattgagcgtcgagattgtgtaatcggtagtaatagtgattttcgtttttttcggtatagtaattggtttagtttcgtttattatcggatgtttttgaattgttagttgttcggtgggattaacgtgaatgttgttattacgcgtatatttttcgttgtcgttagcggtttgtacggttagttagttattttgttgtaacgcgacgtttagcgggcgcgaggtgtaatttattttgtcgggcgtatatttgcgttcggcgttgacgtcgtgattaacgtgcgcgtgggtagagaaagtttttttattggtatcgcgcgtaaagtatttaattgcgcgcgaaaatcgggcgttgaggtattggttagattattggcggttatcgtttgttgatttagtgtttggttg

SEQ ID NO: 24492 - DNA, 690 bp, Artificial Sequence
  chemically treated genomic DNA (Homo sapiens) CpG-island No: 24492
caaccaaacactaaatcaacaaacgataaccgccaataatctaaccaatacctcaacgcccgattttcgcgcgcaattaaatactttacgcgcgataccaataaaaaaactttctctacccacgcgcacgttaatcacgacgtcaacgccgaacgcaaatatacgcccgacaaaataaattacacctcgcgcccgctaaacgtcgcgttacaacaaaataactaactaaccgtacaaaccgctaacgacaacgaaaaatatacgcgtaataacaacattcacgttaatcccaccgaacaactaacaattcaaaaacatccgataataaacgaaactaaaccaattactataccgaaaaaaacgaaaatcactattactaccgattacacaatctcgacgctcaatccgaacgatccgacgaatacgattacgcctaataaaacgtcttaatactaataaaaaccacgaatcaacgataaatactaactacgtatatacgacgacaatttttctatttaaacgcaaaaacccaaaccacgcttaaaccgatactacacgacaaatccaaccttacgtaataatatcgaaaattctaaaacgcaataacgtcgataccgttacgacaataaacgacataattaccaacgcgcgacgttttaaaatacaaattaatattatcaacaacgtcta

SEQ ID NO: 24493 - DNA, 540 bp, Artificial Sequence
  chemically treated genomic DNA (Homo sapiens) CpG-island No: 24493
ttcggttattattcgttagatcgttaatatttattgtatatggttgcgtggcgaattaacgtttgtttcgttatttacgtttttcgttgatgtagtggaagagtattagtaatatcgcgaaagcgaagtttggtagcgtgatgcggtattttgggtagaatagcgtcgttaattgtcgtcgttcgcgttatttttttcggtatttttatcggggcgtagcgtttcggtagatattttgcgtttgaaattggaatttatcgacggggaatttcgttagttggttacgtaatttttaggtgtgtagcgtatcgatttagtttttgcgttggtagttttgtggttggggcgattgtgtaatcggtatggattacgtcgtcgatttatttttatgcgtttgattgggttcgtgcggcgtttacggttatcggattcgtgtttaacgttttcgtcgttgtggtatttatattgtcggcgtaagaaattttgttcggaattggtaattcgtattggtagattataattgaaaaaaatgcgtcgtta

SEQ ID NO: 24494 - DNA, 540 bp, Artificial Sequence
  chemically treated genomic DNA (Homo sapiens) CpG-island No: 24494
taacgacgcatttttttcaattataatctaccaatacgaattaccaattccgaacaaaatttcttacgccgacaatataaataccacaacgacgaaaacgttaaacacgaatccgataaccgtaaacgccgcacgaacccaatcaaacgcataaaaataaatcgacgacgtaatccataccgattacacaatcgccccaaccacaaaactaccaacgcaaaaactaaatcgatacgctacacacctaaaaattacgtaaccaactaacgaaattccccgtcgataaattccaatttcaaacgcaaaatatctaccgaaacgctacgccccgataaaaataccgaaaaaaataacgcgaacgacgacaattaacgacgctattctacccaaaataccgcatcacgctaccaaacttcgctttcgcgatattactaatactcttccactacatcaacgaaaaacgtaaataacgaaacaaacgttaattcgccacgcaaccatatacaataaatattaacgatctaacgaataataaccgaa

SEQ ID NO: 24495 - DNA, 540 bp, Artificial Sequence
  chemically treated genomic DNA (Homo sapiens) CpG-island No: 24495
tgacgacgtattttttttagttgtagtttgttagtgcgggttgttagtttcggatagagttttttgcgtcgataatgtgaatattataacggcgaaaacgttgagtacgggttcggtagtcgtaagcgtcgtacgagtttagttagacgtataaagataaatcggcggcgtagtttatatcgattgtataatcgttttagttataaggttgttagcgtaagggttaaatcggtacgttgtatatttgaaagttgcgtagttagttggcggaatttttcgtcggtaaattttagttttaggcgtagaatatttgtcgaggcgttgcgtttcggtaaaggtgtcggagaaagtgacgcgggcggcggtagttgacgacgttgttttgtttagaatgtcgtattacgttgttaggtttcgttttcgcggtattgttggtatttttttattatattagcgaaaggcgtaaatggcgaagtaggcgttggttcgttacgtagttatgtgtagtaaatattggcgatttggcgggtaatggtcggg

SEQ ID NO: 24496 - DNA, 540 bp, Artificial Sequence
  chemically treated genomic DNA (Homo sapiens) CpG-island No: 24496
cccgaccattacccgccaaatcgccaatatttactacacataactacgtaacgaaccaacgcctacttcgccatttacgcctttcgctaatataataaaaaaataccaacaataccgcgaaaacgaaacctaacaacgtaatacgacattctaaacaaaacaacgtcgtcaactaccgccgcccgcgtcactttctccgacacctttaccgaaacgcaacgcctcgacaaatattctacgcctaaaactaaaatttaccgacgaaaaattccgccaactaactacgcaactttcaaatatacaacgtaccgatttaacccttacgctaacaaccttataactaaaacgattatacaatcgatataaactacgccgccgatttatctttatacgtctaactaaactcgtacgacgcttacgactaccgaacccgtactcaacgttttcgccgttataatattcacattatcgacgcaaaaaactctatccgaaactaacaacccgcactaacaaactacaactaaaaaaaatacgtcgtca

SEQ ID NO: 24497 - DNA, 556 bp, Artificial Sequence
  chemically treated genomic DNA (Homo sapiens) CpG-island No: 24497
tgtacggttacggttttggttttttgttttttcggtgttatcggtttgttattcgcgtacgggtaaatttttattatacggatgcgggattgggtcgatttttttataggggtattaagacgggtggaatttacgtcgttttagttaggtagcgttttttttacgataatcgcggtattacgtatatcgcggattttattaattggttcgtttatcgttagacgatgcgttatttttattagcggacgtttatcgttattaaatattagtatgtcggttttcgaatttattagtacggaacggcgtacggtatcggattagtaattataatgcgcggtacggcgtagattagttttaatatcgacgaggattatcggtatatttttttacgtttttttataacgttgggtataaattagtgtggcgcgattcgggcgtttattcgcgacgttattcggcgtgtaggtatcgttatgacgtaaacggcgatcggcggtataacggttgattatcgaatttatgttgttagtagtaatattcgaagaatagattcggt

SEQ ID NO: 24498 - DNA, 556 bp, Artificial Sequence
  chemically treated genomic DNA (Homo sapiens) CpG-island No: 24498
accgaatctattcttcgaatattactactaacaacataaattcgataatcaaccgttataccgccgatcgccgtttacgtcataacgatacctacacgccgaataacgtcgcgaataaacgcccgaatcgcgccacactaatttatacccaacgttataaaaaaacgtaaaaaaatataccgataatcctcgtcgatattaaaactaatctacgccgtaccgcgcattataattactaatccgataccgtacgccgttccgtactaataaattcgaaaaccgacatactaatatttaataacgataaacgtccgctaataaaaataacgcatcgtctaacgataaacgaaccaattaataaaatccgcgatatacgtaataccgcgattatcgtaaaaaaaacgctacctaactaaaacgacgtaaattccacccgtcttaatacccctataaaaaaatcgacccaatcccgcatccgtataataaaaatttacccgtacgcgaataacaaaccgataacaccgaaaaaacaaaaaaccaaaaccgtaaccgtaca

SEQ ID NO: 24499 - DNA, 556 bp, Artificial Sequence
  chemically treated genomic DNA (Homo sapiens) CpG-island No: 24499
atcgaatttgtttttcgggtgttattgttggtaatatggattcgatgattaatcgttatatcgtcgatcgtcgtttacgttatgacgatgtttatacgtcggataacgtcgcgggtaagcgttcggatcgcgttatattggtttatatttagcgttgtaaagaggcgtggaaagatgtatcggtgattttcgtcggtattgaggttagtttgcgtcgtatcgcgtattatgattattggttcgatatcgtgcgtcgtttcgtgttggtggattcgaaagtcgatatgttgatgtttggtaacggtgagcgttcgttggtggaagtggcgtatcgtttggcgatgggcgagttaattagtgaaattcgcgatgtgcgtaatatcgcgattatcgtgaaagaggcgttgtttggttggagcggcgtggattttattcgttttgatatttttgtggaaaaatcgatttaatttcgtattcgtatggtgaagatttgttcgtgcgcggataataaatcggtggtatcgaaaaagtaggaagttaaagtcgtaatcgtgta

SEQ ID NO: 24500 - DNA, 556 bp, Artificial Sequence
  chemically treated genomic DNA (Homo sapiens) CpG-island No: 24500
tacacgattacgactttaacttcctactttttcgataccaccgatttattatccgcgcacgaacaaatcttcaccatacgaatacgaaattaaatcgatttttccacaaaaatatcaaaacgaataaaatccacgccgctccaaccaaacaacgcctctttcacgataatcgcgatattacgcacatcgcgaatttcactaattaactcgcccatcgccaaacgatacgccacttccaccaacgaacgctcaccgttaccaaacatcaacatatcgactttcgaatccaccaacacgaaacgacgcacgatatcgaaccaataatcataatacgcgatacgacgcaaactaacctcaataccgacgaaaatcaccgatacatctttccacgcctctttacaacgctaaatataaaccaatataacgcgatccgaacgcttacccgcgacgttatccgacgtataaacatcgtcataacgtaaacgacgatcgacgatataacgattaatcatcgaatccatattaccaacaataacacccgaaaaacaaattcgat

SEQ ID NO: 24501 - DNA, 693 bp, Artificial Sequence
  chemically treated genomic DNA (Homo sapiens) CpG-island No: 24501
  misc_feature (9)..(9): n is either a, c, g or t
  misc_feature (39)..(39): n is either a, c, g or t
  misc_feature (55)..(55): n is either a, c, g or t
  misc_feature (57)..(57): n is either a, c, g or t
  misc_feature (66)..(67): n is either a, c, g or t
  misc_feature (98)..(99): n is either a, c, g or t
  misc_feature (115)..(115): n is either a, c, g or t
  misc_feature (159)..(159): n is either a, c, g or t
  misc_feature (175)..(175): n is either a, c, g or t
  misc_feature (193)..(193): n is either a, c, g or t
  misc_feature (198)..(198): n is either a, c, g or t
  misc_feature (200)..(200): n is either a, c, g or t
  misc_feature (205)..(205): n is either a, c, g or t
  misc_feature (259)..(259): n is either a, c, g or t
  misc_feature (304)..(304): n is either a, c, g or t
  misc_feature (369)..(369): n is either a, c, g or t
  misc_feature (382)..(382): n is either a, c, g or t
  misc_feature (401)..(401): n is either a, c, g or t
  misc_feature (415)..(415): n is either a, c, g or t
  misc_feature (456)..(456): n is either a, c, g or t
  misc_feature (525)..(525): n is either a, c, g or t
  misc_feature (546)..(546): n is either a, c, g or t
  misc_feature (558)..(559): n is either a, c, g or t
  misc_feature (586)..(586): n is either a, c, g or t
  misc_feature (595)..(595): n is either a, c, g or t
  misc_feature (651)..(651): n is either a, c, g or t
  misc_feature (662)..(662): n is either a, c, g or t
  misc_feature (669)..(669): n is either a, c, g or t
  misc_feature (687)..(689): n is either a, c, g or t
tcgtatagnagacgtcggcgagtcgagagcgagaacgangagttagaagtaagtnanaagttattnntatatattcgtgtattatttggggagaatanntttttttgttatcganaggtttatcgtatagcgtagacgaggagagttttaattttattnttatatgcggtacgtnttttttttacgatcgttntttantnatatnggttttacgatatttaagttcggttgatatatagtagttgttattcgtatattntttttcgatttagatttatgtcgtcgacgagcgcgcgtgttgagncggttatatcgtttgcggcgttgggcgacgaacgcgattattgtattagcgattgtgttttatgntgatacgtttatnttagttagacggtagtttncgttaattagtcgngcgttacggcgcgagtttcgttttttcgcgagcgtttgtgntttagattcgcgtcgtattttttcgcgtatatatagtttttttgttcgggggcggatgtttttttgaangtttattaatttatgtttcgnaggtacgttttnncgtttattttttttatattagttattntttattttncgtcgtttatagttttgaatcgggtgtcgtttcgtgtattgtattattattagttntatttattgtntaattantttatgattttttttatnnnttag

SEQ ID NO: 24502 - DNA, 693 bp, Artificial Sequence
  chemically treated genomic DNA (Homo sapiens) CpG-island No: 24502
  misc_feature (5)..(7): n is either a, c, g or t
  misc_feature (25)..(25): n is either a, c, g or t
  misc_feature (32)..(32): n is either a, c, g or t
  misc_feature (43)..(43): n is either a, c, g or t
  misc_feature (99)..(99): n is either a, c, g or t
  misc_feature (108)..(108): n is either a, c, g or t
  misc_feature (135)..(136): n is either a, c, g or t
  misc_feature (148)..(148): n is either a, c, g or t
  misc_feature (169)..(169): n is either a, c, g or t
  misc_feature (238)..(238): n is either a, c, g or t
  misc_feature (279)..(279): n is either a, c, g or t
  misc_feature (293)..(293): n is either a, c, g or t
  misc_feature (312)..(312): n is either a, c, g or t
  misc_feature (325)..(325): n is either a, c, g or t
  misc_feature (390)..(390): n is either a, c, g or t
  misc_feature (435)..(435): n is either a, c, g or t
  misc_feature (489)..(489): n is either a, c, g or t
  misc_feature (494)..(494): n is either a, c, g or t
  misc_feature (496)..(496): n is either a, c, g or t
  misc_feature (501)..(501): n is either a, c, g or t
  misc_feature (519)..(519): n is either a, c, g or t
  misc_feature (535)..(535): n is either a, c, g or t
  misc_feature (579)..(579): n is either a, c, g or t
  misc_feature (595)..(596): n is either a, c, g or t
  misc_feature (627)..(628): n is either a, c, g or t
  misc_feature (637)..(637): n is either a, c, g or t
  misc_feature (639)..(639): n is either a, c, g or t
  misc_feature (655)..(655): n is either a, c, g or t
  misc_feature (685)..(685): n is either a, c, g or t
ctaannnataaaaaaaatcataaantaattanacaataaatanaactaataataatacaatacacgaaacgacacccgattcaaaactataaacgacgnaaaataaanaataactaatataaaaaaaataaacgnnaaaacgtacctncgaaacataaattaataaacnttcaaaaaaacatccgcccccgaacaaaaaaactatatatacgcgaaaaaatacgacgcgaatctaaancacaaacgctcgcgaaaaaacgaaactcgcgccgtaacgcncgactaattaacgnaaactaccgtctaactaanataaacgtatcancataaaacacaatcgctaatacaataatcgcgttcgtcgcccaacgccgcaaacgatataaccgnctcaacacgcgcgctcgtcgacgacataaatctaaatcgaaaaanaatatacgaataacaactactatatatcaaccgaacttaaatatcgtaaaaccnatatnantaaanaacgatcgtaaaaaaaanacgtaccgcatataanaataaaattaaaactctcctcgtctacgctatacgataaacctntcgataacaaaaaaanntattctccccaaataatacacgaatatatannaataacttntnacttacttctaactcntcgttctcgctctcgactcgccgacgtctnctatacga

SEQ ID NO: 24503 - DNA, 693 bp, Artificial Sequence
  chemically treated genomic DNA (Homo sapiens) CpG-island No: 24503
  misc_feature (5)..(7): n is either a, c, g or t
  misc_feature (25)..(25): n is either a, c, g or t
  misc_feature (32)..(32): n is either a, c, g or t
  misc_feature (43)..(43): n is either a, c, g or t
  misc_feature (99)..(99): n is either a, c, g or t
  misc_feature (108)..(108): n is either a, c, g or t
  misc_feature (135)..(136): n is either a, c, g or t
  misc_feature (148)..(148): n is either a, c, g or t
  misc_feature (169)..(169): n is either a, c, g or t
  misc_feature (238)..(238): n is either a, c, g or t
  misc_feature (279)..(279): n is either a, c, g or t
  misc_feature (293)..(293): n is either a, c, g or t
  misc_feature (312)..(312): n is either a, c, g or t
  misc_feature (325)..(325): n is either a, c, g or t
  misc_feature (390)..(390): n is either a, c, g or t
  misc_feature (435)..(435): n is either a, c, g or t
  misc_feature (489)..(489): n is either a, c, g or t
  misc_feature (494)..(494): n is either a, c, g or t
  misc_feature (496)..(496): n is either a, c, g or t
  misc_feature (501)..(501): n is either a, c, g or t
  misc_feature (519)..(519): n is either a, c, g or t
  misc_feature (535)..(535): n is either a, c, g or t
  misc_feature (579)..(579): n is either a, c, g or t
  misc_feature (595)..(596): n is either a, c, g or t
  misc_feature (627)..(628): n is either a, c, g or t
  misc_feature (637)..(637): n is either a, c, g or t
  misc_feature (639)..(639): n is either a, c, g or t
  misc_feature (655)..(655): n is either a, c, g or t
  misc_feature (685)..(685): n is either a, c, g or t
ttggnnngtaggagagattatgagntgattgngtagtaaatangattgatggtggtgtagtgtacgaggcgatattcgatttagggttatggacggcgnagagtggangatagttggtgtgaggagggtgagcgnngggacgtgtttncgagatataagttagtgagtntttaggagagtattcgttttcgagtaaaggaattatgtgtgcgcggagaggtgcgacgcgagtttggantataggcgttcgcgagagggcgaggttcgcgtcgtagcgtncggttgattgacgnaaattatcgtttgattagngtgagcgtgttantataagatatagtcgttgatgtagtaatcgcgttcgtcgtttagcgtcgtaagcgatgtgatcgntttaatacgcgcgttcgtcgacgatatagatttggatcggagagnagtatgcgggtgatagttgttgtgtattagtcgggtttgggtatcgtgaggttngtgtngntgggnggcggtcgtgaggaggangcgtatcgtatgtagnagtggggttggggtttttttcgtttgcgttgtgcggtgagtttntcgataatagggaggnntgttttttttaagtgatgtacgggtgtgtgnnagtagtttntngtttgtttttggtttntcgttttcgttttcggttcgtcggcgtttnttatgcgg

SEQ ID NO: 24504 - DNA, 693 bp, Artificial Sequence
  chemically treated genomic DNA (Homo sapiens) CpG-island No: 24504
  misc_feature (9)..(9): n is either a, c, g or t
  misc_feature (39)..(39): n is either a, c, g or t
  misc_feature (55)..(55): n is either a, c, g or t
  misc_feature (57)..(57): n is either a, c, g or t
  misc_feature (66)..(67): n is either a, c, g or t
  misc_feature (98)..(99): n is either a, c, g or t
  misc_feature (115)..(115): n is either a, c, g or t
  misc_feature (159)..(159): n is either a, c, g or t
  misc_feature (175)..(175): n is either a, c, g or t
  misc_feature (193)..(193): n is either a, c, g or t
  misc_feature (198)..(198): n is either a, c, g or t
  misc_feature (200)..(200): n is either a, c, g or t
  misc_feature (205)..(205): n is either a, c, g or t
  misc_feature (259)..(259): n is either a, c, g or t
  misc_feature (304)..(304): n is either a, c, g or t
  misc_feature (369)..(369): n is either a, c, g or t
  misc_feature (382)..(382): n is either a, c, g or t
  misc_feature (401)..(401): n is either a, c, g or t
  misc_feature (415)..(415): n is either a, c, g or t
  misc_feature (456)..(456): n is either a, c, g or t
  misc_feature (525)..(525): n is either a, c, g or t
  misc_feature (546)..(546): n is either a, c, g or t
  misc_feature (558)..(559): n is either a, c, g or t
  misc_feature (586)..(586): n is either a, c, g or t
  misc_feature (595)..(595): n is either a, c, g or t
  misc_feature (651)..(651): n is either a, c, g or t
  misc_feature (662)..(662): n is either a, c, g or t
  misc_feature (669)..(669): n is either a, c, g or t
  misc_feature (687)..(689): n is either a, c, g or t
ccgcataanaaacgccgacgaaccgaaaacgaaaacganaaaccaaaaacaaacnanaaactactnncacacacccgtacatcacttaaaaaaaacanncctccctattatcganaaactcaccgcacaacgcaaacgaaaaaaaccccaaccccactnctacatacgatacgcntcctcctcacgaccgccncccancnacacnaacctcacgatacccaaacccgactaatacacaacaactatcacccgcatactnctctccgatccaaatctatatcgtcgacgaacgcgcgtattaaancgatcacatcgcttacgacgctaaacgacgaacgcgattactacatcaacgactatatcttatantaacacgctcacnctaatcaaacgataatttncgtcaatcaaccgnacgctacgacgcgaacctcgccctctcgcgaacgcctatantccaaactcgcgtcgcacctctccgcgcacacataattcctttactcgaaaacgaatactctcctaaanactcactaacttatatctcgnaaacacgtcccnncgctcaccctcctcacaccaactatcntccactctncgccgtccataaccctaaatcgaatatcgcctcgtacactacaccaccatcaatcntatttactacncaatcanctcataatctctcctacnnnccaa

SEQ ID NO: 24505 - DNA, 543 bp, Artificial Sequence
  chemically treated genomic DNA (Homo sapiens) CpG-island No: 24505
  misc_feature (45)..(45): n is either a, c, g or t
  misc_feature (123)..(123): n is either a, c, g or t
  misc_feature (191)..(191): n is either a, c, g or t
  misc_feature (206)..(206): n is either a, c, g or t
  misc_feature (372)..(372): n is either a, c, g or t
  misc_feature (481)..(481): n is either a, c, g or t
atatcgtataataacgatttttattttagattacgatttcgtttnaggaggttttgcggttatttttaggttttacgtagtatgtattacgtattttatgatatcggaagaatacgtttgagnatattcgtttaagtgcgcgtcgtagatcgtttgttagtcgcgagtttttattttgacgcgagtgtttnatgggattttatttngtgacggttatagatagtcggatttatatacgtcgcgttgtgacgattttgttttttgtcgcgtttttcgttttattcgagaatatgtgatacgtacgatttagtagtttcgcggtggcggtcgttagttttaggtttcggtattcgtatttttcgagtattattncgtcgtttatttattatttaatatgttttttatttatcggatttttatagttttttttgatgtgacgtcgttttagatttttttttttattgtttgcgtaggtattgancgcgttagggagtagcgtgtttatattttttttcgatgatatttatagttattcgtatattt

SEQ ID NO: 24506 - DNA, 543 bp, Artificial Sequence
  chemically treated genomic DNA (Homo sapiens) CpG-island No: 24506
  misc_feature (63)..(63): n is either a, c, g or t
  misc_feature (172)..(172): n is either a, c, g or t
  misc_feature (338)..(338): n is either a, c, g or t
  misc_feature (353)..(353): n is either a, c, g or t
  misc_feature (421)..(421): n is either a, c, g or t
  misc_feature (499)..(499): n is either a, c, g or t
aaatatacgaataactataaatatcatcgaaaaaaaatataaacacgctactccctaacgcgntcaatacctacgcaaacaataaaaaaaaaaatctaaaacgacgtcacatcaaaaaaaactataaaaatccgataaataaaaaacatattaaataataaataaacgacgnaataatactcgaaaaatacgaataccgaaacctaaaactaacgaccgccaccgcgaaactactaaatcgtacgtatcacatattctcgaataaaacgaaaaacgcgacaaaaaacaaaatcgtcacaacgcgacgtatataaatccgactatctataaccgtcacnaaataaaatcccatnaaacactcgcgtcaaaataaaaactcgcgactaacaaacgatctacgacgcgcacttaaacgaatatnctcaaacgtattcttccgatatcataaaatacgtaatacatactacgtaaaacctaaaaataaccgcaaaacctcctnaaacgaaatcgtaatctaaaataaaaatcgttattatacgatat

SEQ ID NO: 24507 - DNA, 543 bp, Artificial Sequence
  chemically treated genomic DNA (Homo sapiens) CpG-island No: 24507
  misc_feature (63)..(63): n is either a, c, g or t
  misc_feature (172)..(172): n is either a, c, g or t
  misc_feature (338)..(338): n is either a, c, g or t
  misc_feature (353)..(353): n is either a, c, g or t
  misc_feature (421)..(421): n is either a, c, g or t
  misc_feature (499)..(499): n is either a, c, g or t
ggatgtacgaatagttataagtattatcgaagaagagtataagtacgttgttttttggcgcgnttagtatttacgtaaatagtgaagggggggatttgggacgacgttatattaggagaggttgtggagattcggtaggtggagaatatattgagtgatggatgggcgacgnagtagtattcggagggtgcgagtgtcggagtttgaggttggcggtcgttatcgcgaagttattaggtcgtacgtgttatatattttcgggtgaggcgagggacgcgatagaggatagaatcgttatagcgcggcgtgtgtgagttcgattgtttatgatcgttatnagatgagattttatnaggtattcgcgttaaagtaggagttcgcgattgataagcggtttacgacgcgtatttaggcgaatatntttaagcgtgttttttcggtgttatgaggtgcgtaatgtatattacgtgaagtttgggagtggtcgtagagttttttngggcggggtcgtggtttagggtggagatcgttgttgtgcggtgt

SEQ ID NO: 24508 - DNA, 543 bp, Artificial Sequence
  chemically treated genomic DNA (Homo sapiens) CpG-island No: 24508
  misc_feature (45)..(45): n is either a, c, g or t
  misc_feature (123)..(123): n is either a, c, g or t
  misc_feature (191)..(191): n is either a, c, g or t
  misc_feature (206)..(206): n is either a, c, g or t
  misc_feature (372)..(372): n is either a, c, g or t
  misc_feature (481)..(481): n is either a, c, g or t
acaccgcacaacaacgatctccaccctaaaccacgaccccgcccnaaaaaactctacgaccactcccaaacttcacgtaatatacattacgcacctcataacaccgaaaaaacacgcttaaanatattcgcctaaatacgcgtcgtaaaccgcttatcaatcgcgaactcctactttaacgcgaatacctnataaaatctcatctnataacgatcataaacaatcgaactcacacacgccgcgctataacgattctatcctctatcgcgtccctcgcctcacccgaaaatatataacacgtacgacctaataacttcgcgataacgaccgccaacctcaaactccgacactcgcaccctccgaatactactncgtcgcccatccatcactcaatatattctccacctaccgaatctccacaacctctcctaatataacgtcgtcccaaatcccccccttcactatttacgtaaatactaancgcgccaaaaaacaacgtacttatactcttcttcgataatacttataactattcgtacatcc

SEQ ID NO: 24509 - DNA, 743 bp, Artificial Sequence
  chemically treated genomic DNA (Homo sapiens) CpG-island No: 24509
  misc_feature (124)..(124): n is either a, c, g or t
  misc_feature (228)..(228): n is either a, c, g or t
  misc_feature (247)..(247): n is either a, c, g or t
  misc_feature (300)..(300): n is either a, c, g or t
  misc_feature (316)..(316): n is either a, c, g or t
  misc_feature (504)..(504): n is either a, c, g or t
  misc_feature (507)..(507): n is either a, c, g or t
  misc_feature (597)..(597): n is either a, c, g or t
  misc_feature (631)..(631): n is either a, c, g or t
  misc_feature (653)..(653): n is either a, c, g or t
  misc_feature (663)..(663): n is either a, c, g or t
  misc_feature (701)..(701): n is either a, c, g or t
  misc_feature (722)..(722): n is either a, c, g or t
  misc_feature (729)..(729): n is either a, c, g or t
cgtcgttttcgtgtatttatttaatcgttaacgtcgttttttattatcgtttcgtgtttcgtttgatattattcgtgttttttcgttacgttattattatatcggttgcgatgtttttcgttanatcgatgttttttttttaattcgtaatcgtttttcgtattattttaacgcgttttatagtgagcgttttttgttgatgtaattagtgttcgttttcgttttttncgtttatttttttaatttntgttttcggtttcgagatttatatttcgttattattttttatttattcgtttnttttttatggttttanatttcgtagtgtatgttgtgagagggagcgttttggtatggttttttgtttttcgttcggcgtagttattattttagtgttttttacggatcgtttttagttgttttttattggatacgttcgtagttcgttattattaacggaagtttattgcgaatttgtcgacgtagatagcgtcggattagcgnatnggtgtttattgttttttttattatggtgttattttcgtttgtttattattgttagatatcgcgttacgtgcgtttttttttgacgtacgnttgagcggcgatttttagatatcgtatttttgangtgttttttatcgatcgatcgnattttacgtnatgagatataatttagattattcgatttcgcgtttttntgtttttttttttattgcgtnttatttnatttttatttatgt

SEQ ID NO: 24510 - DNA, 743 bp, Artificial Sequence
  chemically treated genomic DNA (Homo sapiens) CpG-island No: 24510
  misc_feature (15)..(15): n is either a, c, g or t
  misc_feature (22)..(22): n is either a, c, g or t
  misc_feature (43)..(43): n is either a, c, g or t
  misc_feature (81)..(81): n is either a, c, g or t
  misc_feature (91)..(91): n is either a, c, g or t
  misc_feature (113)..(113): n is either a, c, g or t
  misc_feature (147)..(147): n is either a, c, g or t
  misc_feature (237)..(237): n is either a, c, g or t
  misc_feature (240)..(240): n is either a, c, g or t
  misc_feature (428)..(428): n is either a, c, g or t
  misc_feature (444)..(444): n is either a, c, g or t
  misc_feature (497)..(497): n is either a, c, g or t
  misc_feature (516)..(516): n is either a, c, g or t
  misc_feature (620)..(620): n is either a, c, g or t
acataaataaaaatnaaataanacgcaataaaaaaaaaaacanaaaaacgcgaaatcgaataatctaaattatatctcatnacgtaaaatncgatcgatcgataaaaaacacntcaaaaatacgatatctaaaaatcgccgctcaancgtacgtcaaaaaaaaacgcacgtaacgcgatatctaacaataataaacaaacgaaaataacaccataataaaaaaaacaataaacaccnatncgctaatccgacgctatctacgtcgacaaattcgcaataaacttccgttaataataacgaactacgaacgtatccaataaaaaacaactaaaaacgatccgtaaaaaacactaaaataataactacgccgaacgaaaaacaaaaaaccataccaaaacgctccctctcacaacatacactacgaaatntaaaaccataaaaaanaaacgaataaataaaaaataataacgaaatataaatctcgaaaccgaaaacanaaattaaaaaaataaacgnaaaaaacgaaaacgaacactaattacatcaacaaaaaacgctcactataaaacgcgttaaaataatacgaaaaacgattacgaattaaaaaaaaaacatcgatntaacgaaaaacatcgcaaccgatataataataacgtaacgaaaaaacacgaataatatcaaacgaaacacgaaacgataataaaaaacgacgttaacgattaaataaatacacgaaaacgacg

SEQ ID NO: 24511 - DNA, 743 bp, Artificial Sequence
  chemically treated genomic DNA (Homo sapiens) CpG-island No: 24511
  misc_feature (15)..(15): n is either a, c, g or t
  misc_feature (22)..(22): n is either a, c, g or t
  misc_feature (43)..(43): n is either a, c, g or t
  misc_feature (81)..(81): n is either a, c, g or t
  misc_feature (91)..(91): n is either a, c, g or t
  misc_feature (113)..(113): n is either a, c, g or t
  misc_feature (147)..(147): n is either a, c, g or t
  misc_feature (237)..(237): n is either a, c, g or t
  misc_feature (240)..(240): n is either a, c, g or t
  misc_feature (428)..(428): n is either a, c, g or t
  misc_feature (444)..(444): n is either a, c, g or t
  misc_feature (497)..(497): n is either a, c, g or t
  misc_feature (516)..(516): n is either a, c, g or t
  misc_feature (620)..(620): n is either a, c, g or t
gtatagatgagggtnaggtganacgtagtggaaggagaagtangggagcgcgggatcgagtaatttgagttgtattttatnacgtagggtncggtcgatcgatgaggaatatnttaggagtacggtgtttaaaggtcgtcgtttagncgtgcgttagggaaggacgtacgtggcgcggtgtttgatagtgatgagtaggcgaagatggtattatggtggagaagataatggatattnatncgttagttcgacgttgtttgcgtcgataggttcgtagtggattttcgttgatggtggcgggttgcggacgtgtttagtagagagtagttagagacgattcgtagagggtattgagatagtgattgcgtcgagcggggggtaaagaattatattagagcgtttttttttataatatatattacgggatntggagttatagagganggacgaatgggtaggggatagtggcgagatgtagatttcggggtcgggaatanaagttaagggagtgggcgngaggagcgggagcgggtattaattgtattaataaagggcgtttattatagagcgcgttgggatggtacggggagcggttacgagttgagagggaagtatcggtntagcgaagagtatcgtaatcgatgtggtaatagcgtgacgggggggtacgggtggtgttaggcggagtacggagcggtagtgagaagcgacgttggcgattgagtgggtgtacggaagcggcg

SEQ ID NO: 24512 - DNA, 743 bp, Artificial Sequence
  chemically treated genomic DNA (Homo sapiens) CpG-island No: 24512
  misc_feature (124)..(124): n is either a, c, g or t
  misc_feature (228)..(228): n is either a, c, g or t
  misc_feature (247)..(247): n is either a, c, g or t
  misc_feature (300)..(300): n is either a, c, g or t
  misc_feature (316)..(316): n is either a, c, g or t
  misc_feature (504)..(504): n is either a, c, g or t
  misc_feature (507)..(507): n is either a, c, g or t
  misc_feature (597)..(597): n is either a, c, g or t
  misc_feature (631)..(631): n is either a, c, g or t
  misc_feature (653)..(653): n is either a, c, g or t
  misc_feature (663)..(663): n is either a, c, g or t
  misc_feature (701)..(701): n is either a, c, g or t
  misc_feature (722)..(722): n is either a, c, g or t
  misc_feature (729)..(729): n is either a, c, g or t
cgccgcttccgtacacccactcaatcgccaacgtcgcttctcactaccgctccgtactccgcctaacaccacccgtacccccccgtcacgctattaccacatcgattacgatactcttcgctanaccgatacttccctctcaactcgtaaccgctccccgtaccatcccaacgcgctctataataaacgccctttattaatacaattaatacccgctcccgctcctcncgcccactcccttaacttntattcccgaccccgaaatctacatctcgccactatcccctacccattcgtccntcctctataactccanatcccgtaatatatattataaaaaaaaacgctctaatataattctttaccccccgctcgacgcaatcactatctcaataccctctacgaatcgtctctaactactctctactaaacacgtccgcaacccgccaccatcaacgaaaatccactacgaacctatcgacgcaaacaacgtcgaactaacgnatnaatatccattatcttctccaccataataccatcttcgcctactcatcactatcaaacaccgcgccacgtacgtccttccctaacgcacgnctaaacgacgacctttaaacaccgtactcctaanatattcctcatcgatcgaccgnaccctacgtnataaaatacaactcaaattactcgatcccgcgctcccntacttctccttccactacgtntcacctnaccctcatctatac

SEQ ID NO: 24513 - DNA, 560 bp, Artificial Sequence
  chemically treated genomic DNA (Homo sapiens) CpG-island No: 24513
  misc_feature (9)..(9): n is either a, c, g or t
  misc_feature (20)..(20): n is either a, c, g or t
  misc_feature (89)..(89): n is either a, c, g or t
  misc_feature (140)..(140): n is either a, c, g or t
  misc_feature (163)..(163): n is either a, c, g or t
  misc_feature (195)..(195): n is either a, c, g or t
  misc_feature (228)..(228): n is either a, c, g or t
  misc_feature (231)..(231): n is either a, c, g or t
  misc_feature (539)..(539): n is either a, c, g or t
gttttcgtnatatcgattangcgtcgcgagtcgcgtttggttcgtcgattattttagttgtatcggcgttttttttttatgatacgttntttgtacgcgttcgttttagtttaattacgtaggcgtattttttattatanatattattgttatttcgtttagnacgttagtttattatttgtagtttcgacggtnaggtggtcgtatcggtattaagtcgttcgaatngtntttattttattcgaatacgattgcgcgagttacgtatatacgagttgatttcgtaggtgtatcgtttaagttttgtcgtgattgcgtagtttagatttttattatttgtttttataagtgattatgttagtttagattttattttacgggtcgtttttatacgagttgagcgagcgatattcgcggatattgtacgtttgtatgtagaatagttagcggatcgtagagcgcgttgttgtgcgagataattacgttttagtttgacgttaatatataatgatgagttatttacgggcgacgcgtttttntacgtatagatgagttagtat

SEQ ID NO: 24514 - DNA, 560 bp, Artificial Sequence
  chemically treated genomic DNA (Homo sapiens) CpG-island No: 24514
  misc_feature (22)..(22): n is either a, c, g or t
  misc_feature (330)..(330): n is either a, c, g or t
  misc_feature (333)..(333): n is either a, c, g or t
  misc_feature (366)..(366): n is either a, c, g or t
  misc_feature (398)..(398): n is either a, c, g or t
  misc_feature (421)..(421): n is either a, c, g or t
  misc_feature (472)..(472): n is either a, c, g or t
  misc_feature (541)..(541): n is either a, c, g or t
  misc_feature (552)..(552): n is either a, c, g or t
atactaactcatctatacgtanaaaaacgcgtcgcccgtaaataactcatcattatatattaacgtcaaactaaaacgtaattatctcgcacaacaacgcgctctacgatccgctaactattctacatacaaacgtacaatatccgcgaatatcgctcgctcaactcgtataaaaacgacccgtaaaataaaatctaaactaacataatcacttataaaaacaaataataaaaatctaaactacgcaatcacgacaaaacttaaacgatacacctacgaaatcaactcgtatatacgtaactcgcgcaatcgtattcgaataaaataaanacnattcgaacgacttaataccgatacgaccacctnaccgtcgaaactacaaataataaactaacgtnctaaacgaaataacaataatatntataataaaaaatacgcctacgtaattaaactaaaacgaacgcgtacaaanaacgtatcataaaaaaaaaacgccgatacaactaaaataatcgacgaaccaaacgcgactcgcgacgcntaatcgatatnacgaaaac

SEQ ID NO: 24515 - DNA, 560 bp, Artificial Sequence
  chemically treated genomic DNA (Homo sapiens) CpG-island No: 24515
  misc_feature (22)..(22): n is either a, c, g or t
  misc_feature (330)..(330): n is either a, c, g or t
  misc_feature (333)..(333): n is either a, c, g or t
  misc_feature (366)..(366): n is either a, c, g or t
  misc_feature (398)..(398): n is either a, c, g or t
  misc_feature (421)..(421): n is either a, c, g or t
  misc_feature (472)..(472): n is either a, c, g or t
  misc_feature (541)..(541): n is either a, c, g or t
  misc_feature (552)..(552): n is either a, c, g or t
gtattaatttatttgtacgtanggagacgcgtcgttcgtgaatgatttattattatgtattggcgttaggttggagcgtagttatttcgtataatagcgcgttttgcgattcgttgattgttttgtatgtaggcgtgtagtattcgcgggtgtcgttcgtttaattcgtgtaggggcggttcgtggagtgggatttaggttggtatgattatttgtgggagtaggtggtggagatttaagttacgtagttacggtaagatttggacgatgtatttacggaattaattcgtgtatgcgtgattcgcgtagtcgtgttcggatgagataagnatngttcgagcggtttagtatcggtacgattatttnatcgtcggggttgtaagtagtaaattgacgtnttgagcgaggtagtagtgatgtntgtagtggagagtgcgtttacgtagttaggttgaggcgaacgcgtgtaggngacgtgttatgagaaggaggcgtcgatgtagttaggatgatcggcgagttaggcgcggttcgcgacgtntagtcgatatngcgagggt

SEQ ID NO: 24516 - DNA, 560 bp, Artificial Sequence
  chemically treated genomic DNA (Homo sapiens) CpG-island No: 24516
  misc_feature (9)..(9): n is either a, c, g or t
  misc_feature (20)..(20): n is either a, c, g or t
  misc_feature (89)..(89): n is either a, c, g or t
  misc_feature (140)..(140): n is either a, c, g or t
  misc_feature (163)..(163): n is either a, c, g or t
  misc_feature (195)..(195): n is either a, c, g or t
  misc_feature (228)..(228): n is either a, c, g or t
  misc_feature (231)..(231): n is either a, c, g or t
  misc_feature (539)..(539): n is either a, c, g or t
accctcgcnatatcgactanacgtcgcgaaccgcgcctaactcgccgatcatcctaactacatcgacgcctccttctcataacacgtcncctacacgcgttcgcctcaacctaactacgtaaacgcactctccactacanacatcactactacctcgctcaanacgtcaatttactacttacaaccccgacgatnaaataatcgtaccgatactaaaccgctcgaacnatncttatctcatccgaacacgactacgcgaatcacgcatacacgaattaattccgtaaatacatcgtccaaatcttaccgtaactacgtaacttaaatctccaccacctactcccacaaataatcataccaacctaaatcccactccacgaaccgcccctacacgaattaaacgaacgacacccgcgaatactacacgcctacatacaaaacaatcaacgaatcgcaaaacgcgctattatacgaaataactacgctccaacctaacgccaatacataataataaatcattcacgaacgacgcgtctccntacgtacaaataaattaatac

SEQ ID NO: 24517 - DNA, 615 bp, Artificial Sequence
  chemically treated genomic DNA (Homo sapiens) CpG-island No: 24517
gcgtagtatagcgcgggttttgttacgggtttcgtcggttttcgattgcggaatagaattaaggattatattagtattcgtttgtacggtggcgatatcgttttttattagcgtcgagcggattataagtgtacggtagtcgacgattagtcgatgtagacggtagataataatttttatttgtagtcgttcgatacgtatgcgttgcgtggcgaatagattattgtttgcgtatcgcgtcgaagtttataatattgttagttatggtagttcgcgttagttttgtttttacgaggatagtattaagttgtagagttttttttaatacgttcggcggtataatattttcgaacgattaacgatttattttaaagataagatattaacgtcgggagattagggatttcgggaaagatttgaacgtatcggcgtttcggttttttggttattcgaatcgtacggggggttttttacggcggatttcgcgtaagaatacggcgaaaagaattgtttacgcgagatttggcgaaaatatttagagattttaaaaaggataattttatttatttttaggtttattattttcggtgttaaaaaatcgcgtttttaaagttt

SEQ ID NO: 24518 - DNA, 615 bp, Artificial Sequence
  chemically treated genomic DNA (Homo sapiens) CpG-island No: 24518
aaactttaaaaacgcgattttttaacaccgaaaataataaacctaaaaataaataaaattatcctttttaaaatctctaaatattttcgccaaatctcgcgtaaacaattcttttcgccgtattcttacgcgaaatccgccgtaaaaaaccccccgtacgattcgaataaccaaaaaaccgaaacgccgatacgttcaaatctttcccgaaatccctaatctcccgacgttaatatcttatctttaaaataaatcgttaatcgttcgaaaatattataccgccgaacgtattaaaaaaaactctacaacttaatactatcctcgtaaaaacaaaactaacgcgaactaccataactaacaatattataaacttcgacgcgatacgcaaacaataatctattcgccacgcaacgcatacgtatcgaacgactacaaataaaaattattatctaccgtctacatcgactaatcgtcgactaccgtacacttataatccgctcgacgctaataaaaaacgatatcgccaccgtacaaacgaatactaatataatccttaattctattccgcaatcgaaaaccgacgaaacccgtaacaaaacccgcgctatactacgc

SEQ ID NO: 24519 - DNA, 615 bp, Artificial Sequence
  chemically treated genomic DNA (Homo sapiens) CpG-island No: 24519
gggttttaaaagcgcggttttttggtatcgggggtggtgggtttgggggtaagtgaggttgttttttttggggtttttgggtgttttcgttaaatttcgcgtgggtaatttttttcgtcgtgtttttgcgcgaaattcgtcgtggggagtttttcgtgcggttcgggtagttaaggggtcggggcgtcggtgcgtttaagtttttttcggggtttttggtttttcgacgttggtgttttatttttgggatgaatcgttaatcgttcggaggtgttgtatcgtcgggcgtgttaagaagggttttgtagtttggtgttgttttcgtgaggataaggttaacgcggattgttataattagtaatgttataaatttcggcgcgatgcgtaggtaatggtttgttcgttacgtagcgtatgcgtatcggacggttgtaggtaaggattattgtttatcgtttgtatcggttgatcgtcgattatcgtgtatttgtgattcgttcggcgttggtggaaaacggtatcgttatcgtgtaagcgggtgttggtgtagtttttgattttgtttcgtagtcggaagtcgacgaaattcgtaataaagttcgcgttgtattgcgt

SEQ ID NO: 24520 - DNA, 615 bp, Artificial Sequence
  chemically treated genomic DNA (Homo sapiens) CpG-island No: 24520
acgcaatacaacgcgaactttattacgaatttcgtcgacttccgactacgaaacaaaatcaaaaactacaccaacacccgcttacacgataacgataccgttttccaccaacgccgaacgaatcacaaatacacgataatcgacgatcaaccgatacaaacgataaacaataatccttacctacaaccgtccgatacgcatacgctacgtaacgaacaaaccattacctacgcatcgcgccgaaatttataacattactaattataacaatccgcgttaaccttatcctcacgaaaacaacaccaaactacaaaacccttcttaacacgcccgacgatacaacacctccgaacgattaacgattcatcccaaaaataaaacaccaacgtcgaaaaaccaaaaaccccgaaaaaaacttaaacgcaccgacgccccgaccccttaactacccgaaccgcacgaaaaactccccacgacgaatttcgcgcaaaaacacgacgaaaaaaattacccacgcgaaatttaacgaaaacacccaaaaaccccaaaaaaaacaacctcacttacccccaaacccaccacccccgataccaaaaaaccgcgcttttaaaaccc

SEQ ID NO: 24521 - DNA, 594 bp, Artificial Sequence
  chemically treated genomic DNA (Homo sapiens) CpG-island No: 24521
tgtttcgttgtttaaggagtagttatgatttggtttcgtcgttagttttttatcggcgtcggcgtgttggtagtcgttagcggtatcgtagggcgcgtggtggttaatacgttgaatattaatggggtgcgttacggtatggtgtatgacgagtcgttatgtatcggttgtatcgtttgtatggatgtttgtcgggaagtgaataaggtgtcggaaggcgtttcgcgtttgacgattattcgtagcgagtcgtagggcgaattttttgatgtgaaatatcgtttttttcgtaagttttgttagtattgcgattatgcgtcgtgcgttgacgtttgttcgatcggtgcgttttttcgcgatgtttgtagtgggattgttttatgtttattttcggatttttgcgttcggtcgtttattggttcgttttttgttcgtatcgcgtttgttttttatttttttcggtttttaataacgcggattacgcgaatttcgtcgaaaatttattgtcgggcggaagtttttcggtgtaaacgtcgttacgaacgttatcgagattgtaatatataagattataagtgggttaattattaacgt

SEQ ID NO: 24522 - DNA, 594 bp, Artificial Sequence
  chemically treated genomic DNA (Homo sapiens) CpG-island No: 24522
acgttaataattaacccacttataatcttatatattacaatctcgataacgttcgtaacgacgtttacaccgaaaaacttccgcccgacaataaattttcgacgaaattcgcgtaatccgcgttattaaaaaccgaaaaaaataaaaaacaaacgcgatacgaacaaaaaacgaaccaataaacgaccgaacgcaaaaatccgaaaataaacataaaacaatcccactacaaacatcgcgaaaaaacgcaccgatcgaacaaacgtcaacgcacgacgcataatcgcaatactaacaaaacttacgaaaaaaacgatatttcacatcaaaaaattcgccctacgactcgctacgaataatcgtcaaacgcgaaacgccttccgacaccttattcacttcccgacaaacatccatacaaacgatacaaccgatacataacgactcgtcatacaccataccgtaacgcaccccattaatattcaacgtattaaccaccacgcgccctacgataccgctaacgactaccaacacgccgacgccgataaaaaactaacgacgaaaccaaatcataactactccttaaacaacgaaaca

SEQ ID NO: 24523 - DNA, 594 bp, Artificial Sequence
  chemically treated genomic DNA (Homo sapiens) CpG-island No: 24523
gcgttggtggttggtttatttgtgattttgtgtgttgtagtttcgatggcgttcgtggcgacgtttatatcggggaattttcgttcggtagtgggttttcggcggaattcgcgtggttcgcgttgttgggggtcgggagggataaagggtaagcgcggtgcggatagggggcgagttagtgggcgatcggacgtagagattcgggaataaatatgggataattttattgtaagtatcgcgagaagacgtatcggtcgggtagacgttaacgtacggcgtatgatcgtagtgttggtaagatttacggaagaagcgatattttatattaggaaattcgttttgcggttcgttacgaataatcgttaggcgcgagacgtttttcggtattttgtttatttttcgataagtatttatataggcggtatagtcgatgtataacgattcgttatgtattatgtcgtaacgtattttattgatatttaacgtgttggttattacgcgttttgcggtgtcgttgacggttgttagtacgtcgacgtcggtgagaaattggcgacgagattaggttatggttgttttttaagtaacggaata

SEQ ID NO: 24524 - DNA, 594 bp, Artificial Sequence
  chemically treated genomic DNA (Homo sapiens) CpG-island No: 24524
tattccgttacttaaaaaacaaccataacctaatctcgtcgccaatttctcaccgacgtcgacgtactaacaaccgtcaacgacaccgcaaaacgcgtaataaccaacacgttaaatatcaataaaatacgttacgacataatacataacgaatcgttatacatcgactataccgcctatataaatacttatcgaaaaataaacaaaataccgaaaaacgtctcgcgcctaacgattattcgtaacgaaccgcaaaacgaatttcctaatataaaatatcgcttcttccgtaaatcttaccaacactacgatcatacgccgtacgttaacgtctacccgaccgatacgtcttctcgcgatacttacaataaaattatcccatatttattcccgaatctctacgtccgatcgcccactaactcgccccctatccgcaccgcgcttaccctttatccctcccgacccccaacaacgcgaaccacgcgaattccgccgaaaacccactaccgaacgaaaattccccgatataaacgtcgccacgaacgccatcgaaactacaacacacaaaatcacaaataaaccaaccaccaacgc

SEQ ID NO: 24525 - DNA, 738 bp, Artificial Sequence
  chemically treated genomic DNA (Homo sapiens) CpG-island No: 24525
ttatgttagtattagcgttcgatgtaataacggtatgttatttgtttgtttcgcgtagttgtcgagtatatgttgttagtatttcggttgttgcgttacgtcgatcgtttggttggtttgttagtcggcgtattatgtttatgtcgtaaggaaggcgttattattgttatttttattttattaggtaaagcgcgtttcgggtttcgttagttgtattagtcgtagacggttattttgaattatttgacgaatgtcgttagcggcggtattttgatgatcggtaagcgaacgttaggcgagattgagcgggattagacggttatcggtgttgattacgttattttacggtttatcgattaacgtattaagattgttgcggaaaattttttgcggcgttttattattttgtagtcggatattgttcgtttggtcgggtaatattagcgcgtttatcgtattacgagtatgattttttacggcgtttatcggcgtttcgttattatatatagacgtttcgggtatacgtcgttttgtttgtttattcgtcgtattcgttttatcgtttttcgttatattcgtttcgatataatcgttatgcgcgttcgtttgttattaagcgatacgagttcgtcgtttaatcgtgatataatcgcgcggcgtataaagggatattcgtttttttatttttttattttttatttcgtatagacgtcgcgtcgtcgacgcgcggcgcgtttt

SEQ ID NO: 24526 - DNA, 738 bp, Artificial Sequence
  chemically treated genomic DNA (Homo sapiens) CpG-island No: 24526
aaaacgcgccgcgcgtcgacgacgcgacgtctatacgaaataaaaaataaaaaaataaaaaaacgaatatccctttatacgccgcgcgattatatcacgattaaacgacgaactcgtatcgcttaataacaaacgaacgcgcataacgattatatcgaaacgaatataacgaaaaacgataaaacgaatacgacgaataaacaaacaaaacgacgtatacccgaaacgtctatatataataacgaaacgccgataaacgccgtaaaaaatcatactcgtaatacgataaacgcgctaatattacccgaccaaacgaacaatatccgactacaaaataataaaacgccgcaaaaaattttccgcaacaatcttaatacgttaatcgataaaccgtaaaataacgtaatcaacaccgataaccgtctaatcccgctcaatctcgcctaacgttcgcttaccgatcatcaaaataccgccgctaacgacattcgtcaaataattcaaaataaccgtctacgactaatacaactaacgaaacccgaaacgcgctttacctaataaaataaaaataacaataataacgccttccttacgacataaacataatacgccgactaacaaaccaaccaaacgatcgacgtaacgcaacaaccgaaatactaacaacatatactcgacaactacgcgaaacaaacaaataacataccgttattacatcgaacgctaatactaacataa

SEQ ID NO: 24527 - DNA, 738 bp, Artificial Sequence
  chemically treated genomic DNA (Homo sapiens) CpG-island No: 24527
ggggcgcgtcgcgcgtcggcggcgcggcgtttgtgcggggtggggggtgggggggtggggggacgggtgtttttttgtgcgtcgcgcggttgtgttacggttgggcggcgggttcgtgtcgtttgatggtaggcgggcgcgtatggcggttgtgtcggggcgggtgtggcggggggcggtggggcgggtgcggcgggtgggtaggtagggcggcgtatgttcggggcgtttgtgtgtggtagcggggcgtcggtgggcgtcgtgggaggttatgttcgtggtgcggtgagcgcgttgatgttgttcgattaggcgagtaatattcggttataaagtagtgaaacgtcgtaggagatttttcgtaataattttgatgcgttagtcgatgaatcgtggggtggcgtaattaatatcggtagtcgtttgatttcgtttagtttcgtttggcgttcgtttgtcgattattaaagtgtcgtcgttaacgatattcgttagatgatttaggataatcgtttgcggttgatgtaattggcggggttcggagcgcgttttatttggtggggtgaagatggtaatggtgacgttttttttacggtatgggtatggtacgtcgattggtaggttagttaggcgatcggcgtaacgtaataatcggaatattggtagtatatgttcgatagttacgcggagtaggtagataatatgtcgttattgtatcgggcgttggtgttggtatgg

SEQ ID NO: 24528 - DNA, 738 bp, Artificial Sequence
  chemically treated genomic DNA (Homo sapiens) CpG-island No: 24528
ccataccaacaccaacgcccgatacaataacgacatattatctacctactccgcgtaactatcgaacatatactaccaatattccgattattacgttacgccgatcgcctaactaacctaccaatcgacgtaccatacccataccgtaaaaaaaacgtcaccattaccatcttcaccccaccaaataaaacgcgctccgaaccccgccaattacatcaaccgcaaacgattatcctaaatcatctaacgaatatcgttaacgacgacactttaataatcgacaaacgaacgccaaacgaaactaaacgaaatcaaacgactaccgatattaattacgccaccccacgattcatcgactaacgcatcaaaattattacgaaaaatctcctacgacgtttcactactttataaccgaatattactcgcctaatcgaacaacatcaacgcgctcaccgcaccacgaacataacctcccacgacgcccaccgacgccccgctaccacacacaaacgccccgaacatacgccgccctacctacccacccgccgcacccgccccaccgccccccgccacacccgccccgacacaaccgccatacgcgcccgcctaccatcaaacgacacgaacccgccgcccaaccgtaacacaaccgcgcgacgcacaaaaaaacacccgtccccccacccccccaccccccaccccgcacaaacgccgcgccgccgacgcgcgacgcgcccc

SEQ ID NO: 24529 - DNA, 837 bp, Artificial Sequence
  chemically treated genomic DNA (Homo sapiens) CpG-island No: 24529
ggcgggggacgtaacggattttagtgtcggggagcgtattattttataattgtgcgtagatgtttgatgcgacgttagcgcgttttattatgtttataaatttgtgtcggatcggtaggtcggataaggcgtttatgtcgtattcggtagttatgcgtagatgtttgatgcgacgttggcgcgttttattatgtttataaatttgtgtttgaacggtaggacggataaggcgtttacgtcgtattcggtagttgtgtattaatgttggatatttatattaacgtttttataatttttaattttagtttattcggtatttcgttatacgatagtatatgtagtttcggcgtaaataattttgtataacgcgttagtaaagggcgtagttgcggtggtattagtagtatcgggttttttttcgtcgtttttatttgtttttttatttgtggtatcgtattttggaattggttgagtatattcggatcgatcggtacgttgtcgagtattattttttcgttttgttgcgtttgatttattacgttggttagtagattttttagtttattatttagcgtatatatcgttagtttttgtttgcgaacgaacggatgggtaatgttgcgtcgtaatgttagggggtatatcgggcggtagtagaatatgatttttcgttatcgtgttattggggattagtacgggggcgaatgtgacgaattttcgtaagggaacgttttcggtagtaagcgtcggtgattttattattggtgtattagcgcgggttaaatttcgtcgaacgtgcgttagatacggttttacgcgtaatttcgttatatttga

SEQ ID NO: 24530 - DNA, 837 bp, Artificial Sequence
  chemically treated genomic DNA (Homo sapiens) CpG-island No: 24530
tcaaatataacgaaattacgcgtaaaaccgtatctaacgcacgttcgacgaaatttaacccgcgctaatacaccaataataaaatcaccgacgcttactaccgaaaacgttcccttacgaaaattcgtcacattcgcccccgtactaatccccaataacacgataacgaaaaatcatattctactaccgcccgatataccccctaacattacgacgcaacattacccatccgttcgttcgcaaacaaaaactaacgatatatacgctaaataataaactaaaaaatctactaaccaacgtaataaatcaaacgcaacaaaacgaaaaaataatactcgacaacgtaccgatcgatccgaatatactcaaccaattccaaaatacgataccacaaataaaaaaacaaataaaaacgacgaaaaaaaacccgatactactaataccaccgcaactacgccctttactaacgcgttatacaaaattatttacgccgaaactacatatactatcgtataacgaaataccgaataaactaaaattaaaaattataaaaacgttaatataaatatccaacattaatacacaactaccgaatacgacgtaaacgccttatccgtcctaccgttcaaacacaaatttataaacataataaaacgcgccaacgtcgcatcaaacatctacgcataactaccgaatacgacataaacgccttatccgacctaccgatccgacacaaatttataaacataataaaacgcgctaacgtcgcatcaaacatctacgcacaattataaaataatacgctccccgacactaaaatccgttacgtcccccgcc

SEQ ID NO: 24531 - DNA, 837 bp, Artificial Sequence
  chemically treated genomic DNA (Homo sapiens) CpG-island No: 24531
ttaagtgtagcggaattacgcgtgaaatcgtatttgacgtacgttcggcgaaatttgattcgcgttaatatattagtggtaaggttatcggcgtttgttgtcgaaggcgtttttttgcgagaattcgttatattcgttttcgtgttggtttttagtagtacggtgacgaaagattatattttgttgtcgttcgatgtgttttttggtattgcggcgtagtattatttattcgttcgttcgtaagtaggagttgacggtgtatacgttgaataatgagttggaaaatttgttgattaacgtggtgaattaggcgtaatagggcgggaaagtgatgttcgatagcgtgtcggtcgattcgaatatgtttaattagttttagagtacgatgttataggtgaaagagtagatgaaagcggcggggaaagattcggtgttgttggtgttatcgtagttgcgttttttgttggcgcgttatgtaaggttgtttgcgtcggggttgtatgtgttgtcgtataacgaagtgtcggatgagttggagttgaagattatgggggcgttgatgtaagtatttagtattggtgtataattgtcggatgcggcgtgaacgttttattcgttttatcgtttaggtataagtttgtaggtatgataagacgcgttagcgtcgtattaggtatttgcgtataattgtcggatgcggtataaacgttttattcggtttatcgattcggtataagtttgtaggtatgataagacgcgttagcgtcgtattaggtatttgcgtataattatgaaatgatacgtttttcggtattaaaattcgttacgtttttcgtt

SEQ ID NO: 24532 - DNA, 837 bp, Artificial Sequence
  chemically treated genomic DNA (Homo sapiens) CpG-island No: 24532
aacgaaaaacgtaacgaattttaataccgaaaaacgtatcatttcataattatacgcaaatacctaatacgacgctaacgcgtcttatcatacctacaaacttataccgaatcgataaaccgaataaaacgtttataccgcatccgacaattatacgcaaatacctaatacgacgctaacgcgtcttatcatacctacaaacttatacctaaacgataaaacgaataaaacgttcacgccgcatccgacaattatacaccaatactaaatacttacatcaacgcccccataatcttcaactccaactcatccgacacttcgttatacgacaacacatacaaccccgacgcaaacaaccttacataacgcgccaacaaaaaacgcaactacgataacaccaacaacaccgaatctttccccgccgctttcatctactctttcacctataacatcgtactctaaaactaattaaacatattcgaatcgaccgacacgctatcgaacatcactttcccgccctattacgcctaattcaccacgttaatcaacaaattttccaactcattattcaacgtatacaccgtcaactcctacttacgaacgaacgaataaataatactacgccgcaataccaaaaaacacatcgaacgacaacaaaatataatctttcgtcaccgtactactaaaaaccaacacgaaaacgaatataacgaattctcgcaaaaaaacgccttcgacaacaaacgccgataaccttaccactaatatattaacgcgaatcaaatttcgccgaacgtacgtcaaatacgatttcacgcgtaattccgctacacttaa

SEQ ID NO: 24533 - DNA, 505 bp, Artificial Sequence
  chemically treated genomic DNA (Homo sapiens) CpG-island No: 24533
gttttgtgcgtaatattttcgatcgttttgaagcgcgttttagtttggttgaagtaatttaaagttcgtttttgttgttgtaggggatggtgggttcgtaaatgtcgattgttgttttttatggtgaagggcgcgtggaagtgcgtgatgcggcgtatttggcggtattggaaagtaaagggttggtggtattgcgttatgtcgataatttcggtaaagttattgaaatttattcggttaattcgaacggtttatcgaacggtattacggtagttacgattgaaagtggtcgagttattattatgatgtcgtattcggaacgtgtttttcgtattgttagtaatttttggtattcggaaaattggggcgaggatggtttatggatgcgtatttttcgtaatgcgcgtaagtagttggggtaagtcgttagtttattggttttgtagttcggatgcggtattaagtattaattattattataagtttttaatttcgggagtttttt

SEQ ID NO: 24534 - DNA, 505 bp, Artificial Sequence
  chemically treated genomic DNA (Homo sapiens) CpG-island No: 24534
aaaaaactcccgaaattaaaaacttataataataattaatacttaataccgcatccgaactacaaaaccaataaactaacgacttaccccaactacttacgcgcattacgaaaaatacgcatccataaaccatcctcgccccaattttccgaataccaaaaattactaacaatacgaaaaacacgttccgaatacgacatcataataataactcgaccactttcaatcgtaactaccgtaataccgttcgataaaccgttcgaattaaccgaataaatttcaataactttaccgaaattatcgacataacgcaataccaccaaccctttactttccaataccgccaaatacgccgcatcacgcacttccacgcgcccttcaccataaaaaacaacaatcgacatttacgaacccaccatcccctacaacaacaaaaacgaactttaaattacttcaaccaaactaaaacgcgcttcaaaacgatcgaaaatattacgcacaaaac

SEQ ID NO: 24535 - DNA, 505 bp, Artificial Sequence
  chemically treated genomic DNA (Homo sapiens) CpG-island No: 24535
aaaaagttttcggagttgggagtttatgatagtggttggtgtttaatgtcgtattcgggttgtaaaattaatgggttgacgatttattttaattgtttacgcgtattgcggaaaatgcgtatttatgggttattttcgttttagtttttcggatgttaggagttgttgatagtacggaaaatacgtttcgggtgcggtattataatggtgattcgattatttttagtcgtgattgtcgtaatatcgttcggtgaatcgttcgggttagtcgggtaggttttagtgattttgtcgaagttatcgatatagcgtagtgttattagttttttgttttttagtgtcgttagatgcgtcgtattacgtatttttacgcgttttttattatgagagatagtaatcggtatttgcgagtttattattttttgtaatagtagagacgggttttgggttattttaattaggttgaaacgcgttttaaagcgatcggaggtattgcgtataaaat

SEQ ID NO: 24536 - DNA, 505 bp, Artificial Sequence
  chemically treated genomic DNA (Homo sapiens) CpG-island No: 24536
attttatacgcaatacctccgatcgctttaaaacgcgtttcaacctaattaaaataacccaaaacccgtctctactattacaaaaaataataaactcgcaaataccgattactatctctcataataaaaaacgcgtaaaaatacgtaatacgacgcatctaacgacactaaaaaacaaaaaactaataacactacgctatatcgataacttcgacaaaatcactaaaacctacccgactaacccgaacgattcaccgaacgatattacgacaatcacgactaaaaataatcgaatcaccattataataccgcacccgaaacgtattttccgtactatcaacaactcctaacatccgaaaaactaaaacgaaaataacccataaatacgcattttccgcaatacgcgtaaacaattaaaataaatcgtcaacccattaattttacaacccgaatacgacattaaacaccaaccactatcataaactcccaactccgaaaacttttt

SEQ ID NO: 24537 - DNA, 506 bp, Artificial Sequence
  chemically treated genomic DNA (Homo sapiens) CpG-island No: 24537
  misc_feature (183)..(183): n is either a, c, g or t
  misc_feature (233)..(234): n is either a, c, g or t
  misc_feature (267)..(267): n is either a, c, g or t
cgtcgttggcgcggtattcgcgtagtaggaaagtagtttttcgcggttggtcgggtttaagatcgttaggttaatttcgtttaggtagagataatttaaattcgttagtttttcgtaaatcgtcgtagattgtttattttttagttagaattgtggcggcggtttcgtttcgttagtagtagnaacgtacgttcgtcggtgcgtgtcggttttaagtgtagtaataggttcgnngtagacggttttttatttcgttggtgttagggnaagtattaacgttttcgtcgtgttaggcgtttagtatttgttggttaaaattgttcgtttttagcgtcgttacgtaatgaacggttaatgtcgtaggatcgatttgacgggcgatatagacggaagtgtttagggtatcgtcgtcgaaatcgcgtttaacgttcgcgtttttttcggaaagtttaattatgtattcgttaattacggtaatttttttggatatagtcgtgaatttgatt

SEQ ID NO: 24538 - DNA, 506 bp, Artificial Sequence
  chemically treated genomic DNA (Homo sapiens) CpG-island No: 24538
  misc_feature (240)..(240): n is either a, c, g or t
  misc_feature (273)..(274): n is either a, c, g or t
  misc_feature (324)..(324): n is either a, c, g or t
aatcaaattcacgactatatccaaaaaaattaccgtaattaacgaatacataattaaactttccgaaaaaaacgcgaacgttaaacgcgatttcgacgacgataccctaaacacttccgtctatatcgcccgtcaaatcgatcctacgacattaaccgttcattacgtaacgacgctaaaaacgaacaattttaaccaacaaatactaaacgcctaacacgacgaaaacgttaatacttnccctaacaccaacgaaataaaaaaccgtctacnncgaacctattactacacttaaaaccgacacgcaccgacgaacgtacgttnctactactaacgaaacgaaaccgccgccacaattctaactaaaaaataaacaatctacgacgatttacgaaaaactaacgaatttaaattatctctacctaaacgaaattaacctaacgatcttaaacccgaccaaccgcgaaaaactactttcctactacgcgaataccgcgccaacgacg

SEQ ID NO: 24539 - DNA, 506 bp, Artificial Sequence
  chemically treated genomic DNA (Homo sapiens) CpG-island No: 24539
  misc_feature (240)..(240): n is either a, c, g or t
  misc_feature (273)..(274): n is either a, c, g or t
  misc_feature (324)..(324): n is either a, c, g or t
gattaggtttacgattatgtttaaaaagattgtcgtgattggcgaatgtatgattgagtttttcgagaaaggcgcggacgttaagcgcggtttcggcggcgatattttgaatattttcgtttatatcgttcgttaggtcgattttgcggtattaatcgtttattacgtaacggcgttgggaacggatagttttagttagtagatgttggacgtttggtacggcgagaacgttgatatttnttttgatattaacggaatggaaaatcgtttgtnncgggtttgttattatatttgaaatcgatacgtatcggcgagcgtacgttnttattattggcggaacgaagtcgtcgttataattttggttggagagtgagtagtttgcggcgatttgcgaagagttggcgaatttggattatttttatttgagcgggattagtttggcgattttaagttcgattagtcgcgaaaagttgtttttttgttgcgcgaatgtcgcgttaacggcg

SEQ ID NO: 24540 - DNA, 506 bp, Artificial Sequence
  chemically treated genomic DNA (Homo sapiens) CpG-island No: 24540
  misc_feature (183)..(183): n is either a, c, g or t
  misc_feature (233)..(234): n is either a, c, g or t
  misc_feature (267)..(267): n is either a, c, g or t
cgccgttaacgcgacattcgcgcaacaaaaaaacaacttttcgcgactaatcgaacttaaaatcgccaaactaatcccgctcaaataaaaataatccaaattcgccaactcttcgcaaatcgccgcaaactactcactctccaaccaaaattataacgacgacttcgttccgccaataataanaacgtacgctcgccgatacgtatcgatttcaaatataataacaaacccgnnacaaacgattttccattccgttaatatcaaaanaaatatcaacgttctcgccgtaccaaacgtccaacatctactaactaaaactatccgttcccaacgccgttacgtaataaacgattaataccgcaaaatcgacctaacgaacgatataaacgaaaatattcaaaatatcgccgccgaaaccgcgcttaacgtccgcgcctttctcgaaaaactcaatcatacattcgccaatcacgacaatctttttaaacataatcgtaaacctaatc

SEQ ID NO: 24541 - DNA, 529 bp, Artificial Sequence
  chemically treated genomic DNA (Homo sapiens) CpG-island No: 24541
cgatatcgtcgtcgttatcgtttatggtaaaggatgggcgaataatgtacgggaagtttacgttagcggtaatcgttagcgttttttttatcgtgtgtgcgatatcggaacgcgcggtttttagattaattttttttatcgttacgtcgaaacgacggcggttttttgttttattaatcgtatcggtagtggtattaattatggtgatatcgaatttttttaatacgttttgacgttttagttttagcgcgtagtttagcgtcgtttgatcgtttatcgttggtagtatcgcgttcgggcgtttttttttaataattttgcgtataattttttagtgaatcggttcgatgtaggttgtattagttattttcgggtcggttatgatggtcgtcgggttggagtttattagaatgacgcggtaattttttttacgtagggttttatacgtttgcgcgttagagtagtttaatttatacgtttgatcgataataatcgggttcggatttagaattcggatatttttgaaatt

SEQ ID NO: 24542 - DNA, 529 bp, Artificial Sequence
  chemically treated genomic DNA (Homo sapiens) CpG-island No: 24542
aatttcaaaaatatccgaattctaaatccgaacccgattattatcgatcaaacgtataaattaaactactctaacgcgcaaacgtataaaaccctacgtaaaaaaaattaccgcgtcattctaataaactccaacccgacgaccatcataaccgacccgaaaataactaatacaacctacatcgaaccgattcactaaaaaattatacgcaaaattattaaaaaaaaacgcccgaacgcgatactaccaacgataaacgatcaaacgacgctaaactacgcgctaaaactaaaacgtcaaaacgtattaaaaaaattcgatatcaccataattaataccactaccgatacgattaataaaacaaaaaaccgccgtcgtttcgacgtaacgataaaaaaaattaatctaaaaaccgcgcgttccgatatcgcacacacgataaaaaaaacgctaacgattaccgctaacgtaaacttcccgtacattattcgcccatcctttaccataaacgataacgacgacgatatcg

SEQ ID NO: 24543 - DNA, 529 bp, Artificial Sequence
  chemically treated genomic DNA (Homo sapiens) CpG-island No: 24543
gattttaaaagtattcggattttgggttcgggttcgattgttatcggttaggcgtgtgagttagattattttggcgcgtaagcgtgtaaagttttgcgtgaagagggttatcgcgttattttggtgaattttaattcggcgattattatgatcgattcggaaatggttgatgtaatttatatcgagtcgatttattgggaagttgtacgtaagattattgaaaaagagcgttcggacgcggtgttgttaacgatgggcggttagacggcgttgaattgcgcgttggagttggaacgttagggcgtgttggaagagttcggtgttattatgattggtgttattgtcgatgcgattgataaagtagaagatcgtcgtcgtttcgacgtagcgatgaagaaaattggtttggaaatcgcgcgtttcggtatcgtatatacgatggaagaagcgttggcggttgtcgttgacgtgggtttttcgtgtattattcgtttattttttattatgggcggtagcggcggcggtatcg

SEQ ID NO: 24544 - DNA, 529 bp, Artificial Sequence
  chemically treated genomic DNA (Homo sapiens) CpG-island No: 24544
cgataccgccgccgctaccgcccataataaaaaataaacgaataatacacgaaaaacccacgtcaacgacaaccgccaacgcttcttccatcgtatatacgataccgaaacgcgcgatttccaaaccaattttcttcatcgctacgtcgaaacgacgacgatcttctactttatcaatcgcatcgacaataacaccaatcataataacaccgaactcttccaacacgccctaacgttccaactccaacgcgcaattcaacgccgtctaaccgcccatcgttaacaacaccgcgtccgaacgctctttttcaataatcttacgtacaacttcccaataaatcgactcgatataaattacatcaaccatttccgaatcgatcataataatcgccgaattaaaattcaccaaaataacgcgataaccctcttcacgcaaaactttacacgcttacgcgccaaaataatctaactcacacgcctaaccgataacaatcgaacccgaacccaaaatccgaatacttttaaaatc

SEQ ID NO: 24545 - DNA, 535 bp, Artificial Sequence
  chemically treated genomic DNA (Homo sapiens) CpG-island No: 24545
gcgggtttcgtaaatcgttagcggcgtatcgataaatatttcgataaagcgttttttttttacgcgttcgcgaattatttggcgttcggcgcggtgtggcgagataaatgcggttagtattattagttcggttttaattattaaattcgttattttatcgacgcgacggatattttttttacgatcggtatcgttaaaagcgagatcgttgtataattcgtggcgaatattgtcgttatttagtagatacgtagttgacggcgagtttatgtgacggtttttgtagggttcggtgaacggtgtttatcggattcggaaaggcgggtaattcgggattatttcgttgatcggtttaattttttgtttttcggtcgttgtttgtaaagttggtaggggggtttgtttcgcgtggggtttatgttggtgggaacgtcgttttgatgtatatagtttgcgtattttgttatgggtttaatacgtggattttcggtgattttattgttgtagggtgcggagatgattagtattttttgtt

SEQ ID NO: 24546 - DNA, 535 bp, Artificial Sequence
  chemically treated genomic DNA (Homo sapiens) CpG-island No: 24546
aacaaaaaatactaatcatctccgcaccctacaacaataaaatcaccgaaaatccacgtattaaacccataacaaaatacgcaaactatatacatcaaaacgacgttcccaccaacataaaccccacgcgaaacaaacccccctaccaactttacaaacaacgaccgaaaaacaaaaaattaaaccgatcaacgaaataatcccgaattacccgcctttccgaatccgataaacaccgttcaccgaaccctacaaaaaccgtcacataaactcgccgtcaactacgtatctactaaataacgacaatattcgccacgaattatacaacgatctcgcttttaacgataccgatcgtaaaaaaaatatccgtcgcgtcgataaaataacgaatttaataattaaaaccgaactaataatactaaccgcatttatctcgccacaccgcgccgaacgccaaataattcgcgaacgcgtaaaaaaaaaacgctttatcgaaatatttatcgatacgccgctaacgatttacgaaacccgc

SEQ ID NO: 24547 - DNA, 535 bp, Artificial Sequence
  chemically treated genomic DNA (Homo sapiens) CpG-island No: 24547
agtaagaggtattaattattttcgtattttgtaatagtggaattatcggggatttacgtgttgagtttatagtagaatacgtagattatatgtattaggacgacgtttttattaatatgggttttacgcgggataagtttttttgttaattttgtaaataacggtcgggaaataaggagttaaatcggttaacggggtaatttcgagttattcgttttttcgagttcggtaaatatcgtttatcgggttttgtaggagtcgttatataaattcgtcgttagttacgtatttgttggatggcgataatgttcgttacggattatgtagcgatttcgtttttagcgatgtcgatcgtaaagagaatattcgtcgcgtcggtgaagtggcgaatttgatggttgaagtcggattggtggtgttgatcgtatttatttcgttatatcgcgtcgaacgttagatggttcgcgaacgcgtaggagaagggcgttttatcgaagtgtttgtcgatacgtcgttggcgatttgcgaagttcgt

SEQ ID NO: 24548 - DNA, 535 bp, Artificial Sequence
  chemically treated genomic DNA (Homo sapiens) CpG-island No: 24548
acgaacttcgcaaatcgccaacgacgtatcgacaaacacttcgataaaacgcccttctcctacgcgttcgcgaaccatctaacgttcgacgcgatataacgaaataaatacgatcaacaccaccaatccgacttcaaccatcaaattcgccacttcaccgacgcgacgaatattctctttacgatcgacatcgctaaaaacgaaatcgctacataatccgtaacgaacattatcgccatccaacaaatacgtaactaacgacgaatttatataacgactcctacaaaacccgataaacgatatttaccgaactcgaaaaaacgaataactcgaaattaccccgttaaccgatttaactccttatttcccgaccgttatttacaaaattaacaaaaaaacttatcccgcgtaaaacccatattaataaaaacgtcgtcctaatacatataatctacgtattctactataaactcaacacgtaaatccccgataattccactattacaaaatacgaaaataattaatacctcttact

SEQ ID NO: 24549 - DNA, 557 bp, Artificial Sequence
  chemically treated genomic DNA (Homo sapiens) CpG-island No: 24549
  misc_feature (395)..(395): n is either a, c, g or t
  misc_feature (535)..(535): n is either a, c, g or t
attcgcgtaatggatcggtacgataacgcgcgttttgtcggtgatcgtcgttttaattagcgtttcgtcgatgtttatggtgttcgggcgaatatttataaaaacgatttttgcgttacgtagtataaaggtattggcggtggagataaaggtgtagttcggtatgattattttatcgttaggttggatatcgagtagtagcgtcgttatttttagcgaagcggtgtaggacggcgttagtaatattttggcgttgataaaacgttgttttaggtattgttggtagcgacgggttaaatcgttatcgttatatagtgttgcggtaattattggcgattgcgtattgtttagttcggtttttattatcgggggtgcgtttaatggagtatgtgatnttcgtttaataggtcgcggaggtttttagtcggatacgtgtgtgtttcgtagcgcggcgggttgttattgggtgttatcgtaggtgtttttagagtattattacgataacgggtgttagttaaatcgaacgttttattanggaaatagtcgtgtttaggttt

SEQ ID NO: 24550 - DNA, 557 bp, Artificial Sequence
  chemically treated genomic DNA (Homo sapiens) CpG-island No: 24550
  misc_feature (23)..(23): n is either a, c, g or t
  misc_feature (163)..(163): n is either a, c, g or t
aaacctaaacacgactatttccntaataaaacgttcgatttaactaacacccgttatcgtaataatactctaaaaacacctacgataacacccaataacaacccgccgcgctacgaaacacacacgtatccgactaaaaacctccgcgacctattaaacgaanatcacatactccattaaacgcacccccgataataaaaaccgaactaaacaatacgcaatcgccaataattaccgcaacactatataacgataacgatttaacccgtcgctaccaacaatacctaaaacaacgttttatcaacgccaaaatattactaacgccgtcctacaccgcttcgctaaaaataacgacgctactactcgatatccaacctaacgataaaataatcataccgaactacacctttatctccaccgccaatacctttatactacgtaacgcaaaaatcgtttttataaatattcgcccgaacaccataaacatcgacgaaacgctaattaaaacgacgatcaccgacaaaacgcgcgttatcgtaccgatccattacgcgaat

SEQ ID NO: 24551 - DNA, 557 bp, Artificial Sequence
  chemically treated genomic DNA (Homo sapiens) CpG-island No: 24551
  misc_feature (23)..(23): n is either a, c, g or t
  misc_feature (163)..(163): n is either a, c, g or t
gaatttaaatacggttgtttttntggtaagacgttcggtttaattagtattcgttatcgtggtaatgttttgaaaatatttgcggtggtatttagtggtaattcgtcgcgttacgaaatatatacgtgttcgattagagattttcgcgatttgttaaacgggnattatatattttattaaacgtattttcggtggtgggaatcgaattggataatacgtagtcgttaatggttatcgtaatattgtgtggcgatggcggtttaattcgtcgttgttagtagtgtttggagtaacgttttgttagcgttaaagtgttattgacgtcgttttgtatcgtttcgttggagatggcggcgttgttgttcgatatttagtttggcgatgaagtgattatgtcgagttatatttttgtttttatcgttaatgtttttgtgttgcgtggcgtaaaaatcgtttttgtggatgttcgttcggatattatgaatatcgacgaaacgttgattgaagcggcgattatcgataaaacgcgcgttatcgtgtcggtttattacgcgggt

SEQ ID NO: 24552 - DNA, 557 bp, Artificial Sequence
  chemically treated genomic DNA (Homo sapiens) CpG-island No: 24552
  misc_feature (395)..(395): n is either a, c, g or t
  misc_feature (535)..(535): n is either a, c, g or t
acccgcgtaataaaccgacacgataacgcgcgttttatcgataatcgccgcttcaatcaacgtttcgtcgatattcataatatccgaacgaacatccacaaaaacgatttttacgccacgcaacacaaaaacattaacgataaaaacaaaaatataactcgacataatcacttcatcgccaaactaaatatcgaacaacaacgccgccatctccaacgaaacgatacaaaacgacgtcaataacactttaacgctaacaaaacgttactccaaacactactaacaacgacgaattaaaccgccatcgccacacaatattacgataaccattaacgactacgtattatccaattcgattcccaccaccgaaaatacgtttaataaaatatataatncccgtttaacaaatcgcgaaaatctctaatcgaacacgtatatatttcgtaacgcgacgaattaccactaaataccaccgcaaatattttcaaaacattaccacgataacgaatactaattaaaccgaacgtcttaccanaaaaacaaccgtatttaaattc

SEQ ID NO: 24553 - DNA, 823 bp, Artificial Sequence
  chemically treated genomic DNA (Homo sapiens) CpG-island No: 24553
  misc_feature (747)..(747): n is either a, c, g or t
ggaggtgttggggatgcgtttgatttggaataaacgttatattacgttggtatcgattgcgatcgtgtttgggttggcgtttaaatttttcgattcggaaaaattattcggcggtgtagaagatttaggtattatttgtgcgttgattttaattattacgtcgggcgtggaaattggtcgtcgttatttttcgttgaacgtatcgttttagaacggatcgacgcgcggtaaagatgttttcgtgtcgatcgattatattatcggcgggtcgaaaatggtcgggtaaggttggcggatgttggtggagtgtttttcggtaggtcgcggtattattttgttttttaatttaatcggcggcgtgaaatcggtagcgttggtaatcggcgcgtatgtttatattcgtcgttagtttaaaatttttattggtaagatggaagggattgaagagtcgttggcgcgtattgtcggtaatgtttacgtgatggatgttgcggtatcgttgattatttacggtattatgttcggcgaaaaatttgtcgtgttgtcggttatcgttaagtattattgtatttatcgcgggtagtagtcgattattgatgcgatggatattatcggcggtaaaggtattatgttcgggtaaagtaattttttggcgcgtgtttattagggcgtatcgattgttattatcgttgaaggggttaatattttgattcgtagtatgatgattttcggataagagagcgattncgttgttatttcgtacgtgttggaagagatggaagcggcgaagaataatgacgttaacgcgttcgataaattgttg

SEQ ID NO: 24554 - DNA, 823 bp, Artificial Sequence
  chemically treated genomic DNA (Homo sapiens) CpG-island No: 24554
  misc_feature (77)..(77): n is either a, c, g or t
caacaatttatcgaacgcgttaacgtcattattcttcgccgcttccatctcttccaacacgtacgaaataacaacgnaatcgctctcttatccgaaaatcatcatactacgaatcaaaatattaaccccttcaacgataataacaatcgatacgccctaataaacacgcgccaaaaaattactttacccgaacataatacctttaccgccgataatatccatcgcatcaataatcgactactacccgcgataaatacaataatacttaacgataaccgacaacacgacaaatttttcgccgaacataataccgtaaataatcaacgataccgcaacatccatcacgtaaacattaccgacaatacgcgccaacgactcttcaatcccttccatcttaccaataaaaattttaaactaacgacgaatataaacatacgcgccgattaccaacgctaccgatttcacgccgccgattaaattaaaaaacaaaataataccgcgacctaccgaaaaacactccaccaacatccgccaaccttacccgaccattttcgacccgccgataatataatcgatcgacacgaaaacatctttaccgcgcgtcgatccgttctaaaacgatacgttcaacgaaaaataacgacgaccaatttccacgcccgacgtaataattaaaatcaacgcacaaataatacctaaatcttctacaccgccgaataatttttccgaatcgaaaaatttaaacgccaacccaaacacgatcgcaatcgataccaacgtaatataacgtttattccaaatcaaacgcatccccaacacctcc

SEQ ID NO: 24555 - DNA, 823 bp, Artificial Sequence
  chemically treated genomic DNA (Homo sapiens) CpG-island No: 24555
  misc_feature (77)..(77): n is either a, c, g or t
taatagtttatcgaacgcgttgacgttattgtttttcgtcgtttttattttttttagtacgtacggagtggtaacgnaatcgtttttttgttcgaagattattatgttgcgggttagaatgttagtttttttaacggtgatggtaatcggtgcgttttggtaagtacgcgttaggaagttgttttgttcgagtataatgtttttatcgtcggtaatatttatcgtattaataatcgattgttgttcgcggtgggtatagtgatatttaacgatagtcgatagtacggtaggtttttcgtcgagtataatgtcgtaggtaattagcgatgtcgtagtatttattacgtaggtattatcggtaatacgcgttagcggttttttaattttttttattttattaatagagattttgaattgacggcgaatgtgagtatacgcgtcggttgttagcgttatcgattttacgtcgtcggttgagttggaaggtagggtgatgtcgcggtttatcgagaggtattttattagtattcgttagttttgttcggttattttcggttcgtcgatgatgtaatcgatcggtacgaagatatttttatcgcgcgtcggttcgttttggaacggtacgtttagcgggaagtggcgacgattaatttttacgttcggcgtggtggttgggattagcgtataggtaatgtttaaattttttgtatcgtcgagtaattttttcgggtcggagagtttaaacgttagtttaagtacggtcgtaatcggtgttagcgtaatgtagcgtttgttttaggttagacgtatttttagtattttt

SEQ ID NO: 24556 - DNA, 823 bp, Artificial Sequence
  chemically treated genomic DNA (Homo sapiens) CpG-island No: 24556
  misc_feature (747)..(747): n is either a, c, g or t
aaaaatactaaaaatacgtctaacctaaaacaaacgctacattacgctaacaccgattacgaccgtacttaaactaacgtttaaactctccgacccgaaaaaattactcgacgatacaaaaaatttaaacattacctatacgctaatcccaaccaccacgccgaacgtaaaaattaatcgtcgccacttcccgctaaacgtaccgttccaaaacgaaccgacgcgcgataaaaatatcttcgtaccgatcgattacatcatcgacgaaccgaaaataaccgaacaaaactaacgaatactaataaaatacctctcgataaaccgcgacatcaccctaccttccaactcaaccgacgacgtaaaatcgataacgctaacaaccgacgcgtatactcacattcgccgtcaattcaaaatctctattaataaaataaaaaaaattaaaaaaccgctaacgcgtattaccgataatacctacgtaataaatactacgacatcgctaattacctacgacattatactcgacgaaaaacctaccgtactatcgactatcgttaaatatcactatacccaccgcgaacaacaatcgattattaatacgataaatattaccgacgataaaaacattatactcgaacaaaacaacttcctaacgcgtacttaccaaaacgcaccgattaccatcaccgttaaaaaaactaacattctaacccgcaacataataatcttcgaacaaaaaaacgattncgttaccactccgtacgtactaaaaaaaataaaaacgacgaaaaacaataacgtcaacgcgttcgataaactatta

SEQ ID NO: 24557 - DNA, 976 bp, Artificial Sequence
  chemically treated genomic DNA (Homo sapiens) CpG-island No: 24557
cgaatggggcgtgatgattaacgacgcgcgttagtatatttggatttagtcgttgtaaatgttttggtcggggttggcgttgtttattagcgtgatggtttttaatttggtgggtgacgtattgcgcgattatttggatttttatttggtgacggagtacgtatattaatgtcgtaatagattgaattacgtaatatcgcgttataggtcgcgtagtcgttggtatacggtgtatcgttaattttgtaacgcgggcgcgtgttggcgttagtcggcggtagcggtagcgggaaattattaatttgcgtcgtaacgttgggtattttgttcgttggcgttcgttagacggcgggggaaattttagtcgatggtaaatcggtttcgttttgcgttttgcgcggtattaaaattgttattattatgtagaattcgcgtagcgtttttaatttattgtatattatgtatatttacgcgcgggaaatttgtttggcgttagggaaattcgtcgatgacgttacgtttatcgttgttatagaagcggtggggttggaaaacgtcgcgcgcgtgttgaagttgtattcgttcgagatgagcggcggtatgttgtagcgtatgatgattgcgatggcggtgttgtgtgaattatcgtttattatcgtcgatgaatcgattatcgattttgacgtggtagtataggcgcgtattttcgatttgttggaaagtattatgtaaaaataagcgtcgggaatgttgttggtgaatttagatattgggcgttagggcggtttgcggaataattgcggggaattcgacggtagaatgttgatagggggtgtgaaacgcgtttaaggttttagaattatgaggcgcgttgggttcgcgaattgttttaaggatgaggggtataaggatataatacgggggtttttaatagcggggggatgggataatattcggggggaaaatcgtttcgagg

SEQ ID NO: 24558 - DNA, 976 bp, Artificial Sequence
  chemically treated genomic DNA (Homo sapiens) CpG-island No: 24558
cctcgaaacgattttccccccgaatattatcccatccccccgctattaaaaacccccgtattatatccttatacccctcatccttaaaacaattcgcgaacccaacgcgcctcataattctaaaaccttaaacgcgtttcacaccccctatcaacattctaccgtcgaattccccgcaattattccgcaaaccgccctaacgcccaatatctaaattcaccaacaacattcccgacgcttatttttacataatactttccaacaaatcgaaaatacgcgcctatactaccacgtcaaaatcgataatcgattcatcgacgataataaacgataattcacacaacaccgccatcgcaatcatcatacgctacaacataccgccgctcatctcgaacgaatacaacttcaacacgcgcgcgacgttttccaaccccaccgcttctataacaacgataaacgtaacgtcatcgacgaatttccctaacgccaaacaaatttcccgcgcgtaaatatacataatatacaataaattaaaaacgctacgcgaattctacataataataacaattttaataccgcgcaaaacgcaaaacgaaaccgatttaccatcgactaaaatttcccccgccgtctaacgaacgccaacgaacaaaatacccaacgttacgacgcaaattaataatttcccgctaccgctaccgccgactaacgccaacacgcgcccgcgttacaaaattaacgatacaccgtataccaacgactacgcgacctataacgcgatattacgtaattcaatctattacgacattaatatacgtactccgtcaccaaataaaaatccaaataatcgcgcaatacgtcacccaccaaattaaaaaccatcacgctaataaacaacgccaaccccgaccaaaacatttacaacgactaaatccaaatatactaacgcgcgtcgttaatcatcacgccccattcg

SEQ ID NO: 24559 - DNA, 976 bp, Artificial Sequence
  chemically treated genomic DNA (Homo sapiens) CpG-island No: 24559
tttcggggcggtttttttttcgggtgttgttttattttttcgttattggggattttcgtgttatatttttgtgttttttatttttggggtaattcgcggatttagcgcgttttatgattttggggttttaaacgcgttttatattttttgttagtattttgtcgtcggatttttcgtagttatttcgtagatcgttttaacgtttaatatttgggtttattagtagtattttcggcgtttgtttttgtataatgttttttagtagatcgagaatgcgcgtttgtgttattacgttaaggtcggtggtcggtttatcggcgatgataaacggtgatttatatagtatcgttatcgtaattattatgcgttgtaatatgtcgtcgtttatttcgaacgggtatagttttagtacgcgcgcggcgttttttagttttatcgtttttatggtagcggtaagcgtagcgttatcggcgggtttttttaacgttaggtaggtttttcgcgcgtgggtgtgtatggtgtgtagtggattaaaggcgttgcgcgggttttgtatgatggtggtaattttgatgtcgcgtagggcgtaaggcgaaatcggtttgttatcggttaaaatttttttcgtcgtttggcgaacgttagcgggtaaaatgtttagcgttgcggcgtaggttaatgatttttcgttgtcgttatcgtcgattaacgttagtacgcgttcgcgttgtagggttaacgatatatcgtgtattagcggttgcgcggtttgtagcgcgatattacgtagtttaatttgttgcggtattagtgtgcgtgtttcgttattagatgagggtttagatgatcgcgtagtgcgttatttattaggttaaaggttattacgttgataaatagcgttagtttcggttagaatatttgtagcggttgggtttagatatattggcgcgcgtcgttaattattacgttttattcg

SEQ ID NO: 24560 - DNA, 976 bp, Artificial Sequence
  chemically treated genomic DNA (Homo sapiens) CpG-island No: 24560
cgaataaaacgtaataattaacgacgcgcgccaatatatctaaacccaaccgctacaaatattctaaccgaaactaacgctatttatcaacgtaataacctttaacctaataaataacgcactacgcgatcatctaaaccctcatctaataacgaaacacgcacactaataccgcaacaaattaaactacgtaatatcgcgctacaaaccgcgcaaccgctaatacacgatatatcgttaaccctacaacgcgaacgcgtactaacgttaatcgacgataacgacaacgaaaaatcattaacctacgccgcaacgctaaacattttacccgctaacgttcgccaaacgacgaaaaaaattttaaccgataacaaaccgatttcgccttacgccctacgcgacatcaaaattaccaccatcatacaaaacccgcgcaacgcctttaatccactacacaccatacacacccacgcgcgaaaaacctacctaacgttaaaaaaacccgccgataacgctacgcttaccgctaccataaaaacgataaaactaaaaaacgccgcgcgcgtactaaaactatacccgttcgaaataaacgacgacatattacaacgcataataattacgataacgatactatataaatcaccgtttatcatcgccgataaaccgaccaccgaccttaacgtaataacacaaacgcgcattctcgatctactaaaaaacattatacaaaaacaaacgccgaaaatactactaataaacccaaatattaaacgttaaaacgatctacgaaataactacgaaaaatccgacgacaaaatactaacaaaaaatataaaacgcgtttaaaaccccaaaatcataaaacgcgctaaatccgcgaattaccccaaaaataaaaaacacaaaaatataacacgaaaatccccaataacgaaaaaataaaacaacacccgaaaaaaaaaccgccccgaaa

SEQ ID NO: 24561 - DNA, 638 bp, Artificial Sequence
  chemically treated genomic DNA (Homo sapiens) CpG-island No: 24561
tatttcgtggatcgttatgcgtttttgatagtcggattgatggtaatgagggtagtttacgggagtgttaattgttgttatcgcgagttgatgatatttaaatatttgcgtttgttggggtgatacgggcgtgaattgtcggtattgcggatataggcgacgaattagacgttgcgcgataatttttgttagggaagacgaaagtaggaatgattcgacgtttatgtcgcggagtcgggttattgcgtttgatgtattgttagtgtggagtgttgagagtattagatggtcggtgagcgaggtttgaatcgtaatttgcgcggtttttgtattacgaattttttttattatgacgatattcgggttttggcgaagtatggcgcgtaggtcgcgagcgaaagatatatttatacgggtatttatttgcgtttgtttaatgttttttagtttatattttacgggattttttatcgttagaatattgcggtcgggagtatttagcgtcgaaaggatggcgtagagcgtggtgtttttatcggagtttgtcggttttgttattaggataatatcgtgcggaagttgaatgagattttttaaattttgtttattcgttgtcgttatttttaggttgtttatat

SEQ ID NO: 24562 - DNA, 638 bp, Artificial Sequence
  chemically treated genomic DNA (Homo sapiens) CpG-island No: 24562
atataaacaacctaaaaataacgacaacgaataaacaaaatttaaaaaatctcattcaacttccgcacgatattatcctaataacaaaaccgacaaactccgataaaaacaccacgctctacgccatcctttcgacgctaaatactcccgaccgcaatattctaacgataaaaaatcccgtaaaatataaactaaaaaacattaaacaaacgcaaataaatacccgtataaatatatctttcgctcgcgacctacgcgccatacttcgccaaaacccgaatatcgtcataataaaaaaaattcgtaatacaaaaaccgcgcaaattacgattcaaacctcgctcaccgaccatctaatactctcaacactccacactaacaatacatcaaacgcaataacccgactccgcgacataaacgtcgaatcattcctactttcgtcttccctaacaaaaattatcgcgcaacgtctaattcgtcgcctatatccgcaataccgacaattcacgcccgtatcaccccaacaaacgcaaatatttaaatatcatcaactcgcgataacaacaattaacactcccgtaaactaccctcattaccatcaatccgactatcaaaaacgcataacgatccacgaaata

SEQ ID NO: 24563 - DNA, 638 bp, Artificial Sequence
  chemically treated genomic DNA (Homo sapiens) CpG-island No: 24563
atatgaataatttggggatgacggtagcggataagtaggatttagaaaattttatttagttttcgtacggtattattttggtgatagggtcgataggtttcggtaaaagtattacgttttacgttattttttcggcgttgaatattttcggtcgtaatattttgacggtagaagatttcgtggaatatgagttggaaggtattgggtaaacgtaggtgaatattcgtgtggatatgtttttcgttcgcggtttgcgcgttatatttcgttaggattcggatgtcgttatggtgggggaaattcgtgatatagaaatcgcgtagattgcggtttaggtttcgtttatcggttatttggtatttttaatattttatattaatagtgtattaggcgtagtgattcggtttcgcgatatgggcgtcgaattatttttgttttcgttttttttggtagggattatcgcgtaacgtttggttcgtcgtttgtgttcgtaatgtcgataatttacgttcgtattattttaataagcgtagatgtttaaatattattagttcgcggtgataataattggtattttcgtaggttgtttttattgttattaattcggttattaggggcgtatggcgatttacgaaatg

SEQ ID NO: 24564 - DNA, 638 bp, Artificial Sequence
  chemically treated genomic DNA (Homo sapiens) CpG-island No: 24564
catttcgtaaatcgccatacgcccctaataaccgaattaataacaataaaaacaacctacgaaaataccaattattatcaccgcgaactaataatatttaaacatctacgcttattaaaataatacgaacgtaaattatcgacattacgaacacaaacgacgaaccaaacgttacgcgataatccctaccaaaaaaaacgaaaacaaaaataattcgacgcccatatcgcgaaaccgaatcactacgcctaatacactattaatataaaatattaaaaataccaaataaccgataaacgaaacctaaaccgcaatctacgcgatttctatatcacgaatttcccccaccataacgacatccgaatcctaacgaaatataacgcgcaaaccgcgaacgaaaaacatatccacacgaatattcacctacgtttacccaataccttccaactcatattccacgaaatcttctaccgtcaaaatattacgaccgaaaatattcaacgccgaaaaaataacgtaaaacgtaatacttttaccgaaacctatcgaccctatcaccaaaataataccgtacgaaaactaaataaaattttctaaatcctacttatccgctaccgtcatccccaaattattcatat

SEQ ID NO: 24565 - DNA, 932 bp, Artificial Sequence
  chemically treated genomic DNA (Homo sapiens) CpG-island No: 24565
tcggcgagtaattgatcgattggggcggggcgttacgttggttgaaatcgatagtcgaggataattaaatttatcgtatcgttcgtaacgttggcggttatgcgattcgttttagtgtcggagaggggggttttgtttcgttatcggtttttttatttcgttattattagtagtttaaatagtagttcgatttttgcggcgtgtttaatttcggtcgtatgtacgcggaattttgaggagtaggttatgtaaatttaattaattgaagagatgcggtagaacgcgcgcgcgttggaagtcgatagtattttgcgcgtttgtgtttattgcggattttgtatcgtaatttggttaatttattagtttttgggcgatgaattggacgggtcgcgcgggcgtatttatttgattaaataggtgttggaaggtaaacgaatttacgtttaaaaatataggagtaattcgaatcggggttttacgttggttcgattcgcgtatattatcggatttttcggggcggtattataatttgcggtaatcgggttataaacggtagtttataggtaagtttaggtcggattaaaacgcgtaacgatttttcgtaagtttattcggttatcgattaattcgcggttcgtttttatcgtttcgcgaaggatattacgcgtttaagtaagaatttttcggtttatacgtattacgtacgtttttattcgtttatcgtcgtagttttcgatttttacgcgcggtatattatacgtattcgcgcgttatgcgttgagaagtagcgtatagtgttttttttcgtcgttttttcgttttttcggttcgagcgtcggcgttcgcgcgcgtacggtcgtttcgtttcgttcgggtttcgacgaacgaaaggtggattcgttcgtattttttcgggttttcgcgtttcgata

SEQ ID NO: 24566 - DNA, 932 bp, Artificial Sequence
  chemically treated genomic DNA (Homo sapiens) CpG-island No: 24566
tatcgaaacgcgaaaacccgaaaaaatacgaacgaatccacctttcgttcgtcgaaacccgaacgaaacgaaacgaccgtacgcgcgcgaacgccgacgctcgaaccgaaaaaacgaaaaaacgacgaaaaaaaacactatacgctacttctcaacgcataacgcgcgaatacgtataatataccgcgcgtaaaaatcgaaaactacgacgataaacgaataaaaacgtacgtaatacgtataaaccgaaaaattcttacttaaacgcgtaatatccttcgcgaaacgataaaaacgaaccgcgaattaatcgataaccgaataaacttacgaaaaatcgttacgcgttttaatccgacctaaacttacctataaactaccgtttataacccgattaccgcaaattataataccgccccgaaaaatccgataatatacgcgaatcgaaccaacgtaaaaccccgattcgaattactcctatatttttaaacgtaaattcgtttaccttccaacacctatttaatcaaataaatacgcccgcgcgacccgtccaattcatcgcccaaaaactaataaattaaccaaattacgatacaaaatccgcaataaacacaaacgcgcaaaatactatcgacttccaacgcgcgcgcgttctaccgcatctcttcaattaattaaatttacataacctactcctcaaaattccgcgtacatacgaccgaaattaaacacgccgcaaaaatcgaactactatttaaactactaataataacgaaataaaaaaaccgataacgaaacaaaacccccctctccgacactaaaacgaatcgcataaccgccaacgttacgaacgatacgataaatttaattatcctcgactatcgatttcaaccaacgtaacgccccgccccaatcgatcaattactcgccga

SEQ ID NO: 24567 - DNA, 932 bp, Artificial Sequence
  chemically treated genomic DNA (Homo sapiens) CpG-island No: 24567
tgtcggggcgcgggggttcgggggggtgcgggcgagtttatttttcgttcgtcggggttcgggcggggcggggcggtcgtgcgcgcgcgggcgtcggcgttcgggtcgggggggcgggggggcggcgggggggggtattatgcgttgttttttaacgtatggcgcgcgagtgcgtgtggtgtgtcgcgcgtgggggtcggaggttgcggcggtgggcgggtgggggcgtgcgtggtgcgtgtgggtcggggggtttttgtttgggcgcgtggtgtttttcgcggagcggtgggggcgggtcgcgggttggtcggtggtcgggtgggtttgcgggggatcgttgcgcgttttggttcggtttgggtttgtttgtgggttgtcgtttgtggttcggttgtcgtaggttgtgatgtcgtttcgggaggttcggtggtgtgcgcgagtcgggttaacgtgaggtttcgattcgagttgtttttgtgtttttaagcgtgagttcgtttgttttttagtatttgtttaattagatagatgcgttcgcgcggttcgtttagtttatcgtttagaagttgataggttggttaggttgcggtataaaattcgtagtgaatataggcgcgtaggatgttgtcggtttttagcgcgcgcgcgttttgtcgtatttttttagttaattgggtttgtatagtttgttttttaaagtttcgcgtatatgcgatcggggttaaatacgtcgtaagggtcgagttgttgtttaagttgttggtgatagcggaataaaggagtcgatagcggggtaaagttttttttttcggtattaaagcgggtcgtatgatcgttagcgttgcgggcgatgcgatggatttgattgttttcggttgtcgattttagttagcgtaacgtttcgttttagtcgattagttgttcgtcgg

SEQ ID NO: 24568 - DNA, 932 bp, Artificial Sequence
  chemically treated genomic DNA (Homo sapiens) CpG-island No: 24568
ccgacgaacaactaatcgactaaaacgaaacgttacgctaactaaaatcgacaaccgaaaacaatcaaatccatcgcatcgcccgcaacgctaacgatcatacgacccgctttaataccgaaaaaaaaaactttaccccgctatcgactcctttattccgctatcaccaacaacttaaacaacaactcgacccttacgacgtatttaaccccgatcgcatatacgcgaaactttaaaaaacaaactatacaaacccaattaactaaaaaaatacgacaaaacgcgcgcgcgctaaaaaccgacaacatcctacgcgcctatattcactacgaattttataccgcaacctaaccaacctatcaacttctaaacgataaactaaacgaaccgcgcgaacgcatctatctaattaaacaaatactaaaaaacaaacgaactcacgcttaaaaacacaaaaacaactcgaatcgaaacctcacgttaacccgactcgcgcacaccaccgaacctcccgaaacgacatcacaacctacgacaaccgaaccacaaacgacaacccacaaacaaacccaaaccgaaccaaaacgcgcaacgatcccccgcaaacccacccgaccaccgaccaacccgcgacccgcccccaccgctccgcgaaaaacaccacgcgcccaaacaaaaaccccccgacccacacgcaccacgcacgcccccacccgcccaccgccgcaacctccgacccccacgcgcgacacaccacacgcactcgcgcgccatacgttaaaaaacaacgcataatacccccccccgccgcccccccgcccccccgacccgaacgccgacgcccgcgcgcgcacgaccgccccgccccgcccgaaccccgacgaacgaaaaataaactcgcccgcacccccccgaacccccgcgccccgaca

SEQ ID NO: 24569 - DNA, 551 bp, Artificial Sequence
  chemically treated genomic DNA (Homo sapiens) CpG-island No: 24569
gtcgcggtaggaaaagtaaaagttacggcgtataaatgcgatttttgtgcggggcgcgaaaacggttttgtttgtgttgagaattgttcggcggacgcgttgtaattggttattgacgtcgtatttttcggtatggcgaaatttcgtcgtttgcgtatcgcgcgttaggaatattaatcgtggtatgttagtatcgcggcgtaagaaatgtcggtaatgagtaaagtcgaatagatgtaggtaacgttcgcgcgtggcgagtcggatagattggcgattgaagcgcgtaaaatcggtttgatgattttatttgttatttcgggcggataggtttaagggaagtttgagttgttttagtgcgcgagttcgagttgtgatggattgtcgtgattattttttcgagtgattgacggtgaagcgaatatgagtcgacgtagttttttaaataagttgcggaattcggtttgtttaaacgtgttagggcgttaacgaggtcggggttacggtaaggttaataagggggaggtgggttaacgttaagacgggtaaga

SEQ ID NO: 24570 - DNA, 551 bp, Artificial Sequence
  chemically treated genomic DNA (Homo sapiens) CpG-island No: 24570
tcttacccgtcttaacgttaacccacctcccccttattaaccttaccgtaaccccgacctcgttaacgccctaacacgtttaaacaaaccgaattccgcaacttatttaaaaaactacgtcgactcatattcgcttcaccgtcaatcactcgaaaaaataatcacgacaatccatcacaactcgaactcgcgcactaaaacaactcaaacttcccttaaacctatccgcccgaaataacaaataaaatcatcaaaccgattttacgcgcttcaatcgccaatctatccgactcgccacgcgcgaacgttacctacatctattcgactttactcattaccgacatttcttacgccgcgatactaacataccacgattaatattcctaacgcgcgatacgcaaacgacgaaatttcgccataccgaaaaatacgacgtcaataaccaattacaacgcgtccgccgaacaattctcaacacaaacaaaaccgttttcgcgccccgcacaaaaatcgcatttatacgccgtaacttttacttttcctaccgcgac

SEQ ID NO: 24571 - DNA, 551 bp, Artificial Sequence
  chemically treated genomic DNA (Homo sapiens) CpG-island No: 24571
ttttattcgttttgacgttagtttattttttttttattggttttgtcgtaatttcggtttcgttagcgttttaatacgtttggataagtcggatttcgtagtttgtttggaaagttacgtcggtttatgttcgttttatcgttaattattcggaaaggtaattacggtagtttattataattcgggttcgcgtattaaagtagtttaggttttttttgggtttgttcgttcggaatggtagataaggttattaaatcggttttgcgcgttttaatcgttagtttattcggttcgttacgcgcgggcgttgtttgtatttgttcgattttatttattatcggtattttttgcgtcgcggtattggtatgttacggttgatgtttttgacgcgcggtgcgtaagcggcgggatttcgttatgtcggagagtgcgacgttagtgattagttgtagcgcgttcgtcgggtaatttttaatataggtaggatcgttttcgcgtttcgtataaaggtcgtatttatgcgtcgtggtttttattttttttgtcgcgat

SEQ ID NO: 24572 - DNA, 551 bp, Artificial Sequence
  chemically treated genomic DNA (Homo sapiens) CpG-island No: 24572
atcgcgacaaaaaaaataaaaaccacgacgcataaatacgacctttatacgaaacgcgaaaacgatcctacctatattaaaaattacccgacgaacgcgctacaactaatcactaacgtcgcactctccgacataacgaaatcccgccgcttacgcaccgcgcgtcaaaaacatcaaccgtaacataccaataccgcgacgcaaaaaataccgataataaataaaatcgaacaaatacaaacaacgcccgcgcgtaacgaaccgaataaactaacgattaaaacgcgcaaaaccgatttaataaccttatctaccattccgaacgaacaaacccaaaaaaaacctaaactactttaatacgcgaacccgaattataataaactaccgtaattacctttccgaataattaacgataaaacgaacataaaccgacgtaactttccaaacaaactacgaaatccgacttatccaaacgtattaaaacgctaacgaaaccgaaattacgacaaaaccaataaaaaaaaaataaactaacgtcaaaacgaataaaa

SEQ ID NO: 24573 - DNA, 544 bp, Artificial Sequence
  chemically treated genomic DNA (Homo sapiens) CpG-island No: 24573
gttttcgttaatgttttcgttagcggtattaatcggaattgtcgttatcgtttggatgtcgatatttaatttttttaggttatttatttgacgtatcgcgtcgtaaatgattagatttttttatttattttgtattgttagacgcgttagtttagtatcgattagtgcgcgacgaatagaattaacggtatcgacgataagaatacgattacgggtattttgttcgagtagatcgtatagtaattcgtggttttcgaaatatttatcgtgattattgtcggtaaagagtcgttcgtaaagtggtaatcggttttacgtttttatttgttattttacgcggggtatttttcggggtatcgggggcgagatttattacgcgcggggggagtttttggtgatagtgggtcgcggattttacggggatcgtagatttggtggttatagggatcgtggttttttattgaggcgtttttcgtcgtttggtcgcgcgtatagttacgcgcggttttcggaagcgcgagagagtatagcgtagcggttacgt

SEQ ID NO: 24574 - DNA, 544 bp, Artificial Sequence
  chemically treated genomic DNA (Homo sapiens) CpG-island No: 24574
acgtaaccgctacgctatactctctcgcgcttccgaaaaccgcgcgtaactatacgcgcgaccaaacgacgaaaaacgcctcaataaaaaaccacgatccctataaccaccaaatctacgatccccgtaaaatccgcgacccactatcaccaaaaactccccccgcgcgtaataaatctcgcccccgataccccgaaaaataccccgcgtaaaataacaaataaaaacgtaaaaccgattaccactttacgaacgactctttaccgacaataatcacgataaatatttcgaaaaccacgaattactatacgatctactcgaacaaaatacccgtaatcgtattcttatcgtcgataccgttaattctattcgtcgcgcactaatcgatactaaactaacgcgtctaacaatacaaaataaataaaaaaatctaatcatttacgacgcgatacgtcaaataaataacctaaaaaaattaaatatcgacatccaaacgataacgacaattccgattaataccgctaacgaaaacattaacgaaaac

SEQ ID NO: 24575 - DNA, 544 bp, Artificial Sequence
  chemically treated genomic DNA (Homo sapiens) CpG-island No: 24575
gcgtggtcgttgcgttgtgttttttcgcgttttcgggggtcgcgcgtggttgtgcgcgcggttaaacgacggaaggcgttttaataagggattacgatttttgtggttattaagtttgcgattttcgtgagattcgcgatttattattattaggggtttttttcgcgcgtagtgagtttcgttttcgatgtttcgaaaaatatttcgcgtggaatggtaagtgggaacgtgggatcggttgttattttgcggacggttttttgtcgataataattacggtaaatgtttcgaggattacgggttgttgtacgatttgttcgaatagaatgttcgtggtcgtgtttttgtcgtcgatgtcgttggttttgttcgtcgcgtattggtcgatgttgaattggcgcgtttggtagtataaaatgaatgggaaggtttggttatttacggcgcggtgcgttaggtagatgatttggaagagttggatatcggtatttaggcgatggcggtaatttcggttggtgtcgttggcgaaggtattggcgaaagt

SEQ ID NO: 24576 - DNA, 544 bp, Artificial Sequence
  chemically treated genomic DNA (Homo sapiens) CpG-island No: 24576
actttcgccaataccttcgccaacgacaccaaccgaaattaccgccatcgcctaaataccgatatccaactcttccaaatcatctacctaacgcaccgcgccgtaaataaccaaaccttcccattcattttatactaccaaacgcgccaattcaacatcgaccaatacgcgacgaacaaaaccaacgacatcgacgacaaaaacacgaccacgaacattctattcgaacaaatcgtacaacaacccgtaatcctcgaaacatttaccgtaattattatcgacaaaaaaccgtccgcaaaataacaaccgatcccacgttcccacttaccattccacgcgaaatatttttcgaaacatcgaaaacgaaactcactacgcgcgaaaaaaacccctaataataataaatcgcgaatctcacgaaaatcgcaaacttaataaccacaaaaatcgtaatcccttattaaaacgccttccgtcgtttaaccgcgcgcacaaccacgcgcgacccccgaaaacgcgaaaaaacacaacgcaacgaccacgc

SEQ ID NO: 24577 - DNA, 700 bp, Artificial Sequence
  chemically treated genomic DNA (Homo sapiens) CpG-island No: 24577
gttaagcgttttgtggcgattgttttgcgtaatcgttggcgtcgtatgtagtttaacgaatagttgcgttatgaagtgatttcgaaaaaatattttgatgatcggtttcgattcggttgtcgcgttaaatattgaaatcgttcgtcgtttggttaagttggcgaatgcgtcgtttattaaagttgaagcgattaattatatcgaatcgggttacgtcggtaacgtagtggtattttattatttcgcgtattttgtcgatgtcgtcgcggattattgggtatcgcgttttagtttattcgtagaatattcgttatcgggtcgagtaatcggtatatatcgtatttcgtacgcgtcgattttttcgttttattatttttggtatatttaaacgttttcgaatcgtcgcgtttacgttatttttataatcgcgcgtacgtttacgttatcgtcgttatatcgcgttttttcgtttttatcgtttcgcgataattatttcgttcgtcgttattttataacgttcgcgttcgattttcgtacgttatagtacgtttttatattttttcgtagttatatatcgtcgtttcgttttttttatagtatcgttagatattattttatattttatatatattatttattttcgacgttaatttatttttttatttataattattttatatttttacgtttttatatataa

SEQ ID NO: 24578 - DNA, 700 bp, Artificial Sequence
  chemically treated genomic DNA (Homo sapiens) CpG-island No: 24578
ttatatataaaaacgtaaaaatataaaataattataaataaaaaaataaattaacgtcgaaaataaataatatatataaaatataaaataatatctaacgatactataaaaaaaacgaaacgacgatatataactacgaaaaaatataaaaacgtactataacgtacgaaaatcgaacgcgaacgttataaaataacgacgaacgaaataattatcgcgaaacgataaaaacgaaaaaacgcgatataacgacgataacgtaaacgtacgcgcgattataaaaataacgtaaacgcgacgattcgaaaacgtttaaatataccaaaaataataaaacgaaaaaatcgacgcgtacgaaatacgatatataccgattactcgacccgataacgaatattctacgaataaactaaaacgcgatacccaataatccgcgacgacatcgacaaaatacgcgaaataataaaataccactacgttaccgacgtaacccgattcgatataattaatcgcttcaactttaataaacgacgcattcgccaacttaaccaaacgacgaacgatttcaatatttaacgcgacaaccgaatcgaaaccgatcatcaaaatattttttcgaaatcacttcataacgcaactattcgttaaactacatacgacgccaacgattacgcaaaacaatcgccacaaaacgcttaac

SEQ ID NO: 24579 - DNA, 700 bp, Artificial Sequence
  chemically treated genomic DNA (Homo sapiens) CpG-island No: 24579
ttgtgtgtgggggcgtgggggtgtggggtggttgtgggtgggggggtgggttggcgtcgggggtgggtggtgtgtgtggggtgtggggtggtgtttagcgatgttgtgagaggggcggagcgacggtgtgtggttgcgggggggtgtgggggcgtgttgtggcgtgcgggggtcgggcgcgggcgttgtggggtggcggcgagcggggtggttgtcgcggggcggtgggggcgggggggcgcggtgtggcggcggtggcgtgggcgtgcgcgcggttgtgggaatggcgtgggcgcggcggttcgggggcgtttgggtgtgttaggggtggtggggcgggggggtcggcgcgtgcgggatgcggtgtgtgtcggttgttcggttcgatggcgggtgttttgcgagtaggttgggacgcggtatttagtggttcgcggcggtatcggtagagtgcgcggagtaataggatgttattgcgttgtcgacgtagttcggttcggtgtagttggtcgttttagttttgatgggcggcgtattcgttagtttagttagacgacgggcgattttagtgtttagcgcgatagtcgggtcggggtcgattattaggatattttttcggggttattttatggcgtagttgttcgttgagttgtatgcgacgttagcggttacgtagagtaatcgttatagaacgtttggt

SEQ ID NO: 24580 - DNA, 700 bp, Artificial Sequence
  chemically treated genomic DNA (Homo sapiens) CpG-island No: 24580
accaaacgttctataacgattactctacgtaaccgctaacgtcgcatacaactcaacgaacaactacgccataaaataaccccgaaaaaatatcctaataatcgaccccgacccgactatcgcgctaaacactaaaatcgcccgtcgtctaactaaactaacgaatacgccgcccatcaaaactaaaacgaccaactacaccgaaccgaactacgtcgacaacgcaataacatcctattactccgcgcactctaccgataccgccgcgaaccactaaataccgcgtcccaacctactcgcaaaacacccgccatcgaaccgaacaaccgacacacaccgcatcccgcacgcgccgacccccccgccccaccacccctaacacacccaaacgcccccgaaccgccgcgcccacgccattcccacaaccgcgcgcacgcccacgccaccgccgccacaccgcgcccccccgcccccaccgccccgcgacaaccaccccgctcgccgccaccccacaacgcccgcgcccgacccccgcacgccacaacacgcccccacacccccccgcaaccacacaccgtcgctccgcccctctcacaacatcgctaaacaccaccccacaccccacacacaccacccacccccgacgccaacccacccccccacccacaaccaccccacacccccacgcccccacacacaa

SEQ ID NO: 24581 - DNA, 648 bp, Artificial Sequence
  chemically treated genomic DNA (Homo sapiens) CpG-island No: 24581
cgcggagtttcggtttatcgcgtgtggaatttgttttgtgttcgattcgggttaatgaggttggttttagcgtttttatcgggagggttattatattgggtcggttttgtgttcggggtttatgatgttttcgaggtttttttattgcgggttagttatacgtcggtcggtatcggtatttcgtcgttatatttcggtattttttaagttttcgcggttggtttttcgcgcggttgttttcgttgtgtttaagtagcgtaatggcgtagtcgatttttttttggacggcgaaaggacgattgtagacgcggtagttgtatagcgcgaagcgggattgttgtaggaagtttttttttttttatatcgttagttcgtatttttgcgatagtttgatcgtcgtcgtcgggtagattttttcgtagcgtttatagaagatgtagtgtttaagattaaatttttaggtaagtttttttgtggcgaggttagttttaatcgttaaggcgtttgacgggtaggtattgacgtaggtcgcgtagtcgatgtattgttgcgggttttgttttggtttattacggaagtttttattaatcgtaatcggttttagcggataagacgaggtcgtcgtgtcggttttgatgatttttttga

SEQ ID NO: 24582 - DNA, 648 bp, Artificial Sequence
  chemically treated genomic DNA (Homo sapiens) CpG-island No: 24582
tcaaaaaaatcatcaaaaccgacacgacgacctcgtcttatccgctaaaaccgattacgattaataaaaacttccgtaataaaccaaaacaaaacccgcaacaatacatcgactacgcgacctacgtcaatacctacccgtcaaacgccttaacgattaaaactaacctcgccacaaaaaaacttacctaaaaatttaatcttaaacactacatcttctataaacgctacgaaaaaatctacccgacgacgacgatcaaactatcgcaaaaatacgaactaacgatataaaaaaaaaaaaacttcctacaacaatcccgcttcgcgctatacaactaccgcgtctacaatcgtcctttcgccgtccaaaaaaaaatcgactacgccattacgctacttaaacacaacgaaaacaaccgcgcgaaaaaccaaccgcgaaaacttaaaaaataccgaaatataacgacgaaataccgataccgaccgacgtataactaacccgcaataaaaaaacctcgaaaacatcataaaccccgaacacaaaaccgacccaatataataaccctcccgataaaaacgctaaaaccaacctcattaacccgaatcgaacacaaaacaaattccacacgcgataaaccgaaactccgcg

SEQ ID NO: 24583 - DNA, 648 bp, Artificial Sequence
  chemically treated genomic DNA (Homo sapiens) CpG-island No: 24583
ttaaaaaagttattaaaatcggtacggcgatttcgttttattcgttggagtcgattgcggttgataaaaattttcgtggtaagttagagtagaattcgtagtagtgtatcggttgcgcggtttgcgttaatgtttgttcgttaaacgttttaacggttgaaattgatttcgttataggagagtttgtttgggagtttaattttgggtattgtattttttgtggacgttgcgaagaagtttgttcgacggcggcgattaaattgtcgtaagagtacgaattggcggtgtggaagaaagaagattttttgtaatagtttcgtttcgcgttgtgtaattgtcgcgtttgtaatcgttttttcgtcgtttagaaagagatcgattacgttattgcgttgtttaagtataacggggatagtcgcgcggagaattaatcgcgaaagtttggagaatgtcggaatgtagcggcgaaatgtcggtgtcgatcgacgtatgattgattcgtaatgaagaggtttcgagagtattataggtttcggatataggatcggtttaatatggtgattttttcgataagggcgttggaattaattttattgattcggatcgggtataggataagttttatacgcgataagtcgaagtttcgcg

SEQ ID NO: 24584 - DNA, 648 bp, Artificial Sequence
  chemically treated genomic DNA (Homo sapiens) CpG-island No: 24584
cgcgaaacttcgacttatcgcgtataaaacttatcctatacccgatccgaatcaataaaattaattccaacgcccttatcgaaaaaatcaccatattaaaccgatcctatatccgaaacctataatactctcgaaacctcttcattacgaatcaatcatacgtcgatcgacaccgacatttcgccgctacattccgacattctccaaactttcgcgattaattctccgcgcgactatccccgttatacttaaacaacgcaataacgtaatcgatctctttctaaacgacgaaaaaacgattacaaacgcgacaattacacaacgcgaaacgaaactattacaaaaaatcttctttcttccacaccgccaattcgtactcttacgacaatttaatcgccgccgtcgaacaaacttcttcgcaacgtccacaaaaaatacaatacccaaaattaaactcccaaacaaactctcctataacgaaatcaatttcaaccgttaaaacgtttaacgaacaaacattaacgcaaaccgcgcaaccgatacactactacgaattctactctaacttaccacgaaaatttttatcaaccgcaatcgactccaacgaataaaacgaaatcgccgtaccgattttaataacttttttaa

SEQ ID NO: 24585 - DNA, 628 bp, Artificial Sequence
  chemically treated genomic DNA (Homo sapiens) CpG-island No: 24585
tggttagtatgtgttgttgattatggatttttttattcgttacgcgatggtttagcgtgaaattgcgttggcgattggcgaatttttcgttattaaaggttatttatcgtcggtgtttgttaaattatcggtattggtcgagcgtgtcggaaatggtattagcggcggcggttcgattatcgcgttttatatcgtgtttattgaaggcgatgattagtaggattcgattgtcgatttcgcgcgggcgattttcgacggttatattgtgttgtttcgtcgattggcggaagtcgggtattattcggttatcgatattgaagcgtcgattagtcgcgtaatgacggcgttgattagtgagtaatattacgcgcgagtgcgtatttttaaatagttgttgtcgagtttttagcgtaatcgcgatttggttagcgtcggcgcgtatgttaaaggtagcgattcgatgttcgataaagttatcgttttgtggtcgtagttggagggttatttgtaataaggtatttttgaacgcgcggattgggaagcgtttttttaggggttggagcgtatttttcgatagtgttatatttaggagataacggtagaggtagattttgtgttttgcgatttt

SEQ ID NO: 24586 - DNA, 628 bp, Artificial Sequence
  chemically treated genomic DNA (Homo sapiens) CpG-island No: 24586
aaaatcgcaaaacacaaaatctacctctaccgttatctcctaaatataacactatcgaaaaatacgctccaacccctaaaaaaacgcttcccaatccgcgcgttcaaaaataccttattacaaataaccctccaactacgaccacaaaacgataactttatcgaacatcgaatcgctacctttaacatacgcgccgacgctaaccaaatcgcgattacgctaaaaactcgacaacaactatttaaaaatacgcactcgcgcgtaatattactcactaatcaacgccgtcattacgcgactaatcgacgcttcaatatcgataaccgaataatacccgacttccgccaatcgacgaaacaacacaatataaccgtcgaaaatcgcccgcgcgaaatcgacaatcgaatcctactaatcatcgccttcaataaacacgatataaaacgcgataatcgaaccgccgccgctaataccatttccgacacgctcgaccaataccgataatttaacaaacaccgacgataaataacctttaataacgaaaaattcgccaatcgccaacgcaatttcacgctaaaccatcgcgtaacgaataaaaaaatccataatcaacaacacatactaacca

SEQ ID NO: 24587 - DNA, 628 bp, Artificial Sequence
  chemically treated genomic DNA (Homo sapiens) CpG-island No: 24587
agggtcgtagggtataaggtttgtttttgtcgttattttttgggtatgatattgtcgggaaatacgttttagtttttggagagacgttttttagttcgcgcgtttaaaaatgttttgttgtaaatagttttttagttgcggttatagggcgatggttttatcgagtatcggatcgttgtttttggtatacgcgtcgacgttaattagatcgcggttacgttgaaaattcgataatagttgtttgaaggtgcgtattcgcgcgtaatgttgtttattgattaacgtcgttattgcgcggttgatcgacgttttaatatcgatagtcggatagtgttcggttttcgttagtcggcgagatagtataatgtgatcgtcgaggatcgttcgcgcggagtcggtaatcggattttgttggttatcgtttttagtgagtacggtataaaacgcggtaatcgagtcgtcgtcgttaatgttattttcggtacgttcgattagtgtcggtaatttggtaaatatcgacggtggataatttttggtggcggggggttcgttaatcgttagcgtaattttacgttgggttatcgcgtagcgggtgagggagtttataattagtaatatatgttgatta

SEQ ID NO: 24588 - DNA, 628 bp, Artificial Sequence
  chemically treated genomic DNA (Homo sapiens) CpG-island No: 24588
taatcaacatatattactaattataaactccctcacccgctacgcgataacccaacgtaaaattacgctaacgattaacgaaccccccgccaccaaaaattatccaccgtcgatatttaccaaattaccgacactaatcgaacgtaccgaaaataacattaacgacgacgactcgattaccgcgttttataccgtactcactaaaaacgataaccaacaaaatccgattaccgactccgcgcgaacgatcctcgacgatcacattatactatctcgccgactaacgaaaaccgaacactatccgactatcgatattaaaacgtcgatcaaccgcgcaataacgacgttaatcaataaacaacattacgcgcgaatacgcaccttcaaacaactattatcgaattttcaacgtaaccgcgatctaattaacgtcgacgcgtataccaaaaacaacgatccgatactcgataaaaccatcgccctataaccgcaactaaaaaactatttacaacaaaacatttttaaacgcgcgaactaaaaaacgtctctccaaaaactaaaacgtatttcccgacaatatcatacccaaaaaataacgacaaaaacaaaccttataccctacgaccct

SEQ ID NO: 24589 - DNA, 742 bp, Artificial Sequence
  chemically treated genomic DNA (Homo sapiens) CpG-island No: 24589
cgtttggtaaagtgtttatcgggatacgttattcggtgtggcgtttatgtatggttttaggtcgaataacgattatcgagcgtttgttaatatcgtgcggtagtttattaggcgtattaggttgaggattacgttatcgtattggcggtttggtagaaaattagtttttacgatatgagtaatgaggatttgtttgttgttgttaatatcgtttaggcggtaggaaatggtgcggttcgcgatcgttggttataataggtagataaacgtggattgggaagtaatgttttttattggtggttgtatgcgtaacgttatatttttggttagtcggaattcgtattgaacgattttacgcgtttaattaatattgcgttttttgttaacgtttacgttgcgcgggcgataatttatcgttaacgttataatgtttcggtcgcggtgagtgatttgcgcgtcgcgttggaattggaatcgaataatagtaatatttaggtagcgtttggttacgttttgtgggatagcggtgatatcgtatagtcgcgggaaatgttcgaatcggcgtataaagggttttcggacgattcggtattgattcgataattggtttacgtgaattagcgtttggatgatatgtttgcgacgtagtattacgttcggttggtgattgatgatattgataattaggcgttgataattttattgattttagaataaaattaataacgttttaattttcgtt

SEQ ID NO: 24590 - DNA, 742 bp, Artificial Sequence
  chemically treated genomic DNA (Homo sapiens) CpG-island No: 24590
aacgaaaattaaaacgttattaattttattctaaaatcaataaaattatcaacgcctaattatcaatatcatcaatcaccaaccgaacgtaatactacgtcgcaaacatatcatccaaacgctaattcacgtaaaccaattatcgaatcaataccgaatcgtccgaaaaccctttatacgccgattcgaacatttcccgcgactatacgatatcaccgctatcccacaaaacgtaaccaaacgctacctaaatattactattattcgattccaattccaacgcgacgcgcaaatcactcaccgcgaccgaaacattataacgttaacgataaattatcgcccgcgcaacgtaaacgttaacaaaaaacgcaatattaattaaacgcgtaaaatcgttcaatacgaattccgactaaccaaaaatataacgttacgcatacaaccaccaataaaaaacattacttcccaatccacgtttatctacctattataaccaacgatcgcgaaccgcaccatttcctaccgcctaaacgatattaacaacaacaaacaaatcctcattactcatatcgtaaaaactaattttctaccaaaccgccaatacgataacgtaatcctcaacctaatacgcctaataaactaccgcacgatattaacaaacgctcgataatcgttattcgacctaaaaccatacataaacgccacaccgaataacgtatcccgataaacactttaccaaacg

SEQ ID NO: 24591 - DNA, 742 bp, Artificial Sequence
  chemically treated genomic DNA (Homo sapiens) CpG-island No: 24591
ggcggaaattgaagcgttgttgattttgttttggggttagtggggttattagcgtttgattattaatgttattaattattagtcgggcgtagtgttgcgtcgtaggtatgttatttagacgttggtttacgtaggttagttgtcggattagtgtcggatcgttcggaagttttttatgcgtcggttcgagtatttttcgcgattgtgcgatattatcgttattttataaggcgtaattaagcgttgtttgggtgttgttattattcggttttagttttagcgcggcgcgtaaattatttatcgcggtcgggatattatgacgttggcgataaattgtcgttcgcgtaacgtaagcgttggtagaaggcgtaatattgattgagcgcgtgagatcgtttagtgcgagtttcggttgattaggaatgtaacgttgcgtatgtagttattagtagagggtattgttttttagtttacgtttgtttgtttgttgtagttagcgatcgcgagtcgtattattttttgtcgtttgggcggtattggtagtagtaagtagatttttattgtttatgtcgtgaagattgattttttgttaggtcgttagtgcggtggcgtagtttttaatttgatacgtttgataggttatcgtacgatgttgataggcgttcggtagtcgttgttcggtttgaagttatgtataaacgttatatcgggtagcgtgtttcgataaatattttgttagacg

SEQ ID NO: 24592 - DNA, 742 bp, Artificial Sequence
  chemically treated genomic DNA (Homo sapiens) CpG-island No: 24592
cgtctaacaaaatatttatcgaaacacgctacccgatataacgtttatacataacttcaaaccgaacaacgactaccgaacgcctatcaacatcgtacgataacctatcaaacgtatcaaattaaaaactacgccaccgcactaacgacctaacaaaaaatcaatcttcacgacataaacaataaaaatctacttactactaccaataccgcccaaacgacaaaaaataatacgactcgcgatcgctaactacaacaaacaaacaaacgtaaactaaaaaacaataccctctactaataactacatacgcaacgttacattcctaatcaaccgaaactcgcactaaacgatctcacgcgctcaatcaatattacgccttctaccaacgcttacgttacgcgaacgacaatttatcgccaacgtcataatatcccgaccgcgataaataatttacgcgccgcgctaaaactaaaaccgaataataacaacacccaaacaacgcttaattacgccttataaaataacgataatatcgcacaatcgcgaaaaatactcgaaccgacgcataaaaaacttccgaacgatccgacactaatccgacaactaacctacgtaaaccaacgtctaaataacatacctacgacgcaacactacgcccgactaataattaataacattaataatcaaacgctaataaccccactaaccccaaaacaaaatcaacaacgcttcaatttccgcc

SEQ ID NO: 24593 - DNA, 538 bp, Artificial Sequence
  chemically treated genomic DNA (Homo sapiens) CpG-island No: 24593
ttttttaaagagtaacggaggagtacgaaggtcggttaattttggcggatattaggaggttagtgtaatggtataagttagtttgattgcgagttgacggcgcgagtaggtgcgaaagtaggttatagtgattcggtggttttaatggaagggttatcgtttaacggataaaaggtatttcggggataatagttgatatcgtttaagagtttatatcgacggcggtgtttggtatttcgattcggtttattatattttggggttgaagtaggttttaagggtatggttgtcgttatttaaagtggtacgcgagttgggtttagaacgtcgtgagatagtcggtttttatttgtcgtgggcgttggagaattgaggggggttgtttttatacgagaggatcggagtggacgtattattggtgttcgggttgttatgttatggtattgttcggtagttaaatgcggaagagataagtgttgaaagtattaagtacgaaatttgtttcgagatgagttttttttgattttttaagggtttg

SEQ ID NO: 24594 - DNA, 538 bp, Artificial Sequence
  chemically treated genomic DNA (Homo sapiens) CpG-island No: 24594
caaacccttaaaaaatcaaaaaaaactcatctcgaaacaaatttcgtacttaatactttcaacacttatctcttccgcatttaactaccgaacaataccataacataacaacccgaacaccaataatacgtccactccgatcctctcgtataaaaacaacccccctcaattctccaacgcccacgacaaataaaaaccgactatctcacgacgttctaaacccaactcgcgtaccactttaaataacgacaaccatacccttaaaacctacttcaaccccaaaatataataaaccgaatcgaaataccaaacaccgccgtcgatataaactcttaaacgatatcaactattatccccgaaataccttttatccgttaaacgataacccttccattaaaaccaccgaatcactataacctactttcgcacctactcgcgccgtcaactcgcaatcaaactaacttataccattacactaacctcctaatatccgccaaaattaaccgaccttcgtactcctccgttactctttaaaaaa

SEQ ID NO: 24595 - DNA, 538 bp, Artificial Sequence
  chemically treated genomic DNA (Homo sapiens) CpG-island No: 24595
tagatttttaaagggttagggagaatttatttcggggtaagtttcgtgtttaatgtttttagtatttatttttttcgtatttagttatcgggtagtgttatggtatgataattcgaatattagtgatgcgtttatttcggttttttcgtataggagtagttttttttagttttttagcgtttacggtagatagggatcgattgttttacgacgttttaaatttagttcgcgtattattttaaatggcgatagttatatttttgggatttattttagttttaggatgtgatgagtcgaatcgaggtgttaaatatcgtcgtcgatatgaatttttgggcggtattagttgttattttcggagtattttttattcgttgagcgatggtttttttattagaattatcggattattatgatttgttttcgtatttgttcgcgtcgttagttcgtagttaagttggtttatgttattgtattaattttttgatgttcgttaggattagtcgattttcgtgttttttcgttattttttaggagg

SEQ ID NO: 24596 - DNA, 538 bp, Artificial Sequence
  chemically treated genomic DNA (Homo sapiens) CpG-island No: 24596
cctcctaaaaaataacgaaaaaacacgaaaatcgactaatcctaacgaacatcaaaaaattaatacaataacataaaccaacttaactacgaactaacgacgcgaacaaatacgaaaacaaatcataataatccgataattctaataaaaaaaccatcgctcaacgaataaaaaatactccgaaaataacaactaataccgcccaaaaattcatatcgacgacgatatttaacacctcgattcgactcatcacatcctaaaactaaaataaatcccaaaaatataactatcgccatttaaaataatacgcgaactaaatttaaaacgtcgtaaaacaatcgatccctatctaccgtaaacgctaaaaaactaaaaaaaactactcctatacgaaaaaaccgaaataaacgcatcactaatattcgaattatcataccataacactacccgataactaaatacgaaaaaaataaatactaaaaacattaaacacgaaacttaccccgaaataaattctccctaaccctttaaaaatcta

SEQ ID NO: 24597 - DNA, 748 bp, Artificial Sequence
  chemically treated genomic DNA (Homo sapiens) CpG-island No: 24597
gatatcggcgttttcgtacgtttcgtcgcgttaggtttttagaagatttatcgatatttgcggggtaagttgtcgttcgtcgatatcgtttcgtcgtcgtcgagtagtagggtatgaatagatgatcgtcgtagtcgtagagtacggtgaagtgcggatgggtattttgacggtatggattatgttgcgtaggtgggcgacggagtcgatggttttttgatgtcgataatattgttgcgcgagtcggcgagggtttttattacgtcggagttagattttgttcggttagcgtcgggaagttatagagtatttcggtagcgtgacgttgtcggttatttgttcgaaatagcggattaggttgttttcgatattttttagtagtaggggttgattattacgatgtcgttcggttcgtttgttgcgcgtgttggttgagttcgatggtttttcgggcgttgtgtcgtcggtgtcgattagtatcggtacgcgacgatcgatatgatcgatgtaaagcgggtaatggttttacgtttttcggcgtcgagttgggagaattgttatcgttgtttaggaagaataggtcgttaacgtttgttttgattagacgtcgattagcgcggcggtgttcggtttatcgagttggtcgtcggcggtaaaatggtggagatagggggaatgattttcgtgaataagcggattgcggatgagattttttgtcgaattatttggtttatattatagtatagcg

SEQ ID NO: 24598 - DNA, 748 bp, Artificial Sequence
  chemically treated genomic DNA (Homo sapiens) CpG-island No: 24598
cgctatactataatataaaccaaataattcgacaaaaaatctcatccgcaatccgcttattcacgaaaatcattccccctatctccaccattttaccgccgacgaccaactcgataaaccgaacaccgccgcgctaatcgacgtctaatcaaaacaaacgttaacgacctattcttcctaaacaacgataacaattctcccaactcgacgccgaaaaacgtaaaaccattacccgctttacatcgatcatatcgatcgtcgcgtaccgatactaatcgacaccgacgacacaacgcccgaaaaaccatcgaactcaaccaacacgcgcaacaaacgaaccgaacgacatcgtaataatcaacccctactactaaaaaatatcgaaaacaacctaatccgctatttcgaacaaataaccgacaacgtcacgctaccgaaatactctataacttcccgacgctaaccgaacaaaatctaactccgacgtaataaaaaccctcgccgactcgcgcaacaatattatcgacatcaaaaaaccatcgactccgtcgcccacctacgcaacataatccataccgtcaaaatacccatccgcacttcaccgtactctacgactacgacgatcatctattcataccctactactcgacgacgacgaaacgatatcgacgaacgacaacttaccccgcaaatatcgataaatcttctaaaaacctaacgcgacgaaacgtacgaaaacgccgatatc

SEQ ID NO: 24599 - DNA, 748 bp, Artificial Sequence
  chemically treated genomic DNA (Homo sapiens) CpG-island No: 24599
cgttgtgttataatgtggattaaatgattcggtaagagattttattcgtagttcgtttgtttacgggaattattttttttgtttttattattttatcgtcgacggttagttcgataagtcgggtatcgtcgcgttgatcgacgtttgattaaagtaggcgttgacggtttgttttttttgggtagcggtggtagtttttttagttcggcgtcgaagagcgtaaagttattgttcgttttgtatcgattatgtcgatcgtcgcgtgtcggtgttgatcggtatcggcggtataacgttcgggaaattatcgaatttagttagtacgcgtagtaggcgggtcggacggtatcgtggtgattaatttttattattggaaagtgtcggaagtaatttgattcgttatttcgagtaggtggtcgatagcgttacgttgtcgggatgttttataatttttcggcgttgatcgggtaggatttgatttcggcgtggtgaaaattttcgtcgattcgcgtagtaatattatcggtattaaagaattatcgatttcgtcgtttatttgcgtagtatgatttatatcgttaaagtgtttattcgtattttatcgtgttttgcggttacgacgattatttgtttatattttgttgttcggcggcgacggggcgatatcggcgagcggtaatttgtttcgtaggtgtcggtgaattttttgaaagtttggcgcgacgggacgtgcgaaagcgtcggtatt

SEQ ID NO: 24600 - DNA, 748 bp, Artificial Sequence
  chemically treated genomic DNA (Homo sapiens) CpG-island No: 24600
aataccgacgctttcgcacgtcccgtcgcgccaaactttcaaaaaattcaccgacacctacgaaacaaattaccgctcgccgatatcgccccgtcgccgccgaacaacaaaatataaacaaataatcgtcgtaaccgcaaaacacgataaaatacgaataaacactttaacgatataaatcatactacgcaaataaacgacgaaatcgataattctttaataccgataatattactacgcgaatcgacgaaaattttcaccacgccgaaatcaaatcctacccgatcaacgccgaaaaattataaaacatcccgacaacgtaacgctatcgaccacctactcgaaataacgaatcaaattacttccgacactttccaataataaaaattaatcaccacgataccgtccgacccgcctactacgcgtactaactaaattcgataatttcccgaacgttataccgccgataccgatcaacaccgacacgcgacgatcgacataatcgatacaaaacgaacaataactttacgctcttcgacgccgaactaaaaaaactaccaccgctacccaaaaaaaacaaaccgtcaacgcctactttaatcaaacgtcgatcaacgcgacgatacccgacttatcgaactaaccgtcgacgataaaataataaaaacaaaaaaaataattcccgtaaacaaacgaactacgaataaaatctcttaccgaatcatttaatccacattataacacaacg

SEQ ID NO: 24601 - DNA, 696 bp, Artificial Sequence
  chemically treated genomic DNA (Homo sapiens) CpG-island No: 24601
ttatcgcgttttgttcgtttcggcgttgtcggaagtggattattcgattatttaggtggttacgttttatttaggtgttagttcggatgttatgatttttgtcgttatcgcgtcgttagaacgttagttcgggtagatgtttggtttgaaatagatgtcgtcgtaaagtttcggcggtgcgttagttattattttgtagttttagttaatattatcgttcgatgtcgtcgagtaggaagtgtaggtcgcgattaacgttgcgattaatttgttgtcgagcgatttgtttaattcgtcggtttatagtaaagtgaattcggtagattcgtcgattatgacgttcgtcgttattttaatcgttatgtcgatgacgtaagtggaagatatggtggaaattcgcgtcgcgtagaaaatttcgtagattttcggcgtcggtttggtgacgtttttcggcggttagcgttcggttgttcgcgttaaatttaacgtttaggcgattgtcgttttcggtttgattagcgaaatcgtgcgtatcgttattatcggcgttaacgttaattcggtaaaaggtagtttcgacggtttttttcgtgcggttacgtttttcgcgaacgattagatgtttagtgtaatgtatgtattattttattagtatcgagttttattagagattttcgatttagggcgtatcgttta

SEQ ID NO: 24602 - DNA, 696 bp, Artificial Sequence
  chemically treated genomic DNA (Homo sapiens) CpG-island No: 24602
taaacgatacgccctaaatcgaaaatctctaataaaactcgatactaataaaataatacatacattacactaaacatctaatcgttcgcgaaaaacgtaaccgcacgaaaaaaaccgtcgaaactaccttttaccgaattaacgttaacgccgataataacgatacgcacgatttcgctaatcaaaccgaaaacgacaatcgcctaaacgttaaatttaacgcgaacaaccgaacgctaaccgccgaaaaacgtcaccaaaccgacgccgaaaatctacgaaattttctacgcgacgcgaatttccaccatatcttccacttacgtcatcgacataacgattaaaataacgacgaacgtcataatcgacgaatctaccgaattcactttactataaaccgacgaattaaacaaatcgctcgacaacaaattaatcgcaacgttaatcgcgacctacacttcctactcgacgacatcgaacgataatattaactaaaactacaaaataataactaacgcaccgccgaaactttacgacgacatctatttcaaaccaaacatctacccgaactaacgttctaacgacgcgataacgacaaaaatcataacatccgaactaacacctaaataaaacgtaaccacctaaataatcgaataatccacttccgacaacgccgaaacgaacaaaacgcgataa

SEQ ID NO: 24603 - DNA, 696 bp, Artificial Sequence
  chemically treated genomic DNA (Homo sapiens) CpG-island No: 24603
tagacgatacgttttgggtcgggagtttttgatagagttcgatattagtaaggtagtatatatattgtattgggtatttggtcgttcgcggaaagcgtgatcgtacgggaagggtcgtcgaggttattttttgtcgagttaacgttagcgtcggtaatggcggtgcgtacggtttcgttggttaggtcgagggcggtaatcgtttgagcgttaagtttgacgcgaatagtcggacgttgatcgtcggaaagcgttattaggtcgacgtcggaaatttgcgagattttttgcgcgacgcgggtttttattatattttttatttgcgttatcggtatggcggttgaggtgacggcgagcgttatgatcggcggatttgtcgggtttattttgttgtaaatcggcgggttaggtagatcgttcggtaataagttggtcgtagcgttaatcgcggtttgtattttttgttcggcgatatcgagcggtaatgttagttggaattgtaaagtgataattgacgtatcgtcggaattttgcgacgatatttgttttaggttagatatttgttcgaattggcgttttagcggcgcggtaacggtagaggttatgatattcgggttggtatttgggtagagcgtgattatttgaatggtcggatagtttattttcggtagcgtcgaaacgggtagggcgcgataa

SEQ ID NO: 24604 - DNA, 696 bp, Artificial Sequence
  chemically treated genomic DNA (Homo sapiens) CpG-island No: 24604
ttatcgcgccctacccgtttcgacgctaccgaaaataaactatccgaccattcaaataatcacgctctacccaaataccaacccgaatatcataacctctaccgttaccgcgccgctaaaacgccaattcgaacaaatatctaacctaaaacaaatatcgtcgcaaaattccgacgatacgtcaattatcactttacaattccaactaacattaccgctcgatatcgccgaacaaaaaatacaaaccgcgattaacgctacgaccaacttattaccgaacgatctacctaacccgccgatttacaacaaaataaacccgacaaatccgccgatcataacgctcgccgtcacctcaaccgccataccgataacgcaaataaaaaatataataaaaacccgcgtcgcgcaaaaaatctcgcaaatttccgacgtcgacctaataacgctttccgacgatcaacgtccgactattcgcgtcaaacttaacgctcaaacgattaccgccctcgacctaaccaacgaaaccgtacgcaccgccattaccgacgctaacgttaactcgacaaaaaataacctcgacgacccttcccgtacgatcacgctttccgcgaacgaccaaatacccaatacaatatatatactaccttactaatatcgaactctatcaaaaactcccgacccaaaacgtatcgtcta

SEQ ID NO: 24605 - DNA, 712 bp, Artificial Sequence
  chemically treated genomic DNA (Homo sapiens) CpG-island No: 24605
gcgcgttggcgttttgacggttagcgttttcgtttggtgcgttacgtcgtagaatttatttgcgataattggtatgggttagacgtttggtttacgttgtggattattcgttaaataaaatggcgggatatgtaggtcggataagacgttgtaggtcggataagacgcgttagcgtcgtattcggtaattagtattcggtaattattattaggtattttttatttttagtattttatgcgtttttgttataatattttcggcggtaaagttaaagaacgggaatagtttattcgtcggagtagatttttcgtaattcgttatttcgataattgttttttttagattaatatatttgtattagtaatcggtaatatttgtttttatcgttacgcgagtcgtaacgttagaaggtaatatcgattttcgatattttttattttgggcgtcgaaaatatcggtcgagggtagggaaattacgcgtatattgcgatttttttttgttaatttttttgtcgtttgtagggtaatttttatttttgaatcggtttgcgtttatttatcgggttatagattttatttaatttatagcgttttggtattttttttcggtgtcggcggttgttcgtttttaatttattgttcggttttggtaattcgattttggtttttgtttttttgttgttggggttaagtttgatgggtttgattttt

SEQ ID NO: 24606 - DNA, 712 bp, Artificial Sequence
  chemically treated genomic DNA (Homo sapiens) CpG-island No: 24606
aaaaatcaaacccatcaaacttaaccccaacaacaaaaaaacaaaaaccaaaatcgaattaccaaaaccgaacaataaattaaaaacgaacaaccgccgacaccgaaaaaaaataccaaaacgctataaattaaataaaatctataacccgataaataaacgcaaaccgattcaaaaataaaaattaccctacaaacgacaaaaaaattaacaaaaaaaaatcgcaatatacgcgtaatttccctaccctcgaccgatattttcgacgcccaaaataaaaaatatcgaaaatcgatattaccttctaacgttacgactcgcgtaacgataaaaacaaatattaccgattactaatacaaatatattaatctaaaaaaaacaattatcgaaataacgaattacgaaaaatctactccgacgaataaactattcccgttctttaactttaccgccgaaaatattataacaaaaacgcataaaatactaaaaataaaaaatacctaataataattaccgaatactaattaccgaatacgacgctaacgcgtcttatccgacctacaacgtcttatccgacctacatatcccgccattttatttaacgaataatccacaacgtaaaccaaacgtctaacccataccaattatcgcaaataaattctacgacgtaacgcaccaaacgaaaacgctaaccgtcaaaacgccaacgcgc

SEQ ID NO: 24607 - DNA, 712 bp, Artificial Sequence
  chemically treated genomic DNA (Homo sapiens) CpG-island No: 24607
gaaggttagatttattagatttaattttagtagtaggaaggtaaaaattagaatcgggttgttagaatcgagtagtgggttaaaggcgaatagtcgtcgatatcgagggaggatattagagcgttgtgggttggataggatttgtaattcggtgggtaaacgtaaatcggtttagagatggaaattattttgtaagcggtagagaaattagtaggagaaggtcgtaatgtacgcgtagtttttttgttttcgatcgatattttcgacgtttaggatgaggaatatcgggagtcggtgttgttttttaacgttgcggttcgcgtggcggtggaagtaggtattgtcgattattggtataagtatgttggtttgaaaggggtaattgtcgggatgacgggttacggggaatttgtttcggcggataagttgttttcgttttttggttttatcgtcgagaatattgtggtaaaagcgtataaggtgttgggagtgaaaggtgtttgatggtgattgtcggatgttgattgtcggatgcgacgttgacgcgttttattcggtttatagcgttttattcggtttatatgtttcgttattttgtttaacgggtgatttataacgtgggttaggcgtttggtttatgttagttatcgtaggtgggttttgcggcgtaacgtattaggcgaaaacgttgatcgttaaagcgttagcgcgt

SEQ ID NO: 24608 - DNA, 712 bp, Artificial Sequence
  chemically treated genomic DNA (Homo sapiens) CpG-island No: 24608
acgcgctaacgctttaacgatcaacgttttcgcctaatacgttacgccgcaaaacccacctacgataactaacataaaccaaacgcctaacccacgttataaatcacccgttaaacaaaataacgaaacatataaaccgaataaaacgctataaaccgaataaaacgcgtcaacgtcgcatccgacaatcaacatccgacaatcaccatcaaacacctttcactcccaacaccttatacgcttttaccacaatattctcgacgataaaaccaaaaaacgaaaacaacttatccgccgaaacaaattccccgtaacccgtcatcccgacaattacccctttcaaaccaacatacttataccaataatcgacaatacctacttccaccgccacgcgaaccgcaacgttaaaaaacaacaccgactcccgatattcctcatcctaaacgtcgaaaatatcgatcgaaaacaaaaaaactacgcgtacattacgaccttctcctactaatttctctaccgcttacaaaataatttccatctctaaaccgatttacgtttacccaccgaattacaaatcctatccaacccacaacgctctaatatcctccctcgatatcgacgactattcgcctttaacccactactcgattctaacaacccgattctaatttttaccttcctactactaaaattaaatctaataaatctaaccttc

SEQ ID NO: 24609 - DNA, 712 bp, Artificial Sequence
  chemically treated genomic DNA (Homo sapiens) CpG-island No: 24609
gcgtacgcgcgtcggggtgttggggattttatgggcgtgagtcggaaggaggttttatagcgtaaatgggcgggataagcgagttgacgaaatataggggcgcggtatgggcggtgcgatacgcggaaagggcggtgaggcgcgcggcgggagggggcgttatcgaggtatgggggcgggaggggcggggggaggaaagtaaagcggcgcgattgtcggtcggttcgtcggatcggcgggcgggcgagtcggcgggcgggcggggggtcgttaaggcgggggatgagttgacgcggcgggggggtgggtcgtgagggggaacgaatagcgcggatacgagtaagtcggcgagcgagggtcggtaatggtgtatgtgtgtaagtagaaatagggagtgcggtacggagggagcggttttgggtgagaaaggcggagacgaaaaagggagggtaaatagcgatagggtggggataacgtatattgtttacgggtttttgtcgcgattggcgggggggagtgaggtattgagatagtgtgggatgtattggagagtttatattatcgtaattagggaaatggcgaggcggggacgagtcggggtacgtaagttagcggggtttcgtggatgcgaatataaaagtaatattgagtaatagaagatagtggggtgatattaggatcgaagcgaatcgcgtgatattttcggtatgat

SEQ ID NO: 24610 - DNA, 712 bp, Artificial Sequence
  chemically treated genomic DNA (Homo sapiens) CpG-island No: 24610
atcataccgaaaatatcacgcgattcgcttcgatcctaatatcaccccactatcttctattactcaatattacttttatattcgcatccacgaaaccccgctaacttacgtaccccgactcgtccccgcctcgccatttccctaattacgataatataaactctccaatacatcccacactatctcaatacctcactcccccccgccaatcgcgacaaaaacccgtaaacaatatacgttatccccaccctatcgctatttaccctccctttttcgtctccgcctttctcacccaaaaccgctccctccgtaccgcactccctatttctacttacacacatacaccattaccgaccctcgctcgccgacttactcgtatccgcgctattcgttccccctcacgacccacccccccgccgcgtcaactcatcccccgccttaacgaccccccgcccgcccgccgactcgcccgcccgccgatccgacgaaccgaccgacaatcgcgccgctttactttcctccccccgcccctcccgcccccatacctcgataacgccccctcccgccgcgcgcctcaccgccctttccgcgtatcgcaccgcccataccgcgcccctatatttcgtcaactcgcttatcccgcccatttacgctataaaacctccttccgactcacgcccataaaatccccaacaccccgacgcgcgtacgc

SEQ ID NO: 24611 - DNA, 712 bp, Artificial Sequence
  chemically treated genomic DNA (Homo sapiens) CpG-island No: 24611
gttatatcgggagtattacgcggttcgtttcggttttggtgttattttattattttttgttgtttaatattatttttatattcgtatttacggggtttcgttgatttgcgtgtttcggttcgttttcgtttcgttatttttttagttgcggtagtatgggttttttaatatattttatattgttttaatgttttattttttttcgttagtcgcggtaaaggttcgtaggtagtatgcgttatttttattttgtcgttgtttattttttttttttcgttttcgttttttttatttaaaatcgtttttttcgtatcgtattttttatttttgtttatatatatgtattattatcggttttcgttcgtcggtttgttcgtgttcgcgttattcgtttttttttacggtttattttttcgtcgcgttaatttatttttcgttttagcgatttttcgttcgttcgtcggttcgttcgttcgtcggttcggcgggtcggtcggtagtcgcgtcgttttattttttttttttcgtttttttcgtttttatatttcggtaacgttttttttcgtcgcgcgttttatcgtttttttcgcgtgtcgtatcgtttatatcgcgtttttatatttcgttagttcgtttgtttcgtttatttgcgttgtaaagttttttttcggtttacgtttatagagtttttagtatttcggcgcgcgtgcgt

SEQ ID NO: 24612 - DNA, 712 bp, Artificial Sequence
  chemically treated genomic DNA (Homo sapiens) CpG-island No: 24612
acgcacgcgcgccgaaatactaaaaactctataaacgtaaaccgaaaaaaaactttacaacgcaaataaacgaaacaaacgaactaacgaaatataaaaacgcgatataaacgatacgacacgcgaaaaaaacgataaaacgcgcgacgaaaaaaaacgttaccgaaatataaaaacgaaaaaaacgaaaaaaaaaaaataaaacgacgcgactaccgaccgacccgccgaaccgacgaacgaacgaaccgacgaacgaacgaaaaatcgctaaaacgaaaaataaattaacgcgacgaaaaaataaaccgtaaaaaaaaacgaataacgcgaacacgaacaaaccgacgaacgaaaaccgataataatacatatatataaacaaaaataaaaaatacgatacgaaaaaaacgattttaaataaaaaaaacgaaaacgaaaaaaaaaaaataaacaacgacaaaataaaaataacgcatactacctacgaacctttaccgcgactaacgaaaaaaaataaaacattaaaacaatataaaatatattaaaaaacccatactaccgcaactaaaaaaataacgaaacgaaaacgaaccgaaacacgcaaatcaacgaaaccccgtaaatacgaatataaaaataatattaaacaacaaaaaataataaaataacaccaaaaccgaaacgaaccgcgtaatactcccgatataac

SEQ ID NO: 24613 - DNA, 569 bp, Artificial Sequence
  chemically treated genomic DNA (Homo sapiens) CpG-island No: 24613
tcgaggagggcgatggcggagagggatttacgggaggggggtgggggatggagcgcggggatggacggtttgggggtattaatagtggcggtaagtaggggagcgagggataacgtgttgtattagtggtgttgattatgtagttttgcgcgattatgcgagtgtaagtatatgataggttgggggtagcgtttggatttgaagatatttatgaattagatatttcggttatggtgtagttacgttgttgcgcgtcgcgtatttgcgtcggtacggatgggcgttaatcggtcgagagttttatttgcggtatttcgttcggcgcgttttatagggttttcgtttatattttttagtatgtattcgtttgtattatataaattcgacggcggtcgtaagtaattatattacgatgtatgtttatttatgggggaggtcgagtttgggttgtggtgggtgatggggattgcgagggcggggtcgtatatcggatgaagtatggtgaaaaattgattgttattgatttattgttatcgtatagcgtcgattttaggatttttgtttgtgga

SEQ ID NO: 24614 - DNA, 569 bp, Artificial Sequence
  chemically treated genomic DNA (Homo sapiens) CpG-island No: 24614
tccacaaacaaaaatcctaaaatcgacgctatacgataacaataaatcaataacaatcaatttttcaccatacttcatccgatatacgaccccgccctcgcaatccccatcacccaccacaacccaaactcgacctcccccataaataaacatacatcgtaatataattacttacgaccgccgtcgaatttatataatacaaacgaatacatactaaaaaatataaacgaaaaccctataaaacgcgccgaacgaaataccgcaaataaaactctcgaccgattaacgcccatccgtaccgacgcaaatacgcgacgcgcaacaacgtaactacaccataaccgaaatatctaattcataaatatcttcaaatccaaacgctacccccaacctatcatatacttacactcgcataatcgcgcaaaactacataatcaacaccactaatacaacacgttatccctcgctcccctacttaccgccactattaatacccccaaaccgtccatccccgcgctccatcccccacccccctcccgtaaatccctctccgccatcgccctcctcga

SEQ ID NO: 24615 - DNA, 569 bp, Artificial Sequence
  chemically treated genomic DNA (Homo sapiens) CpG-island No: 24615
tttataagtaaaggttttaaaatcggcgttatacgatggtagtaagttagtagtagttagttttttattatgttttattcggtatacggtttcgttttcgtaatttttattatttattatagtttaagttcggttttttttatgggtggatatgtatcgtggtgtggttgtttacgatcgtcgtcggatttgtatagtataagcgggtatatgttagaaggtgtaggcggaaattttataaaacgcgtcgaacggggtgtcgtaggtggggttttcggtcggttggcgtttattcgtatcggcgtaggtacgcggcgcgtaatagcgtaattgtattatagtcgaggtatttagtttatgggtatttttaagtttaagcgttgtttttaatttattatatatttatattcgtatggtcgcgtagagttgtatggttagtattattaatgtaatacgttatttttcgtttttttgtttgtcgttattattggtatttttaagtcgtttattttcgcgttttattttttatttttttttcgtggattttttttcgttatcgtttttttcgg

SEQ ID NO: 24616 - DNA, 569 bp, Artificial Sequence
  chemically treated genomic DNA (Homo sapiens) CpG-island No: 24616
ccgaaaaaaacgataacgaaaaaaaatccacgaaaaaaaaataaaaaataaaacgcgaaaataaacgacttaaaaataccaataataacgacaaacaaaaaaacgaaaaataacgtattacattaataatactaaccatacaactctacgcgaccatacgaatataaatatataataaattaaaaacaacgcttaaacttaaaaatacccataaactaaatacctcgactataatacaattacgctattacgcgccgcgtacctacgccgatacgaataaacgccaaccgaccgaaaaccccacctacgacaccccgttcgacgcgttttataaaatttccgcctacaccttctaacatatacccgcttatactatacaaatccgacgacgatcgtaaacaaccacaccacgatacatatccacccataaaaaaaaccgaacttaaactataataaataataaaaattacgaaaacgaaaccgtataccgaataaaacataataaaaaactaactactactaacttactaccatcgtataacgccgattttaaaacctttacttataaa

SEQ ID NO: 24617 - DNA, 540 bp, Artificial Sequence
  chemically treated genomic DNA (Homo sapiens) CpG-island No: 24617
gcggtgcgtcggcggtgattaaacgggaaaatttagagtgtgagagagtgtattaagtagtgtgtgtgataaataattatatttgttacgcgtttatagcggcggttggggtggcggcggtatagtttagagttttggaggtcgtgtttgttgtgtgcgataatagaattggatttgaatagtggagggttcgggtggtttatttatcgcggtagttacgatagcgttatttttgttttacgtttattgtttatttgattatttgcgggcggtcgcgattatgggaggtggggtgggtcgagagatatgttatcgtatcggtttggttcgggcgttattatgattttgggttacgggtggaaacgttgtggggagggaggtgtagaatcgaagaggttggggaggaggggagtgagataatatattgagtacgtgtgggagggagagaacgtagggagggagggaggagtgagggaggcggagtttgggatatagtggggcggaattggtaggacgatagattgtatatttttatggtag

SEQ ID NO: 24618 - DNA, 540 bp, Artificial Sequence
  chemically treated genomic DNA (Homo sapiens) CpG-island No: 24618
ctaccataaaaatatacaatctatcgtcctaccaattccgccccactatatcccaaactccgcctccctcactcctccctccctccctacgttctctccctcccacacgtactcaatatattatctcactcccctcctccccaacctcttcgattctacacctccctccccacaacgtttccacccgtaacccaaaatcataataacgcccgaaccaaaccgatacgataacatatctctcgacccaccccacctcccataatcgcgaccgcccgcaaataatcaaataaacaataaacgtaaaacaaaaataacgctatcgtaactaccgcgataaataaaccacccgaaccctccactattcaaatccaattctattatcgcacacaacaaacacgacctccaaaactctaaactataccgccgccaccccaaccgccgctataaacgcgtaacaaatataattatttatcacacacactacttaatacactctctcacactctaaattttcccgtttaatcaccgccgacgcaccgc

SEQ ID NO: 24619 - DNA, 540 bp, Artificial Sequence
  chemically treated genomic DNA (Homo sapiens) CpG-island No: 24619
ttgttataaaaatgtatagtttgtcgttttgttaatttcgttttattgtattttaggtttcgttttttttatttttttttttttttttgcgtttttttttttttatacgtatttaatgtgttattttattttttttttttttaattttttcggttttgtatttttttttttatagcgtttttattcgtagtttaaggttataatagcgttcgaattaagtcgatacggtaatatgtttttcggtttattttattttttatagtcgcggtcgttcgtaagtggttaaatgagtagtaagcgtagggtaggggtagcgttatcgtagttgtcgcggtaaataggttattcgggttttttattatttaagtttaattttgttatcgtatatagtaaatacggtttttagggttttaaattgtgtcgtcgttattttagtcgtcgttatgggcgcgtagtaagtatagttatttgttatatatattgtttggtatatttttttatattttaaattttttcgtttggttatcgtcggcgtatcgt

SEQ ID NO: 24620 - DNA, 540 bp, Artificial Sequence
  chemically treated genomic DNA (Homo sapiens) CpG-island No: 24620
acgatacgccgacgataaccaaacgaaaaaatttaaaatataaaaaaatataccaaacaatatatataacaaataactatacttactacgcgcccataacgacgactaaaataacgacgacacaatttaaaaccctaaaaaccgtatttactatatacgataacaaaattaaacttaaataataaaaaacccgaataacctatttaccgcgacaactacgataacgctacccctaccctacgcttactactcatttaaccacttacgaacgaccgcgactataaaaaataaaataaaccgaaaaacatattaccgtatcgacttaattcgaacgctattataaccttaaactacgaataaaaacgctataaaaaaaaaaatacaaaaccgaaaaaattaaaaaaaaaaaaaataaaataacacattaaatacgtataaaaaaaaaaaaacgcaaaaaaaaaaaaaaaaataaaaaaaacgaaacctaaaatacaataaaacgaaattaacaaaacgacaaactatacatttttataacaa

SEQ ID NO: 24621 - DNA, 615 bp, Artificial Sequence
  chemically treated genomic DNA (Homo sapiens) CpG-island No: 24621
  misc_feature (230)..(230): n is either a, c, g or t
  misc_feature (249)..(249): n is either a, c, g or t
cgggttggaagagtacgggagtttaagatggggagaatacgtgtagagtgatattttggtataaggtgtgatggttggcgatagtagttgatatggcgttagtataagataacggcggtacgacggttaggtaggggtaaacggatagttttggtatcgtattcgatttatcgttgggtaagtattcgatgtaggtaaattattggtatatttagacgtgcggcgacgtntaagaggtttacgcgattnagacgacggtaaagtacgaaaatttcgtttaatttaaaaatcgcgggtcgtttatcgttaaaagagtcgttcggagtgcgattttaatcggaagttttttttttatagtcgtgaggttttttttcgcgggttgttttagcgtgttttagtacgttgtttggaataatgtggtttatcgtgtgggtaatttcgttttttttttttcgtgcgttatttttggggggattgttgtcgtaattgtggtggcgtgatttggacgtgttaatcgcggaggttagtagtggtgagggtgggggatagtgtgattgtatgtaggttagaaatgaattgggaagaaacgacggtttagcgatatagtgtttatag

SEQ ID NO: 24622 - DNA, 615 bp, Artificial Sequence
  chemically treated genomic DNA (Homo sapiens) CpG-island No: 24622
  misc_feature (367)..(367): n is either a, c, g or t
  misc_feature (386)..(386): n is either a, c, g or t
ctataaacactatatcgctaaaccgtcgtttcttcccaattcatttctaacctacatacaatcacactatcccccaccctcaccactactaacctccgcgattaacacgtccaaatcacgccaccacaattacgacaacaatccccccaaaaataacgcacgaaaaaaaaaaaacgaaattacccacacgataaaccacattattccaaacaacgtactaaaacacgctaaaacaacccgcgaaaaaaaacctcacgactataaaaaaaaaacttccgattaaaatcgcactccgaacgactcttttaacgataaacgacccgcgatttttaaattaaacgaaattttcgtactttaccgtcgtctnaatcgcgtaaacctcttanacgtcgccgcacgtctaaatataccaataatttacctacatcgaatacttacccaacgataaatcgaatacgataccaaaactatccgtttacccctacctaaccgtcgtaccgccgttatcttatactaacgccatatcaactactatcgccaaccatcacaccttataccaaaatatcactctacacgtattctccccatcttaaactcccgtactcttccaacccg

SEQ ID NO: 24623 - DNA, 615 bp, Artificial Sequence
  chemically treated genomic DNA (Homo sapiens) CpG-island No: 24623
  misc_feature (367)..(367): n is either a, c, g or t
  misc_feature (386)..(386): n is either a, c, g or t
ttatgagtattatgtcgttgagtcgtcgtttttttttaatttatttttagtttgtatataattatattattttttatttttattattattagttttcgcggttaatacgtttaaattacgttattatagttacggtaataatttttttaaaaatggcgtacgaaaagggggaagcgaaattatttatacggtgaattatattattttaaataacgtgttgggatacgttagagtaattcgcggggggaagttttacgattatagaggagggattttcgattggaatcgtatttcggacggtttttttagcggtaagcggttcgcggtttttaggttgggcggaattttcgtgttttatcgtcgtttnggtcgcgtgggttttttangcgtcgtcgtacgtttgggtgtgttaatggtttatttgtatcgggtatttgtttaacgataaatcgggtgcgatattaggattattcgtttatttttgtttgatcgtcgtgtcgtcgttattttgtattagcgttatgttagttgttatcgttagttattatattttgtattaaagtgttattttgtacgtgttttttttattttagattttcgtatttttttaattcg

SEQ ID NO: 24624 - DNA, 615 bp, Artificial Sequence
  chemically treated genomic DNA (Homo sapiens) CpG-island No: 24624
  misc_feature (230)..(230): n is either a, c, g or t
  misc_feature (249)..(249): n is either a, c, g or t
cgaattaaaaaaatacgaaaatctaaaataaaaaaaacacgtacaaaataacactttaatacaaaatataataactaacgataacaactaacataacgctaatacaaaataacgacgacacgacgatcaaacaaaaataaacgaataatcctaatatcgcacccgatttatcgttaaacaaatacccgatacaaataaaccattaacacacccaaacgtacgacgacgcntaaaaaacccacgcgaccnaaacgacgataaaacacgaaaattccgcccaacctaaaaaccgcgaaccgcttaccgctaaaaaaaccgtccgaaatacgattccaatcgaaaatccctcctctataatcgtaaaacttccccccgcgaattactctaacgtatcccaacacgttatttaaaataatataattcaccgtataaataatttcgcttcccccttttcgtacgccatttttaaaaaaattattaccgtaactataataacgtaatttaaacgtattaaccgcgaaaactaataataataaaaataaaaaataatataattatatacaaactaaaaataaattaaaaaaaaacgacgactcaacgacataatactcataa

SEQ ID NO: 24625 - DNA, 507 bp, Artificial Sequence
  chemically treated genomic DNA (Homo sapiens) CpG-island No: 24625
gagatttcgtatataacgaaagtattgtagcgtttgttatcgcgtttatcgtcgttaaacgtcgagtattacgtaatttatatagtttttattcggcggtatgacgacgtagatgcggtgggcgggagcggtaattacgtaggtcgggaatagcggtggggcgtcgggggtgtacgtcggattgtcggggcgtgattatggtttttttgggggattttaatattatgtcgttggcggatcggtgggacgtgggtatttgtatgtagcggattagatatagtatttatagttgtttttatcgattttcgatggagttgtagagcggtttggcgggaacgtacgcggtcggcggcgtttagtgtatagtagattttatgataggttattgcgcgttaatagttatcgtatagcgtcgatttttgcgcgggtagttattatttgcgtttgtgttttattaattgtatagatttgtaggttgagaggaggatattttgcgttggtaggttt

SEQ ID NO: 24626 - DNA, 507 bp, Artificial Sequence
  chemically treated genomic DNA (Homo sapiens) CpG-island No: 24626
aaacctaccaacgcaaaatatcctcctctcaacctacaaatctatacaattaataaaacacaaacgcaaataataactacccgcgcaaaaatcgacgctatacgataactattaacgcgcaataacctatcataaaatctactatacactaaacgccgccgaccgcgtacgttcccgccaaaccgctctacaactccatcgaaaatcgataaaaacaactataaatactatatctaatccgctacatacaaatacccacgtcccaccgatccgccaacgacataatattaaaatcccccaaaaaaaccataatcacgccccgacaatccgacgtacacccccgacgccccaccgctattcccgacctacgtaattaccgctcccgcccaccgcatctacgtcgtcataccgccgaataaaaactatataaattacgtaatactcgacgtttaacgacgataaacgcgataacaaacgctacaatactttcgttatatacgaaatctc

SEQ ID NO: 24627 - DNA, 507 bp, Artificial Sequence
  chemically treated genomic DNA (Homo sapiens) CpG-island No: 24627
aagtttgttagcgtagggtgttttttttttagtttgtaagtttatgtaattgatagggtataagcgtaagtggtagttgttcgcgtaaaaatcggcgttatacgatggttgttggcgcgtagtagtttattatggggtttattgtatattaggcgtcgtcgatcgcgtgcgttttcgttaggtcgttttgtagttttatcgggaatcggtaaaggtaattgtaaatattgtgtttaattcgttgtatataagtgtttacgttttatcggttcgttaacgatatggtattgaggttttttaggggggttatgattacgtttcggtaattcgacgtatattttcggcgttttatcgttgttttcggtttgcgtagttgtcgttttcgtttatcgtatttacgtcgttatgtcgtcgggtaggggttatgtgagttacgtagtattcggcgtttagcggcggtaggcgcggtaataagcgttgtaatgttttcgttatgtacggggtttt

SEQ ID NO: 24628 - DNA, 507 bp, Artificial Sequence
  chemically treated genomic DNA (Homo sapiens) CpG-island No: 24628
aaaaccccgtacataacgaaaacattacaacgcttattaccgcgcctaccgccgctaaacgccgaatactacgtaactcacataacccctacccgacgacataacgacgtaaatacgataaacgaaaacgacaactacgcaaaccgaaaacaacgataaaacgccgaaaatatacgtcgaattaccgaaacgtaatcataacccccctaaaaaacctcaataccatatcgttaacgaaccgataaaacgtaaacacttatatacaacgaattaaacacaatatttacaattacctttaccgattcccgataaaactacaaaacgacctaacgaaaacgcacgcgatcgacgacgcctaatatacaataaaccccataataaactactacgcgccaacaaccatcgtataacgccgatttttacgcgaacaactaccacttacgcttataccctatcaattacataaacttacaaactaaaaaaaaaacaccctacgctaacaaactt

SEQ ID NO: 24629 - DNA, 686 bp, Artificial Sequence
  chemically treated genomic DNA (Homo sapiens) CpG-island No: 24629
ggacgttcgcgaggaaggggagtggaattatggttaatgcgattatcggagattgtcgagtatatcggtatacgcggggcggttgttcggtttaattatcgacgtcgtttgtacgtaacgcgggtgcggaacgaaggttgtatcgagcggtttgaaatgtcgatattgggtattgatatagcgtttatcgtcgcgtggcgtcggttacggattgagtcgtacgttgcgcggtattagcgttgattaatttgtatgtcggtatttggggttttacgcgttattaggcgcggttgttaaagagggcgtgtttagtacgtaattcgtaaggttatgttcgggattcgttatgtgtgcgttaaaagtgcgcggtgtaggtgcgatgcgaaaatatatcgggcgattaatattaaatgagagggtcgatttatcgttcggatatcgcggttagacgcgtagtgttatattatcgcgacgagacggggtagttcgcggtagttttcgtgtaggcggtacgtatcgatcgacgatagtttcgtcgaggttacgtaggaagcgagcgtttatattaatggttcgtgtcgatatggtcgacgtatatcgtaatatgatagggagggagtggagcggtaaaataatttggcgtggttttttataattcgtttattgtttttcgggatttgtcgtta

SEQ ID NO: 24630 - DNA, 686 bp, Artificial Sequence
  chemically treated genomic DNA (Homo sapiens) CpG-island No: 24630
taacgacaaatcccgaaaaacaataaacgaattataaaaaaccacgccaaattattttaccgctccactccctccctatcatattacgatatacgtcgaccatatcgacacgaaccattaatataaacgctcgcttcctacgtaacctcgacgaaactatcgtcgatcgatacgtaccgcctacacgaaaactaccgcgaactaccccgtctcgtcgcgataatataacactacgcgtctaaccgcgatatccgaacgataaatcgaccctctcatttaatattaatcgcccgatatattttcgcatcgcacctacaccgcgcacttttaacgcacacataacgaatcccgaacataaccttacgaattacgtactaaacacgccctctttaacaaccgcgcctaataacgcgtaaaaccccaaataccgacatacaaattaatcaacgctaataccgcgcaacgtacgactcaatccgtaaccgacgccacgcgacgataaacgctatatcaatacccaatatcgacatttcaaaccgctcgatacaaccttcgttccgcacccgcgttacgtacaaacgacgtcgataattaaaccgaacaaccgccccgcgtataccgatatactcgacaatctccgataatcgcattaaccataattccactccccttcctcgcgaacgtcc

SEQ ID NO: 24631 - DNA, 686 bp, Artificial Sequence
  chemically treated genomic DNA (Homo sapiens) CpG-island No: 24631
tagcggtaagtttcgaaaagtaataagcgggttatgaggggttacgttaagttattttatcgttttattttttttttattatattacggtatacgtcggttatgtcggtacgggttattagtgtgggcgttcgttttttacgtggtttcgacggggttgtcgtcggtcggtgcgtgtcgtttgtacgggggttatcgcgggttatttcgtttcgtcgcggtggtgtagtattgcgcgtttagtcgcggtgttcgggcggtaggtcggtttttttatttggtattaatcgttcggtatattttcgtatcgtatttgtatcgcgtatttttggcgtatatatggcgggtttcgggtataattttacggattacgtattggatacgttttttttaatagtcgcgtttggtggcgcgtaaagttttaagtatcggtatataaattaattagcgttagtgtcgcgtagcgtgcggtttagttcgtggtcggcgttacgcggcggtaagcgttgtgttagtatttagtgtcggtattttaagtcgttcggtgtaattttcgtttcgtattcgcgttgcgtataggcggcgtcggtaattaggtcgggtagtcgtttcgcgtgtgtcggtgtattcggtagttttcggtggtcgtattggttatggttttatttttttttttcgcgggcgttt

SEQ ID NO: 24632 - DNA, 686 bp, Artificial Sequence
  chemically treated genomic DNA (Homo sapiens) CpG-island No: 24632
aaacgcccgcgaaaaaaaaaaataaaaccataaccaatacgaccaccgaaaactaccgaatacaccgacacacgcgaaacgactacccgacctaattaccgacgccgcctatacgcaacgcgaatacgaaacgaaaattacaccgaacgacttaaaataccgacactaaatactaacacaacgcttaccgccgcgtaacgccgaccacgaactaaaccgcacgctacgcgacactaacgctaattaatttatataccgatacttaaaactttacgcgccaccaaacgcgactattaaaaaaaacgtatccaatacgtaatccgtaaaattatacccgaaacccgccatatatacgccaaaaatacgcgatacaaatacgatacgaaaatataccgaacgattaataccaaataaaaaaaccgacctaccgcccgaacaccgcgactaaacgcgcaatactacaccaccgcgacgaaacgaaataacccgcgataacccccgtacaaacgacacgcaccgaccgacgacaaccccgtcgaaaccacgtaaaaaacgaacgcccacactaataacccgtaccgacataaccgacgtataccgtaatataataaaaaaaaaataaaacgataaaataacttaacgtaacccctcataacccgcttattacttttcgaaacttaccgcta

SEQ ID NO: 24633 - DNA, 1039 bp, Artificial Sequence
  chemically treated genomic DNA (Homo sapiens) CpG-island No: 24633
taagcggtcggggtaggtggatgcgggtcgagttgatggtggtcgtggaggtcgatattgtgtgggggtattgatacgttatgttggtgttgggttttgggttagcgagggattgtgggcgacgtcggggttgtattgggggtatacggggaattggggtttgcgtatttataatatattgggttattgtgtaattatggggttggttcggtggggtatcggttaggacgtaaacgacggaacgtgcggtagtttaatgcgattatttaggagggggtattatacgttagggtcgttgataataggtttggattggtcggttagcgtttaacgaggggttatgcgtcggaattaggtagcggaggttgtaaacgcgtcggtgagggacgttacgatcgttacgggggtgtgttgtcgcggtatgacggttgtgtgtgtagatggagtttgggatggatggttgcggcgggcgagattcgcgaacggttatggtaaggacgggagggttaatcgcgtggtaagcgcggggggcggacggggtcggtgggtggatatattggcgggagattgtagtgacggggcgttgggatagataaacgaattatagttacgggtattgttcgcggatcggttggtaatcggggtgtttaatgtcgagaagattgcgtcggaattttggttagttggtttgttttggtgaatgggaatgtcgggatgcgcggtgtgggtaagtattatcgcggggttggttttggggggaggatttggatgttgtttacgtatttttggtatatgttcgtttcgcggtgtattagttgtgtcggttgtgggtaggggcgattgcggggttttattacggttggggttttaggagtgataggggagtttgttataatcggtgggtaggtaggggggttaaggcgtcgcgatcgtgttatgatgtggcgttgatatgggataagtagtagttttgggttgtgtgttgcggtgttaattgattatagttatgcgtatagcgtcgatttttaattatgagtaa

SEQ ID NO: 24634 - DNA, 1039 bp, Artificial Sequence
  chemically treated genomic DNA (Homo sapiens) CpG-island No: 24634
ttactcataattaaaaatcgacgctatacgcataactataatcaattaacaccgcaacacacaacccaaaactactacttatcccatatcaacgccacatcataacacgatcgcgacgccttaacccccctacctacccaccgattataacaaactcccctatcactcctaaaaccccaaccgtaataaaaccccgcaatcgcccctacccacaaccgacacaactaatacaccgcgaaacgaacatataccaaaaatacgtaaacaacatccaaatcctccccccaaaaccaaccccgcgataatacttacccacaccgcgcatcccgacattcccattcaccaaaacaaaccaactaaccaaaattccgacgcaatcttctcgacattaaacaccccgattaccaaccgatccgcgaacaatacccgtaactataattcgtttatctatcccaacgccccgtcactacaatctcccgccaatatatccacccaccgaccccgtccgccccccgcgcttaccacgcgattaaccctcccgtccttaccataaccgttcgcgaatctcgcccgccgcaaccatccatcccaaactccatctacacacacaaccgtcataccgcgacaacacacccccgtaacgatcgtaacgtccctcaccgacgcgtttacaacctccgctacctaattccgacgcataacccctcgttaaacgctaaccgaccaatccaaacctattatcaacgaccctaacgtataataccccctcctaaataatcgcattaaactaccgcacgttccgtcgtttacgtcctaaccgataccccaccgaaccaaccccataattacacaataacccaatatattataaatacgcaaaccccaattccccgtatacccccaatacaaccccgacgtcgcccacaatccctcgctaacccaaaacccaacaccaacataacgtatcaatacccccacacaatatcgacctccacgaccaccatcaactcgacccgcatccacctaccccgaccgctta

SEQ ID NO: 24635 - DNA, 1039 bp, Artificial Sequence
  chemically treated genomic DNA (Homo sapiens) CpG-island No: 24635
ttgtttatagttgaaaatcggcgttatacgtatggttgtagttagttggtatcgtaatatatagtttaagattgttatttattttatgttaacgttatattatagtacggtcgcgacgttttaatttttttatttatttatcgattataataaatttttttattatttttggagttttaatcgtagtagaatttcgtaatcgtttttatttataatcggtataattggtgtatcgcgaaacggatatgtattagaagtacgtggataatatttaaattttttttttaaaattagtttcgcgataatatttgtttatatcgcgtatttcggtatttttatttattaaggtaggttagttaattaaaatttcggcgtaattttttcggtattaaatatttcggttgttaatcggttcgcgggtagtgttcgtaattgtggttcgtttgtttattttaacgtttcgttattatagtttttcgttaatatgtttatttatcggtttcgttcgtttttcgcgtttgttacgcggttagttttttcgtttttattatagtcgttcgcggatttcgttcgtcgtagttatttattttaagttttatttgtatatatagtcgttatatcgcggtagtatattttcgtagcggtcgtaacgttttttatcggcgcgtttgtaattttcgttatttagtttcggcgtatggtttttcgttaagcgttagtcggttagtttaaatttattgttagcggttttagcgtataatatttttttttgggtggtcgtattaggttgtcgtacgtttcgtcgtttgcgttttggtcggtattttatcgggttagttttataattgtataatggtttaatatattataagtacgtaagttttaatttttcgtatgtttttagtgtaatttcggcgtcgtttataatttttcgttggtttaaggtttaatattaatatggcgtattaatatttttatataatgtcggtttttacggttattattagttcggttcgtatttatttatttcggtcgtttg

SEQ ID NO: 24636 - DNA, 1039 bp, Artificial Sequence
  chemically treated genomic DNA (Homo sapiens) CpG-island No: 24636
caaacgaccgaaataaataaatacgaaccgaactaataataaccgtaaaaaccgacattatataaaaatattaatacgccatattaatattaaaccttaaaccaacgaaaaattataaacgacgccgaaattacactaaaaacatacgaaaaattaaaacttacgtacttataatatattaaaccattatacaattataaaactaacccgataaaataccgaccaaaacgcaaacgacgaaacgtacgacaacctaatacgaccacccaaaaaaaaatattatacgctaaaaccgctaacaataaatttaaactaaccgactaacgcttaacgaaaaaccatacgccgaaactaaataacgaaaattacaaacgcgccgataaaaaacgttacgaccgctacgaaaatatactaccgcgatataacgactatatatacaaataaaacttaaaataaataactacgacgaacgaaatccgcgaacgactataataaaaacgaaaaaactaaccgcgtaacaaacgcgaaaaacgaacgaaaccgataaataaacatattaacgaaaaactataataacgaaacgttaaaataaacaaacgaaccacaattacgaacactacccgcgaaccgattaacaaccgaaatatttaataccgaaaaaattacgccgaaattttaattaactaacctaccttaataaataaaaataccgaaatacgcgatataaacaaatattatcgcgaaactaattttaaaaaaaaaatttaaatattatccacgtacttctaatacatatccgtttcgcgatacaccaattataccgattataaataaaaacgattacgaaattctactacgattaaaactccaaaaataataaaaaaatttattataatcgataaataaataaaaaaattaaaacgtcgcgaccgtactataatataacgttaacataaaataaataacaatcttaaactatatattacgataccaactaactacaaccatacgtataacgccgattttcaactataaacaa

SEQ ID NO: 24637 - DNA, 521 bp, Artificial Sequence
  chemically treated genomic DNA (Homo sapiens) CpG-island No: 24637
aattatacgtcgtttacgggtacgcggtttattgtgggtttttagtgttcggggaaaggggttttcgtatttcggcgcgttcgtagtttggaagaggttatgtagtagtagtcgagaggtggttatcgtgtagcgatcgtgatgtttacgcggttagtgaagggtaaagattcggtcggaagttgtcgggttttagttgcggttatagttttagatcgtagtgtagcggtacggttagggcggtaggcgtagttggttttagggtttcgggggtcgttagttttcggggtggtcgttatcgttagttcgcgtgtattgttgggtttcggggtggcgtcggtttttgtttgaggggaggggaagattcggtttttaagttttgagtttaggtagtttcgacggtgggacgcgttcgtagtggtcgtataagcggcgagtacggttagcgttagtaggagggcggttattagtttagttatagtagggttattgcgcggtttatatagaagtttgagttggaa

SEQ ID NO: 24638 - DNA, 521 bp, Artificial Sequence
  chemically treated genomic DNA (Homo sapiens) CpG-island No: 24638
ttccaactcaaacttctatataaaccgcgcaataaccctactataactaaactaataaccgccctcctactaacgctaaccgtactcgccgcttatacgaccactacgaacgcgtcccaccgtcgaaactacctaaactcaaaacttaaaaaccgaatcttcccctcccctcaaacaaaaaccgacgccaccccgaaacccaacaatacacgcgaactaacgataacgaccaccccgaaaactaacgacccccgaaaccctaaaaccaactacgcctaccgccctaaccgtaccgctacactacgatctaaaactataaccgcaactaaaacccgacaacttccgaccgaatctttacccttcactaaccgcgtaaacatcacgatcgctacacgataaccacctctcgactactactacataacctcttccaaactacgaacgcgccgaaatacgaaaacccctttccccgaacactaaaaacccacaataaaccgcgtacccgtaaacgacgtataatt

SEQ ID NO: 24639 - DNA, 521 bp, Artificial Sequence
  chemically treated genomic DNA (Homo sapiens) CpG-island No: 24639
ttttagtttaggtttttatgtgagtcgcgtagtggttttgttgtggttgggttggtagtcgtttttttgttggcgttggtcgtattcgtcgtttgtacggttattgcgagcgcgttttatcgtcggagttgtttggatttaggatttggaagtcgagtttttttttttttttaggtagaagtcgacgttatttcgaaatttagtagtgtacgcgagttagcggtgacgattatttcgagaattggcgattttcggggttttgggattagttacgtttgtcgttttggtcgtgtcgttgtattacgatttggagttgtggtcgtagttgaggttcgatagttttcggtcgggtttttgttttttattggtcgcgtgaatattacggtcgttgtacggtggttatttttcgattgttgttgtatagttttttttaggttgcgagcgcgtcgaggtgcggggattttttttttcgggtattgggaatttatagtgggtcgcgtgttcgtggacgacgtgtggtt

SEQ ID NO: 24640 - DNA, 521 bp, Artificial Sequence
  chemically treated genomic DNA (Homo sapiens) CpG-island No: 24640
aaccacacgtcgtccacgaacacgcgacccactataaattcccaatacccgaaaaaaaaaatccccgcacctcgacgcgctcgcaacctaaaaaaaactatacaacaacaatcgaaaaataaccaccgtacaacgaccgtaatattcacgcgaccaataaaaaacaaaaacccgaccgaaaactatcgaacctcaactacgaccacaactccaaatcgtaatacaacgacacgaccaaaacgacaaacgtaactaatcccaaaaccccgaaaatcgccaattctcgaaataatcgtcaccgctaactcgcgtacactactaaatttcgaaataacgtcgacttctacctaaaaaaaaaaaaaaactcgacttccaaatcctaaatccaaacaactccgacgataaaacgcgctcgcaataaccgtacaaacgacgaatacgaccaacgccaacaaaaaaacgactaccaacccaaccacaacaaaaccactacgcgactcacataaaaacctaaactaaaa

SEQ ID NO: 24641 - DNA, 580 bp, Artificial Sequence
  chemically treated genomic DNA (Homo sapiens) CpG-island No: 24641
cggttttaatcgcgatagataggcgatcgcgtcggtggtttttataaaaacgggtttgtgtcggatgggggtggatttggttgtgtacgtatgatttataggatttggtgtaaacggtcgtggtttgtcgtcgtattaacgttttgtcgtaatgataatgttatatttggtgagtacgcggttttgataaagggcggggtgtttttttattttattatgttttataggatttgtcgtaaattcgtttacgtttgtttgcgatgtacgttatgtcgtaatggcgttggtatcgtggtgacgacgggtttttattagtagggggagtgggggaagatattttgattattatttagttatagtattgttagtatttcgtttacgtttgtcgcggattttacggtttgtcgtttcgttaattgtacgtttcgcgaatttttgattcgggattttttattttaagtttgttcgcgaatttaattgcggtagttagttattatttatgtcgtatgtttatgtgttatgtcgttttaagtggcgtattcgtatggttatagttatatattttaatatttttattgga

SEQ ID NO: 24642 - DNA, 580 bp, Artificial Sequence
  chemically treated genomic DNA (Homo sapiens) CpG-island No: 24642
tccaataaaaatattaaaatatataactataaccatacgaatacgccacttaaaacgacataacacataaacatacgacataaataataactaactaccgcaattaaattcgcgaacaaacttaaaataaaaaatcccgaatcaaaaattcgcgaaacgtacaattaacgaaacgacaaaccgtaaaatccgcgacaaacgtaaacgaaatactaacaatactataactaaataataatcaaaatatcttcccccactccccctactaataaaaacccgtcgtcaccacgataccaacgccattacgacataacgtacatcgcaaacaaacgtaaacgaatttacgacaaatcctataaaacataataaaataaaaaaacaccccgccctttatcaaaaccgcgtactcaccaaatataacattatcattacgacaaaacgttaatacgacgacaaaccacgaccgtttacaccaaatcctataaatcatacgtacacaaccaaatccacccccatccgacacaaacccgtttttataaaaaccaccgacgcgatcgcctatctatcgcgattaaaaccg

SEQ ID NO: 24643 - DNA, 580 bp, Artificial Sequence
  chemically treated genomic DNA (Homo sapiens) CpG-island No: 24643
tttagtaaaggtgttggggtatgtggttatgattatacgaatgcgttatttgaagcgatatggtatatgagtatgcgatataagtggtgattgattgtcgtaattgaattcgcgagtagatttggggtaggaaatttcgggttaagagttcgcgaagcgtgtagttagcgaggcggtaaatcgtaaggttcgcggtaggcgtaggcgggatattagtaatgttgtaattgggtggtggttagggtatttttttttattttttttattaatgaaaattcgtcgttattacggtattaacgttattgcggtatggcgtatatcgtaggtaggcgtaggcgggtttacggtaaattttgtaagatatagtggagtgggaaggtatttcgttttttattaaaatcgcgtgtttattagatgtagtattgttattgcggtaaagcgttagtacggcggtaggttacggtcgtttatattaaattttgtaagttatacgtgtatagttaagtttatttttattcggtataaattcgtttttgtaggggttatcggcgcggtcgtttatttgtcgcggttagggtcg

SEQ ID NO: 24644 - DNA, 580 bp, Artificial Sequence
  chemically treated genomic DNA (Homo sapiens) CpG-island No: 24644
cgaccctaaccgcgacaaataaacgaccgcgccgataacccctacaaaaacgaatttataccgaataaaaataaacttaactatacacgtataacttacaaaatttaatataaacgaccgtaacctaccgccgtactaacgctttaccgcaataacaatactacatctaataaacacgcgattttaataaaaaacgaaataccttcccactccactatatcttacaaaatttaccgtaaacccgcctacgcctacctacgatatacgccataccgcaataacgttaataccgtaataacgacgaattttcattaataaaaaaaataaaaaaaaataccctaaccaccacccaattacaacattactaatatcccgcctacgcctaccgcgaaccttacgatttaccgcctcgctaactacacgcttcgcgaactcttaacccgaaatttcctaccccaaatctactcgcgaattcaattacgacaatcaatcaccacttatatcgcatactcatataccatatcgcttcaaataacgcattcgtataatcataaccacataccccaacacctttactaaa

SEQ ID NO: 24645 - DNA, 1039 bp, Artificial Sequence
  chemically treated genomic DNA (Homo sapiens) CpG-island No: 24645
  misc_feature (241)..(241): n is either a, c, g or t
tttacgttttttttttttcggtatttttttttattttcgttttggggttgtcgtgtatttttttcgttcgtttcgtttcgtttcgttttcgtttattcgtcgattcggattcggttatgcgatttcggttggggtcgcggttcgagtttgacgttcgagcgtttcggtgggttttgtttgtgagttgcgtgcgcggtagatttttggttttggcggttgttgtttggttgtgtgggggcgnatcggtgaagaattataaataatgagtagtcgcgtggggtcggcgggggttgttgtcggcggcggtcgggtgtcgcggcggcggtgttcgtcgttcgtcggcgcgtgggcgtgggcgtgttttttgtgtttggtttatatatagttatattatatcggtttgtcggttgtcggttggcggtgtttgttgttttggggttcgttgtttttgcgcggtcgtgtcggtttgtgtagcgtttttaacggacgcgattatacggggagagggagtatattaagtaggcgagcggaattagtaaagggtataaaaggatagcgggtatttatgttggttgtcgtttggcggattacggcgtgtaatatatgtacgacgcggcgatagcgggtttgttagatcgcgtaatttacggcggaatgaatgtagtgtatttaatttatgtatattgtaatattgtgtatggtgtattgattatgtttcgcgttataacgcgattataggtcgcgtagtaaagaaatttggtcgtaaggggggtgttagcgggaggtttcgttagtttatttggtttttttacgcgtgttttcgtttagggcgggcgagggtttgggtttgttacgacggggcgatttagattattattttttttatttacgttatataggatttgttgtaaatcgttttcgtttattatcgatgtcgttatgtcgcgatcgcgttgattattaggtgtttacggttttttatatagtagggggagtgggggggaagtttttttattattttttttttatagtatttgtt

SEQ ID NO: 24646 - DNA, 1039 bp, Artificial Sequence
  chemically treated genomic DNA (Homo sapiens) CpG-island No: 24646
  misc_feature (799)..(799): n is either a, c, g or t
aacaaatactataaaaaaaaaataataaaaaaacttcccccccactccccctactatataaaaaaccgtaaacacctaataatcaacgcgatcgcgacataacgacatcgataataaacgaaaacgatttacaacaaatcctatataacgtaaataaaaaaaataataatctaaatcgccccgtcgtaacaaacccaaaccctcgcccgccctaaacgaaaacacgcgtaaaaaaaccaaataaactaacgaaacctcccgctaacaccccccttacgaccaaatttctttactacgcgacctataatcgcgttataacgcgaaacataatcaatacaccatacacaatattacaatatacataaattaaatacactacattcattccgccgtaaattacgcgatctaacaaacccgctatcgccgcgtcgtacatatattacacgccgtaatccgccaaacgacaaccaacataaatacccgctatccttttataccctttactaattccgctcgcctacttaatatactccctctccccgtataatcgcgtccgttaaaaacgctacacaaaccgacacgaccgcgcaaaaacaacgaaccccaaaacaacaaacaccgccaaccgacaaccgacaaaccgatataatataactatatataaaccaaacacaaaaaacacgcccacgcccacgcgccgacgaacgacgaacaccgccgccgcgacacccgaccgccgccgacaacaacccccgccgaccccacgcgactactcattatttataattcttcaccgatncgcccccacacaaccaaacaacaaccgccaaaaccaaaaatctaccgcgcacgcaactcacaaacaaaacccaccgaaacgctcgaacgtcaaactcgaaccgcgaccccaaccgaaatcgcataaccgaatccgaatcgacgaataaacgaaaacgaaacgaaacgaaacgaacgaaaaaaatacacgacaaccccaaaacgaaaataaaaaaaaataccgaaaaaaaaaaaacgtaaa

SEQ ID NO: 24647 - DNA, 1039 bp, Artificial Sequence
  chemically treated genomic DNA (Homo sapiens) CpG-island No: 24647
  misc_feature (799)..(799): n is either a, c, g or t
agtaaatgttgtaagagggaggtggtgaggaagttttttttttattttttttattatatgaaaagtcgtggatatttggtaattaacgcgatcgcggtatggcgatatcggtggtaggcgaaggcggtttatagtaaattttgtatgacgtaggtggagagggtagtggtttaaatcgtttcgtcgtagtaaatttaggttttcgttcgttttaggcgaaagtacgcgtaaaggaattaggtgggttagcgggatttttcgttggtattttttttgcggttaagtttttttattgcgcggtttgtaatcgcgttgtggcgcggggtataattagtgtattatatatagtgttatagtgtgtatgagttgggtgtattgtatttatttcgtcgtgaattacgcggtttggtaaattcgttatcgtcgcgtcgtgtatgtgttgtacgtcgtggttcgttaggcggtaattaatataagtattcgttgtttttttgtattttttgttagtttcgttcgtttatttggtgtgtttttttttttcgtatggtcgcgttcgttaggaacgttatataggtcgatacggtcgcgtagaagtagcggattttagaataataggtatcgttaatcggtaatcgataaatcgatgtgatgtgattatgtgtggattaaatatagagagtacgtttacgtttacgcgtcgacgagcggcggatatcgtcgtcgcggtattcgatcgtcgtcggtagtagttttcgtcgattttacgcggttatttattatttataattttttatcggtncgtttttatataattaagtagtaatcgttagaattagagatttgtcgcgtacgtaatttatagatagggtttatcggaacgttcgggcgttagattcgagtcgcggttttagtcgggatcgtatagtcggattcgaatcgacgaatggacgggaacgaaacgaaacggaacgaacgaagagggtgtacgatagttttagagcgggagtgagaagggatatcggagaggagggggcgtagg

SEQ ID NO: 24648 - DNA, 1039 bp, Artificial Sequence
  chemically treated genomic DNA (Homo sapiens) CpG-island No: 24648
  misc_feature (241)..(241): n is either a, c, g or t
cctacgccccctcctctccgatatcccttctcactcccgctctaaaactatcgtacaccctcttcgttcgttccgtttcgtttcgttcccgtccattcgtcgattcgaatccgactatacgatcccgactaaaaccgcgactcgaatctaacgcccgaacgttccgataaaccctatctataaattacgtacgcgacaaatctctaattctaacgattactacttaattatataaaaacgnaccgataaaaaattataaataataaataaccgcgtaaaatcgacgaaaactactaccgacgacgatcgaataccgcgacgacgatatccgccgctcgtcgacgcgtaaacgtaaacgtactctctatatttaatccacacataatcacatcacatcgatttatcgattaccgattaacgatacctattattctaaaatccgctacttctacgcgaccgtatcgacctatataacgttcctaacgaacgcgaccatacgaaaaaaaaaaacacaccaaataaacgaacgaaactaacaaaaaatacaaaaaaacaacgaatacttatattaattaccgcctaacgaaccacgacgtacaacacatacacgacgcgacgataacgaatttaccaaaccgcgtaattcacgacgaaataaatacaatacacccaactcatacacactataacactatatataatacactaattataccccgcgccacaacgcgattacaaaccgcgcaataaaaaaacttaaccgcaaaaaaaataccaacgaaaaatcccgctaacccacctaattcctttacgcgtactttcgcctaaaacgaacgaaaacctaaatttactacgacgaaacgatttaaaccactaccctctccacctacgtcatacaaaatttactataaaccgccttcgcctaccaccgatatcgccataccgcgatcgcgttaattaccaaatatccacgacttttcatataataaaaaaaataaaaaaaaaacttcctcaccacctccctcttacaacatttact

SEQ ID NO: 24649 - DNA, 504 bp, Artificial Sequence
  chemically treated genomic DNA (Homo sapiens) CpG-island No: 24649
tcgtaatcgcgatgtttacgttggttatacgggttttgatatagtagggggagtgggggaagttttttatattatttcgatttataggatttgttagtatttcgtttacgtttgtcgcggatttaaggttttttttttgcgttatttgtacgtttggcgatgttttgaattgtatgtttattttcgtggcgtaggcgtattgatatggggggagggaggggcgaggagggaggggacgggaaaatggggggcgaggtgaaagtggggttgatggcgggtgatgagtacgtcggagagataggcgcggcgagtttggtttaaagagtgcgcggtggaagatataagatcgcgcgggaagggcgacgttaggtcggagaggtgtttacgggacgtacgtgtcgagtagatcgttataagttaattttgggtacgtaagagcgtaagtatacgaaatttatgtgttttgtattatttatatttatatatagaacgggtatcgttgga

SEQ ID NO: 24650 - DNA, 504 bp, Artificial Sequence
  chemically treated genomic DNA (Homo sapiens) CpG-island No: 24650
tccaacgatacccgttctatatataaatataaataatacaaaacacataaatttcgtatacttacgctcttacgtacccaaaattaacttataacgatctactcgacacgtacgtcccgtaaacacctctccgacctaacgtcgcccttcccgcgcgatcttatatcttccaccgcgcactctttaaaccaaactcgccgcgcctatctctccgacgtactcatcacccgccatcaaccccactttcacctcgccccccattttcccgtcccctccctcctcgcccctccctccccccatatcaatacgcctacgccacgaaaataaacatacaattcaaaacatcgccaaacgtacaaataacgcaaaaaaaaaaccttaaatccgcgacaaacgtaaacgaaatactaacaaatcctataaatcgaaataatataaaaaacttcccccactccccctactatatcaaaacccgtataaccaacgtaaacatcgcgattacga

SEQ ID NO: 24651 - DNA, 504 bp, Artificial Sequence
  chemically treated genomic DNA (Homo sapiens) CpG-island No: 24651
tttaacggtattcgttttgtgtgtgggtgtgggtggtgtaaaatatatggatttcgtgtatttacgtttttacgtgtttaaaattagtttgtggcggtttattcgatacgtgcgtttcgtaggtattttttcggtttaacgtcgtttttttcgcgcgattttgtgttttttatcgcgtattttttaggttagattcgtcgcgtttgttttttcggcgtatttattattcgttattagttttatttttatttcgttttttattttttcgtttttttttttttcgtttttttttttttttatattaatacgtttgcgttacgagggtaagtatatagtttaagatatcgttaagcgtgtagatggcgtaggggggaaattttagattcgcggtaggcgtaggcgggatattagtaaattttgtaagtcgaggtggtgtgggaagttttttttattttttttattatattaaaattcgtgtgattaacgtaagtatcgcgattgcgg

SEQ ID NO: 24652 - DNA, 504 bp, Artificial Sequence
  chemically treated genomic DNA (Homo sapiens) CpG-island No: 24652
ccgcaatcgcgatacttacgttaatcacacgaattttaatataataaaaaaaataaaaaaaacttcccacaccacctcgacttacaaaatttactaatatcccgcctacgcctaccgcgaatctaaaatttcccccctacgccatctacacgcttaacgatatcttaaactatatacttaccctcgtaacgcaaacgtattaatataaaaaaaaaaaaaaacgaaaaaaaaaaaaacgaaaaaataaaaaacgaaataaaaataaaactaataacgaataataaatacgccgaaaaaacaaacgcgacgaatctaacctaaaaaatacgcgataaaaaacacaaaatcgcgcgaaaaaaacgacgttaaaccgaaaaaatacctacgaaacgcacgtatcgaataaaccgccacaaactaattttaaacacgtaaaaacgtaaatacacgaaatccatatattttacaccacccacacccacacacaaaacgaataccgttaaa

SEQ ID NO: 24653 - DNA, 527 bp, Artificial Sequence
  chemically treated genomic DNA (Homo sapiens) CpG-island No: 24653
agttataggcggggcgcggttattggttggttttggggttattttttttcgggcgggtagcgaatgatgaaatgggaacggggaggggaaaggtcgcgacgtgagcgcgcgattttcggcgttattttgtagagaaataagcggagttaatcgaagagggggtcgaggagagtcggagtcggggatttaggagttttttgtgtttagcgttgtcggagtcgtttgaggtgaggcgggttggcgttaggggttagggtagggtggcggtgttagtttgggaacgcgagagtcggtgggaggaggaataggggtggatttggggttattggaagcgtttttcggagttttagggagtgagaggtagtcgggacggggaagtgggacgaggcgggagagggcggatttttttttatacggttttcggaggtttcgcgttttgaagatgagaggtttagcgagaaggttttaggaagcggagggtagagcgcggggtgagatttatggtggtttttgtttcgggtttggag

SEQ ID NO: 24654 - DNA, 527 bp, Artificial Sequence
  chemically treated genomic DNA (Homo sapiens) CpG-island No: 24654
ctccaaacccgaaacaaaaaccaccataaatctcaccccgcgctctaccctccgcttcctaaaaccttctcgctaaacctctcatcttcaaaacgcgaaacctccgaaaaccgtataaaaaaaaatccgccctctcccgcctcgtcccacttccccgtcccgactacctctcactccctaaaactccgaaaaacgcttccaataaccccaaatccacccctattcctcctcccaccgactctcgcgttcccaaactaacaccgccaccctaccctaacccctaacgccaacccgcctcacctcaaacgactccgacaacgctaaacacaaaaaactcctaaatccccgactccgactctcctcgaccccctcttcgattaactccgcttatttctctacaaaataacgccgaaaatcgcgcgctcacgtcgcgacctttcccctccccgttcccatttcatcattcgctacccgcccgaaaaaaaataaccccaaaaccaaccaataaccgcgccccgcctataact

SEQ ID NO: 24655 - DNA, 527 bp, Artificial Sequence
  chemically treated genomic DNA (Homo sapiens) CpG-island No: 24655
ttttaggttcgggatagagattattatgggttttatttcgcgttttatttttcgttttttggagttttttcgttgggttttttatttttagagcgcgaagttttcgagagtcgtgtggagaagagttcgttttttttcgtttcgttttattttttcgtttcggttgttttttattttttagagtttcgggaaacgtttttagtggttttaggtttatttttgtttttttttttatcggttttcgcgtttttaagttgatatcgttattttattttagtttttgacgttaattcgttttattttaggcggtttcggtagcgttggatataggaaatttttgggttttcgatttcggtttttttcgatttttttttcggttaatttcgtttgtttttttataaaatggcgtcggaggtcgcgcgtttacgtcgcggtttttttttttttcgtttttattttattattcgttgttcgttcgaggagggatggttttagagttagttaatggtcgcgtttcgtttgtggtt

SEQ ID NO: 24656 - DNA, 527 bp, Artificial Sequence
  chemically treated genomic DNA (Homo sapiens) CpG-island No: 24656
aaccacaaacgaaacgcgaccattaactaactctaaaaccatccctcctcgaacgaacaacgaataataaaataaaaacgaaaaaaaaaaaaaccgcgacgtaaacgcgcgacctccgacgccattttataaaaaaacaaacgaaattaaccgaaaaaaaaatcgaaaaaaaccgaaatcgaaaacccaaaaatttcctatatccaacgctaccgaaaccgcctaaaataaaacgaattaacgtcaaaaactaaaataaaataacgatatcaacttaaaaacgcgaaaaccgataaaaaaaaaaacaaaaataaacctaaaaccactaaaaacgtttcccgaaactctaaaaaataaaaaacaaccgaaacgaaaaaataaaacgaaacgaaaaaaaacgaactcttctccacacgactctcgaaaacttcgcgctctaaaaataaaaaacccaacgaaaaaactccaaaaaacgaaaaataaaacgcgaaataaaacccataataatctctatcccgaacctaaaa

SEQ ID NO: 24657 - DNA, 743 bp, Artificial Sequence
  chemically treated genomic DNA (Homo sapiens) CpG-island No: 24657
attgtgcggtgttacgcgcggtttagtgggtgtcggggtcgtcggttatttcgtttgcggcgttttcgattcgcgcggtttggtatatggttggtaggggttttgttgcgacggtgatgtattttatcgcggtgatcgttagttagatttggcgcgattattcggtggattgattgttgttcgttgttggtgtaaagtttgatagggttgtttttgggcgttggtatttagcggttgcgtgaacgtaattagtcgtttgtaaaaggaattggcgcgtaattagtatttggttgtacggttgttggaaatcgaagagagcgtgcgtcgtgatgtggcgcgtgagttgtatgatgatatcggttagattattattgttattcgtatttaggcgggtattgtttagcggttggcggtagagaacgttagcgtgaagtagagcgggtagtttatcgaataattatcgttgggcgtttacgacgcggtgcgtcgtttgttgggtcggttacgttcgcgttagttggatgattttattttggagtaggttattcgtttattgatgcgggaaatggagttggaagggcgcggtattgttagttatttcgaatggcgaatcgatgaattagcgttaagcgaaaattagcgcgtgacgttgtttcgtgtttgttaggaagggttgaataatattgtgaaatatgttgatgttagcgcggttattttgtaaggttggtagtaggatgaacggt

SEQ ID NO: 24658 - DNA, 743 bp, Artificial Sequence
  chemically treated genomic DNA (Homo sapiens) CpG-island No: 24658
accgttcatcctactaccaaccttacaaaataaccgcgctaacatcaacatatttcacaatattattcaacccttcctaacaaacacgaaacaacgtcacgcgctaattttcgcttaacgctaattcatcgattcgccattcgaaataactaacaataccgcgcccttccaactccatttcccgcatcaataaacgaataacctactccaaaataaaatcatccaactaacgcgaacgtaaccgacccaacaaacgacgcaccgcgtcgtaaacgcccaacgataattattcgataaactacccgctctacttcacgctaacgttctctaccgccaaccgctaaacaatacccgcctaaatacgaataacaataataatctaaccgatatcatcatacaactcacgcgccacatcacgacgcacgctctcttcgatttccaacaaccgtacaaccaaatactaattacgcgccaattccttttacaaacgactaattacgttcacgcaaccgctaaataccaacgcccaaaaacaaccctatcaaactttacaccaacaacgaacaacaatcaatccaccgaataatcgcgccaaatctaactaacgatcaccgcgataaaatacatcaccgtcgcaacaaaacccctaccaaccatataccaaaccgcgcgaatcgaaaacgccgcaaacgaaataaccgacgaccccgacacccactaaaccgcgcgtaacaccgcacaat

SEQ ID NO: 24659 - DNA, 743 bp, Artificial Sequence
  chemically treated genomic DNA (Homo sapiens) CpG-island No: 24659
atcgtttattttgttgttagttttgtagggtgatcgcgttggtattagtatgttttataatgttgtttagttttttttggtagatacgaaatagcgttacgcgttggttttcgtttaacgttgatttatcgattcgttattcgagatggttgataatatcgcgtttttttagttttatttttcgtattagtgagcggatggtttgttttagggtgagattatttaattggcgcggacgtaatcgatttaataaacggcgtatcgcgtcgtaaacgtttagcgatagttgttcgatgagttgttcgttttgttttacgttggcgttttttgtcgttagtcgttgaataatgttcgtttgagtacgaatagtagtgatggtttgatcgatattattatgtagtttacgcgttatattacggcgtacgtttttttcggtttttagtaatcgtatagttagatgttgattgcgcgttagttttttttgtaagcgattggttacgtttacgtaatcgttggatgttagcgtttagaaataattttgttagattttgtattagtagcgagtagtaattaatttatcggatgatcgcgttaggtttgattggcgattatcgcgatggagtatattatcgtcgtaatagggtttttgttaattatgtgttaggtcgcgcgaatcgggagcgtcgtagacggggtaatcgacggtttcggtatttattgagtcgcgcgtgatatcgtatagt

SEQ ID NO: 24660 - DNA, 743 bp, Artificial Sequence
  chemically treated genomic DNA (Homo sapiens) CpG-island No: 24660
actatacgatatcacgcgcgactcaataaataccgaaaccgtcgattaccccgtctacgacgctcccgattcgcgcgacctaacacataattaacaaaaaccctattacgacgataatatactccatcgcgataatcgccaatcaaacctaacgcgatcatccgataaattaattactactcgctactaatacaaaatctaacaaaattatttctaaacgctaacatccaacgattacgtaaacgtaaccaatcgcttacaaaaaaaactaacgcgcaatcaacatctaactatacgattactaaaaaccgaaaaaaacgtacgccgtaatataacgcgtaaactacataataatatcgatcaaaccatcactactattcgtactcaaacgaacattattcaacgactaacgacaaaaaacgccaacgtaaaacaaaacgaacaactcatcgaacaactatcgctaaacgtttacgacgcgatacgccgtttattaaatcgattacgtccgcgccaattaaataatctcaccctaaaacaaaccatccgctcactaatacgaaaaataaaactaaaaaaacgcgatattatcaaccatctcgaataacgaatcgataaatcaacgttaaacgaaaaccaacgcgtaacgctatttcgtatctaccaaaaaaaactaaacaacattataaaacatactaataccaacgcgatcaccctacaaaactaacaacaaaataaacgat

SEQ ID NO: 24661 - DNA, 1166 bp, Artificial Sequence
  chemically treated genomic DNA (Homo sapiens) CpG-island No: 24661
  misc_feature (51)..(51): n is either a, c, g or t
gatgtgcgaatggcggagatggacggtatcgttacgttgtaaagagattanaacgcgttaaattcgggtaatttcggtgttgattatgattgcgtattttagcgtcgagacggcggtagaggtattgaaaattggggcgttggattattttattaagtcgttggatttcgataatttataggcgacgttggaaaaagcgttcgcgtatacgtatagtattgatgttgaaatatttgcggtgattgttagttagttcggtatggtcggtaaaagttcggcgatgtaatatttgtttagtgaaatcgttttcgtcgcgttatcggaagttacggtattgatttacggcgatttcggtatcggtaaagagttggtcgttagggcgatttacgttagtagcgtacgtagcgaaaaatcgttggtaacgtttaattgtgcggtatttaacgaatttttgttggaatttgaattgttcggttacgaaaaaggggcgtttattggagtcgataaacgtcgggaagggcgttttgttgaggcggacggcggtacgttgtttttcgatgaaattcgtcgatattttttcgatgatttaggtgcgttttttgcgtgcgatttaggagcgcgaagtttagcgtgtcggtagtaattagattatttcggttgatgttcgtttgattgcggcgatttatcgcgattttgtcgtagaggtgaatgtcgggcgttttcgttaggatttttattatcgtttgaatgtggtggcgattgaagtattatcgttgcggtaacggcgggaagatatttttttgttggttggttattttttgtagcgttttgtcgagcgtaatcgtaaggcggtaaaaggttttacgttttaggcgatggatttgttgatttattacgattggtcgggaaatattcgtgagttggaaaacgcggtggaacgggtagtggtgttgttgatcggggaatatattttcgaacgcgagttgtcgttggcgattgttagtacgtcgatttcgttgggataaagttaggatatttagtcgttggtggaagtggaaaaagaggtgattttggcggcgttggagaaaacgggcggtaataaaatcgaagtcgttcgttagttagggattacgcgtaaaacgttattggtaaaattgtcgcgttag

SEQ ID NO: 24662 - DNA, 1166 bp, Artificial Sequence
  chemically treated genomic DNA (Homo sapiens) CpG-island No: 24662
  misc_feature (1116)..(1116): n is either a, c, g or t
ctaacgcgacaattttaccaataacgttttacgcgtaatccctaactaacgaacgacttcgattttattaccgcccgttttctccaacgccgccaaaatcacctctttttccacttccaccaacgactaaatatcctaactttatcccaacgaaatcgacgtactaacaatcgccaacgacaactcgcgttcgaaaatatattccccgatcaacaacaccactacccgttccaccgcgttttccaactcacgaatatttcccgaccaatcgtaataaatcaacaaatccatcgcctaaaacgtaaaaccttttaccgccttacgattacgctcgacaaaacgctacaaaaaataaccaaccaacaaaaaaatatcttcccgccgttaccgcaacgataatacttcaatcgccaccacattcaaacgataataaaaatcctaacgaaaacgcccgacattcacctctacgacaaaatcgcgataaatcgccgcaatcaaacgaacatcaaccgaaataatctaattactaccgacacgctaaacttcgcgctcctaaatcgcacgcaaaaaacgcacctaaatcatcgaaaaaatatcgacgaatttcatcgaaaaacaacgtaccgccgtccgcctcaacaaaacgcccttcccgacgtttatcgactccaataaacgcccctttttcgtaaccgaacaattcaaattccaacaaaaattcgttaaataccgcacaattaaacgttaccaacgatttttcgctacgtacgctactaacgtaaatcgccctaacgaccaactctttaccgataccgaaatcgccgtaaatcaataccgtaacttccgataacgcgacgaaaacgatttcactaaacaaatattacatcgccgaacttttaccgaccataccgaactaactaacaatcaccgcaaatatttcaacatcaatactatacgtatacgcgaacgctttttccaacgtcgcctataaattatcgaaatccaacgacttaataaaataatccaacgccccaattttcaatacctctaccgccgtctcgacgctaaaatacgcaatcataatcaacaccgaaattacccgaatttaacgcgttntaatctctttacaacgtaacgataccgtccatctccgccattcgcacatc

SEQ ID NO: 24663 - DNA, 1166 bp, Artificial Sequence
  chemically treated genomic DNA (Homo sapiens) CpG-island No: 24663
  misc_feature (1116)..(1116): n is either a, c, g or t
ttaacgcgatagttttgttaatagcgttttgcgcgtgatttttaattgacgggcggtttcggttttgttgtcgttcgttttttttagcgtcgttagaattatttttttttttatttttattaacggttgaatattttgattttgttttagcgggatcggcgtattggtaatcgttagcggtagttcgcgttcggaaatatatttttcggttagtagtattattgttcgttttatcgcgttttttagtttacgaatatttttcggttagtcgtaatgaattaatagatttatcgtttggggcgtaaaattttttatcgttttgcgattacgttcggtaaagcgttgtagaaaatggttagttagtagagggatattttttcgtcgttgtcgtagcgatggtattttaatcgttattatatttaggcgatagtagagattttggcgaaaacgttcggtatttatttttgcggtaagatcgcgatgggtcgtcgtaattaggcggatattaatcgagataatttggttgttatcgatacgttgaatttcgcgtttttgaatcgtacgtaggagacgtatttggattatcggagagatatcggcgaattttatcgagaaatagcgtgtcgtcgttcgttttaataaagcgtttttttcggcgtttatcggttttagtaaacgtttttttttcgtgatcgaataatttagattttagtaaggattcgttgagtgtcgtatagttgagcgttattagcggtttttcgttacgtgcgttattggcgtgaatcgttttggcgattagttttttatcggtgtcggaatcgtcgtggattagtatcgtggttttcgatggcgcgacgagggcgattttattgagtaggtgttgtatcgtcgggtttttatcgattatatcgaattggttggtagttatcgtaggtgttttagtattaatattgtgcgtatgcgcgagcgttttttttagcgtcgtttgtaggttatcgaaatttagcggtttgatgagataatttagcgttttagtttttagtgtttttatcgtcgtttcgacgttggagtacgtagttataattagtatcggaattgttcgggtttaacgcgttntgatttttttgtagcgtggcgatgtcgtttattttcgttattcgtatatt

SEQ ID NO: 24664 - DNA, 1166 bp, Artificial Sequence
  chemically treated genomic DNA (Homo sapiens) CpG-island No: 24664
  misc_feature (51)..(51): n is either a, c, g or t
aatatacgaataacgaaaataaacgacatcgccacgctacaaaaaaatcanaacgcgttaaacccgaacaattccgatactaattataactacgtactccaacgtcgaaacgacgataaaaacactaaaaactaaaacgctaaattatctcatcaaaccgctaaatttcgataacctacaaacgacgctaaaaaaaacgctcgcgcatacgcacaatattaatactaaaacacctacgataactaccaaccaattcgatataatcgataaaaacccgacgatacaacacctactcaataaaatcgccctcgtcgcgccatcgaaaaccacgatactaatccacgacgattccgacaccgataaaaaactaatcgccaaaacgattcacgccaataacgcacgtaacgaaaaaccgctaataacgctcaactatacgacactcaacgaatccttactaaaatctaaattattcgatcacgaaaaaaaaacgtttactaaaaccgataaacgccgaaaaaaacgctttattaaaacgaacgacgacacgctatttctcgataaaattcgccgatatctctccgataatccaaatacgtctcctacgtacgattcaaaaacgcgaaattcaacgtatcgataacaaccaaattatctcgattaatatccgcctaattacgacgacccatcgcgatcttaccgcaaaaataaataccgaacgttttcgccaaaatctctactatcgcctaaatataataacgattaaaataccatcgctacgacaacgacgaaaaaatatccctctactaactaaccattttctacaacgctttaccgaacgtaatcgcaaaacgataaaaaattttacgccccaaacgataaatctattaattcattacgactaaccgaaaaatattcgtaaactaaaaaacgcgataaaacgaacaataatactactaaccgaaaaatatatttccgaacgcgaactaccgctaacgattaccaatacgccgatcccgctaaaacaaaatcaaaatattcaaccgttaataaaaataaaaaaaaaaataattctaacgacgctaaaaaaaacgaacgacaacaaaaccgaaaccgcccgtcaattaaaaatcacgcgcaaaacgctattaacaaaactatcgcgttaa

SEQ ID NO: 24665 - DNA, 1150 bp, Artificial Sequence
  chemically treated genomic DNA (Homo sapiens) CpG-island No: 24665
tcgtgtattcggtttgttatttttacgttttcgggtatattatttgtatttatttattattgcgtagtatggcgggttgtcggacgtgtatttgtcggtgattaattttttatttatttggaaagtgtcggaagcgaatttgattcgttatttcgagtaggtggtcgatagcgttacgttgtcggtgatgttttataatttttcggcgttgatcgggtaggatttgatttcggcgttggtgaaaattttcgtcgattcgcgtagtaatattatcggtattaaagatattatcgatttcgtcgtttatttgcgtagtatgatttatatcgttaaaggtgtttattcgtattttatcgtgttttgcggttacgacgattatttgtttaatattttgttgttcggcggcgacggggcgatatcggcgagcggtaattttgtttcgtaggtgtcggtgaattttttgaaagtttggcgcgacggggacgtggcgaaagcggtcgggtattattagattttgttgtaaatttcgtagatgtattagttggatacgtcgtttgtgaacgtgattaaagaggcgatcgtgttttgcggtcgttttgtttttacgtacgtgttgtcgttcgtttcgtcgttggacgagtcgcgtaaggcgtagttgaaaattttgttgtaatagtttaagttttgttgagtcggacgataacgatgattattgagaaaatttttatttcgtagacgacgcgtttatgcggtgattatttacgcggaggggtcgtagggcgttttgtcgttgatttcgtagatgttgatggaattttttagcgtgtaatttgattcggtatgacgtagaacgtcgggatgggttggcgacgttaataagtttatcggtaaagagagtgttgattatcggtatttagggcggtattcgcgtcggagacggacgtttaatcgcgttgggttattatatcgggtattgggagatcggtatgtagatgtaggcggcggcgaaggagattattcgtaatggcgggattttagttcgcggttttcgttagcgattcgtgtagacggtgcgttcgtagggtacgtaacggtatgttcgattttttgtcgtatcgtaacgacgcggcgatcgtgtttcgtcgtttga

SEQ ID NO: 24666 - DNA, 1150 bp, Artificial Sequence
  chemically treated genomic DNA (Homo sapiens) CpG-island No: 24666
tcaaacgacgaaacacgatcgccgcgtcgttacgatacgacaaaaaatcgaacataccgttacgtaccctacgaacgcaccgtctacacgaatcgctaacgaaaaccgcgaactaaaatcccgccattacgaataatctccttcgccgccgcctacatctacataccgatctcccaatacccgatataataacccaacgcgattaaacgtccgtctccgacgcgaataccgccctaaataccgataatcaacactctctttaccgataaacttattaacgtcgccaacccatcccgacgttctacgtcataccgaatcaaattacacgctaaaaaattccatcaacatctacgaaatcaacgacaaaacgccctacgacccctccgcgtaaataatcaccgcataaacgcgtcgtctacgaaataaaaattttctcaataatcatcgttatcgtccgactcaacaaaacttaaactattacaacaaaattttcaactacgccttacgcgactcgtccaacgacgaaacgaacgacaacacgtacgtaaaaacaaaacgaccgcaaaacacgatcgcctctttaatcacgttcacaaacgacgtatccaactaatacatctacgaaatttacaacaaaatctaataatacccgaccgctttcgccacgtccccgtcgcgccaaactttcaaaaaattcaccgacacctacgaaacaaaattaccgctcgccgatatcgccccgtcgccgccgaacaacaaaatattaaacaaataatcgtcgtaaccgcaaaacacgataaaatacgaataaacacctttaacgatataaatcatactacgcaaataaacgacgaaatcgataatatctttaataccgataatattactacgcgaatcgacgaaaattttcaccaacgccgaaatcaaatcctacccgatcaacgccgaaaaattataaaacatcaccgacaacgtaacgctatcgaccacctactcgaaataacgaatcaaattcgcttccgacactttccaaataaataaaaaattaatcaccgacaaatacacgtccgacaacccgccatactacgcaataataaataaatacaaataatatacccgaaaacgtaaaaataacaaaccgaatacacga

SEQ ID NO: 24667 - DNA, 1150 bp, Artificial Sequence
  chemically treated genomic DNA (Homo sapiens) CpG-island No: 24667
ttaggcggcgaaatacgatcgtcgcgtcgttgcggtacggtagggaatcgaatatatcgttgcgtgttttgcgagcgtatcgtttgtacggatcgttgacgaaggtcgcgaattgggatttcgttattgcgggtgatttttttcgtcgtcgtttgtatttgtatgtcgattttttaatgttcggtgtggtagtttagcgcgattgggcgttcgttttcggcgcggatgtcgttttgagtgtcgataattagtattttttttgtcggtgagtttgttggcgtcgttagtttatttcggcgttttgcgttatgtcgaattaggttgtacgttgggagattttattagtatttgcggggttagcggtagagcgttttgcggttttttcgcgtgggtgattatcgtataaacgcgtcgtttgcggggtgaaaatttttttaatggttatcgttatcgttcggtttagtaaagtttgagttgttgtagtagggtttttagttgcgttttgcgcggttcgtttagcggcgaggcgggcggtagtacgtgcgtggagataggacgatcgtagagtacgatcgtttttttaattacgtttataaacggcgtatttagttgatatatttgcggaatttgtagtaaggtttgatgatattcggtcgttttcgttacgttttcgtcgcgttaggtttttagaagatttatcgatatttgcggggtaaagttgtcgttcgtcgatatcgtttcgtcgtcgtcgagtagtagggtattgaatagatgatcgtcgtagtcgtagagtacggtgaagtgcggatgggtatttttgacggtatggattatgttgcgtaggtgggcgacggagtcgatggtgtttttgatgtcgataatattgttgcgcgagtcggcgagggtttttattagcgtcggagttagattttgttcggttagcgtcgggaagttatagagtattatcggtagcgtgacgttgtcggttatttgttcgaaatagcggattaggttcgttttcgatattttttagatagatagagggttgattatcgatagatgtacgttcgatagttcgttatgttgcgtagtgatggatgagtataggtggtatattcgaggacgtaaggatgatagatcggatgtacga

SEQ ID NO: 24668 - DNA, 1150 bp, Artificial Sequence
  chemically treated genomic DNA (Homo sapiens) CpG-island No: 24668
tcgtacatccgatctatcatccttacgtcctcgaatataccacctatactcatccatcactacgcaacataacgaactatcgaacgtacatctatcgataatcaaccctctatctatctaaaaaatatcgaaaacgaacctaatccgctatttcgaacaaataaccgacaacgtcacgctaccgataatactctataacttcccgacgctaaccgaacaaaatctaactccgacgctaataaaaaccctcgccgactcgcgcaacaatattatcgacatcaaaaacaccatcgactccgtcgcccacctacgcaacataatccataccgtcaaaaatacccatccgcacttcaccgtactctacgactacgacgatcatctattcaataccctactactcgacgacgacgaaacgatatcgacgaacgacaactttaccccgcaaatatcgataaatcttctaaaaacctaacgcgacgaaaacgtaacgaaaacgaccgaatatcatcaaaccttactacaaattccgcaaatatatcaactaaatacgccgtttataaacgtaattaaaaaaacgatcgtactctacgatcgtcctatctccacgcacgtactaccgcccgcctcgccgctaaacgaaccgcgcaaaacgcaactaaaaaccctactacaacaactcaaactttactaaaccgaacgataacgataaccattaaaaaaattttcaccccgcaaacgacgcgtttatacgataatcacccacgcgaaaaaaccgcaaaacgctctaccgctaaccccgcaaatactaataaaatctcccaacgtacaacctaattcgacataacgcaaaacgccgaaataaactaacgacgccaacaaactcaccgacaaaaaaaatactaattatcgacactcaaaacgacatccgcgccgaaaacgaacgcccaatcgcgctaaactaccacaccgaacattaaaaaatcgacatacaaatacaaacgacgacgaaaaaaatcacccgcaataacgaaatcccaattcgcgaccttcgtcaacgatccgtacaaacgatacgctcgcaaaacacgcaacgatatattcgattccctaccgtaccgcaacgacgcgacgatcgtatttcgccgcctaa

SEQ ID NO: 24669 - DNA, 720 bp, Artificial Sequence
  chemically treated genomic DNA (Homo sapiens) CpG-island No: 24669
gtatattatacgcgtacgtattagcgtttgatgtttttacgtttaggtttcgtttttttgataatcggtaaatgtttttgcggatgttattagtattttcgtcgtttcggacggacgtagtcgagtatttattttatataaaatgtcggaagaggtacgcgtattgaatagatgtataatgcgttgcgttagacgtagattaaattgtcgttcgtcgatttttcgtttatcgttagttatcgtatttattgggtaattatggaggaagataaggttaagatcggaattgtagtttaatttttagtcgtttagtttgtcgtagtcgattatcgtaaaattacgtttttcgcgttcgtttaggtgattcggtttatcgtagcgggtaattatttgaatttacgtttgttgaacgacggtatttattatggttttcgttagttaggttaagtgatcgtttatttttattatcggtagcgtatcggcgatattcgttgcggcgatgcgtaatagttgcgtttgtttgaattgacgtagcgttttaagttgttgtttttcgttatttttcggtacgcgtagtaaatattggcgtaatttatcgcggtaggtatcggtcgtcgtcggttggtaaagggtgtttggatcgagtaatttatttagtaataatggataacgcgttagttggttggtaattatcggcgacgcggtatatagagaaattaa

SEQ ID NO: 24670 - DNA, 720 bp, Artificial Sequence
  chemically treated genomic DNA (Homo sapiens) CpG-island No: 24670
ttaatttctctatataccgcgtcgccgataattaccaaccaactaacgcgttatccattattactaaataaattactcgatccaaacaccctttaccaaccgacgacgaccgatacctaccgcgataaattacgccaatatttactacgcgtaccgaaaaataacgaaaaacaacaacttaaaacgctacgtcaattcaaacaaacgcaactattacgcatcgccgcaacgaatatcgccgatacgctaccgataataaaaataaacgatcacttaacctaactaacgaaaaccataataaataccgtcgttcaacaaacgtaaattcaaataattacccgctacgataaaccgaatcacctaaacgaacgcgaaaaacgtaattttacgataatcgactacgacaaactaaacgactaaaaattaaactacaattccgatcttaaccttatcttcctccataattacccaataaatacgataactaacgataaacgaaaaatcgacgaacgacaatttaatctacgtctaacgcaacgcattatacatctattcaatacgcgtacctcttccgacattttatataaaataaatactcgactacgtccgtccgaaacgacgaaaatactaataacatccgcaaaaacatttaccgattatcaaaaaaacgaaacctaaacgtaaaaacatcaaacgctaatacgtacgcgtataatatac

SEQ ID NO: 24671 - DNA, 720 bp, Artificial Sequence
  chemically treated genomic DNA (Homo sapiens) CpG-island No: 24671
ttgatttttttgtgtgtcgcgtcgtcgatgattgttagttagttggcgcgttatttattattgttggatgaattgttcgatttaaatattttttattagtcgacggcgatcgatgtttatcgcgatgagttgcgttagtatttgttgcgcgtgtcggaagatgacgaagagtaatagtttgaggcgttgcgttagtttaaataggcgtagttgttacgtatcgtcgtagcggatatcgtcggtacgttatcggtgatgaaagtgagcgattatttaatttggttggcggaagttatgatagatgtcgtcgtttagtaggcgtgggtttaaatggttgttcgttacggtaagtcgaattatttgaacgaacgcgaagggcgtggttttgcggtggtcggttacggtaagttgggcggttgggagttaggttatagtttcgattttgattttatttttttttatgattgtttaatggatgcgatgattgacggtgagcgggaaatcgacgggcggtagtttagtttgcgtttggcgtaacgtattatgtatttgtttagtacgcgtatttttttcggtattttgtatgaagtggatgttcgattgcgttcgttcggggcggcgggaatgttggtgatattcgtagaagtatttgtcgattattagaaaaacgaggtttggacgtgggaatattaggcgttggtgcgtgcgcgtgtagtgtat

SEQ ID NO: 24672 - DNA, 720 bp, Artificial Sequence
  chemically treated genomic DNA (Homo sapiens) CpG-island No: 24672
atacactacacgcgcacgcaccaacgcctaatattcccacgtccaaacctcgtttttctaataatcgacaaatacttctacgaatatcaccaacattcccgccgccccgaacgaacgcaatcgaacatccacttcatacaaaataccgaaaaaaatacgcgtactaaacaaatacataatacgttacgccaaacgcaaactaaactaccgcccgtcgatttcccgctcaccgtcaatcatcgcatccattaaacaatcataaaaaaaaataaaatcaaaatcgaaactataacctaactcccaaccgcccaacttaccgtaaccgaccaccgcaaaaccacgcccttcgcgttcgttcaaataattcgacttaccgtaacgaacaaccatttaaacccacgcctactaaacgacgacatctatcataacttccgccaaccaaattaaataatcgctcactttcatcaccgataacgtaccgacgatatccgctacgacgatacgtaacaactacgcctatttaaactaacgcaacgcctcaaactattactcttcgtcatcttccgacacgcgcaacaaatactaacgcaactcatcgcgataaacatcgatcgccgtcgactaataaaaaatatttaaatcgaacaattcatccaacaataataaataacgcgccaactaactaacaatcatcgacgacgcgacacacaaaaaaatcaa

SEQ ID NO: 24673 - DNA, 689 bp, Artificial Sequence
  chemically treated genomic DNA (Homo sapiens) CpG-island No: 24673
tttattcggatatttaggcgtattagttatagttttagcgtcgtttaggtgtcggtggtgtcgttttacggtgagtcgttatttatggttattcggttcggtaggtcgtaacgtttaaatacgttgattagttgttgttgtacggtttcgcgtcgtttatcggtatagtgcgttaggtatagggaaaaacgggagtggtcgtttagtagggtgagcggatggtagcgtttatcgttaaaaggaaagtggtttttaaaatttatttgttagaggcggttcggcgcgtcgtgttcgaatcggttcgtggcgggaatgttcggtgaagcgttcggtagtaggttatggcgggttattaggttatggacggtgttgaaggcgggtatggtgtgtttttggttttcgagttagcgtttaattttgcgggttttttagcgtttatgacggttatgggttatacgtagtagggtcgtgatgtcgttagatgagcggttcggggatgtcggatgcgcggcgttttgaagatcgcggtatttttttgagtttagcgttggagttatttgtagtcggtggtaggtgaatgtcgaagcgacgtagagggacggatgttcgttttttgcgagcgataaataatttagtacgtatgatatggtatttttcgtatttaggtataacgattttataacggtttt

SEQ ID NO: 24674 - DNA, 689 bp, Artificial Sequence
  chemically treated genomic DNA (Homo sapiens) CpG-island No: 24674
aaaaccgttataaaatcgttatacctaaatacgaaaaataccatatcatacgtactaaattatttatcgctcgcaaaaaacgaacatccgtccctctacgtcgcttcgacattcacctaccaccgactacaaataactccaacgctaaactcaaaaaaataccgcgatcttcaaaacgccgcgcatccgacatccccgaaccgctcatctaacgacatcacgaccctactacgtataacccataaccgtcataaacgctaaaaaacccgcaaaattaaacgctaactcgaaaaccaaaaacacaccatacccgccttcaacaccgtccataacctaataacccgccataacctactaccgaacgcttcaccgaacattcccgccacgaaccgattcgaacacgacgcgccgaaccgcctctaacaaataaattttaaaaaccactttccttttaacgataaacgctaccatccgctcaccctactaaacgaccactcccgtttttccctatacctaacgcactataccgataaacgacgcgaaaccgtacaacaacaactaatcaacgtatttaaacgttacgacctaccgaaccgaataaccataaataacgactcaccgtaaaacgacaccaccgacacctaaacgacgctaaaactataactaatacgcctaaatatccgaataaa

SEQ ID NO: 24675 - DNA, 689 bp, Artificial Sequence
  chemically treated genomic DNA (Homo sapiens) CpG-island No: 24675
aaaatcgttatggagtcgttatgtttggatgcgagagatattatgttatacgtattgagttgtttgtcgttcgtagagggcgaatattcgtttttttgcgtcgtttcggtatttatttgttatcggttataagtggttttagcgttgggtttaggaaggtgtcgcggtttttaggacgtcgcgtattcgatattttcgaatcgtttatttgacgatattacggttttgttgcgtatggtttatgatcgttatgaacgttggggagttcgtaagattaagcgttggttcgaggattaggggtatattatgttcgtttttagtatcgtttataatttgatggttcgttatggtttgttgtcgggcgttttatcgggtattttcgttacgggtcggttcgaatacgacgcgtcgaatcgtttttggtagatggattttaagggttattttttttttggcggtggacgttgttattcgtttattttgttggacgattattttcgtttttttttgtgtttggcgtattgtatcgatgaacggcgcgagatcgtgtagtagtagttggttagcgtgtttgagcgttacggtttgtcggatcggatgattatggataacggtttatcgtggggcgatattatcggtatttggacggcgttggagttgtggttgatgcgtttgggtattcgggtggg

SEQ ID NO: 24676 - DNA, 689 bp, Artificial Sequence
  chemically treated genomic DNA (Homo sapiens) CpG-island No: 24676
cccacccgaatacccaaacgcatcaaccacaactccaacgccgtccaaataccgataatatcgccccacgataaaccgttatccataatcatccgatccgacaaaccgtaacgctcaaacacgctaaccaactactactacacgatctcgcgccgttcatcgatacaatacgccaaacacaaaaaaaaacgaaaataatcgtccaacaaaataaacgaataacaacgtccaccgccaaaaaaaaaataacccttaaaatccatctaccaaaaacgattcgacgcgtcgtattcgaaccgacccgtaacgaaaatacccgataaaacgcccgacaacaaaccataacgaaccatcaaattataaacgatactaaaaacgaacataatatacccctaatcctcgaaccaacgcttaatcttacgaactccccaacgttcataacgatcataaaccatacgcaacaaaaccgtaatatcgtcaaataaacgattcgaaaatatcgaatacgcgacgtcctaaaaaccgcgacaccttcctaaacccaacgctaaaaccacttataaccgataacaaataaataccgaaacgacgcaaaaaaacgaatattcgccctctacgaacgacaaacaactcaatacgtataacataatatctctcgcatccaaacataacgactccataacgatttt

SEQ ID NO: 24677 - DNA, 759 bp, Artificial Sequence
  chemically treated genomic DNA (Homo sapiens) CpG-island No: 24677
  misc_feature (697)..(697): n is either a, c, g or t
tataatgtttgatgcgacgtttgtcgcgttttattatgtttataagtttgtgtcgaatcgtaggtcggataaggcgtttacgtcgtattcggtagtcggcgtataatgtttgatgcgacgtttgtcgcgttttattatgtttataggtttgtgtcgaatcgtaggtcggataaggcgttcgcgtcgtattcggtagttggcgtataatgtttgatgcgacgtttgacgcgttttattaggtttataagtttgtgtcgaatcgtaggtcgtattcggtatgttataaatagagcgtcggaaatattaatcggtttatttcgcgtatttttaacgtattagttaacggtttaacgtttttcggcgtggcgttcgtttagttttgcgtttcgttatatacgtcgtgggtatgaaacgcgtttaggcgtatcggaatatcgtcgagttttttgataaacgtcgttagtttttcgatgtgttgtaaataatttatttggttagggattattagtaaacgtagtttcgttagtttggcgcgttttggtagtaaatagatgttgcgtttaatttgttgattatcgcgttcggtgagttgttgatgatattcgttttttacgttttgagatcgagtattgcgtcgtcgtatatcggggggttattttttttcgtcggttttttttaatatgtcggtttttggttntttaatcgggggaatggcgttatatattttatagttgggaaatagatgtttagatgtatggg

SEQ ID NO: 24678 - DNA, 759 bp, Artificial Sequence
  chemically treated genomic DNA (Homo sapiens) CpG-island No: 24678
  misc_feature (63)..(63): n is either a, c, g or t
cccatacatctaaacatctatttcccaactataaaatatataacgccattcccccgattaaanaaccaaaaaccgacatattaaaaaaaaccgacgaaaaaaaataaccccccgatatacgacgacgcaatactcgatctcaaaacgtaaaaaacgaatatcatcaacaactcaccgaacgcgataatcaacaaattaaacgcaacatctatttactaccaaaacgcgccaaactaacgaaactacgtttactaataatccctaaccaaataaattatttacaacacatcgaaaaactaacgacgtttatcaaaaaactcgacgatattccgatacgcctaaacgcgtttcatacccacgacgtatataacgaaacgcaaaactaaacgaacgccacgccgaaaaacgttaaaccgttaactaatacgttaaaaatacgcgaaataaaccgattaatatttccgacgctctatttataacataccgaatacgacctacgattcgacacaaacttataaacctaataaaacgcgtcaaacgtcgcatcaaacattatacgccaactaccgaatacgacgcgaacgccttatccgacctacgattcgacacaaacctataaacataataaaacgcgacaaacgtcgcatcaaacattatacgccgactaccgaatacgacgtaaacgccttatccgacctacgattcgacacaaacttataaacataataaaacgcgacaaacgtcgcatcaaacattata

SEQ ID NO: 24679 - DNA, 759 bp, Artificial Sequence
  chemically treated genomic DNA (Homo sapiens) CpG-island No: 24679
  misc_feature (63)..(63): n is either a, c, g or t
tttatatatttaaatatttgttttttaattatggagtgtgtagcgttattttttcggttgggnggttaagaatcggtatgttgaagggaatcggcgggggaaaatggtttttcggtgtgcgacggcgtaatgttcgattttaaagcgtggggagcgaatgttattaataatttatcggacgcgataattagtagattaagcgtagtatttatttgttgttagagcgcgttaagttggcggaattgcgtttgttggtgatttttggttaggtggattatttgtaatatatcgaagaattggcggcgtttattaagggattcggcgatgtttcggtacgtttgaacgcgttttatgtttacggcgtgtatggcgaggcgtaaagttgggcgagcgttacgtcggaagacgttgagtcgttggttgatgcgttaaaggtgcgcggggtgagtcggttgatattttcggcgttttatttgtgatatgtcggatacggtttacggttcggtatagatttgtaggtttgataagacgcgttaagcgtcgtattaggtattgtgcgttaattgtcggatgcggcgcgaacgttttattcggtttacggttcggtataaatttgtaggtatgataagacgcgataagcgtcgtattaggtattatgcgtcgattgtcggatgcggcgtgaacgttttattcggtttacggttcggtatagatttgtaggtatgataagacgcgataagcgtcgtattaggtattgtg

SEQ ID NO: 24680 - DNA, 759 bp, Artificial Sequence
  chemically treated genomic DNA (Homo sapiens) CpG-island No: 24680
  misc_feature (697)..(697): n is either a, c, g or t
cacaatacctaatacgacgcttatcgcgtcttatcatacctacaaatctataccgaaccgtaaaccgaataaaacgttcacgccgcatccgacaatcgacgcataatacctaatacgacgcttatcgcgtcttatcatacctacaaatttataccgaaccgtaaaccgaataaaacgttcgcgccgcatccgacaattaacgcacaatacctaatacgacgcttaacgcgtcttatcaaacctacaaatctataccgaaccgtaaaccgtatccgacatatcacaaataaaacgccgaaaatatcaaccgactcaccccgcgcacctttaacgcatcaaccaacgactcaacgtcttccgacgtaacgctcgcccaactttacgcctcgccatacacgccgtaaacataaaacgcgttcaaacgtaccgaaacatcgccgaatcccttaataaacgccgccaattcttcgatatattacaaataatccacctaaccaaaaatcaccaacaaacgcaattccgccaacttaacgcgctctaacaacaaataaatactacgcttaatctactaattatcgcgtccgataaattattaataacattcgctccccacgctttaaaatcgaacattacgccgtcgcacaccgaaaaaccattttcccccgccgattcccttcaacataccgattcttaaccncccaaccgaaaaaataacgctacacactccataattaaaaaacaaatatttaaatatataaa

SEQ ID NO: 24681 - DNA, 751 bp, Artificial Sequence
  chemically treated genomic DNA (Homo sapiens) CpG-island No: 24681
  misc_feature (440)..(440): n is either a, c, g or t
  misc_feature (451)..(451): n is either a, c, g or t
  misc_feature (467)..(467): n is either a, c, g or t
  misc_feature (665)..(665): n is either a, c, g or t
  misc_feature (701)..(701): n is either a, c, g or t
attgcgttatagtttttcgggagacgtgggttttcggatttttttagtgtcggatttcgggtcgtaggtagtttcgcggtagtaggttataggtgaatagatggcgggtttgggttttttattggggttgcgtttttggcgattaggaggggcgttttcggcgaggttcgatttcggggttttttaagttattttttttttttcgtattttttaattttttatttcggtttcggttcggttgggtcgtatttttgtttttttggtttcgttttttggggtttcgtaatggggttttttttcgggaatgttttgtagttttcgtacgggttttttttcgtttcgtgggattagtttagttcgagttttcgtcgggtttggtttttaagcgttttattttttcgttatatcgtttcggttatatcgcgattagtgtgatttnatgggattttnttaaagtcgtatacgnttcgtgagtagcgggttgcgtgttgaagttaggtcgagttttgtcgtattttaggacggttcgtttttgtattattagtgaaaggagaaggtagtagcggacggttgagttggtggaggtggcgggttatagtggtataacgggtaagaagggcgatatgcgggagcgttgattttttcgtgggcgttcggcgtgtanagttgttttattttttgtggtatttggtggggatgngcgattgtggttttggagagttttcgggtcgtttgttttggttgcgattg

SEQ ID NO: 24682 - DNA, 751 bp, Artificial Sequence
  chemically treated genomic DNA (Homo sapiens) CpG-island No: 24682
  misc_feature (51)..(51): n is either a, c, g or t
  misc_feature (87)..(87): n is either a, c, g or t
  misc_feature (285)..(285): n is either a, c, g or t
  misc_feature (301)..(301): n is either a, c, g or t
  misc_feature (312)..(312): n is either a, c, g or t
caatcgcaaccaaaacaaacgacccgaaaactctccaaaaccacaatcgcncatccccaccaaataccacaaaaaataaaacaactntacacgccgaacgcccacgaaaaaatcaacgctcccgcatatcgcccttcttacccgttataccactataacccgccacctccaccaactcaaccgtccgctactaccttctcctttcactaataatacaaaaacgaaccgtcctaaaatacgacaaaactcgacctaacttcaacacgcaacccgctactcacgaancgtatacgactttaanaaaatcccatnaaatcacactaatcgcgatataaccgaaacgatataacgaaaaaataaaacgcttaaaaaccaaacccgacgaaaactcgaactaaactaatcccacgaaacgaaaaaaaacccgtacgaaaactacaaaacattcccgaaaaaaaaccccattacgaaaccccaaaaaacgaaaccaaaaaaacaaaaatacgacccaaccgaaccgaaaccgaaataaaaaattaaaaaatacgaaaaaaaaaaaataacttaaaaaaccccgaaatcgaacctcgccgaaaacgcccctcctaatcgccaaaaacgcaaccccaataaaaaacccaaacccgccatctattcacctataacctactaccgcgaaactacctacgacccgaaatccgacactaaaaaaatccgaaaacccacgtctcccgaaaaactataacgcaat

SEQ ID NO: 24683 - DNA, 751 bp, Artificial Sequence
  chemically treated genomic DNA (Homo sapiens) CpG-island No: 24683
  misc_feature (51)..(51): n is either a, c, g or t
  misc_feature (87)..(87): n is either a, c, g or t
  misc_feature (285)..(285): n is either a, c, g or t
  misc_feature (301)..(301): n is either a, c, g or t
  misc_feature (312)..(312): n is either a, c, g or t
taatcgtagttaagataggcgattcggagattttttaaggttataatcgtntatttttattaggtgttataaggggtaaggtaattntatacgtcgggcgtttacgaaggaattagcgttttcgtatgtcgttttttttgttcgttgtgttattgtggttcgttatttttattagtttagtcgttcgttattgttttttttttttattaatagtataagaacgggtcgttttaggatacgataaggttcggtttgattttagtacgtagttcgttatttacgggncgtatacgattttaangaggttttatnggattatattagtcgcgatatggtcggggcgatgtggcgggaagatagagcgtttgagggttaagttcggcgggggttcgggttgggttggttttacgaagcggagggaagttcgtacgggagttgtagggtattttcggagagaagttttattacgagattttagagagcggagttagggaggtaagagtgcgatttagtcgagtcgaagtcgggatgaagggttaagaggtgcggggagaggggagtggtttgaggggtttcgagatcgggtttcgtcggaagcgttttttttgatcgttaggaacgtagttttaatggagggtttaggttcgttatttgtttatttgtgatttgttgtcgcgggattgtttgcggttcggagttcggtattaaaaaggttcgagggtttacgtttttcgagaggttgtggcgtagt

SEQ ID NO: 24684 - DNA, 751 bp, Artificial Sequence
  chemically treated genomic DNA (Homo sapiens) CpG-island No: 24684
  misc_feature (440)..(440): n is either a, c, g or t
  misc_feature (451)..(451): n is either a, c, g or t
  misc_feature (467)..(467): n is either a, c, g or t
  misc_feature (665)..(665): n is either a, c, g or t
  misc_feature (701)..(701): n is either a, c, g or t
actacgccacaacctctcgaaaaacgtaaaccctcgaacctttttaataccgaactccgaaccgcaaacaatcccgcgacaacaaatcacaaataaacaaataacgaacctaaaccctccattaaaactacgttcctaacgatcaaaaaaaacgcttccgacgaaacccgatctcgaaacccctcaaaccactcccctctccccgcacctcttaacccttcatcccgacttcgactcgactaaatcgcactcttacctccctaactccgctctctaaaatctcgtaataaaacttctctccgaaaataccctacaactcccgtacgaacttccctccgcttcgtaaaaccaacccaacccgaacccccgccgaacttaaccctcaaacgctctatcttcccgccacatcgccccgaccatatcgcgactaatataatccnataaaacctcnttaaaatcgtatacgncccgtaaataacgaactacgtactaaaatcaaaccgaaccttatcgtatcctaaaacgacccgttcttatactattaataaaaaaaaaaaacaataacgaacgactaaactaataaaaataacgaaccacaataacacaacgaacaaaaaaaacgacatacgaaaacgctaattccttcgtaaacgcccgacgtatanaattaccttaccccttataacacctaataaaaatanacgattataaccttaaaaaatctccgaatcgcctatcttaactacgatta

SEQ ID NO: 24685 - DNA, 1187 bp, Artificial Sequence
  chemically treated genomic DNA (Homo sapiens) CpG-island No: 24685
ggggacggcgacgatataggttttcgtagaggggttttagtttaggggacggcgacgatataggttttcgtagaggggttttagttgacgggacggcgtcgatataggttttcgtagaggggtttagtttaggggacggcgacgatataggttttcgtagaggggtttagtttaggggacggcgacgatataggttttcgtagaggggtttagtttaggggacggcgacgatataggttttcgtagaggggtttagtttaggggacggcgtcgatataggttttcgtagaggggtttagttgacgggacggcgtcgatataggttttcgtagaggggtttagttgacgggacggcgtcgatataggttttcgtagaggggtttagttgacgggacggcgtcgatataggtttttcgtagaggggcgcggtttaggggacggcgacgatataggttttcgtagaggggttcggttgacgggacggcgacgatataggttttcgtagaggggtttagtttaggggacggcgacgatataggtttttcgtagaggggttcggttgacgggacggcgacgatataggttttcgtagaggggcgcggttgacgggacggcgacgatataggttttcgtagaggggtttagttgaggggacggcgtcgatataggtttttcgtagaggggcgcggtttaggggacggcgacgatataggttttcgtagaggggttcggttgacgggacggcgacgatataggttttcgtagaggggtttagtttaggggacggcgacgatataggtttttcgtagaggggttcggttgacgggacggcgacgatataggttttcgtagaggggcgcggttgacgggacggcgtcgatataggttttcgtagaggggtttagtttaggggacggcgacgatataggttttcgtagaggggtttagtttaggggacggcgacgatataggttttcgtagaggggtttagtttaggggacggcgacgatataggttttcgtagaggggtttagtttaggggacggcgacgatataggttttcgtagaggggcgcggttgaggggacggcgtcgatataggttttcgtaggggggtttagttgaggggacggcgtcgatataggttttcgtagaggggcgtagtcgtatttttatgtggttttagta

SEQ ID NO: 24686 - DNA, 1187 bp, Artificial Sequence
  chemically treated genomic DNA (Homo sapiens) CpG-island No: 24686
tactaaaaccacataaaaatacgactacgcccctctacgaaaacctatatcgacgccgtcccctcaactaaacccccctacgaaaacctatatcgacgccgtcccctcaaccgcgcccctctacgaaaacctatatcgtcgccgtcccctaaactaaacccctctacgaaaacctatatcgtcgccgtcccctaaactaaacccctctacgaaaacctatatcgtcgccgtcccctaaactaaacccctctacgaaaacctatatcgtcgccgtcccctaaactaaacccctctacgaaaacctatatcgacgccgtcccgtcaaccgcgcccctctacgaaaacctatatcgtcgccgtcccgtcaaccgaacccctctacgaaaaacctatatcgtcgccgtcccctaaactaaacccctctacgaaaacctatatcgtcgccgtcccgtcaaccgaacccctctacgaaaacctatatcgtcgccgtcccctaaaccgcgcccctctacgaaaaacctatatcgacgccgtcccctcaactaaacccctctacgaaaacctatatcgtcgccgtcccgtcaaccgcgcccctctacgaaaacctatatcgtcgccgtcccgtcaaccgaacccctctacgaaaaacctatatcgtcgccgtcccctaaactaaacccctctacgaaaacctatatcgtcgccgtcccgtcaaccgaacccctctacgaaaacctatatcgtcgccgtcccctaaaccgcgcccctctacgaaaaacctatatcgacgccgtcccgtcaactaaacccctctacgaaaacctatatcgacgccgtcccgtcaactaaacccctctacgaaaacctatatcgacgccgtcccgtcaactaaacccctctacgaaaacctatatcgacgccgtcccctaaactaaacccctctacgaaaacctatatcgtcgccgtcccctaaactaaacccctctacgaaaacctatatcgtcgccgtcccctaaactaaacccctctacgaaaacctatatcgtcgccgtcccctaaactaaacccctctacgaaaacctatatcgacgccgtcccgtcaactaaaacccctctacgaaaacctatatcgtcgccgtcccctaaactaaaacccctctacgaaaacctatatcgtcgccgtcccc

SEQ ID NO: 24687 - DNA, 1187 bp, Artificial Sequence
  chemically treated genomic DNA (Homo sapiens) CpG-island No: 24687
tgttggggttatatggaaatgcggttgcgtttttttgcgggggtttgtgtcggcgtcgtttttttagttgaatttttttgcgggggtttgtgtcggcgtcgtttttttagtcgcgtttttttgcgggggtttgtgtcgtcgtcgttttttgagttgaatttttttgcgggggtttgtgtcgtcgtcgttttttgagttgaatttttttgcgggggtttgtgtcgtcgtcgttttttgagttgaatttttttgcgggggtttgtgtcgtcgtcgttttttgagttgaatttttttgcgggggtttgtgtcggcgtcgtttcgttagtcgcgtttttttgcgggggtttgtgtcgtcgtcgtttcgttagtcgagtttttttgcggggagtttgtgtcgtcgtcgttttttgagttgaatttttttgcgggggtttgtgtcgtcgtcgtttcgttagtcgagtttttttgcgggggtttgtgtcgtcgtcgttttttgagtcgcgtttttttgcggggagtttgtgtcggcgtcgtttttttagttgaatttttttgcgggggtttgtgtcgtcgtcgtttcgttagtcgcgtttttttgcgggggtttgtgtcgtcgtcgtttcgttagtcgagtttttttgcggggagtttgtgtcgtcgtcgttttttgagttgaatttttttgcgggggtttgtgtcgtcgtcgtttcgttagtcgagtttttttgcgggggtttgtgtcgtcgtcgttttttgagtcgcgtttttttgcggggagtttgtgtcggcgtcgtttcgttagttgaatttttttgcgggggtttgtgtcggcgtcgtttcgttagttgaatttttttgcgggggtttgtgtcggcgtcgtttcgttagttgaatttttttgcgggggtttgtgtcggcgtcgttttttgagttgaatttttttgcgggggtttgtgtcgtcgtcgttttttgagttgaatttttttgcgggggtttgtgtcgtcgtcgttttttgagttgaatttttttgcgggggtttgtgtcgtcgtcgttttttgagttgaatttttttgcgggggtttgtgtcggcgtcgtttcgttagttgaagtttttttgcgggggtttgtgtcgtcgtcgttttttgagttgaagtttttttgcgggggtttgtgtcgtcgtcgttttt

SEQ ID NO: 24688 - DNA, 1187 bp, Artificial Sequence
  chemically treated genomic DNA (Homo sapiens) CpG-island No: 24688
aaaaacgacgacgacacaaacccccgcaaaaaaacttcaactcaaaaaacgacgacgacacaaacccccgcaaaaaaacttcaactaacgaaacgacgccgacacaaacccccgcaaaaaaattcaactcaaaaaacgacgacgacacaaacccccgcaaaaaaattcaactcaaaaaacgacgacgacacaaacccccgcaaaaaaattcaactcaaaaaacgacgacgacacaaacccccgcaaaaaaattcaactcaaaaaacgacgccgacacaaacccccgcaaaaaaattcaactaacgaaacgacgccgacacaaacccccgcaaaaaaattcaactaacgaaacgacgccgacacaaacccccgcaaaaaaattcaactaacgaaacgacgccgacacaaactccccgcaaaaaaacgcgactcaaaaaacgacgacgacacaaacccccgcaaaaaaactcgactaacgaaacgacgacgacacaaacccccgcaaaaaaattcaactcaaaaaacgacgacgacacaaactccccgcaaaaaaactcgactaacgaaacgacgacgacacaaacccccgcaaaaaaacgcgactaacgaaacgacgacgacacaaacccccgcaaaaaaattcaactaaaaaaacgacgccgacacaaactccccgcaaaaaaacgcgactcaaaaaacgacgacgacacaaacccccgcaaaaaaactcgactaacgaaacgacgacgacacaaacccccgcaaaaaaattcaactcaaaaaacgacgacgacacaaactccccgcaaaaaaactcgactaacgaaacgacgacgacacaaacccccgcaaaaaaacgcgactaacgaaacgacgccgacacaaacccccgcaaaaaaattcaactcaaaaaacgacgacgacacaaacccccgcaaaaaaattcaactcaaaaaacgacgacgacacaaacccccgcaaaaaaattcaactcaaaaaacgacgacgacacaaacccccgcaaaaaaattcaactcaaaaaacgacgacgacacaaacccccgcaaaaaaacgcgactaaaaaaacgacgccgacacaaacccccgcaaaaaaattcaactaaaaaaacgacgccgacacaaacccccgcaaaaaaacgcaaccgcatttccatataaccccaaca

SEQ ID NO: 24689 - DNA, 660 bp, Artificial Sequence
  chemically treated genomic DNA (Homo sapiens) CpG-island No: 24689
ggcgtcgtaggagagtttttgtgtttcgtagtttattttagggcgatggcgcgggggatttggtaaggttcggtaggttgcggggcgtgggggggtcgtgcgtttttttttagtatcgttttcggtcggttcgttagtgttcgtcggggtcgcgcgttttttttttcgttttcggggatagttcggtcggttacgtcgtcgaattcgttatgggttttttttcgtattcgtatgtgtattcgtaatcgttttcgtttcgttgagcgtacgaattttttcgtttttgtttttttcgtttcgttcgtttcgttcgtttcggacgtttttgttgcggtgttttagcggttcgcggataggcgatttttttcgtggacgtttttttttcggtcgtcgtttcgtttcgcgtttcgttttttcgcgtttttgggtcgagattttcggtcgtttcgtttcgttttcggttacgaaaggcgttgcggatttggcggttacgcgcgaagttagtggttttttttcgttcggggtttcgggattcgggtattaatagattcggagggatcgcgtcgtttcgggtaaattcgtttatttcgttgtttaatataattggaagtattaaaatcgaatttaatcgtgtgtagagattagtttagcgttttggga

SEQ ID NO: 24690 - DNA, 660 bp, Artificial Sequence
  chemically treated genomic DNA (Homo sapiens) CpG-island No: 24690
tcccaaaacgctaaactaatctctacacacgattaaattcgattttaatacttccaattatattaaacaacgaaataaacgaatttacccgaaacgacgcgatccctccgaatctattaatacccgaatcccgaaaccccgaacgaaaaaaaaccactaacttcgcgcgtaaccgccaaatccgcaacgcctttcgtaaccgaaaacgaaacgaaacgaccgaaaatctcgacccaaaaacgcgaaaaaacgaaacgcgaaacgaaacgacgaccgaaaaaaaaacgtccacgaaaaaaatcgcctatccgcgaaccgctaaaacaccgcaacaaaaacgtccgaaacgaacgaaacgaacgaaacgaaaaaaacaaaaacgaaaaaattcgtacgctcaacgaaacgaaaacgattacgaatacacatacgaatacgaaaaaaaacccataacgaattcgacgacgtaaccgaccgaactatccccgaaaacgaaaaaaaaaacgcgcgaccccgacgaacactaacgaaccgaccgaaaacgatactaaaaaaaaacgcacgacccccccacgccccgcaacctaccgaaccttaccaaatcccccgcgccatcgccctaaaataaactacgaaacacaaaaactctcctacgacgcc

SEQ ID NO: 24691 - DNA, 660 bp, Artificial Sequence
  chemically treated genomic DNA (Homo sapiens) CpG-island No: 24691
ttttagagcgttgggttggtttttgtatacggttggattcggttttagtgtttttagttgtgttgggtaacggggtgggcgggtttgttcggggcggcgcggttttttcgggtttgttggtgttcggatttcggagtttcgggcggggggaggttattggtttcgcgcgtgatcgttaggttcgtagcgtttttcgtggtcggagacggggcgaggcgatcggaggtttcggtttaggggcgcgggggagcggggcgcggggcggggcggcggtcgggagaggggcgtttacgggggaggtcgtttgttcgcggatcgttaagatatcgtagtagaggcgttcggggcgggcggggcgggcggggcgggagggataggagcgagagggttcgtgcgtttagcgggacggaagcggttgcggatgtatatgcggatgcggagagaggtttatggcgagttcggcggcgtggtcggtcgggttgttttcgagggcggaagggaggacgcgcgatttcgacgggtattgacgggtcggtcggggacggtgttgggagggagcgtacgatttttttacgtttcgtagtttgtcgggttttgttaggtttttcgcgttatcgttttggggtggattgcggggtatagagatttttttgcggcgtt

SEQ ID NO: 24692 - DNA, 660 bp, Artificial Sequence
  chemically treated genomic DNA (Homo sapiens) CpG-island No: 24692
aacgccgcaaaaaaatctctataccccgcaatccaccccaaaacgataacgcgaaaaacctaacaaaacccgacaaactacgaaacgtaaaaaaatcgtacgctccctcccaacaccgtccccgaccgacccgtcaatacccgtcgaaatcgcgcgtcctcccttccgccctcgaaaacaacccgaccgaccacgccgccgaactcgccataaacctctctccgcatccgcatatacatccgcaaccgcttccgtcccgctaaacgcacgaaccctctcgctcctatccctcccgccccgcccgccccgcccgccccgaacgcctctactacgatatcttaacgatccgcgaacaaacgacctcccccgtaaacgcccctctcccgaccgccgccccgccccgcgccccgctcccccgcgcccctaaaccgaaacctccgatcgcctcgccccgtctccgaccacgaaaaacgctacgaacctaacgatcacgcgcgaaaccaataacctccccccgcccgaaactccgaaatccgaacaccaacaaacccgaaaaaaccgcgccgccccgaacaaacccgcccaccccgttacccaacacaactaaaaacactaaaaccgaatccaaccgtatacaaaaaccaacccaacgctctaaaa

SEQ ID NO: 24693 - DNA, 634 bp, Artificial Sequence
  chemically treated genomic DNA (Homo sapiens) CpG-island No: 24693
cgtagtcgcgtcgtaatattttgcgttagcgtatcgttaagggaatattttagtaggtaataagggttatgcggttgttgtttaagtaacgttgttagatgcgtttcgtagattttatttaggtttgtcgtcgtttgtatggggttattggggcgcggtgattgaatgtcgataatcgattattgtggatcgagataacgcgagagtacgttgaattgttaggtaaaatcggacgtaggatggaaataaaatagcgtcgggttattatttttacgtaacggtagaatggtttcgaattttatacgtcgggtgttgttttttttagtattaataatcgttgttagtttggcgatagttgacgcgattattatttgtttcggcgttatttggcgggtaatttgtcgatttaattgcgttgttagttttattgttagtagcgaatgatcgttaagcgcgaagaaattagtatcggtattttgtacgttatattttagtaacgacgagaatgtcgcggcgataatcgttttattgttcgttttcggcgtacgttttggcgtttgtgtttttagtttaggtaacggggaagggattggaatttagttgggtcgaggggttaaagggaaagggggatatt

SEQ ID NO: 24694 - DNA, 634 bp, Artificial Sequence
  chemically treated genomic DNA (Homo sapiens) CpG-island No: 24694
aatatccccctttccctttaacccctcgacccaactaaattccaatcccttccccgttacctaaactaaaaacacaaacgccaaaacgtacgccgaaaacgaacaataaaacgattatcgccgcgacattctcgtcgttactaaaatataacgtacaaaataccgatactaatttcttcgcgcttaacgatcattcgctactaacaataaaactaacaacgcaattaaatcgacaaattacccgccaaataacgccgaaacaaataataatcgcgtcaactatcgccaaactaacaacgattattaatactaaaaaaaacaacacccgacgtataaaattcgaaaccattctaccgttacgtaaaaataataacccgacgctattttatttccatcctacgtccgattttacctaacaattcaacgtactctcgcgttatctcgatccacaataatcgattatcgacattcaatcaccgcgccccaataaccccatacaaacgacgacaaacctaaataaaatctacgaaacgcatctaacaacgttacttaaacaacaaccgcataacccttattacctactaaaatattcccttaacgatacgctaacgcaaaatattacgacgcgactacg

SEQ ID NO: 24695 - DNA, 634 bp, Artificial Sequence
  chemically treated genomic DNA (Homo sapiens) CpG-island No: 24695
aatgtttttttttttttttggtttttcggtttaattgggttttaatttttttttcgttgtttgaattgaaggtataagcgttagggcgtgcgtcgaaagcgggtagtgaaacgattatcgtcgcggtattttcgtcgttgttggggtgtgacgtgtaggatgtcgatgttgattttttcgcgtttggcggttattcgttattggtaatgaaattggtagcgtagttaagtcggtaggttgttcgttaggtgacgtcggggtaagtgatggtcgcgttaattgtcgttaaattggtaacgattattgatgttgaagaagatagtattcggcgtatgggattcgaaattattttgtcgttgcgtgaaggtaatggttcgacgttgttttgtttttattttgcgttcggttttgtttggtagtttagcgtgttttcgcgttatttcgatttataatggtcgattatcggtatttagttatcgcgttttaatggttttatgtagacggcggtaaatttggatgaagtttgcgaagcgtatttggtaacgttatttgaataataatcgtatggtttttattatttgttggggtatttttttggcggtacgttggcgtagggtattgcggcgcgattgcg

SEQ ID NO: 24696 - DNA, 634 bp, Artificial Sequence
  chemically treated genomic DNA (Homo sapiens) CpG-island No: 24696
cgcaatcgcgccgcaataccctacgccaacgtaccgccaaaaaaataccccaacaaataataaaaaccatacgattattattcaaataacgttaccaaatacgcttcgcaaacttcatccaaatttaccgccgtctacataaaaccattaaaacgcgataactaaataccgataatcgaccattataaatcgaaataacgcgaaaacacgctaaactaccaaacaaaaccgaacgcaaaataaaaacaaaacaacgtcgaaccattaccttcacgcaacgacaaaataatttcgaatcccatacgccgaatactatcttcttcaacatcaataatcgttaccaatttaacgacaattaacgcgaccatcacttaccccgacgtcacctaacgaacaacctaccgacttaactacgctaccaatttcattaccaataacgaataaccgccaaacgcgaaaaaatcaacatcgacatcctacacgtcacaccccaacaacgacgaaaataccgcgacgataatcgtttcactacccgctttcgacgcacgccctaacgcttataccttcaattcaaacaacgaaaaaaaaattaaaacccaattaaaccgaaaaaccaaaaaaaaaaaaaaacatt

SEQ ID NO: 24697 - DNA, 514 bp, Artificial Sequence
  chemically treated genomic DNA (Homo sapiens) CpG-island No: 24697
agcgtggcgtattacgttgagttaatcggagaggttgattcgttattattggttcgcgcggtggttgtcggattagcgtaagtagatacgttgcggatgcgttttacggaagataacggcgaagtttggtagtgggtcgatgatgcgttgacgttcgaattgttagaaattatcgatttacgaattaatattgattcgtacggtattgcgtaggtattaatgtaggcggatttgttataagatttgcgcgtcgatagcggtgaattattggttttttattaggtgatataggtggcggataatcggtggttttcgggttcgcggtttttttttttgttgtttaagggtttagttttcggttttttcgtcgattgttaatttttggtttggtttttgggattatttgttgttttaagtttcgcgatttgggaagtattacggggattttgtttttttttcggtagcggaatagaggcggatttgtattatagggggttcgttatcgggatatacg

SEQ ID NO: 24698 - DNA, 514 bp, Artificial Sequence
  chemically treated genomic DNA (Homo sapiens) CpG-island No: 24698
cgtatatcccgataacgaaccccctataatacaaatccgcctctattccgctaccgaaaaaaaaacaaaatccccgtaatacttcccaaatcgcgaaacttaaaacaacaaataatcccaaaaaccaaaccaaaaattaacaatcgacgaaaaaaccgaaaactaaacccttaaacaacaaaaaaaaaaaccgcgaacccgaaaaccaccgattatccgccacctatatcacctaataaaaaaccaataattcaccgctatcgacgcgcaaatcttataacaaatccgcctacattaatacctacgcaataccgtacgaatcaatattaattcgtaaatcgataatttctaacaattcgaacgtcaacgcatcatcgacccactaccaaacttcgccgttatcttccgtaaaacgcatccgcaacgtatctacttacgctaatccgacaaccaccgcgcgaaccaataataacgaatcaacctctccgattaactcaacgtaatacgccacgct

SEQ ID NO: 24699 - DNA, 514 bp, Artificial Sequence
  chemically treated genomic DNA (Homo sapiens) CpG-island No: 24699
cgtatatttcgatagcgggttttttatagtgtaggttcgtttttatttcgttatcgaagaaaagataagattttcgtggtgttttttaaatcgcgaagtttagggtaataggtggttttaagaattaggttaaaaattggtaatcggcggaaaggtcgggaattaaatttttggatagtaaaggggaaaatcgcgaattcgagaattatcggttattcgttatttgtattatttgatgaaagattagtggtttatcgttatcgacgcgtagattttgtggtaaattcgtttgtattaatgtttgcgtagtatcgtgcggattaatgttggttcgtaggtcgataatttttggtagttcgaacgttagcgtattatcgatttattgttagatttcgtcgttatttttcgtaaaacgtattcgtagcgtatttgtttgcgttagttcggtaattatcgcgcgggttagtaatggcgaattaattttttcggttaatttaacgtaatgcgttacgtt

SEQ ID NO: 24700 - DNA, 514 bp, Artificial Sequence
  chemically treated genomic DNA (Homo sapiens) CpG-island No: 24700
aacgtaacgcattacgttaaattaaccgaaaaaattaattcgccattactaacccgcgcgataattaccgaactaacgcaaacaaatacgctacgaatacgttttacgaaaaataacgacgaaatctaacaataaatcgataatacgctaacgttcgaactaccaaaaattatcgacctacgaaccaacattaatccgcacgatactacgcaaacattaatacaaacgaatttaccacaaaatctacgcgtcgataacgataaaccactaatctttcatcaaataatacaaataacgaataaccgataattctcgaattcgcgattttcccctttactatccaaaaatttaattcccgacctttccgccgattaccaatttttaacctaattcttaaaaccacctattaccctaaacttcgcgatttaaaaaacaccacgaaaatcttatcttttcttcgataacgaaataaaaacgaacctacactataaaaaacccgctatcgaaatatacg

SEQ ID NO: 24701 - DNA, 767 bp, Artificial Sequence
  chemically treated genomic DNA (Homo sapiens) CpG-island No: 24701
  misc_feature (333)..(333): n is either a, c, g or t
gttagtagataacgttacgagtgattgagttcgggcgcgggtttttcggtagattcgtattgcgcgatagtaagatattattgatttgatttaataatggtacggtattggtaaagttaaattgattaataacgggcgtgtcgttcggtttgttagtttagattttaatgatatagcgagcgttaattttaatcgtttaggcgttacgatagttatagttggtgttcgttttttatgttagtggggcgacgcgcggtaaggtattattcggtaagggttgcgttttattagttataattcggcgaatgatttacgtcgttttcgacgatattnaaggtcgtttaagtagcggatcgttaggttgtaagcgtaatttgtttgttttgtcgtggcgagtaaacgcggtatacgttgtcgttatattttttagttttgtattagcgtcgtcgagaatgagtgaaagattcggcgtagtatcgttgggtaatattacggtaatttaatattgcgttattttgtcgtaaatcgtttcggtttataggtttttagtatttgtatagtaggtaagtttagcgagcgtattagcgtttcgtttatgttgatcgggttatgaaaatcgttattaaagttatttggtcgataattatcggtgcgtcgggggacgttttgtagtagtgattgtcggtggattaagtttttatttagcgttagattataaataaacggtttgagtattgattttgtgcgatcggatcgaattgattata

SEQ ID NO: 24702 - DNA, 767 bp, Artificial Sequence
  chemically treated genomic DNA (Homo sapiens) CpG-island No: 24702
  misc_feature (435)..(435): n is either a, c, g or t
tataatcaattcgatccgatcgcacaaaatcaatactcaaaccgtttatttataatctaacgctaaataaaaacttaatccaccgacaatcactactacaaaacgtcccccgacgcaccgataattatcgaccaaataactttaataacgattttcataacccgatcaacataaacgaaacgctaatacgctcgctaaacttacctactatacaaatactaaaaacctataaaccgaaacgatttacgacaaaataacgcaatattaaattaccgtaatattacccaacgatactacgccgaatctttcactcattctcgacgacgctaatacaaaactaaaaaatataacgacaacgtataccgcgtttactcgccacgacaaaacaaacaaattacgcttacaacctaacgatccgctacttaaacgaccttnaatatcgtcgaaaacgacgtaaatcattcgccgaattataactaataaaacgcaacccttaccgaataataccttaccgcgcgtcgccccactaacataaaaaacgaacaccaactataactatcgtaacgcctaaacgattaaaattaacgctcgctatatcattaaaatctaaactaacaaaccgaacgacacgcccgttattaatcaatttaactttaccaataccgtaccattattaaatcaaatcaataatatcttactatcgcgcaatacgaatctaccgaaaaacccgcgcccgaactcaatcactcgtaacgttatctactaac

SEQ ID NO: 24703 - DNA, 767 bp, Artificial Sequence
  chemically treated genomic DNA (Homo sapiens) CpG-island No: 24703
  misc_feature (435)..(435): n is either a, c, g or t
tatggttaattcgattcgatcgtataggattagtgtttaaatcgtttgtttatggtttggcgttggatgaaggtttgatttatcggtaattattgttgtaagacgtttttcggcgtatcggtgattatcgattaggtaattttgatagcggtttttatggttcgattagtatgagcgaggcgttggtgcgttcgttgaatttatttgttgtgtaggtgttggaagtttatggatcgaaacggtttgcggtaaagtaacgtaatgttggattgtcgtaatattgtttaacggtgttgcgtcgaattttttatttattttcggcggcgttggtgtaaaattggaagatatggcggtagcgtatatcgcgtttgttcgttacggtaaggtaggtaaattgcgtttatagtttgacgattcgttgtttgaacggttttnaatgtcgtcgggggcggcgtggattattcgtcggattatggttgatgaagcgtaatttttgtcggatagtgttttgtcgcgcgtcgttttattggtatggaaaacgggtattagttatggttatcgtgacgtttgggcgattggggttaacgttcgttatgttattgggatttggattggtagatcggacggtacgttcgttgttggttagtttggttttgttagtgtcgtattattgttgaattaggttaataatattttattgtcgcgtagtgcgaatttgtcggaagattcgcgttcgaatttagttattcgtggcgttatttgttggt

SEQ ID NO: 24704 - DNA, 767 bp, Artificial Sequence
  chemically treated genomic DNA (Homo sapiens) CpG-island No: 24704
  misc_feature (333)..(333): n is either a, c, g or t
accaacaaataacgccacgaataactaaattcgaacgcgaatcttccgacaaattcgcactacgcgacaataaaatattattaacctaattcaacaataatacgacactaacaaaaccaaactaaccaacaacgaacgtaccgtccgatctaccaatccaaatcccaataacataacgaacgttaaccccaatcgcccaaacgtcacgataaccataactaatacccgttttccataccaataaaacgacgcgcgacaaaacactatccgacaaaaattacgcttcatcaaccataatccgacgaataatccacgccgcccccgacgacattnaaaaccgttcaaacaacgaatcgtcaaactataaacgcaatttacctaccttaccgtaacgaacaaacgcgatatacgctaccgccatatcttccaattttacaccaacgccgccgaaaataaataaaaaattcgacgcaacaccgttaaacaatattacgacaatccaacattacgttactttaccgcaaaccgtttcgatccataaacttccaacacctacacaacaaataaattcaacgaacgcaccaacgcctcgctcatactaatcgaaccataaaaaccgctatcaaaattacctaatcgataatcaccgatacgccgaaaaacgtcttacaacaataattaccgataaatcaaaccttcatccaacgccaaaccataaacaaacgatttaaacactaatcctatacgatcgaatcgaattaaccata

SEQ ID NO: 24705 - DNA, 528 bp, Artificial Sequence
  chemically treated genomic DNA (Homo sapiens) CpG-island No: 24705
aatattatttagaatggtttgcgttgggcgacggcgatttttagttaatgaggttttcgaaaggtggtgttttcgtaagcgtacgcgcggtcgcggcgggattttcgttgttttttttgtggcggtcgttttggtatttgtttggattgattatttggtagaaagtttcggagcgttgggttagtattattcgtgattgattgagaaggcgcgagaggagtttttttcgttgtatagaggcgtggttgaggttcggcggcgtttagggtatttaggttcggttcggaataaggatattttttttggtttcgtttcgtttatagagttagatggcggcggtcgagttgacggtttcggtttaggtatgtgtcgcgttttttgggtttttttcgttttttttacgttagttttagtattttcgagggcgtttgttcgcggttttgttgtttaggataggatacgggggttcgtcggaggggttttcgtttttaatatttggtgtgttagggaagggagggcgcgattggt

SEQ ID NO: 24706 - DNA, 528 bp, Artificial Sequence
  chemically treated genomic DNA (Homo sapiens) CpG-island No: 24706
accaatcgcgccctcccttccctaacacaccaaatattaaaaacgaaaacccctccgacgaacccccgtatcctatcctaaacaacaaaaccgcgaacaaacgccctcgaaaatactaaaactaacgtaaaaaaaacgaaaaaaacccaaaaaacgcgacacatacctaaaccgaaaccgtcaactcgaccgccgccatctaactctataaacgaaacgaaaccaaaaaaaatatccttattccgaaccgaacctaaataccctaaacgccgccgaacctcaaccacgcctctatacaacgaaaaaaactcctctcgcgccttctcaatcaatcacgaataatactaacccaacgctccgaaactttctaccaaataatcaatccaaacaaataccaaaacgaccgccacaaaaaaaacaacgaaaatcccgccgcgaccgcgcgtacgcttacgaaaacaccacctttcgaaaacctcattaactaaaaatcgccgtcgcccaacgcaaaccattctaaataatatt

SEQ ID NO: 24707 - DNA, 528 bp, Artificial Sequence
  chemically treated genomic DNA (Homo sapiens) CpG-island No: 24707
gttagtcgcgtttttttttttttagtatattaggtgttggaaacgggagttttttcggcgagttttcgtgttttgttttgggtagtagggtcgcgagtaagcgttttcgggggtgttaggattagcgtggggagggcggggaaggtttagaggacgcggtatatatttgggtcggggtcgttagttcggtcgtcgttatttgattttgtgagcggagcggggttagagaggatgtttttatttcgggtcgggtttgggtattttgggcgtcgtcgagttttagttacgtttttgtgtagcggggaagatttttttcgcgtttttttagttagttacggatgatgttgatttagcgtttcggggttttttattaagtaattagtttagataaatgttaaaacgatcgttataaggaggataacggaagtttcgtcgcgatcgcgcgtgcgtttacggaaatattatttttcggaggttttattggttgaaggtcgtcgtcgtttaacgtaggttattttgggtaatgtt

SEQ ID NO: 24708 - DNA, 528 bp, Artificial Sequence
  chemically treated genomic DNA (Homo sapiens) CpG-island No: 24708
aacattacccaaaataacctacgttaaacgacgacgaccttcaaccaataaaacctccgaaaaataatatttccgtaaacgcacgcgcgatcgcgacgaaacttccgttatcctccttataacgatcgttttaacatttatctaaactaattacttaataaaaaaccccgaaacgctaaatcaacatcatccgtaactaactaaaaaaacgcgaaaaaaatcttccccgctacacaaaaacgtaactaaaactcgacgacgcccaaaatacccaaacccgacccgaaataaaaacatcctctctaaccccgctccgctcacaaaatcaaataacgacgaccgaactaacgaccccgacccaaatatataccgcgtcctctaaaccttccccgccctccccacgctaatcctaacacccccgaaaacgcttactcgcgaccctactacccaaaacaaaacacgaaaactcgccgaaaaaactcccgtttccaacacctaatatactaaaaaaaaaaaaacgcgactaac

SEQ ID NO: 24709 - DNA, 958 bp, Artificial Sequence
  chemically treated genomic DNA (Homo sapiens) CpG-island No: 24709
tggtggatgacgaacgttgggcgcgttttaacgagaaatttgagaatatcgagcgtgagcgttagcgtttgaaatcgatttgggtaatttcgtcggcggaagttgtagtcgaagtgaaagttttgtttgatgtttagttcgaagtggtttatttattggcgaagtggaaacgttagattttagggtaatacgattttagcgcgggcgaagggttgtatacgtatatgaaagtttttcgtttcgatgaagatcgttttttttcgttgtattcggtttatgttgattagtgggattgggaacgcgtaatgggcgacggtgagcgttaattttcgattttgaaaagtacggtagaggcgatttgggcgggaattaaagtaatcgaagttgcggttagcgaagagtttggtttggtatcgtttttgtcggattagatttatttcgtatatagttaggagttattgtttcgttattcggattttgatgttaaagggcgtgagcgggcgatagcgaaagattttggcgcggtattttttgtcgggattggcggtaagttgagcgatggttatcgttacgacgtgcgcgtatcggattatgatgattggagtatttcgttagagttgggttatgcgggtttgaacggcgatttttggtgtggaattcggtattggaagatgcgtttgagtttttttttatggggattcgtgtagattcgatacgttgaagtattaattggcgttgatcggtgacgaagatcgtttggagttggagttggtattaggcgttgttgcgcggtgaaatgtcgtagattatcggcggcggtatcggttagtttcgtttgattatttgttgttgtaattgtcgtatatcggttaggtttagtgtggagtatggttagttgttgtcgcgagagcgtttttttttggtgtaataatttaatcgcgtagcgtttagagtaggg

SEQ ID NO: 24710 - DNA, 958 bp, Artificial Sequence
  chemically treated genomic DNA (Homo sapiens) CpG-island No: 24710
ccctactctaaacgctacgcgattaaattattacaccaaaaaaaaacgctctcgcgacaacaactaaccatactccacactaaacctaaccgatatacgacaattacaacaacaaataatcaaacgaaactaaccgataccgccgccgataatctacgacatttcaccgcgcaacaacgcctaataccaactccaactccaaacgatcttcgtcaccgatcaacgccaattaatacttcaacgtatcgaatctacacgaatccccataaaaaaaaactcaaacgcatcttccaataccgaattccacaccaaaaatcgccgttcaaacccgcataacccaactctaacgaaatactccaatcatcataatccgatacgcgcacgtcgtaacgataaccatcgctcaacttaccgccaatcccgacaaaaaataccgcgccaaaatctttcgctatcgcccgctcacgccctttaacatcaaaatccgaataacgaaacaataactcctaactatatacgaaataaatctaatccgacaaaaacgataccaaaccaaactcttcgctaaccgcaacttcgattactttaattcccgcccaaatcgcctctaccgtacttttcaaaatcgaaaattaacgctcaccgtcgcccattacgcgttcccaatcccactaatcaacataaaccgaatacaacgaaaaaaaacgatcttcatcgaaacgaaaaactttcatatacgtatacaacccttcgcccgcgctaaaatcgtattaccctaaaatctaacgtttccacttcgccaataaataaaccacttcgaactaaacatcaaacaaaactttcacttcgactacaacttccgccgacgaaattacccaaatcgatttcaaacgctaacgctcacgctcgatattctcaaatttctcgttaaaacgcgcccaacgttcgtcatccacca

SEQ ID NO: 24711 - DNA, 958 bp, Artificial Sequence
  chemically treated genomic DNA (Homo sapiens) CpG-island No: 24711
ttttgttttaaacgttgcgcgattaaattattatattaggaaaggacgttttcgcgatagtagttggttatattttatattgaatttggtcgatatgcggtagttgtagtagtagatagttaaacgagattggtcgatatcgtcgtcgatggtttgcggtattttatcgcgtagtagcgtttgatgttaattttagttttaggcgattttcgttatcggttagcgttagttgatgttttagcgtgtcggatttatacggatttttatggaggaaagtttaaacgtattttttagtatcgggttttatattagaaatcgtcgtttagattcgtatggtttagttttgacggggtgttttagttattataattcggtgcgcgtacgtcgtggcgatgattatcgtttagtttgtcgttaatttcgataaggaatatcgcgttaagatttttcgttatcgttcgtttacgttttttggtattaagattcggataacgagatagtaatttttggttgtgtacgaagtggatttgattcggtaggaacggtgttaggttaaatttttcgttaatcgtagtttcggttgttttaattttcgtttagatcgtttttatcgtgttttttagagtcgagaattgacgtttatcgtcgtttattacgcgtttttagttttattggttaatatagatcgagtgtaacggagaaagacggtttttatcggggcgaagggtttttatgtgcgtgtatagtttttcgttcgcgttgaagtcgtgttgttttaaggtttgacgtttttatttcgttagtgaatgaattatttcgaattgggtattaggtagagtttttatttcggttgtagttttcgtcgacggggttatttaggtcgattttagacgttgacgtttacgttcgatatttttaagtttttcgttaaagcgcgtttaacgttcgttatttatta

SEQ ID NO: 24712 - DNA, 958 bp, Artificial Sequence
  chemically treated genomic DNA (Homo sapiens) CpG-island No: 24712
taataaataacgaacgttaaacgcgctttaacgaaaaacttaaaaatatcgaacgtaaacgtcaacgtctaaaatcgacctaaataaccccgtcgacgaaaactacaaccgaaataaaaactctacctaatacccaattcgaaataattcattcactaacgaaataaaaacgtcaaaccttaaaacaacacgacttcaacgcgaacgaaaaactatacacgcacataaaaacccttcgccccgataaaaaccgtctttctccgttacactcgatctatattaaccaataaaactaaaaacgcgtaataaacgacgataaacgtcaattctcgactctaaaaaacacgataaaaacgatctaaacgaaaattaaaacaaccgaaactacgattaacgaaaaatttaacctaacaccgttcctaccgaatcaaatccacttcgtacacaaccaaaaattactatctcgttatccgaatcttaataccaaaaaacgtaaacgaacgataacgaaaaatcttaacgcgatattccttatcgaaattaacgacaaactaaacgataatcatcgccacgacgtacgcgcaccgaattataataactaaaacaccccgtcaaaactaaaccatacgaatctaaacgacgatttctaatataaaacccgatactaaaaaatacgtttaaactttcctccataaaaatccgtataaatccgacacgctaaaacatcaactaacgctaaccgataacgaaaatcgcctaaaactaaaattaacatcaaacgctactacgcgataaaataccgcaaaccatcgacgacgatatcgaccaatctcgtttaactatctactactacaactaccgcatatcgaccaaattcaatataaaatataaccaactactatcgcgaaaacgtcctttcctaatataataatttaatcgcgcaacgtttaaaacaaaa

SEQ ID NO: 24713 - DNA, 629 bp, Artificial Sequence
  chemically treated genomic DNA (Homo sapiens) CpG-island No: 24713
acgggtcgtacgagttgtattcggacgtaacgatgatgattagttggtatttgtcggagaattcgttgtagaagagcggttacggttcgttgttgtagacgtatacgggtgaatggtatatggtttattttattagtcgttcgttgcgtttgttcggcgtgtcgttgttggttttcggcggacgcggttattgttcgttggggcgcgagatcggtatcgttcgtattgaatggcgcgacggttggtcgtacgtggaaggcggtaagtacgcgtagttgatcgtgaaaggttcgtaagtagtcgagtagtttgtagtcgtttcgggtaattggcgggacgatttcgacgttagttcgtttgattcggagttgtagattttgcgtatttcgttcgacgatattttcggttcgtttatcgcgcgttcgggttttttacggttttatggtaacgattcgtttaattcgatttttatttaatcgatcgtggcgcgtcgttggtagtatttcgtttttcgggtagaaacgcggatggagttttcgtcggtgtatttttagtagagcgcggggttgatttgttattataatagtaaaaattggagttattgttttgtggattacgaggagggatag

SEQ ID NO: 24714 - DNA, 629 bp, Artificial Sequence
  chemically treated genomic DNA (Homo sapiens) CpG-island No: 24714
ctatccctcctcgtaatccacaaaacaataactccaatttttactattataataacaaatcaaccccgcgctctactaaaaatacaccgacgaaaactccatccgcgtttctacccgaaaaacgaaatactaccaacgacgcgccacgatcgattaaataaaaatcgaattaaacgaatcgttaccataaaaccgtaaaaaacccgaacgcgcgataaacgaaccgaaaatatcgtcgaacgaaatacgcaaaatctacaactccgaatcaaacgaactaacgtcgaaatcgtcccgccaattacccgaaacgactacaaactactcgactacttacgaacctttcacgatcaactacgcgtacttaccgccttccacgtacgaccaaccgtcgcgccattcaatacgaacgataccgatctcgcgccccaacgaacaataaccgcgtccgccgaaaaccaacaacgacacgccgaacaaacgcaacgaacgactaataaaataaaccatataccattcacccgtatacgtctacaacaacgaaccgtaaccgctcttctacaacgaattctccgacaaataccaactaatcatcatcgttacgtccgaatacaactcgtacgacccgt

SEQ ID NO: 24715 - DNA, 629 bp, Artificial Sequence
  chemically treated genomic DNA (Homo sapiens) CpG-island No: 24715
ttgttttttttcgtagtttataaagtagtagttttagtttttgttgttgtagtagtaggttagtttcgcgttttgttggaagtgtatcggcgagaattttattcgcgtttttgttcggaaggcgaagtgttgttagcggcgcgttacggtcgattgggtgaaggtcgaattgagcgagtcgttgttatagagtcgtaagaagttcgggcgcgcggtgagcgagtcgagggtgtcgtcgaacggaatgcgtagggtttgtagtttcgggttaagcgaattggcgtcgaaatcgtttcgttagttgttcggaacggttgtaggttgttcggttatttgcgggttttttacggttagttgcgcgtgtttgtcgttttttacgtacggttagtcgtcgcgttatttaatgcgggcgatgtcggtttcgcgttttagcgggtagtagtcgcgttcgtcggaggttagtagcggtacgtcgggtaggcgtagcgggcggttggtgaggtaggttatgtattatttattcgtatgcgtttgtagtagcgagtcgtggtcgtttttttgtagcgggtttttcggtaggtgttagttggttattatcgttacgttcgggtgtagttcgtacggttcgt

SEQ ID NO: 24716 - DNA, 629 bp, Artificial Sequence
  chemically treated genomic DNA (Homo sapiens) CpG-island No: 24716
acgaaccgtacgaactacacccgaacgtaacgataataaccaactaacacctaccgaaaaacccgctacaaaaaaacgaccacgactcgctactacaaacgcatacgaataaataatacataacctacctcaccaaccgcccgctacgcctacccgacgtaccgctactaacctccgacgaacgcgactactacccgctaaaacgcgaaaccgacatcgcccgcattaaataacgcgacgactaaccgtacgtaaaaaacgacaaacacgcgcaactaaccgtaaaaaacccgcaaataaccgaacaacctacaaccgttccgaacaactaacgaaacgatttcgacgccaattcgcttaacccgaaactacaaaccctacgcattccgttcgacgacaccctcgactcgctcaccgcgcgcccgaacttcttacgactctataacaacgactcgctcaattcgaccttcacccaatcgaccgtaacgcgccgctaacaacacttcgccttccgaacaaaaacgcgaataaaattctcgccgatacacttccaacaaaacgcgaaactaacctactactacaacaacaaaaactaaaactactactttataaactacgaaaaaaaacaa

SEQ ID NO: 24717 - DNA, 500 bp, Artificial Sequence
  chemically treated genomic DNA (Homo sapiens) CpG-island No: 24717
tgattcggagtagttatttacgttttatttttttgttgacgatattgatattacgcggcgtacgttttttcggaggaaattattagcgtattaaacgcggtttgaggattataggtgttattaaatagcgggtattgatgcggtttatatttgttcgttaatattttattataacgcgcgcgcgggttatcgtagatttgttgcggtgtcgggcggaaatgtgtttcggtatcgaatcgttgatattcggcgttaggtgtacgttagaagatttaattacgtttaagtcgcgttattcgttgtcgtcgttgatatagaatatatcggtaatcgtttgttgcgttagtaggttatcggtattcggtattattcgacgatattgattttttattttgttgtgggtcgttttttttgttgtattagtatgattacgttttgtagtagattaaggggttcgaatttagtaattattagcggacgatgaaaatcgttgcgataaa

SEQ ID NO: 24718 - DNA, 500 bp, Artificial Sequence
  chemically treated genomic DNA (Homo sapiens) CpG-island No: 24718
tttatcgcaacgattttcatcgtccgctaataattactaaattcgaaccccttaatctactacaaaacgtaatcatactaatacaacaaaaaaaacgacccacaacaaaataaaaaatcaatatcgtcgaataataccgaataccgataacctactaacgcaacaaacgattaccgatatattctatatcaacgacgacaacgaataacgcgacttaaacgtaattaaatcttctaacgtacacctaacgccgaatatcaacgattcgataccgaaacacatttccgcccgacaccgcaacaaatctacgataacccgcgcgcgcgttataataaaatattaacgaacaaatataaaccgcatcaatacccgctatttaataacacctataatcctcaaaccgcgtttaatacgctaataatttcctccgaaaaaacgtacgccgcgtaatatcaatatcgtcaacaaaaaaataaaacgtaaataactactccgaatca

SEQ ID NO: 24719 - DNA, 500 bp, Artificial Sequence
  chemically treated genomic DNA (Homo sapiens) CpG-island No: 24719
tttatcgtagcgatttttatcgttcgttggtggttgttggattcgaattttttgatttattataaggcgtggttatgttggtgtagtagaaaaagcggtttatagtaaggtagagaattagtatcgtcgagtggtatcggatgtcggtaatttgttggcgtaataggcgattgtcgatgtgttttgtgttaacggcgatagcgaatggcgcggtttaggcgtgattgaattttttggcgtgtatttgacgtcggatattaacgattcgatgtcgaagtatattttcgttcggtatcgtagtaggtttgcgatgattcgcgcgcgcgttgtggtgaggtattaacgggtaaatgtaagtcgtattaatgttcgttgtttggtaatatttgtaatttttaaatcgcgtttggtgcgttgatggtttttttcgaaggagcgtgcgtcgcgtggtattagtatcgttagtaggagagtgaagcgtgaataattatttcgaatta

SEQ ID NO: 24720 - DNA, 500 bp, Artificial Sequence
  chemically treated genomic DNA (Homo sapiens) CpG-island No: 24720
taattcgaaataattattcacgcttcactctcctactaacgatactaataccacgcgacgcacgctccttcgaaaaaaaccatcaacgcaccaaacgcgatttaaaaattacaaatattaccaaacaacgaacattaatacgacttacatttacccgttaatacctcaccacaacgcgcgcgcgaatcatcgcaaacctactacgataccgaacgaaaatatacttcgacatcgaatcgttaatatccgacgtcaaatacacgccaaaaaattcaatcacgcctaaaccgcgccattcgctatcgccgttaacacaaaacacatcgacaatcgcctattacgccaacaaattaccgacatccgataccactcgacgatactaattctctaccttactataaaccgctttttctactacaccaacataaccacgccttataataaatcaaaaaattcgaatccaacaaccaccaacgaacgataaaaatcgctacgataaa

SEQ ID NO: 24721 - DNA, 640 bp, Artificial Sequence
  chemically treated genomic DNA (Homo sapiens) CpG-island No: 24721
gcggtatgggtattatgatttagagttatcgattgaacgaagtcgattttcgtggtgaacgttttgtcgattggttatgcgattttaaaggtaataacgatttgttggtatttagtaaatcggaagtgatcgtcgttatttataacgtttattttgaagcgggcgcggatattatcgaaattaatatttttaattttacgattattgcgatggcggattattagatggaatttttgtcggcggaaattaattttgcggcggcgaaattggcgcgagtttgtgttgacgagtggatcgcgcgtacgttagagaaatcgcgttacgttgtcggtgttttcggttcgattaatcgtacggcgtttattttttcggacgttaacgattcggtatttcgtaatattatttttgacgggttggtggcggtttatcgagagtttattaaagcgttggtggaaggtggcgcggatttgattttgattgaaatcgttttcgatatttttaacgttaaagcggcggtatttgcggtgaaaacggagtttgaagcgttgggcgttgagttgtcgattatgattttcggtattattatcgacgttttcgggcgtacgtttttcgggtagattatcgaagtatttataattta

SEQ ID NO: 24722 - DNA, 640 bp, Artificial Sequence
  chemically treated genomic DNA (Homo sapiens) CpG-island No: 24722
taaattataaatacttcgataatctacccgaaaaacgtacgcccgaaaacgtcgataataataccgaaaatcataatcgacaactcaacgcccaacgcttcaaactccgttttcaccgcaaataccgccgctttaacgttaaaaatatcgaaaacgatttcaatcaaaatcaaatccgcgccaccttccaccaacgctttaataaactctcgataaaccgccaccaacccgtcaaaaataatattacgaaataccgaatcgttaacgtccgaaaaaataaacgccgtacgattaatcgaaccgaaaacaccgacaacgtaacgcgatttctctaacgtacgcgcgatccactcgtcaacacaaactcgcgccaatttcgccgccgcaaaattaatttccgccgacaaaaattccatctaataatccgccatcgcaataatcgtaaaattaaaaatattaatttcgataatatccgcgcccgcttcaaaataaacgttataaataacgacgatcacttccgatttactaaataccaacaaatcgttattacctttaaaatcgcataaccaatcgacaaaacgttcaccacgaaaatcgacttcgttcaatcgataactctaaatcataatacccataccgc

SEQ ID NO: 24723 - DNA, 640 bp, Artificial Sequence
  chemically treated genomic DNA (Homo sapiens) CpG-island No: 24723
tgagttgtaaatgtttcggtggtttgttcggagagcgtgcgttcggaggcgtcggtgatggtgtcggagattataatcggtagtttaacgtttagcgttttaaatttcgtttttatcgtaaatatcgtcgttttggcgttaagggtgtcgaaaacggttttaattaggattagattcgcgttattttttattagcgttttggtggattttcgataagtcgttattagttcgttaaaagtgatattacgaaatgtcggatcgttgacgttcggagaaatagacgtcgtgcggttggtcgggtcgagaatatcggtaacgtagcgcggtttttttggcgtgcgcgcggtttattcgttagtataagttcgcgttagtttcgtcgtcgtaaagttgattttcgtcgatagggattttatttggtaattcgttatcgtaatggtcgtggagttgaaggtgttggtttcgatgatattcgcgttcgttttaaagtaggcgttgtggatagcggcgattattttcggtttattgagtattagtaggtcgttgttgtttttgaggtcgtatggttagtcggtaaagcgtttattacgaaaatcggtttcgtttagtcgataattttggattatggtgtttatatcgt

SEQ ID NO: 24724 - DNA, 640 bp, Artificial Sequence
  chemically treated genomic DNA (Homo sapiens) CpG-island No: 24724
acgatataaacaccataatccaaaattatcgactaaacgaaaccgattttcgtaataaacgctttaccgactaaccatacgacctcaaaaacaacaacgacctactaatactcaataaaccgaaaataatcgccgctatccacaacgcctactttaaaacgaacgcgaatatcatcgaaaccaacaccttcaactccacgaccattacgataacgaattaccaaataaaatccctatcgacgaaaatcaactttacgacgacgaaactaacgcgaacttatactaacgaataaaccgcgcgcacgccaaaaaaaccgcgctacgttaccgatattctcgacccgaccaaccgcacgacgtctatttctccgaacgtcaacgatccgacatttcgtaatatcacttttaacgaactaataacgacttatcgaaaatccaccaaaacgctaataaaaaataacgcgaatctaatcctaattaaaaccgttttcgacacccttaacgccaaaacgacgatatttacgataaaaacgaaatttaaaacgctaaacgttaaactaccgattataatctccgacaccatcaccgacgcctccgaacgcacgctctccgaacaaaccaccgaaacatttacaactca

SEQ ID NO: 24725 - DNA, 533 bp, Artificial Sequence
  chemically treated genomic DNA (Homo sapiens) CpG-island No: 24725
gtcgagcgtgttcgttcggtaatttattataggtgtacgagggtatataatttcgtgtgttcgagtggttttagcggcgtgggttatttttattacgttggataagttttcgtggtttattaaaaggcggagatcgtattcgaggagcggggtaaagagaaaaggaggtgtcggggggtttattgtgggtcgagtttatattttggggtgtatcgggtcgtttttattttttcgtcggggtcgtttttttcggtcggttttcggagtcgtttttaaggcgttgtggaagttttttcggattttgggcggttcgttcggtgggattcggggtttttcgggggtcggtgggtcggggggtcggtaagcggttcgggggggttaagtttttaaggtatcgtttttcgaaatcggtttttttaattaatataagggaggggcgtaggggggtgcgttttataaatatgttttaagattcgggagggcgttttttttaatttttttttcgaatacgaaaggggaatataattttttaa

SEQ ID NO: 24726 - DNA, 533 bp, Artificial Sequence
  chemically treated genomic DNA (Homo sapiens) CpG-island No: 24726
ttaaaaaattatattcccctttcgtattcgaaaaaaaaattaaaaaaaacgccctcccgaatcttaaaacatatttataaaacgcacccccctacgcccctcccttatattaattaaaaaaaccgatttcgaaaaacgataccttaaaaacttaacccccccgaaccgcttaccgaccccccgacccaccgacccccgaaaaaccccgaatcccaccgaacgaaccgcccaaaatccgaaaaaacttccacaacgccttaaaaacgactccgaaaaccgaccgaaaaaaacgaccccgacgaaaaaataaaaacgacccgatacaccccaaaatataaactcgacccacaataaaccccccgacacctccttttctctttaccccgctcctcgaatacgatctccgccttttaataaaccacgaaaacttatccaacgtaataaaaataacccacgccgctaaaaccactcgaacacacgaaattatataccctcgtacacctataataaattaccgaacgaacacgctcgac

SEQ ID NO: 24727 - DNA, 533 bp, Artificial Sequence
  chemically treated genomic DNA (Homo sapiens) CpG-island No: 24727
ttgggaaattgtgtttttttttcgtattcgggggaaaagttaaagaaaacgttttttcgggttttaaaatatgtttgtgagacgtatttttttgcgttttttttttgtgttgattggggaaatcggtttcgggaagcggtattttgggaatttaattttttcgggtcgtttatcggtttttcggtttatcgattttcggaaaatttcggattttatcggacggatcgtttaaagttcggaagagtttttataacgttttggaagcggtttcggaaatcggtcggaaaaaacggtttcggcggaaaaatgggaacggttcggtatattttagaatataaattcggtttataataagtttttcggtatttttttttttttttgtttcgtttttcgggtacggttttcgttttttggtgaattacggaaatttgtttaacgtggtaaaggtggtttacgtcgttggggttattcggatatacggggttgtatattttcgtatatttgtgatagattgtcgggcgaatacgttcgat

SEQ ID NO: 24728 - DNA, 533 bp, Artificial Sequence
  chemically treated genomic DNA (Homo sapiens) CpG-island No: 24728
atcgaacgtattcgcccgacaatctatcacaaatatacgaaaatatacaaccccgtatatccgaataaccccaacgacgtaaaccacctttaccacgttaaacaaatttccgtaattcaccaaaaaacgaaaaccgtacccgaaaaacgaaacaaaaaaaaaaaaaaataccgaaaaacttattataaaccgaatttatattctaaaatataccgaaccgttcccatttttccgccgaaaccgttttttccgaccgatttccgaaaccgcttccaaaacgttataaaaactcttccgaactttaaacgatccgtccgataaaatccgaaattttccgaaaatcgataaaccgaaaaaccgataaacgacccgaaaaaattaaattcccaaaataccgcttcccgaaaccgatttccccaatcaacacaaaaaaaaaacgcaaaaaaatacgtctcacaaacatattttaaaacccgaaaaaacgttttctttaacttttcccccgaatacgaaaaaaaaacacaatttcccaa

SEQ ID NO: 24729 - DNA, 679 bp, Artificial Sequence
  chemically treated genomic DNA (Homo sapiens) CpG-island No: 24729
  misc_feature (528)..(528): n is either a, c, g or t
aaggcgttcgcgtcgtattcggtaattaatgtttgatgcgacgttgtcgcgttttattaggtttataattattgtcgatttgtaggtttgataaggtatttgtgtcgtattcggtaattaatgtttgatgcgacgttgtcgcgttttattaggtttataattgttgtcgatttgtaggtcggataaggtatttgtgtcgtattcggtaattaatgtttgatgcgacgttgtcgcgttttattaggtttataattattgtcgatttgtaggtcggataaagtatttgtgtcgtattcggtaattaatgtttgatgcgacgttgtcgcgttttattaggtttataattgttgtcgattcgtaggtcggataaagcgttcgcgtcgtattcggtagtgtttattcgcggcgatttaaaattttttttttataagttcgtacgttttgtagttattcgttatttgttggcgtatcgtgacgttggtaatatattttttagatcgtttgttacggtaacgatttttgtttttntagtagtgttagacgcgtagtgtaatcgttcgtcgtttttagtttgcgtagtttagcggtaggttttagtaacgtttggaacgatttgaagttgttttttttgagaagggttgtgttatgttttttttttagcgtcgagagagattgggtt

SEQ ID NO: 24730 - DNA, 679 bp, Artificial Sequence
  chemically treated genomic DNA (Homo sapiens) CpG-island No: 24730
  misc_feature (152)..(152): n is either a, c, g or t
aacccaatctctctcgacgctaaaaaaaaaacataacacaacccttctcaaaaaaaacaacttcaaatcgttccaaacgttactaaaacctaccgctaaactacgcaaactaaaaacgacgaacgattacactacgcgtctaacactactanaaaaacaaaaatcgttaccgtaacaaacgatctaaaaaatatattaccaacgtcacgatacgccaacaaataacgaataactacaaaacgtacgaacttataaaaaaaaaattttaaatcgccgcgaataaacactaccgaatacgacgcgaacgctttatccgacctacgaatcgacaacaattataaacctaataaaacgcgacaacgtcgcatcaaacattaattaccgaatacgacacaaatactttatccgacctacaaatcgacaataattataaacctaataaaacgcgacaacgtcgcatcaaacattaattaccgaatacgacacaaataccttatccgacctacaaatcgacaacaattataaacctaataaaacgcgacaacgtcgcatcaaacattaattaccgaatacgacacaaataccttatcaaacctacaaatcgacaataattataaacctaataaaacgcgacaacgtcgcatcaaacattaattaccgaatacgacgcgaacgcctt

SEQ ID NO: 24731 - DNA, 679 bp, Artificial Sequence
  chemically treated genomic DNA (Homo sapiens) CpG-island No: 24731
  misc_feature (152)..(152): n is either a, c, g or t
aatttagtttttttcggcgttgaggagaaaatatggtatagttttttttaggggaagtagttttaggtcgttttaaacgttgttggaatttatcgttaagttgcgtaagttgaaagcggcgggcgattatattgcgcgtttggtattgttgnaagagtagaaatcgttgtcgtggtaggcggtttgggaaatgtattgttaacgttacgatacgttagtaggtagcgaatggttgtagagcgtgcgggtttatgagaaagaaattttgagtcgtcgcgggtaaatattgtcggatgcggcgcgagcgttttattcggtttacgggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgtcggatgcggtataagtgttttattaggtttataggtcggtaatagttgtaggtttgataagacgcgatagcgtcgtattaggtattgattgtcggatgcggcgcgagcgtttt

SEQ ID NO: 24732 - DNA, 679 bp, Artificial Sequence
  chemically treated genomic DNA (Homo sapiens) CpG-island No: 24732
  misc_feature (528)..(528): n is either a, c, g or t
aaaacgctcgcgccgcatccgacaatcaatacctaatacgacgctatcgcgtcttatcaaacctacaactattaccgacctataaacctaataaaacacttataccgcatccgacaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacccgtaaaccgaataaaacgctcgcgccgcatccgacaatatttacccgcgacgactcaaaatttctttctcataaacccgcacgctctacaaccattcgctacctactaacgtatcgtaacgttaacaatacatttcccaaaccgcctaccacgacaacgatttctactcttncaacaataccaaacgcgcaatataatcgcccgccgctttcaacttacgcaacttaacgataaattccaacaacgtttaaaacgacctaaaactacttcccctaaaaaaaactataccatattttctcctcaacgccgaaaaaaactaaatt

SEQ ID NO: 24733 - DNA, 512 bp, Artificial Sequence
  chemically treated genomic DNA (Homo sapiens) CpG-island No: 24733
cgttattatttgcgcggcgattacggtaggtagtaaataatgaggcgttgggagcgaggttgagagacgtacgggttttatttcgggttcgttttttgttaattttagagaggggaaggtttttcgcgtttcgcgtttcgtttttagttttttaggtttcgttattttttcgcgggtttcgtttaggtttggtttttgtttttgcgttgcgtaggaattcggttgataagaattttagggaaagtcgcgatttagatattgagacgttgatgtgggttcgttacgcgtagacgcgtgacgtttttgtttttggtgtatgttgttaatcgtttagcgatttttttaaggttttcgtgcgttttttgtattttgaggacgtggggtttttagtagtattttggatagatttttgtatcgcgtcggggttgggggttttattttttcgattattttttaaaattatcgattaaaggggtaaaggggtttaaaaataattttttgtaaagtaatta

SEQ ID NO: 24734 - DNA, 512 bp, Artificial Sequence
  chemically treated genomic DNA (Homo sapiens) CpG-island No: 24734
taattactttacaaaaaattatttttaaacccctttacccctttaatcgataattttaaaaaataatcgaaaaaataaaacccccaaccccgacgcgatacaaaaatctatccaaaatactactaaaaaccccacgtcctcaaaatacaaaaaacgcacgaaaaccttaaaaaaatcgctaaacgattaacaacatacaccaaaaacaaaaacgtcacgcgtctacgcgtaacgaacccacatcaacgtctcaatatctaaatcgcgactttccctaaaattcttatcaaccgaattcctacgcaacgcaaaaacaaaaaccaaacctaaacgaaacccgcgaaaaaataacgaaacctaaaaaactaaaaacgaaacgcgaaacgcgaaaaaccttcccctctctaaaattaacaaaaaacgaacccgaaataaaacccgtacgtctctcaacctcgctcccaacgcctcattatttactacctaccgtaatcgccgcgcaaataataacg

SEQ ID NO: 24735 - DNA, 512 bp, Artificial Sequence
  chemically treated genomic DNA (Homo sapiens) CpG-island No: 24735
tggttgttttataagaggttgtttttgggtttttttgtttttttaatcggtggttttgggaaataatcggggggataaaatttttaatttcggcgcgatgtagaaatttgtttagggtattattggggattttacgtttttaaggtataagaagcgtacggggattttgggaaggtcgttagacggttaataatatatattaggagtagaaacgttacgcgtttgcgcgtagcggatttatattagcgttttagtgtttgaatcgcggttttttttggggtttttgttagtcgaatttttgcgtagcgtagggatagaagttaggtttgggcgggattcgcggggaggtagcggggtttgaggagttaggggcggggcgcgaagcgcgagagatttttttttttttagaattggtagaaggcgggttcggggtgggattcgtgcgttttttaatttcgtttttagcgttttattgtttgttgtttgtcgtggtcgtcgcgtaggtgatgacg

SEQ ID NO: 24736 - DNA, 512 bp, Artificial Sequence
  chemically treated genomic DNA (Homo sapiens) CpG-island No: 24736
cgtcatcacctacgcgacgaccacgacaaacaacaaacaataaaacgctaaaaacgaaattaaaaaacgcacgaatcccaccccgaacccgccttctaccaattctaaaaaaaaaaaaatctctcgcgcttcgcgccccgcccctaactcctcaaaccccgctacctccccgcgaatcccgcccaaacctaacttctatccctacgctacgcaaaaattcgactaacaaaaaccccaaaaaaaaccgcgattcaaacactaaaacgctaatataaatccgctacgcgcaaacgcgtaacgtttctactcctaatatatattattaaccgtctaacgaccttcccaaaatccccgtacgcttcttataccttaaaaacgtaaaatccccaataataccctaaacaaatttctacatcgcgccgaaattaaaaattttatccccccgattatttcccaaaaccaccgattaaaaaaacaaaaaaacccaaaaacaacctcttataaaacaacca

SEQ ID NO: 24737 - DNA, 1109 bp, Artificial Sequence
  chemically treated genomic DNA (Homo sapiens) CpG-island No: 24737
  misc_feature (225)..(225): n is either a, c, g or t
  misc_feature (246)..(246): n is either a, c, g or t
  misc_feature (250)..(250): n is either a, c, g or t
  misc_feature (252)..(253): n is either a, c, g or t
gtcgattttagggtagggcgcgggtcgtgattgtgtttgggggtttttggatattgtgagggcgttgggttagcgagggggttgtgggcgattcggggggttgcgttggggggtggggggatagggggatgcgtatttatatttttttattgggtcgattgttattatgttgttggatcggtgggttatcgtgcgcggacgtacgtgtaaagcgcggtttaaatnggcgtgggtaaagtatttatnggtntnnaggtttcgtttggattaatcggttagatttgggcggaaaaggggttaacgggggggaagcgacggacgtagtcgaggttgggttgcgcggtattaagggcgttatagtcgcgacggggttggtttgtggcggtagttacgtcggattgtgtttatgcggtttcgtatgggatggtatcggcgggtttagatgtacgacggcgatgggacgggacggtaaagcgcggggggggggaaggggcgggacgtgggtttattggcgggagatttgtagatacgcggcgttgggatagttatcgaattatagttattggtacgtgttcgcggatcggttggtaatcggggttatattgtttagaagattgtcgcggttatttttgatagttggtttgtttggagaatgggaaagtcgggagtgcgcggtgttgtgggcgagtattatcgggcgttggtattggagtgtgaggaatatgcgaatgttgggtaacgggacgtcggggggataaggttttgtttgcgcgggttattttaagtttgtgggtcggttttgatgcgtaggtgttacgatatatgttgcgggtaggggtttgggcgtgtatttttttggagaatggtgaataagggcggagaatggtttgcgaaatgagattgtttgggtaggttaatgaaggacggtcgcgggaggggaggcgtggttgggattacgcgcgaaaatatgtagttgttttattttagggggttattacggtcgcgtgtagggtgaacgggtaggtggttgtagtttttttattggtggtgatttgggaaaagggtgttgatcgtttagtcggcgggtaagatggtaggtggttggggag

SEQ ID NO: 24738 - DNA, 1109 bp, Artificial Sequence
  chemically treated genomic DNA (Homo sapiens) CpG-island No: 24738
  misc_feature (857)..(858): n is either a, c, g or t
  misc_feature (860)..(860): n is either a, c, g or t
  misc_feature (864)..(864): n is either a, c, g or t
  misc_feature (885)..(885): n is either a, c, g or t
ctccccaaccacctaccatcttacccgccgactaaacgatcaacacccttttcccaaatcaccaccaataaaaaaactacaaccacctacccgttcaccctacacgcgaccgtaataaccccctaaaataaaacaactacatattttcgcgcgtaatcccaaccacgcctcccctcccgcgaccgtccttcattaacctacccaaacaatctcatttcgcaaaccattctccgcccttattcaccattctccaaaaaaatacacgcccaaacccctacccgcaacatatatcgtaacacctacgcatcaaaaccgacccacaaacttaaaataacccgcgcaaacaaaaccttatccccccgacgtcccgttacccaacattcgcatattcctcacactccaataccaacgcccgataatactcgcccacaacaccgcgcactcccgactttcccattctccaaacaaaccaactatcaaaaataaccgcgacaatcttctaaacaatataaccccgattaccaaccgatccgcgaacacgtaccaataactataattcgataactatcccaacgccgcgtatctacaaatctcccgccaataaacccacgtcccgccccttccccccccccgcgctttaccgtcccgtcccatcgccgtcgtacatctaaacccgccgataccatcccatacgaaaccgcataaacacaatccgacgtaactaccgccacaaaccaaccccgtcgcgactataacgcccttaataccgcgcaacccaacctcgactacgtccgtcgcttcccccccgttaaccccttttccgcccaaatctaaccgattaatccaaacgaaacctnnanaccnataaatactttacccacgccnatttaaaccgcgctttacacgtacgtccgcgcacgataacccaccgatccaacaacataataacaatcgacccaataaaaaaatataaatacgcatccccctatccccccaccccccaacgcaaccccccgaatcgcccacaaccccctcgctaacccaacgccctcacaatatccaaaaacccccaaacacaatcacgacccgcgccctaccctaaaatcgac

SEQ ID NO: 24739 - DNA, 1109 bp, Artificial Sequence
  chemically treated genomic DNA (Homo sapiens) CpG-island No: 24739
  misc_feature (857)..(858): n is either a, c, g or t
  misc_feature (860)..(860): n is either a, c, g or t
  misc_feature (864)..(864): n is either a, c, g or t
  misc_feature (885)..(885): n is either a, c, g or t
ttttttagttatttattattttattcgtcggttaggcgattaatattttttttttaagttattattagtaaaggaattgtaattatttgttcgtttattttatacgcggtcgtaatagttttttaaagtaaggtaattatatgttttcgcgcgtagttttagttacgttttttttttcgcggtcgttttttattagtttatttaagtaattttatttcgtaaattatttttcgtttttatttattattttttaagggggtgtacgtttaagtttttattcgtagtatatatcgtagtatttacgtattaaagtcggtttataaatttgggatggttcgcgtaagtagggttttgttttttcggcgtttcgttgtttaatattcgtatgttttttatattttaatattagcgttcggtaatattcgtttataatatcgcgtattttcggtttttttattttttaggtaggttagttattaaaaataatcgcggtaattttttgggtagtataatttcggttgttaatcggttcgcgggtacgtgttagtaattgtggttcgatgattattttaacgtcgcgtgtttataggtttttcgttaataagtttacgtttcgtttttttttttttttcgcgttttgtcgtttcgttttatcgtcgtcgtgtatttggattcgtcggtattattttatacgaagtcgtataagtatagttcgacgtgattatcgttataggttaatttcgtcgcggttgtaacgtttttaatgtcgcgtagtttaatttcggttacgttcgtcgtttttttttcgttaatttttttttcgtttaggtttaatcgattagtttaggcgagatttnngngttngtgggtattttatttacgttnatttgagtcgcgttttgtacgtacgttcgcgtacggtagtttatcggtttagtaatataatagtagtcggtttaataaaaaaatataagtgcgtatttttttatttttttattttttagcgtagtttttcgggtcgtttataattttttcgttggtttaacgtttttatagtatttaaaaatttttaaatataattacggttcgcgttttattttgaaatcggt

SEQ ID NO: 24740 - DNA, 1109 bp, Artificial Sequence
  chemically treated genomic DNA (Homo sapiens) CpG-island No: 24740
  misc_feature (225)..(225): n is either a, c, g or t
  misc_feature (246)..(246): n is either a, c, g or t
  misc_feature (250)..(250): n is either a, c, g or t
  misc_feature (252)..(253): n is either a, c, g or t
accgatttcaaaataaaacgcgaaccgtaattatatttaaaaatttttaaatactataaaaacgttaaaccaacgaaaaaattataaacgacccgaaaaactacgctaaaaaataaaaaaataaaaaaatacgcacttatatttttttattaaaccgactactattatattactaaaccgataaactaccgtacgcgaacgtacgtacaaaacgcgactcaaatnaacgtaaataaaatacccacnaacncnnaaatctcgcctaaactaatcgattaaacctaaacgaaaaaaaaattaacgaaaaaaaaacgacgaacgtaaccgaaattaaactacgcgacattaaaaacgttacaaccgcgacgaaattaacctataacgataatcacgtcgaactatacttatacgacttcgtataaaataataccgacgaatccaaatacacgacgacgataaaacgaaacgacaaaacgcgaaaaaaaaaaaaaaacgaaacgtaaacttattaacgaaaaacctataaacacgcgacgttaaaataatcatcgaaccacaattactaacacgtacccgcgaaccgattaacaaccgaaattatactacccaaaaaattaccgcgattatttttaataactaacctacctaaaaaataaaaaaaccgaaaatacgcgatattataaacgaatattaccgaacgctaatattaaaatataaaaaacatacgaatattaaacaacgaaacgccgaaaaaacaaaaccctacttacgcgaaccatcccaaatttataaaccgactttaatacgtaaatactacgatatatactacgaataaaaacttaaacgtacacccccttaaaaaataataaataaaaacgaaaaataatttacgaaataaaattacttaaataaactaataaaaaacgaccgcgaaaaaaaaaacgtaactaaaactacgcgcgaaaacatataattaccttactttaaaaaactattacgaccgcgtataaaataaacgaacaaataattacaattcctttactaataataacttaaaaaaaaaatattaatcgcctaaccgacgaataaaataataaataactaaaaaa

SEQ ID NO: 24741 - DNA, 553 bp, Artificial Sequence
  chemically treated genomic DNA (Homo sapiens) CpG-island No: 24741
cgttttttgcgattcgtagttttttaattttaggttttgagtagttaatttcgggcggcgcgtttttttcggcggttggttcgggttagattttttacgttaattatttttgaagaggagtcggttcggttcgcgttgttatggcgatgggttgggcgtttcggcgttttttggagacgttaaggtcggtagggagtcggggaggggcgaatagagtttttttcgtttttttttttcgtttcggagggcgagagaggaaggggtcgttttcgtgtaggttcggcgggtaaggcgtttttagttagagcgagagtaacggaggcgacggttcggtatgacgagttttcgcggggattcggttattttagggtttgggcggttttcgttttgggttttgcggtttacgttttgcgtcggcgttgttatggtaatcgttgcgcgtttgggaagcgcgtttacgtcgattttttagtttcgtttttttggttcggcggggggcgtttagagaggatgttagatttagacggtagggatgggggtagagtcgtttaag

SEQ ID NO: 24742 - DNA, 553 bp, Artificial Sequence
  chemically treated genomic DNA (Homo sapiens) CpG-island No: 24742
cttaaacgactctacccccatccctaccgtctaaatctaacatcctctctaaacgccccccgccgaaccaaaaaaacgaaactaaaaaatcgacgtaaacgcgcttcccaaacgcgcaacgattaccataacaacgccgacgcaaaacgtaaaccgcaaaacccaaaacgaaaaccgcccaaaccctaaaataaccgaatccccgcgaaaactcgtcataccgaaccgtcgcctccgttactctcgctctaactaaaaacgccttacccgccgaacctacacgaaaacgaccccttcctctctcgccctccgaaacgaaaaaaaaaaacgaaaaaaactctattcgcccctccccgactccctaccgaccttaacgtctccaaaaaacgccgaaacgcccaacccatcgccataacaacgcgaaccgaaccgactcctcttcaaaaataattaacgtaaaaaatctaacccgaaccaaccgccgaaaaaaacgcgccgcccgaaattaactactcaaaacctaaaattaaaaaactacgaatcgcaaaaaacg

SEQ ID NO: 24743 - DNA, 553 bp, Artificial Sequence
  chemically treated genomic DNA (Homo sapiens) CpG-island No: 24743
tttgggcgattttgtttttatttttgtcgtttgggtttagtattttttttgggcgtttttcgtcgggttaggagggcggagttggagagtcggcgtgaacgcgttttttaggcgcgtagcggttattatggtagcgtcggcgtagagcgtagatcgtagggtttagggcggaggtcgtttaagttttggggtgatcgaattttcgcggggattcgttatgtcgggtcgtcgttttcgttgttttcgttttaattgggggcgttttgttcgtcgagtttgtacggaggcggtttttttttttttcgtttttcgaggcgggggaggggggcggggggggttttgttcgttttttttcggttttttgtcgattttggcgtttttaggaaacgtcggagcgtttagtttatcgttatggtaacgcgggtcgggtcggtttttttttagggatgattgacgtagggggtttggttcgggttaatcgtcggggagggcgcgtcgttcgggattaattgtttagggtttagagttgggaagttgcgggtcgtagggggcg

SEQ ID NO: 24744 - DNA, 553 bp, Artificial Sequence
  chemically treated genomic DNA (Homo sapiens) CpG-island No: 24744
cgccccctacgacccgcaacttcccaactctaaaccctaaacaattaatcccgaacgacgcgccctccccgacgattaacccgaaccaaaccccctacgtcaatcatccctaaaaaaaaaccgacccgacccgcgttaccataacgataaactaaacgctccgacgtttcctaaaaacgccaaaatcgacaaaaaaccgaaaaaaaacgaacaaaaccccccccgcccccctcccccgcctcgaaaaacgaaaaaaaaaaaaaccgcctccgtacaaactcgacgaacaaaacgcccccaattaaaacgaaaacaacgaaaacgacgacccgacataacgaatccccgcgaaaattcgatcaccccaaaacttaaacgacctccgccctaaaccctacgatctacgctctacgccgacgctaccataataaccgctacgcgcctaaaaaacgcgttcacgccgactctccaactccgccctcctaacccgacgaaaaacgcccaaaaaaaatactaaacccaaacgacaaaaataaaaacaaaatcgcccaaa

SEQ ID NO: 24745 - DNA, 1151 bp, Artificial Sequence
  chemically treated genomic DNA (Homo sapiens) CpG-island No: 24745
gttcgtttcggaaaatttcgttgatttcgatttttatgcgttcgtagtttcgcgtatttacgtttcgaggaggtttcgcgattttcgagattcgttcggggatttcgcgcgtttttttaaatttcgcgttttcgggtttcgcgcgttttcgttaatttcgcgatttttggagtcgtttcggtttcgttcgtttattttcgtttagcgtttttcgggtcgttcgttaatttttaatttcggcgattttttagggtttcgcgcgtttttcgttaatttcgtgtttttcgggggtcgcgcgttttcgttaatttcgcgatttttcgagcgcgtttaggttcgcgtttttcgtcgttcgcgtttacgtgtttcgcgcggtgttcgttcgcgtcggagtttacggaagagcgcggacgtcgagtttcgttttcggtttcgtatttatttttcgcgggtttggttgtcggagggtacggtcgaatttttgttttttttggcgtatatgttgttttacgtcgtcgtcgtcggggtttatatttgttaggcggcgtcgcgggtcgcgtttgtcgtcgttatagttatttcgcgtttcgggttttatcgtttcgagttttaggcgggtacggtaggtatcgttcgcgcgggggagttttagacggtcgcggcggcggcggtagcggcggttttagtttcggtttcggtcgtagggtggtttttttttttttttttttttcgcgcgggttgtttcgggaaacgcgcgttttttttttttcgtcgcgcgcgttttcgttcgttgtttttacgtcgttcgcgggcgtagtttttaaaggggcgatggcgggcgcgcgggtgggtttcgtcgtcggagcgcgtacgcgtagtgttcgtcgcggggggtgggggcgcggttatatattcgcgggttaggatttcggacggttatttagggacgtatagttgatcgcggttgtatacgcgcgcgtgtatatatacgtttatttattttaaatggagtcggttatttatattgttgtatatttagttatatatattcgtagcgatatttaatatagcgttttatatagtaaaagtgtatttcgttgttggaacgattgcggatagttttataaagttttaggtagtgatattgggtg

SEQ ID NO: 24746 - DNA, 1151 bp, Artificial Sequence
  chemically treated genomic DNA (Homo sapiens) CpG-island No: 24746
cacccaatatcactacctaaaactttataaaactatccgcaatcgttccaacaacgaaatacacttttactatataaaacgctatattaaatatcgctacgaatatatataactaaatatacaacaatataaataaccgactccatttaaaataaataaacgtatatatacacgcgcgcgtatacaaccgcgatcaactatacgtccctaaataaccgtccgaaatcctaacccgcgaatatataaccgcgcccccaccccccgcgacgaacactacgcgtacgcgctccgacgacgaaacccacccgcgcgcccgccatcgcccctttaaaaactacgcccgcgaacgacgtaaaaacaacgaacgaaaacgcgcgcgacgaaaaaaaaaaaacgcgcgtttcccgaaacaacccgcgcgaaaaaaaaaaaaaaaaaaaaaccaccctacgaccgaaaccgaaactaaaaccgccgctaccgccgccgccgcgaccgtctaaaactcccccgcgcgaacgatacctaccgtacccgcctaaaactcgaaacgataaaacccgaaacgcgaaataactataacgacgacaaacgcgacccgcgacgccgcctaacaaatataaaccccgacgacgacgacgtaaaacaacatatacgccaaaaaaaacaaaaattcgaccgtaccctccgacaaccaaacccgcgaaaaataaatacgaaaccgaaaacgaaactcgacgtccgcgctcttccgtaaactccgacgcgaacgaacaccgcgcgaaacacgtaaacgcgaacgacgaaaaacgcgaacctaaacgcgctcgaaaaatcgcgaaattaacgaaaacgcgcgacccccgaaaaacacgaaattaacgaaaaacgcgcgaaaccctaaaaaatcgccgaaattaaaaattaacgaacgacccgaaaaacgctaaacgaaaataaacgaacgaaaccgaaacgactccaaaaatcgcgaaattaacgaaaacgcgcgaaacccgaaaacgcgaaatttaaaaaaacgcgcgaaatccccgaacgaatctcgaaaatcgcgaaacctcctcgaaacgtaaatacgcgaaactacgaacgcataaaaatcgaaatcaacgaaattttccgaaacgaac

SEQ ID NO: 24747 - DNA, 1151 bp, Artificial Sequence
  chemically treated genomic DNA (Homo sapiens) CpG-island No: 24747
tatttaatgttattgtttgaggttttatggggttattcgtagtcgttttagtagcggggtatatttttgttgtgtggagcgttatgttgagtgtcgttgcgaatgtgtgtggttgggtgtataataatgtgggtggtcggttttatttgaggtgagtgaacgtgtgtgtgtacgcgcgcgtgtgtagtcgcgattagttgtgcgtttttgggtggtcgttcgggattttgattcgcgagtgtgtagtcgcgtttttatttttcgcggcgggtattgcgcgtgcgcgtttcggcggcgggatttattcgcgcgttcgttatcgtttttttaagagttgcgttcgcgggcggcgtagaggtagcgggcgggggcgcgcgcggcgggaggaggggagcgcgcgtttttcggaatagttcgcgcggaggaaagggaggaaaaaaagttattttgcggtcggggtcggagttggagtcgtcgttgtcgtcgtcgtcgcggtcgtttggagttttttcgcgcggacgatgtttgtcgtgttcgtttggggttcggggcggtgaggttcggggcgcggggtagttatggcgacggtaagcgcggttcgcggcgtcgtttgataggtgtgggtttcggcggcggcggcgtggagtagtatgtacgttaaggggggtaagggttcggtcgtgtttttcgatagttaggttcgcgagaagtgagtgcggggtcgggggcggggttcggcgttcgcgttttttcgtgggtttcggcgcgggcgggtatcgcgcggggtacgtgggcgcgggcggcggggagcgcgagtttgagcgcgttcgaggggtcgcgagattggcgggggcgcgcgattttcgaggggtacgagattggcggggggcgcgcgagattttgaggggtcgtcggagttgagggttggcgggcgattcgaggggcgttagacgggagtggacgggcgagatcggagcggttttaggggtcgcgagattggcgggggcgcgcgaaattcgagggcgcgagatttgagggggcgcgcgagattttcgagcgggtttcgggggtcgcgaggttttttcgagacgtgggtgcgcgaggttgcggacgtatggggatcgaggttagcgaagtttttcgggacgaat

SEQ ID NO: 24748 - DNA, 1151 bp, Artificial Sequence
  chemically treated genomic DNA (Homo sapiens) CpG-island No: 24748
attcgtcccgaaaaacttcgctaacctcgatccccatacgtccgcaacctcgcgcacccacgtctcgaaaaaacctcgcgacccccgaaacccgctcgaaaatctcgcgcgccccctcaaatctcgcgccctcgaatttcgcgcgcccccgccaatctcgcgacccctaaaaccgctccgatctcgcccgtccactcccgtctaacgcccctcgaatcgcccgccaaccctcaactccgacgacccctcaaaatctcgcgcgccccccgccaatctcgtacccctcgaaaatcgcgcgcccccgccaatctcgcgacccctcgaacgcgctcaaactcgcgctccccgccgcccgcgcccacgtaccccgcgcgatacccgcccgcgccgaaacccacgaaaaaacgcgaacgccgaaccccgcccccgaccccgcactcacttctcgcgaacctaactatcgaaaaacacgaccgaacccttaccccccttaacgtacatactactccacgccgccgccgccgaaacccacacctatcaaacgacgccgcgaaccgcgcttaccgtcgccataactaccccgcgccccgaacctcaccgccccgaaccccaaacgaacacgacaaacatcgtccgcgcgaaaaaactccaaacgaccgcgacgacgacgacaacgacgactccaactccgaccccgaccgcaaaataactttttttcctccctttcctccgcgcgaactattccgaaaaacgcgcgctcccctcctcccgccgcgcgcgcccccgcccgctacctctacgccgcccgcgaacgcaactcttaaaaaaacgataacgaacgcgcgaataaatcccgccgccgaaacgcgcacgcgcaatacccgccgcgaaaaataaaaacgcgactacacactcgcgaatcaaaatcccgaacgaccacccaaaaacgcacaactaatcgcgactacacacgcgcgcgtacacacacacgttcactcacctcaaataaaaccgaccacccacattattatacacccaaccacacacattcgcaacgacactcaacataacgctccacacaacaaaaatataccccgctactaaaacgactacgaataaccccataaaacctcaaacaataacattaaata

SEQ ID NO: 24749 - DNA, 761 bp, Artificial Sequence
  chemically treated genomic DNA (Homo sapiens) CpG-island No: 24749
tgcgttgtttgtcggtgtggcggcgattgttggtttggtcggattcggggggcgtggttagtcgcgttttatgaataatgtagcgcgttagcgggcggcggggcggggcgtggtcggcgtggcggcgttggagtcgggaagggggcgcgggggagagatggtcgtaagatggcggcgttgaaggaggataggagttacgggttgtcgtgcgggcgggttagcgacggtagtaaggtgtcggtgttttacgtgaagtttatcgatagtgttttgagggttttcgagagttatcgcgttagataggtgagtggtatggcgttcggcgcgttagtggggaacgttcggacgcgggtcggtttcgcgttttttttattgaggcgttcgggttcggagacgttaggtttgtggtgttgttcgcgggtttttgggtcggcggggcgcggagtgggcgttagttcggtttggagcgttgagaatcgcgtttttttttagtattaggaggtaatataggcgggtggttcggggttgttgaggggtttagattcgcgcgtcgggttcggggggcgtcggtgtcggtatttggcggcgttcggggtttttttggtttgttgggtatttgggtagggtttagtttgcgtatttggcggcggggcgaggaggcggtgggtcgtacggtttcggtatcgtgatagggggaagttgggggtttttttatttggggtcggggtagcgtcgttggtgggggtgattgtgtttgtttt

SEQ ID NO: 24750 - DNA, 761 bp, Artificial Sequence
  chemically treated genomic DNA (Homo sapiens) CpG-island No: 24750
aaaacaaacacaatcacccccaccaacgacgctaccccgaccccaaataaaaaaacccccaacttccccctatcacgataccgaaaccgtacgacccaccgcctcctcgccccgccgccaaatacgcaaactaaaccctacccaaatacccaacaaaccaaaaaaaccccgaacgccgccaaataccgacaccgacgccccccgaacccgacgcgcgaatctaaacccctcaacaaccccgaaccacccgcctatattacctcctaatactaaaaaaaaacgcgattctcaacgctccaaaccgaactaacgcccactccgcgccccgccgacccaaaaacccgcgaacaacaccacaaacctaacgtctccgaacccgaacgcctcaataaaaaaaacgcgaaaccgacccgcgtccgaacgttccccactaacgcgccgaacgccataccactcacctatctaacgcgataactctcgaaaaccctcaaaacactatcgataaacttcacgtaaaacaccgacaccttactaccgtcgctaacccgcccgcacgacaacccgtaactcctatcctccttcaacgccgccatcttacgaccatctctcccccgcgcccccttcccgactccaacgccgccacgccgaccacgccccgccccgccgcccgctaacgcgctacattattcataaaacgcgactaaccacgccccccgaatccgaccaaaccaacaatcgccgccacaccgacaaacaacgca

SEQ ID NO: 24751 - DNA, 761 bp, Artificial Sequence
  chemically treated genomic DNA (Homo sapiens) CpG-island No: 24751
aggatagatatagttatttttattaacggcgttgtttcggttttagatggaaaagtttttagtttttttttattacggtgtcgggatcgtgcggtttatcgttttttcgtttcgtcgttaggtgcgtaaattggattttgtttaggtgtttagtaggttagaaaggtttcggacgtcgttaggtgtcgatatcgacgtttttcgggttcggcgcgcgagtttgggttttttagtagtttcgggttattcgtttgtattgttttttagtgttgagaaggaacgcggtttttagcgttttaggtcggattggcgtttatttcgcgtttcgtcggtttagggattcgcgagtagtattatagatttagcgttttcgagttcggacgttttagtgaggggagcgcgaggtcggttcgcgttcggacgttttttattggcgcgtcgggcgttatgttatttatttgtttggcgcggtagttttcgaaggtttttagggtattgtcggtgagttttacgtggaatatcgatattttgttgtcgtcgttaattcgttcgtacgatagttcgtagtttttatttttttttagcgtcgttattttgcgattatttttttttcgcgtttttttttcggttttagcgtcgttacgtcggttacgtttcgtttcgtcgttcgttgacgcgttgtattatttatgagacgcggttggttacgtttttcgagttcgattaaattaatagtcgtcgttatatcggtaggtagcgta

SEQ ID NO: 24752 - DNA, 761 bp, Artificial Sequence
  chemically treated genomic DNA (Homo sapiens) CpG-island No: 24752
tacgctacctaccgatataacgacgactattaatttaatcgaactcgaaaaacgtaaccaaccgcgtctcataaataatacaacgcgtcaacgaacgacgaaacgaaacgtaaccgacgtaacgacgctaaaaccgaaaaaaaaacgcgaaaaaaaaataatcgcaaaataacgacgctaaaaaaaaataaaaactacgaactatcgtacgaacgaattaacgacgacaacaaaatatcgatattccacgtaaaactcaccgacaataccctaaaaaccttcgaaaactaccgcgccaaacaaataaataacataacgcccgacgcgccaataaaaaacgtccgaacgcgaaccgacctcgcgctcccctcactaaaacgtccgaactcgaaaacgctaaatctataatactactcgcgaatccctaaaccgacgaaacgcgaaataaacgccaatccgacctaaaacgctaaaaaccgcgttccttctcaacactaaaaaacaatacaaacgaataacccgaaactactaaaaaacccaaactcgcgcgccgaacccgaaaaacgtcgatatcgacacctaacgacgtccgaaacctttctaacctactaaacacctaaacaaaatccaatttacgcacctaacgacgaaacgaaaaaacgataaaccgcacgatcccgacaccgtaataaaaaaaaactaaaaacttttccatctaaaaccgaaacaacgccgttaataaaaataactatatctatcct

SEQ ID NO: 24753 - DNA, 610 bp, Artificial Sequence
  chemically treated genomic DNA (Homo sapiens) CpG-island No: 24753
gtatttttcgggtcgtttttttcgaggggtttttcgaggtttttcgtttttatcgggttttgtttcggttgttttcgacggcgttaggtcgtgggacgtgatacgatcgttgcggcgttagtttagttttgtaagattttaggcgttcgcgttgtatttgcgattgtcgtcgtcgtcgtcgtagtcggattaattgttggtagaattttcgttcgtacggttttagttggagttgtatttgcggtcgtaagtcgttagggggcgtcgtagagcgcgtgcgcgtaacggggatttattgtttcgttcgggttcgggcgttgttgtcgtaggtatacggttcgcgcgtcgttggaagatttgggttgggtcgattgggtgttgtcgttacgggaggtgtaagtgattatgtgtatcggcgcgtgttcgagttagtttcgggcggtaaatatgtacgcgtagattaagacgagtttgtatcgtttgaagttcgatacggtgttagcgttttgttgcgtgttcgttagttataattttatggtgtttatttaaaagatcgatatcggggtgtcgttttagatttatgatgatttgttagttaaagattgttatt

SEQ ID NO: 24754 - DNA, 610 bp, Artificial Sequence
  chemically treated genomic DNA (Homo sapiens) CpG-island No: 24754
aataacaatctttaactaacaaatcatcataaatctaaaacgacaccccgatatcgatcttttaaataaacaccataaaattataactaacgaacacgcaacaaaacgctaacaccgtatcgaacttcaaacgatacaaactcgtcttaatctacgcgtacatatttaccgcccgaaactaactcgaacacgcgccgatacacataatcacttacacctcccgtaacgacaacacccaatcgacccaacccaaatcttccaacgacgcgcgaaccgtatacctacgacaacaacgcccgaacccgaacgaaacaataaatccccgttacgcgcacgcgctctacgacgccccctaacgacttacgaccgcaaatacaactccaactaaaaccgtacgaacgaaaattctaccaacaattaatccgactacgacgacgacgacgacaatcgcaaatacaacgcgaacgcctaaaatcttacaaaactaaactaacgccgcaacgatcgtatcacgtcccacgacctaacgccgtcgaaaacaaccgaaacaaaacccgataaaaacgaaaaacctcgaaaaacccctcgaaaaaaacgacccgaaaaatac

SEQ ID NO: 24755 - DNA, 610 bp, Artificial Sequence
  chemically treated genomic DNA (Homo sapiens) CpG-island No: 24755
agtggtagtttttggttaataagttattataggtttggagcgatatttcggtgtcggttttttgaatgagtattatgggattgtagttggcgggtacgtagtagggcgttggtatcgtgtcgggttttaggcggtgtaggttcgttttgatttgcgcgtgtatgtttgtcgttcggaattggttcgggtacgcgtcgatgtatatggttatttgtatttttcgtggcgatagtatttaatcggtttagtttaggttttttagcgacgcgcggatcgtgtgtttacggtaataacgttcgggttcgagcgggatagtgggttttcgttgcgcgtacgcgttttgcggcgttttttggcggtttgcggtcgtaagtgtaattttagttggggtcgtgcggacgaagattttgttagtagttggttcgattgcgacggcggcggcgatagtcgtaggtgtagcgcgggcgtttggggttttgtaaggttgagttgacgtcgtagcggtcgtgttacgttttacgatttgacgtcgtcggggatagtcggaatagagttcggtgaaggcgggaggtttcggggagtttttcgggaagggcggttcgagagatat

SEQ ID NO: 24756 - DNA, 610 bp, Artificial Sequence
  chemically treated genomic DNA (Homo sapiens) CpG-island No: 24756
atatctctcgaaccgcccttcccgaaaaactccccgaaacctcccgccttcaccgaactctattccgactatccccgacgacgtcaaatcgtaaaacgtaacacgaccgctacgacgtcaactcaaccttacaaaaccccaaacgcccgcgctacacctacgactatcgccgccgccgtcgcaatcgaaccaactactaacaaaatcttcgtccgcacgaccccaactaaaattacacttacgaccgcaaaccgccaaaaaacgccgcaaaacgcgtacgcgcaacgaaaacccactatcccgctcgaacccgaacgttattaccgtaaacacacgatccgcgcgtcgctaaaaaacctaaactaaaccgattaaatactatcgccacgaaaaatacaaataaccatatacatcgacgcgtacccgaaccaattccgaacgacaaacatacacgcgcaaatcaaaacgaacctacaccgcctaaaacccgacacgataccaacgccctactacgtacccgccaactacaatcccataatactcattcaaaaaaccgacaccgaaatatcgctccaaacctataataacttattaaccaaaaactaccact

SEQ ID NO: 24757 - DNA, 546 bp, Artificial Sequence
  chemically treated genomic DNA (Homo sapiens) CpG-island No: 24757
gtcgggtcggttttttgagatttcggcgtagtgtcggttagtgggtgttgtcgttgttttttatattaacgcgtagtcgaatttgttcgcgttcgagcgtttttttgtggtcgtgtttaggacgatgcgggtatgttgtgtttgtaggggtcgagtaggatgcgtacgtagttgtattattaatagtattagtattacgagtaggtagagtacgaagtgcgaatatcgtgttgtttgtttcgcgtttagtgttttgcgtttatcggggtgtttcgtcgacggttgtgtagtggtgtttttgtgttgatatgttgtttacgtcgcgtttatggtttatatcgtcgcgttgttttgcggaggagtgggattcgtttttgggcgtcggggatgaggtttgttgttttttttttcgcgtttttttcgtttcgtttttttatagttgcgatagtcgcgatttttttaacgtgtcgataataatttttagatagagtttcggtaacgcggataagtttatattaagtttagttaaatataagtaataataaa

SEQ ID NO: 24758 - DNA, 546 bp, Artificial Sequence
  chemically treated genomic DNA (Homo sapiens) CpG-island No: 24758
tttattattacttatatttaactaaacttaatataaacttatccgcgttaccgaaactctatctaaaaattattatcgacacgttaaaaaaatcgcgactatcgcaactataaaaaaacgaaacgaaaaaaacgcgaaaaaaaaaacaacaaacctcatccccgacgcccaaaaacgaatcccactcctccgcaaaacaacgcgacgatataaaccataaacgcgacgtaaacaacatatcaacacaaaaacaccactacacaaccgtcgacgaaacaccccgataaacgcaaaacactaaacgcgaaacaaacaacacgatattcgcacttcgtactctacctactcgtaatactaatactattaataatacaactacgtacgcatcctactcgacccctacaaacacaacatacccgcatcgtcctaaacacgaccacaaaaaaacgctcgaacgcgaacaaattcgactacgcgttaatataaaaaacaacgacaacacccactaaccgacactacgccgaaatctcaaaaaaccgacccgac

SEQ ID NO: 24759 - DNA, 546 bp, Artificial Sequence
  chemically treated genomic DNA (Homo sapiens) CpG-island No: 24759
tttgttgttgtttgtatttggttgggtttggtatgggtttattcgcgttatcggagttttgtttggggattgttatcggtacgttaagggagtcgcggttgtcgtagttatgagggggcgaagcggaggaggcgcgggagggagggtagtaagttttattttcggcgtttaggggcgggttttattttttcgtagggtagcgcggcgatgtgagttatgagcgcgacgtggatagtatgttagtataggagtattattgtatagtcgtcgacggggtatttcggtgggcgtagggtattggacgcggagtaagtagtacggtgttcgtatttcgtgttttgtttgttcgtggtgttggtgttgttgatggtgtagttgcgtgcgtattttgttcgatttttataagtatagtatgttcgtatcgttttggatacgattataaggaggcgttcgagcgcgggtaagttcgattacgcgttggtgtgaggggtagcggtagtatttattagtcggtattgcgtcggggttttagagggtcggttcggt

SEQ ID NO: 24760 - DNA, 546 bp, Artificial Sequence
  chemically treated genomic DNA (Homo sapiens) CpG-island No: 24760
accgaaccgaccctctaaaaccccgacgcaataccgactaataaatactaccgctacccctcacaccaacgcgtaatcgaacttacccgcgctcgaacgcctccttataatcgtatccaaaacgatacgaacatactatacttataaaaatcgaacaaaatacgcacgcaactacaccatcaacaacaccaacaccacgaacaaacaaaacacgaaatacgaacaccgtactacttactccgcgtccaataccctacgcccaccgaaataccccgtcgacgactatacaataatactcctatactaacatactatccacgtcgcgctcataactcacatcgccgcgctaccctacgaaaaaataaaacccgcccctaaacgccgaaaataaaacttactaccctccctcccgcgcctcctccgcttcgccccctcataactacgacaaccgcgactcccttaacgtaccgataacaatccccaaacaaaactccgataacgcgaataaacccataccaaacccaaccaaatacaaacaacaacaaa

SEQ ID NO: 24761 - DNA, 553 bp, Artificial Sequence
  chemically treated genomic DNA (Homo sapiens) CpG-island No: 24761
  misc_feature (37)..(37): n is either a, c, g or t
  misc_feature (67)..(67): n is either a, c, g or t
  misc_feature (506)..(506): n is either a, c, g or t
  misc_feature (511)..(511): n is either a, c, g or t
  misc_feature (547)..(547): n is either a, c, g or t
tagcggattgtcgcgattagtagatagacgatcgtangagatcgttatatacgttatttttttagangacgtgggggtacgcgtttgacgtttttttcggtgggcgtttcggttttggatgcgatgttgtaatcgcgttggtttttttaaagcgggggggggtatatttttataaaacgttaagttttcgttttttagtaagtattttttagtttgcgtacgtaaatagttacgtgttattaagcgagggttttattcgtgtggagtattcgttagtattaacgtttttttttaaaaggatgagagtttttttttgtttttacgacgtggtttttttttttatcgaaaaggtgtcgttcgtatttagcgttggtttatgtgggtttttttttttcggtaggacgatcgattatcgtacgtatcgagggttgagcgattgttttttcgtgtgaagggggtttttatcgatggttgtacgtttcgatatagttggttagttatcgagntgttncgagggaggaaatttaaatttttatgggtagagcgntttata

SEQ ID NO: 24762 - DNA, 553 bp, Artificial Sequence
  chemically treated genomic DNA (Homo sapiens) CpG-island No: 24762
  misc_feature (7)..(7): n is either a, c, g or t
  misc_feature (43)..(43): n is either a, c, g or t
  misc_feature (48)..(48): n is either a, c, g or t
  misc_feature (487)..(487): n is either a, c, g or t
  misc_feature (517)..(517): n is either a, c, g or t
tataaancgctctacccataaaaatttaaatttcctccctcgnaacanctcgataactaaccaactatatcgaaacgtacaaccatcgataaaaacccccttcacacgaaaaaacaatcgctcaaccctcgatacgtacgataatcgatcgtcctaccgaaaaaaaaaaacccacataaaccaacgctaaatacgaacgacaccttttcgataaaaaaaaaaaccacgtcgtaaaaacaaaaaaaaactctcatccttttaaaaaaaaacgttaatactaacgaatactccacacgaataaaaccctcgcttaataacacgtaactatttacgtacgcaaactaaaaaatacttactaaaaaacgaaaacttaacgttttataaaaatatacccccccccgctttaaaaaaaccaacgcgattacaacatcgcatccaaaaccgaaacgcccaccgaaaaaaacgtcaaacgcgtacccccacgtcntctaaaaaaataacgtatataacgatctcntacgatcgtctatctactaatcgcgacaatccgcta

SEQ ID NO: 24763 - DNA, 553 bp, Artificial Sequence
  chemically treated genomic DNA (Homo sapiens) CpG-island No: 24763
  misc_feature (7)..(7): n is either a, c, g or t
  misc_feature (43)..(43): n is either a, c, g or t
  misc_feature (48)..(48): n is either a, c, g or t
  misc_feature (487)..(487): n is either a, c, g or t
  misc_feature (517)..(517): n is either a, c, g or t
tgtgagncgttttatttatagaaatttagattttttttttcgngatanttcgatagttagttagttatgtcgggacgtatagttatcgatagagattttttttatacggagagatagtcgtttagttttcggtgcgtgcgatagtcggtcgttttatcgaaggagagaggtttatatgggttaacgttaggtgcggacggtattttttcggtggggggagggattacgtcgtgggggtagggagaaatttttatttttttgaggggagacgttggtgttagcggatgttttatacgagtgggattttcgtttggtggtacgtggttgtttgcgtacgtaaattagagagtatttattgggagacgagagtttagcgttttgtgggagtatgttttttttcgttttgagggaattaacgcgattgtaatatcgtatttaagatcgggacgtttatcgaggggggcgttaagcgcgtgtttttacgttntttggaggaatggcgtgtgtaacggttttntacggtcgtttatttattaatcgcgataattcgtta

SEQ ID NO: 24764 - DNA, 553 bp, Artificial Sequence
  chemically treated genomic DNA (Homo sapiens) CpG-island No: 24764
  misc_feature (37)..(37): n is either a, c, g or t
  misc_feature (67)..(67): n is either a, c, g or t
  misc_feature (506)..(506): n is either a, c, g or t
  misc_feature (511)..(511): n is either a, c, g or t
  misc_feature (547)..(547): n is either a, c, g or t
taacgaattatcgcgattaataaataaacgaccgtanaaaaccgttacacacgccattcctccaaanaacgtaaaaacacgcgcttaacgcccccctcgataaacgtcccgatcttaaatacgatattacaatcgcgttaattccctcaaaacgaaaaaaaacatactcccacaaaacgctaaactctcgtctcccaataaatactctctaatttacgtacgcaaacaaccacgtaccaccaaacgaaaatcccactcgtataaaacatccgctaacaccaacgtctcccctcaaaaaaataaaaatttctccctacccccacgacgtaatccctccccccaccgaaaaaataccgtccgcacctaacgttaacccatataaacctctctccttcgataaaacgaccgactatcgcacgcaccgaaaactaaacgactatctctccgtataaaaaaaatctctatcgataactatacgtcccgacataactaactaactatcgaantatcncgaaaaaaaaaatctaaatttctataaataaaacgnctcaca

SEQ ID NO: 24765 - DNA, 621 bp, Artificial Sequence
  chemically treated genomic DNA (Homo sapiens) CpG-island No: 24765
tagagttgaagcgagttaagtagacgttggtcggggagagggaggcggtgcgttgttcgttttgtgttttcgtttcggagtttagtaggggcgttcggggcgtggtggttttgggcggaggagcgtattatttggttttcggatggtcgttcggagcgatatcgcgtcgggttcgaggttggaagttaggagtaggagtcggagtaagacgtttcggattaaatttatttcgtagtcggcgtttgtaaagttttattaagtttcgggcgtatacggaaagggcgttttcgggggcgcgtgggggacgcggttttaacggattttcgggtcggggcgaggaggtggggggttgcgagggttgggttcggaaatacgggtagttttaagaggtaggattgtagtcgggaggtcggcgtgcgcgagtgaagtcggttgtaagttgtagggtttttcgcgggggcgggggcgacgaaggaggtcgattgggagggaagggttggtcgcgggagggagggaggttcgatcggttcggggatgaaattataatcgagtggaagtgagagggataggttttgaaatttttatttttcgtttatttcggaagtagatagttcgtttttt

SEQ ID NO: 24766 - DNA, 621 bp, Artificial Sequence
  chemically treated genomic DNA (Homo sapiens) CpG-island No: 24766
aaaaaacgaactatctacttccgaaataaacgaaaaataaaaatttcaaaacctatccctctcacttccactcgattataatttcatccccgaaccgatcgaacctccctccctcccgcgaccaacccttccctcccaatcgacctccttcgtcgcccccgcccccgcgaaaaaccctacaacttacaaccgacttcactcgcgcacgccgacctcccgactacaatcctacctcttaaaactacccgtatttccgaacccaaccctcgcaaccccccacctcctcgccccgacccgaaaatccgttaaaaccgcgtcccccacgcgcccccgaaaacgccctttccgtatacgcccgaaacttaataaaactttacaaacgccgactacgaaataaatttaatccgaaacgtcttactccgactcctactcctaacttccaacctcgaacccgacgcgatatcgctccgaacgaccatccgaaaaccaaataatacgctcctccgcccaaaaccaccacgccccgaacgcccctactaaactccgaaacgaaaacacaaaacgaacaacgcaccgcctccctctccccgaccaacgtctacttaactcgcttcaactcta

SEQ ID NO: 24767 - DNA, 621 bp, Artificial Sequence
  chemically treated genomic DNA (Homo sapiens) CpG-island No: 24767
gaggggcgggttgtttgttttcgaggtgggcgaggagtgaaggttttagggtttgttttttttatttttattcgattgtaattttattttcgggtcggtcgagtttttttttttttcgcggttagttttttttttttagtcggtttttttcgtcgttttcgttttcgcgaaaagttttgtagtttgtagtcggttttattcgcgtacgtcgatttttcggttgtagttttattttttggaattattcgtgttttcgggtttagttttcgtagttttttattttttcgtttcggttcggggattcgttggggtcgcgttttttacgcgttttcggagacgtttttttcgtgtgcgttcgggatttggtgaaattttgtaggcgtcggttgcgaaatggatttaattcgaggcgttttgtttcggtttttgtttttggtttttagtttcggattcggcgcggtgtcgtttcgagcggttattcgaaaattaggtaatgcgttttttcgtttagagttattacgtttcgagcgtttttgttgggtttcggggcgaggatatagagcgggtagcgtatcgttttttttttttcgattaacgtttgtttaattcgttttagttttg

SEQ ID NO: 24768 - DNA, 621 bp, Artificial Sequence
  chemically treated genomic DNA (Homo sapiens) CpG-island No: 24768
caaaactaaaacgaattaaacaaacgttaatcgaaaaaaaaaaaacgatacgctacccgctctatatcctcgccccgaaacccaacaaaaacgctcgaaacgtaataactctaaacgaaaaaacgcattacctaattttcgaataaccgctcgaaacgacaccgcgccgaatccgaaactaaaaaccaaaaacaaaaaccgaaacaaaacgcctcgaattaaatccatttcgcaaccgacgcctacaaaatttcaccaaatcccgaacgcacacgaaaaaaacgtctccgaaaacgcgtaaaaaacgcgaccccaacgaatccccgaaccgaaacgaaaaaataaaaaactacgaaaactaaacccgaaaacacgaataattccaaaaaataaaactacaaccgaaaaatcgacgtacgcgaataaaaccgactacaaactacaaaacttttcgcgaaaacgaaaacgacgaaaaaaaccgactaaaaaaaaaaaactaaccgcgaaaaaaaaaaaaactcgaccgacccgaaaataaaattacaatcgaataaaaataaaaaaaacaaaccctaaaaccttcactcctcgcccacctcgaaaacaaacaacccgcccctc

SEQ ID NO: 24769 - DNA, 821 bp, Artificial Sequence
  chemically treated genomic DNA (Homo sapiens) CpG-island No: 24769
gattacgcgtagatcgagggtatacggtggcgtgcgtgtgtatttattttatgggcgtagattggttacggggattcgtgcgcgcgttgtcggttattcggatttgaaattatgtttcgttatttatattgggtttttacgttattgggtgttgtgaatagcgattcgttagtggttgttatgtattatttcgttacgtatgacgaacggtcgtttatcggcgaggtcgacggggttcgtcggtatttgttacgaggatttgacgtatagtgattggaaggtcgtaaacggtagttattattgttttatcggttatgacgtagacgtcgacgtgatttatcggtatgtaaaattatggaatggttgttaggacgcgttttcgatcgaaaggacgtatttcgtaatcggggcgaagcggtattgcgtgttgtatttttcgcgtaattttgtatttttgtcgtggttattacggttttacggtatttttgtatattgtcggattcgtttgtatattgaaacgttttattgtgtcgtaaggggatgttgtcgataagttagaacgatttcgttgaatttcgttattttttgtttgcgtaaatattttattatttacgatcgtggtcgaatttttttaatcgtttataatttttttcgcgcgtgattatttaatattttgcgtatcgtaatttttaattaacgttttattatcgggacgcgattgcgtgttggttagtattgtataagtatgtacgtttttggtttttggttacggggttgtcgtgaatacgggtgtgaaataaaaataggaaatttttgttaaa

SEQ ID NO: 24770 - DNA, 821 bp, Artificial Sequence
  chemically treated genomic DNA (Homo sapiens) CpG-island No: 24770
tttaacaaaaatttcctatttttatttcacacccgtattcacgacaaccccgtaaccaaaaaccaaaaacgtacatacttatacaatactaaccaacacgcaatcgcgtcccgataataaaacgttaattaaaaattacgatacgcaaaatattaaataatcacgcgcgaaaaaaattataaacgattaaaaaaattcgaccacgatcgtaaataataaaatatttacgcaaacaaaaaataacgaaattcaacgaaatcgttctaacttatcgacaacatccccttacgacacaataaaacgtttcaatatacaaacgaatccgacaatatacaaaaataccgtaaaaccgtaataaccacgacaaaaatacaaaattacgcgaaaaatacaacacgcaataccgcttcgccccgattacgaaatacgtcctttcgatcgaaaacgcgtcctaacaaccattccataattttacataccgataaatcacgtcgacgtctacgtcataaccgataaaacaataataactaccgtttacgaccttccaatcactatacgtcaaatcctcgtaacaaataccgacgaaccccgtcgacctcgccgataaacgaccgttcgtcatacgtaacgaaataatacataacaaccactaacgaatcgctattcacaacacccaataacgtaaaaacccaatataaataacgaaacataatttcaaatccgaataaccgacaacgcgcgcacgaatccccgtaaccaatctacgcccataaaataaatacacacgcacgccaccgtataccctcgatctacgcgtaatc

SEQ ID NO: 24771 - DNA, 821 bp, Artificial Sequence
  chemically treated genomic DNA (Homo sapiens) CpG-island No: 24771
tttagtaaaagttttttgtttttattttatattcgtatttacggtaatttcgtagttaagggttaggggcgtgtatatttatgtagtattggttagtacgtagtcgcgtttcggtaataaagcgttaattaggggttacggtacgtagggtattggatagttacgcgcgggggaggttatgagcggttggaggagttcggttacggtcgtaagtggtaaggtatttgcgtaagtagggggtggcggggtttaacggggtcgttttaatttgtcggtagtatttttttgcggtatagtagggcgttttagtgtgtaggcgggttcggtagtgtataggggtatcgtaaggtcgtggtggttacggtaaaggtgtagggttacgcgggggatgtagtacgtaatgtcgtttcgtttcggttgcggggtgcgttttttcggtcgggggcgcgttttagtaattattttataattttgtatatcggtaggttacgtcggcgtttgcgttatggtcggtaaggtagtaatggttatcgtttgcggttttttagttattgtacgttaggttttcgtggtaggtgtcggcgggtttcgtcggtttcgtcggtgggcggtcgttcgttatgcgtagcggggtagtgtatggtaattattagcgggtcgttgtttatagtatttagtggcgtaaaggtttagtgtaagtaacggggtataattttaggttcgggtggtcggtaacgcgcgtacgggttttcgtagttagtttgcgtttataaagtaaatgtatacgtacgttatcgtgtattttcggtttacgcgtaatt

SEQ ID NO: 24772 - DNA, 821 bp, Artificial Sequence
  chemically treated genomic DNA (Homo sapiens) CpG-island No: 24772
aattacgcgtaaaccgaaaatacacgataacgtacgtatacatttactttataaacgcaaactaactacgaaaacccgtacgcgcgttaccgaccacccgaacctaaaattataccccgttacttacactaaacctttacgccactaaatactataaacaacgacccgctaataattaccatacactaccccgctacgcataacgaacgaccgcccaccgacgaaaccgacgaaacccgccgacacctaccacgaaaacctaacgtacaataactaaaaaaccgcaaacgataaccattactaccttaccgaccataacgcaaacgccgacgtaacctaccgatatacaaaattataaaataattactaaaacgcgcccccgaccgaaaaaacgcaccccgcaaccgaaacgaaacgacattacgtactacatcccccgcgtaaccctacacctttaccgtaaccaccacgaccttacgatacccctatacactaccgaacccgcctacacactaaaacgccctactataccgcaaaaaaatactaccgacaaattaaaacgaccccgttaaaccccgccaccccctacttacgcaaataccttaccacttacgaccgtaaccgaactcctccaaccgctcataacctcccccgcgcgtaactatccaataccctacgtaccgtaacccctaattaacgctttattaccgaaacgcgactacgtactaaccaatactacataaatatacacgcccctaacccttaactacgaaattaccgtaaatacgaatataaaataaaaacaaaaaacttttactaaa

SEQ ID NO: 24773 - DNA, 959 bp, Artificial Sequence
  chemically treated genomic DNA (Homo sapiens) CpG-island No: 24773
  misc_feature (695)..(695): n is either a, c, g or t
tattggtattaggtgcgttagttcgcgattttatgttcgtttgtatcgtcgatgcggattttgttgtcgtttgtttgtttttggttaagttaatcgttgtttcgcgtttttcgttttgtatcgttcgtggagaataaacgttttttgtttatggcgaatgacgcgattatttgtaaattgcgaaacgttcgattatggtcgagcgtatagatggttttagtacgttggttttgttattgtcgttggtatttattagaaagttaaagcgggagataaggcgagattcgcggttttaatgttgcggaaatcgcggattataagcgggtgagggatattatagttttattggtatgataatataagttcgttttggttggtcgtatttttaatttgtacgttggaaatcgaatcggtagtattatgcggacgttttcgttattttagcgcgtttagaatatttagttataattgacgttgaagtcgatttttattttcgtatcgttataggtaattcgaggatttttttcgtttttttttgtttcgggttgttggcggtgattttagttggttttcgttgatataaagacgtacgtcgcggaatttttcgttaagagaatcgtcgcgcgagtaaacgtttgtttgagtagatcgtagttagttttagatgtttgttcgggtttttcggtagtaacgtnggcgataattcggaagcgattatttattagtttggaggtgaagataaagtcgttaacgtggggcgaatgttgttgttgttaatttgtacgcgtagcggattgtcgtcgtcgcgagtatacgtattagtttaattacgtttttacgcggtacgattatcgatggtttggtaaagattgattaattggtattgaatagatcgttagacggtgtcgtcggttgttacgtgcgtagttttttattttcgttttaaatagtatttatat

SEQ ID NO: 24774 - DNA, 959 bp, Artificial Sequence
  chemically treated genomic DNA (Homo sapiens) CpG-island No: 24774
  misc_feature (265)..(265): n is either a, c, g or t
atataaatactatttaaaacgaaaataaaaaactacgcacgtaacaaccgacgacaccgtctaacgatctattcaataccaattaatcaatctttaccaaaccatcgataatcgtaccgcgtaaaaacgtaattaaactaatacgtatactcgcgacgacgacaatccgctacgcgtacaaattaacaacaacaacattcgccccacgttaacgactttatcttcacctccaaactaataaataatcgcttccgaattatcgccnacgttactaccgaaaaacccgaacaaacatctaaaactaactacgatctactcaaacaaacgtttactcgcgcgacgattctcttaacgaaaaattccgcgacgtacgtctttatatcaacgaaaaccaactaaaatcaccgccaacaacccgaaacaaaaaaaaacgaaaaaaatcctcgaattacctataacgatacgaaaataaaaatcgacttcaacgtcaattataactaaatattctaaacgcgctaaaataacgaaaacgtccgcataatactaccgattcgatttccaacgtacaaattaaaaatacgaccaaccaaaacgaacttatattatcataccaataaaactataatatccctcacccgcttataatccgcgatttccgcaacattaaaaccgcgaatctcgccttatctcccgctttaactttctaataaataccaacgacaataacaaaaccaacgtactaaaaccatctatacgctcgaccataatcgaacgtttcgcaatttacaaataatcgcgtcattcgccataaacaaaaaacgtttattctccacgaacgatacaaaacgaaaaacgcgaaacaacgattaacttaaccaaaaacaaacaaacgacaacaaaatccgcatcgacgatacaaacgaacataaaatcgcgaactaacgcacctaataccaata

SEQ ID NO: 24775 - DNA, 959 bp, Artificial Sequence
  chemically treated genomic DNA (Homo sapiens) CpG-island No: 24775
  misc_feature (265)..(265): n is either a, c, g or t
atatggatgttgtttgaaacgaaggtgaagaattgcgtacgtggtaatcgacggtatcgtttggcggtttgtttaatgttaattggttaatttttgttaagttatcggtgatcgtatcgcgtaaaggcgtgattgaattgatgcgtatgttcgcggcggcgataattcgttgcgcgtatagattggtagtaataatattcgttttacgttggcgattttatttttatttttaaattggtggatggtcgttttcggattatcgttngcgttattgtcgaagaattcggataaatatttggagttggttgcgatttgtttaagtaggcgtttgttcgcgcggcgatttttttaacgagaaatttcgcggcgtacgtttttatgttagcgaaaattagttgaaattatcgttaataattcggaataggaagaagcggaagagattttcgagttatttatagcggtgcggagatggaaatcggttttaacgttagttatggttggatgttttgaacgcgttgaaatggcgaaaacgttcgtatgatgttatcgattcggtttttagcgtgtagattgaagatgcggttagttagagcgggtttatgttgttatgttaatgagattgtaatgttttttattcgtttgtgattcgcgattttcgtaatattgaaatcgcggatttcgttttatttttcgttttaattttttggtaggtgttaacggtagtggtaaaattagcgtgttgaagttatttatacgttcggttatggtcgggcgtttcgtagtttgtagatggtcgcgttattcgttatgagtaggaggcgtttgttttttacgggcgatatagggcgaagagcgcgagatagcgattggtttaattaaagataaataggcgatagtaaagttcgtatcgacggtatagacgggtataaggtcgcggattggcgtatttgatgttaatg

SEQ ID NO: 24776 - DNA, 959 bp, Artificial Sequence
  chemically treated genomic DNA (Homo sapiens) CpG-island No: 24776
  misc_feature (695)..(695): n is either a, c, g or t
cattaacatcaaatacgccaatccgcgaccttatacccgtctataccgtcgatacgaactttactatcgcctatttatctttaattaaaccaatcgctatctcgcgctcttcgccctatatcgcccgtaaaaaacaaacgcctcctactcataacgaataacgcgaccatctacaaactacgaaacgcccgaccataaccgaacgtataaataacttcaacacgctaattttaccactaccgttaacacctaccaaaaaattaaaacgaaaaataaaacgaaatccgcgatttcaatattacgaaaatcgcgaatcacaaacgaataaaaaacattacaatctcattaacataacaacataaacccgctctaactaaccgcatcttcaatctacacgctaaaaaccgaatcgataacatcatacgaacgttttcgccatttcaacgcgttcaaaacatccaaccataactaacgttaaaaccgatttccatctccgcaccgctataaataactcgaaaatctcttccgcttcttcctattccgaattattaacgataatttcaactaattttcgctaacataaaaacgtacgccgcgaaatttctcgttaaaaaaatcgccgcgcgaacaaacgcctacttaaacaaatcgcaaccaactccaaatatttatccgaattcttcgacaataacgcnaacgataatccgaaaacgaccatccaccaatttaaaaataaaaataaaatcgccaacgtaaaacgaatattattactaccaatctatacgcgcaacgaattatcgccgccgcgaacatacgcatcaattcaatcacgcctttacgcgatacgatcaccgataacttaacaaaaattaaccaattaacattaaacaaaccgccaaacgataccgtcgattaccacgtacgcaattcttcaccttcgtttcaaacaacatccatat

SEQ ID NO: 24777 - DNA, 899 bp, Artificial Sequence
  chemically treated genomic DNA (Homo sapiens) CpG-island No: 24777
tataattagtagttatatttgtatttatcgcgattacgaaggtattagaagttgcgatttcggttcgggatgcggcggttttaaaagaagcggtaaaattattagaaacgaacgtattattaagcgttagtagtgtagttttttcggtaacggcggtaggaaatttcgcgaaggcggtaaaaacgttcgagacgaacgttaggttttttgaaacggtagcgggatagagcgtttcggttgcggtaggtttaaaaatagcggttgcgtcgtttgttagtgtagcgttaataagtgtcgggtaggttttagttagtgttatcgtcgtcggaaaatcggtagaaagcgtcgtatcgtttgttttaatagttataacgaaggttggcgaagttattgaataggttagcgtagtagcgaggtttgttttcgtagcgaagatattcgaaacgaacgcgaaagcgtcggaaataagcgtagaatttttaaaaacggttgtcgtatcgttagttagttcggcggcgttatcggtattatcggcgtttgttttaaaagatgaggcgattagataagcgttagtagcgaagagtagcgttacgacggtatttacgaaggcgatagaggttgttggtagtgcgacggcggtagtttagagtaaaagtacggcggaattcgcggtaacgcgcgtcgagatagtagttaaacgggtagaggatattgtattcgtcgtggcgtttgaggatgtaagtacgacgaaaaaggggatagtatagtttagtagtgcgattaatagtacgtttgaaacgttggcggtaacgttaaaggtagtaaaattagtttatgataatgtagagaaacgtttgtagaaagattagaacggcgttgatatattcgataagggatgt

SEQ ID NO: 24778 - DNA, 899 bp, Artificial Sequence
  chemically treated genomic DNA (Homo sapiens) CpG-island No: 24778
acatcccttatcgaatatatcaacgccgttctaatctttctacaaacgtttctctacattatcataaactaattttactacctttaacgttaccgccaacgtttcaaacgtactattaatcgcactactaaactatactatcccctttttcgtcgtacttacatcctcaaacgccacgacgaatacaatatcctctacccgtttaactactatctcgacgcgcgttaccgcgaattccgccgtacttttactctaaactaccgccgtcgcactaccaacaacctctatcgccttcgtaaataccgtcgtaacgctactcttcgctactaacgcttatctaatcgcctcatcttttaaaacaaacgccgataataccgataacgccgccgaactaactaacgatacgacaaccgtttttaaaaattctacgcttatttccgacgctttcgcgttcgtttcgaatatcttcgctacgaaaacaaacctcgctactacgctaacctattcaataacttcgccaaccttcgttataactattaaaacaaacgatacgacgctttctaccgattttccgacgacgataacactaactaaaacctacccgacacttattaacgctacactaacaaacgacgcaaccgctatttttaaacctaccgcaaccgaaacgctctatcccgctaccgtttcaaaaaacctaacgttcgtctcgaacgtttttaccgccttcgcgaaatttcctaccgccgttaccgaaaaaactacactactaacgcttaataatacgttcgtttctaataattttaccgcttcttttaaaaccgccgcatcccgaaccgaaatcgcaacttctaataccttcgtaatcgcgataaatacaaatataactactaattata

SEQ ID NO: 24779 - DNA, 899 bp, Artificial Sequence
  chemically treated genomic DNA (Homo sapiens) CpG-island No: 24779
gtattttttatcgggtatattagcgtcgttttggtttttttgtagacgtttttttgtattgttataggttgattttattgtttttggcgttgtcgttagcgttttagacgtattgttggtcgtattgttgagttgtattattttttttttcgtcgtatttgtatttttaagcgttacggcggatgtaatattttttgttcgtttagttgttgtttcggcgcgcgttgtcgcggatttcgtcgtatttttgttttgagttgtcgtcgtcgtattgttagtagtttttgtcgttttcgtggatgtcgtcgtggcgttgtttttcgttgttgacgtttgtttggtcgttttattttttgaagtagacgtcgatgatgtcgatgacgtcgtcgaattggttgacgatgcggtagtcgtttttgaggattttgcgtttgttttcgacgttttcgcgttcgtttcggatgttttcgttgcggaagtagatttcgttgttgcgttggtttgtttagtggtttcgttagttttcgttgtggttgttgaagtagacgatgcggcgttttttgtcgatttttcggcggcggtggtattggttgaggtttgttcggtatttgttgacgttgtattggtagacgacgtagtcgttgtttttgagtttgtcgtagtcgaggcgttttgtttcgttgtcgttttagaagatttggcgttcgtttcggacgtttttgtcgttttcgcggaattttttgtcgtcgttgtcgaggaagttgtattattggcgtttgatgatgcgttcgtttttgatgattttgtcgttttttttgaggtcgtcgtatttcgggtcgaggtcgtagtttttgatgttttcgtggtcgcggtggatgtagatgtggttgttgattgta

SEQ ID NO: 24780 - DNA, 899 bp, Artificial Sequence
  chemically treated genomic DNA (Homo sapiens) CpG-island No: 24780
tacaatcaacaaccacatctacatccaccgcgaccacgaaaacatcaaaaactacgacctcgacccgaaatacgacgacctcaaaaaaaacgacaaaatcatcaaaaacgaacgcatcatcaaacgccaataatacaacttcctcgacaacgacgacaaaaaattccgcgaaaacgacaaaaacgtccgaaacgaacgccaaatcttctaaaacgacaacgaaacaaaacgcctcgactacgacaaactcaaaaacaacgactacgtcgtctaccaatacaacgtcaacaaataccgaacaaacctcaaccaataccaccgccgccgaaaaatcgacaaaaaacgccgcatcgtctacttcaacaaccacaacgaaaactaacgaaaccactaaacaaaccaacgcaacaacgaaatctacttccgcaacgaaaacatccgaaacgaacgcgaaaacgtcgaaaacaaacgcaaaatcctcaaaaacgactaccgcatcgtcaaccaattcgacgacgtcatcgacatcatcgacgtctacttcaaaaaataaaacgaccaaacaaacgtcaacaacgaaaaacaacgccacgacgacatccacgaaaacgacaaaaactactaacaatacgacgacgacaactcaaaacaaaaatacgacgaaatccgcgacaacgcgcgccgaaacaacaactaaacgaacaaaaaatattacatccgccgtaacgcttaaaaatacaaatacgacgaaaaaaaaaataatacaactcaacaatacgaccaacaatacgtctaaaacgctaacgacaacgccaaaaacaataaaatcaacctataacaatacaaaaaaacgtctacaaaaaaaccaaaacgacgctaatatacccgataaaaaatac

SEQ ID NO: 24781 - DNA, 566 bp, Artificial Sequence
  chemically treated genomic DNA (Homo sapiens) CpG-island No: 24781
cgggacgttttattacgtatattttacgattatattagtatttcgattagcgattcgatgtcgtattaggttcgtcgtgcgtagcgtgtttattacgtattaattatataacggtcgtgtaaattatcggtttatattattatgatatatagcggcgtatatagcgatagtgtattatatatatagtcgaggttaaatagagtttagatataaaagggattagcgatatcgttaattataggttcgtcgttagttcggacgtataaaattaattagggttatcgaatattattggatagagttattaatataataattcgaacgatttaacgattaagaaggttggtcgaaaaatatcgaatacggtataatttatagtatattatagtcgtaaatatattggaagagtaatttatagtgacgatttttatagttatcggaattatgttcgtataatcggtatatttagttcggtaagaaaatatatagaggaaatcgtggcggtagttgttgttgtatgtcgattttagaggattttataatatatttttgtagtatcggtataa

SEQ ID NO: 24782 - DNA, 566 bp, Artificial Sequence
  chemically treated genomic DNA (Homo sapiens) CpG-island No: 24782
ttataccgatactacaaaaatatattataaaatcctctaaaatcgacatacaacaacaactaccgccacgatttcctctatatattttcttaccgaactaaatataccgattatacgaacataattccgataactataaaaatcgtcactataaattactcttccaatatatttacgactataatatactataaattataccgtattcgatatttttcgaccaaccttcttaatcgttaaatcgttcgaattattatattaataactctatccaataatattcgataaccctaattaattttatacgtccgaactaacgacgaacctataattaacgatatcgctaatcccttttatatctaaactctatttaacctcgactatatatataatacactatcgctatatacgccgctatatatcataataatataaaccgataatttacacgaccgttatataattaatacgtaataaacacgctacgcacgacgaacctaatacgacatcgaatcgctaatcgaaatactaatataatcgtaaaatatacgtaataaaacgtcccg

SEQ ID NO: 24783 - DNA, 566 bp, Artificial Sequence
  chemically treated genomic DNA (Homo sapiens) CpG-island No: 24783
ttatatcgatattgtaagaatgtgttgtgggattttttagagtcgatatatagtagtagttgtcgttacggttttttttgtgtgtttttttgtcggattgggtatgtcggttgtgcgggtatggtttcggtagttgtgagagtcgttattgtgggttgtttttttagtgtgtttacggttgtggtatgttgtgagttgtgtcgtgttcggtgtttttcggttagtttttttgatcgttgagtcgttcgagttgttgtgttgatggttttgtttagtggtgttcggtagttttgattggttttgtacgttcgagttagcggcgggtttgtggttgacggtgtcgttggttttttttgtgtttgggttttgtttggtttcgattatgtgtgtggtgtattgtcgttgtatgcgtcgttgtatgttatggtggtatagatcggtgatttatacggtcgttgtgtagttgatgcgtgatgagtacgttgcgtacggcgagtttggtacgatatcgagtcgttagtcgaggtgttagtgtagtcgtaggatatgcgtgatagagcgtttcg

SEQ ID NO: 24784 - DNA, 566 bp, Artificial Sequence
  chemically treated genomic DNA (Homo sapiens) CpG-island No: 24784
cgaaacgctctatcacgcatatcctacgactacactaacacctcgactaacgactcgatatcgtaccaaactcgccgtacgcaacgtactcatcacgcatcaactacacaacgaccgtataaatcaccgatctataccaccataacatacaacgacgcatacaacgacaatacaccacacacataatcgaaaccaaacaaaacccaaacacaaaaaaaaccaacgacaccgtcaaccacaaacccgccgctaactcgaacgtacaaaaccaatcaaaactaccgaacaccactaaacaaaaccatcaacacaacaactcgaacgactcaacgatcaaaaaaactaaccgaaaaacaccgaacacgacacaactcacaacataccacaaccgtaaacacactaaaaaaacaacccacaataacgactctcacaactaccgaaaccatacccgcacaaccgacatacccaatccgacaaaaaaacacacaaaaaaaaccgtaacgacaactactactatatatcgactctaaaaaatcccacaacacattcttacaatatcgatataa

SEQ ID NO: 24785 - DNA, 681 bp, Artificial Sequence
  chemically treated genomic DNA (Homo sapiens) CpG-island No: 24785
attcgtagcgcgtgagtgtaattggagattttggatttaagatgtttttatgaggaacgattttagttcgcggtaatttcggttagtttgtagcgtggacgataaaataggtattacgtggtttcggcgtcggggcggggttagagacgtcggaagtgatcgcgcggtgcgtcggttcgcgaggaaacgcgtttttagattatggcgatttaggcgaagcgtttacgggtgagtggcgggcgcggggtttagttttttttttcgcgttttatttttttttcgttcgtagaatcgttcgtttgcgtttttttcgttttttttcgcgggtttcgcgttttttttcgttcgtttttttttttatttaaagttcgttttgcgttcgcgtcgaggtttttgtagtttttagcgatttttttgggggtcggatttggttattgcggtatttatttaggtggcggggttcgtggacggcggcgatttggattttgtggtttgttttttgagttgggtcggcgggtggggttggagttgagttttaaggtgagcgagcgacggcgggcggaggattcgcggcggggcgcggggttattagttcgtaggcgttacgagtacggcgtacggtgtgatataggtgagaaggttaggggttttgttatggttatagaggtataagtgtttaat

SEQ ID NO: 24786 - DNA, 681 bp, Artificial Sequence
  chemically treated genomic DNA (Homo sapiens) CpG-island No: 24786
attaaacacttatacctctataaccataacaaaacccctaaccttctcacctatatcacaccgtacgccgtactcgtaacgcctacgaactaataaccccgcgccccgccgcgaatcctccgcccgccgtcgctcgctcaccttaaaactcaactccaaccccacccgccgacccaactcaaaaaacaaaccacaaaatccaaatcgccgccgtccacgaaccccgccacctaaataaataccgcaataaccaaatccgacccccaaaaaaatcgctaaaaactacaaaaacctcgacgcgaacgcaaaacgaactttaaataaaaaaaaaaacgaacgaaaaaaaacgcgaaacccgcgaaaaaaaacgaaaaaaacgcaaacgaacgattctacgaacgaaaaaaaaataaaacgcgaaaaaaaaaactaaaccccgcgcccgccactcacccgtaaacgcttcgcctaaatcgccataatctaaaaacgcgtttcctcgcgaaccgacgcaccgcgcgatcacttccgacgtctctaaccccgccccgacgccgaaaccacgtaatacctattttatcgtccacgctacaaactaaccgaaattaccgcgaactaaaatcgttcctcataaaaacatcttaaatccaaaatctccaattacactcacgcgctacgaat

SEQ ID NO: 24787 - DNA, 681 bp, Artificial Sequence
  chemically treated genomic DNA (Homo sapiens) CpG-island No: 24787
gttaaatatttatatttttgtagttataataaaatttttagtttttttatttatattatatcgtacgtcgtgttcgtgacgtttacgagttggtggtttcgcgtttcgtcgcgggtttttcgttcgtcgtcgttcgtttattttgggatttagttttagttttattcgtcggtttagtttaggaagtaggttataggatttaggtcgtcgtcgtttacgggtttcgttatttagataagtgtcgtagtgattaggttcgatttttaagagagtcgttgggaattgtagagatttcggcgcgagcgtagaacgggttttgggtggaggaggggacgagcggagaggggcgcgggattcgcgggagggagcggagggggcgtaggcggacggttttgcgaacggagaaggggtgaggcgcggaggaaaaggttggatttcgcgttcgttatttattcgtggacgtttcgtttgggtcgttatggtttaagagcgcgttttttcgcgggtcggcgtatcgcgcggttattttcggcgtttttggtttcgtttcggcgtcggaattacgtggtgtttgttttgtcgtttacgttgtagattggtcggagttatcgcgggttggaatcgttttttatgaaaatattttgagtttaggatttttaattgtatttacgcgttgcgagt

SEQ ID NO: 24788 - DNA, 681 bp, Artificial Sequence
  chemically treated genomic DNA (Homo sapiens) CpG-island No: 24788
actcgcaacgcgtaaatacaattaaaaatcctaaactcaaaatattttcataaaaaacgattccaacccgcgataactccgaccaatctacaacgtaaacgacaaaacaaacaccacgtaattccgacgccgaaacgaaaccaaaaacgccgaaaataaccgcgcgatacgccgacccgcgaaaaaacgcgctcttaaaccataacgacccaaacgaaacgtccacgaataaataacgaacgcgaaatccaaccttttcctccgcgcctcaccccttctccgttcgcaaaaccgtccgcctacgccccctccgctccctcccgcgaatcccgcgcccctctccgctcgtcccctcctccacccaaaacccgttctacgctcgcgccgaaatctctacaattcccaacgactctcttaaaaatcgaacctaatcactacgacacttatctaaataacgaaacccgtaaacgacgacgacctaaatcctataacctacttcctaaactaaaccgacgaataaaactaaaactaaatcccaaaataaacgaacgacgacgaacgaaaaacccgcgacgaaacgcgaaaccaccaactcgtaaacgtcacgaacacgacgtacgatataatataaataaaaaaactaaaaattttattataactacaaaaatataaatatttaac

SEQ ID NO: 24789 - DNA, 505 bp, Artificial Sequence
  chemically treated genomic DNA (Homo sapiens) CpG-island No: 24789
tcgtagagagtagagtttttatggtgtcgcgtttttattttcgcgttattattagcgaggtgagaatcgcgtcgatgatcgttatgataatggttatcgtatcggggataatgaagtgttggttaatcgtcgtcgggttaaattagtagcgggtttgtatattaataagcggtttaaaagtttgttcgttgtttttcgttcgttgtatttgttagatttgttagattttttcgatatatttttgtataaagttagcggtattcggtttattgtcgtcggtgattatttgaatcggtgcggtggcgttggcgcgttttatttgtttcgtaaaatttatcggaataattattagatcgcgaatttttttcgtttgtattttggcgattagtttttgacggttatcgttgatggtggcgtcgatgtagggcgaatcggttatggtgtgggtgaaatttagcgtcgtttcgttacgttgttttagttaaatttcgaatcgtaggttgtt

SEQ ID NO: 24790 - DNA, 505 bp, Artificial Sequence
  chemically treated genomic DNA (Homo sapiens) CpG-island No: 24790
aacaacctacgattcgaaatttaactaaaacaacgtaacgaaacgacgctaaatttcacccacaccataaccgattcgccctacatcgacgccaccatcaacgataaccgtcaaaaactaatcgccaaaatacaaacgaaaaaaattcgcgatctaataattattccgataaattttacgaaacaaataaaacgcgccaacgccaccgcaccgattcaaataatcaccgacgacaataaaccgaataccgctaactttatacaaaaatatatcgaaaaaatctaacaaatctaacaaatacaacgaacgaaaaacaacgaacaaacttttaaaccgcttattaatatacaaacccgctactaatttaacccgacgacgattaaccaacacttcattatccccgatacgataaccattatcataacgatcatcgacgcgattctcacctcgctaataataacgcgaaaataaaaacgcgacaccataaaaactctactctctacga

SEQ ID NO: 24791 - DNA, 505 bp, Artificial Sequence
  chemically treated genomic DNA (Homo sapiens) CpG-island No: 24791
agtaatttgcggttcgggatttgattggaatagcgtagcgaagcggcgttggattttatttatattatgatcggttcgttttatatcgacgttattattagcgataatcgttaggaattgatcgttaaaatgtaggcggggaaaattcgcggtttggtggttatttcggtggattttgcggaatagatggagcgcgttaacgttatcgtatcgatttaggtgattatcgacggtagtgagtcgaatatcgttaattttgtataggggtatgtcgaagggatttggtagatttggtaaatgtagcgagcggaggataacgggtagatttttgaatcgtttattgatgtataaattcgttattggtttaattcggcggcgattagttagtattttattattttcggtgcggtgattattattatgacggttatcggcgcgatttttatttcgttggtggtggcgcgagaatgggaacgcggtattatggaggttttgttttttacgg

SEQ ID NO: 24792 - DNA, 505 bp, Artificial Sequence
  chemically treated genomic DNA (Homo sapiens) CpG-island No: 24792
ccgtaaaaaacaaaacctccataataccgcgttcccattctcgcgccaccaccaacgaaataaaaatcgcgccgataaccgtcataataataatcaccgcaccgaaaataataaaatactaactaatcgccgccgaattaaaccaataacgaatttatacatcaataaacgattcaaaaatctacccgttatcctccgctcgctacatttaccaaatctaccaaatcccttcgacatacccctatacaaaattaacgatattcgactcactaccgtcgataatcacctaaatcgatacgataacgttaacgcgctccatctattccgcaaaatccaccgaaataaccaccaaaccgcgaattttccccgcctacattttaacgatcaattcctaacgattatcgctaataataacgtcgatataaaacgaaccgatcataatataaataaaatccaacgccgcttcgctacgctattccaatcaaatcccgaaccgcaaattact

SEQ ID NO: 24793 - DNA, 705 bp, Artificial Sequence
  chemically treated genomic DNA (Homo sapiens) CpG-island No: 24793
  misc_feature (162)..(162): n is either a, c, g or t
  misc_feature (198)..(198): n is either a, c, g or t
  misc_feature (210)..(210): n is either a, c, g or t
  misc_feature (316)..(316): n is either a, c, g or t
  misc_feature (362)..(362): n is either a, c, g or t
  misc_feature (455)..(455): n is either a, c, g or t
  misc_feature (523)..(523): n is either a, c, g or t
  misc_feature (529)..(529): n is either a, c, g or t
  misc_feature (541)..(541): n is either a, c, g or t
  misc_feature (545)..(545): n is either a, c, g or t
  misc_feature (606)..(606): n is either a, c, g or t
tttattagttcgtatagggttcgtaatcgattttaagattcgttttttaataaagtttcgataagtgtgggtttggtttcgttagatttgtaagttcgacgtttgatatttttataagttttaggtgagatatttttgttgtcgtcgatttaggtttcggtnattttaattagatattgcgggatatatatttggcgntcggagcgtagntagtggcgagtttatagtcgataatttgggcgttagattgtttttcgtcgcgtatgtattgcgcgttattacgtcggaatatttggcgttgtcggtttttttgtgntttagattgtcgtagttcgtggttgtagtagtacggtagtggttantcgatcgtatttagcgtttagatatgcgcggcgttatattgatcgagttttagttattattaagtataatatatgcggaggagtgaagcggtnacgtgatagaggtatattatcgatcgaggatatataacgcggcgtatgtaatagataagggtataagngaatanttttgttagaangatngcggttaggtcgtttggtttcgagtcggttttttttgtatatttagcgttatattaggcgnattttcgtgtagcgtaggtagtttattataatatatacggattgtttgtaatcgttaatgagcgttgggtagtaaatatatagattagggtacgttatt

SEQ ID NO: 24794 - DNA, 705 bp, Artificial Sequence
  chemically treated genomic DNA (Homo sapiens) CpG-island No: 24794
  misc_feature (100)..(100): n is either a, c, g or t
  misc_feature (161)..(161): n is either a, c, g or t
  misc_feature (165)..(165): n is either a, c, g or t
  misc_feature (177)..(177): n is either a, c, g or t
  misc_feature (183)..(183): n is either a, c, g or t
  misc_feature (251)..(251): n is either a, c, g or t
  misc_feature (344)..(344): n is either a, c, g or t
  misc_feature (390)..(390): n is either a, c, g or t
  misc_feature (496)..(496): n is either a, c, g or t
  misc_feature (508)..(508): n is either a, c, g or t
  misc_feature (544)..(544): n is either a, c, g or t
aataacgtaccctaatctatatatttactacccaacgctcattaacgattacaaacaatccgtatatattataataaactacctacgctacacgaaaatncgcctaatataacgctaaatatacaaaaaaaaccgactcgaaaccaaacgacctaaccgcnatcnttctaacaaaantattcncttatacccttatctattacatacgccgcgttatatatcctcgatcgataatatacctctatcacgtnaccgcttcactcctccgcatatattatacttaataataactaaaactcgatcaatataacgccgcgcatatctaaacgctaaatacgatcgantaaccactaccgtactactacaaccacgaactacgacaatctaaancacaaaaaaaccgacaacgccaaatattccgacgtaataacgcgcaatacatacgcgacgaaaaacaatctaacgcccaaattatcgactataaactcgccactanctacgctccgancgccaaatatatatcccgcaatatctaattaaaatnaccgaaacctaaatcgacgacaacaaaaatatctcacctaaaacttataaaaatatcaaacgtcgaacttacaaatctaacgaaaccaaacccacacttatcgaaactttattaaaaaacgaatcttaaaatcgattacgaaccctatacgaactaataaa

SEQ ID NO: 24795 - DNA, 705 bp, Artificial Sequence
  chemically treated genomic DNA (Homo sapiens) CpG-island No: 24795
  misc_feature (100)..(100): n is either a, c, g or t
  misc_feature (161)..(161): n is either a, c, g or t
  misc_feature (165)..(165): n is either a, c, g or t
  misc_feature (177)..(177): n is either a, c, g or t
  misc_feature (183)..(183): n is either a, c, g or t
  misc_feature (251)..(251): n is either a, c, g or t
  misc_feature (344)..(344): n is either a, c, g or t
  misc_feature (390)..(390): n is either a, c, g or t
  misc_feature (496)..(496): n is either a, c, g or t
  misc_feature (508)..(508): n is either a, c, g or t
  misc_feature (544)..(544): n is either a, c, g or t
aatgacgtattttagtttgtgtgtttattgtttaacgtttattgacggttgtaggtagttcgtatgtgttatagtagattgtttacgttatacgggggtncgtttggtatgacgttgagtgtgtaagaggaatcggttcgaggttagacggtttggtcgtngttnttttaatagggntgtttntttgtgtttttgtttgttgtatgcgtcgcgttgtatgttttcgatcgatagtatatttttgttacgtngtcgttttattttttcgtatgtattatgtttggtagtgattagagttcggttagtgtaacgtcgcgtatatttgaacgttggatgcggtcgantgattattgtcgtattgttatagttacggattgcgataatttgagntatagagaggtcgataacgttagatgtttcgacgtagtagcgcgtagtgtatacgcggcggaaggtagtttggcgtttaaattatcgattataaattcgttattgnttgcgtttcggncgttaggtgtgtgtttcgtagtatttagttaaaatngtcgaggtttgggtcgacggtagtaggagtgttttatttgagatttgtgaagatgttaggcgtcgagtttgtaagtttgacgagattaggtttatatttatcgagattttgttgggaagcgaattttagggtcgattgcggattttgtgcgaattggtgag

SEQ ID NO: 24796 - DNA, 705 bp, Artificial Sequence
  chemically treated genomic DNA (Homo sapiens) CpG-island No: 24796
  misc_feature (162)..(162): n is either a, c, g or t
  misc_feature (198)..(198): n is either a, c, g or t
  misc_feature (210)..(210): n is either a, c, g or t
  misc_feature (316)..(316): n is either a, c, g or t
  misc_feature (362)..(362): n is either a, c, g or t
  misc_feature (455)..(455): n is either a, c, g or t
  misc_feature (523)..(523): n is either a, c, g or t
  misc_feature (529)..(529): n is either a, c, g or t
  misc_feature (541)..(541): n is either a, c, g or t
  misc_feature (545)..(545): n is either a, c, g or t
  misc_feature (606)..(606): n is either a, c, g or t
ctcaccaattcgcacaaaatccgcaatcgaccctaaaattcgcttcccaacaaaatctcgataaatataaacctaatctcgtcaaacttacaaactcgacgcctaacatcttcacaaatctcaaataaaacactcctactaccgtcgacccaaacctcgacnattttaactaaatactacgaaacacacacctaacgnccgaaacgcaancaataacgaatttataatcgataatttaaacgccaaactaccttccgccgcgtatacactacgcgctactacgtcgaaacatctaacgttatcgacctctctatanctcaaattatcgcaatccgtaactataacaatacgacaataatcantcgaccgcatccaacgttcaaatatacgcgacgttacactaaccgaactctaatcactaccaaacataatacatacgaaaaaataaaacgacnacgtaacaaaaatatactatcgatcgaaaacatacaacgcgacgcatacaacaaacaaaaacacaaanaaacanccctattaaaanaacnacgaccaaaccgtctaacctcgaaccgattcctcttacacactcaacgtcataccaaacgnacccccgtataacgtaaacaatctactataacacatacgaactacctacaaccgtcaataaacgttaaacaataaacacacaaactaaaatacgtcatt

SEQ ID NO: 24797 - DNA, 527 bp, Artificial Sequence
  chemically treated genomic DNA (Homo sapiens) CpG-island No: 24797
attttggtcgtagcgcgcgggcgatgtacgttagtttatttacgtttttacggtagatttagcgtttggaagaagatttcggttagtcgttgtttgtgcgcgataatcgtacggtgacgttgattgaagcgggcgaagagttgcgcgttttcgtttagtaaacgttgttgtagtattagtagttgcgttatattatcgattagtaagggtcgtcgttttttggcgaattatatattttttgttcggtgatcgttgtttatagttatttgtcgtcgattttggatcgttttcgcgcggaatattcgtcggtggagattaaatttattattggtgatgcggtagatgcgatggaaaaggtggttattggtgaagcggatttggcgattgcgggtaaatcggaaattttgttcggcgtagtggcgttttcgatgttggagaatttggtagtagtgttgattgttttcgcgttgttttgttcggtgcgtaattatttttatagtatatagtatattcgcgatattgtattt

SEQ ID NO: 24798 - DNA, 527 bp, Artificial Sequence
  chemically treated genomic DNA (Homo sapiens) CpG-island No: 24798
aaatacaatatcgcgaatatactatatactataaaaataattacgcaccgaacaaaacaacgcgaaaacaatcaacactactaccaaattctccaacatcgaaaacgccactacgccgaacaaaatttccgatttacccgcaatcgccaaatccgcttcaccaataaccaccttttccatcgcatctaccgcatcaccaataataaatttaatctccaccgacgaatattccgcgcgaaaacgatccaaaatcgacgacaaataactataaacaacgatcaccgaacaaaaaatatataattcgccaaaaaacgacgacccttactaatcgataatataacgcaactactaatactacaacaacgtttactaaacgaaaacgcgcaactcttcgcccgcttcaatcaacgtcaccgtacgattatcgcgcacaaacaacgactaaccgaaatcttcttccaaacgctaaatctaccgtaaaaacgtaaataaactaacgtacatcgcccgcgcgctacgaccaaaat

SEQ ID NO: 24799 - DNA, 527 bp, Artificial Sequence
  chemically treated genomic DNA (Homo sapiens) CpG-island No: 24799
aggtatagtatcgcgggtatattgtatgttgtagaagtgattacgtatcgggtagggtagcgcgggggtaattagtattattgttagattttttagtatcgaaaacgttattgcgtcgggtaaggttttcggtttattcgtaatcgttagattcgttttattagtgattattttttttatcgtatttgtcgtattattagtagtaagtttaatttttatcgacgggtgtttcgcgcggaagcgatttagaatcggcggtagatggttgtaggtagcggttatcgagtagaagatatgtaattcgttagagagcgacggtttttgttgatcgatggtgtggcgtaattgttgatattgtaatagcgtttgttgggcgaaaacgcgtagtttttcgttcgttttagttagcgttatcgtgcggttatcgcgtataaatagcggttgatcgagatttttttttaggcgttgaatttgtcgtgagagcgtggatgggttaacgtgtatcgttcgcgcgttgcggttaaaat

SEQ ID NO: 24800 - DNA, 527 bp, Artificial Sequence
  chemically treated genomic DNA (Homo sapiens) CpG-island No: 24800
attttaaccgcaacgcgcgaacgatacacgttaacccatccacgctctcacgacaaattcaacgcctaaaaaaaaatctcgatcaaccgctatttatacgcgataaccgcacgataacgctaactaaaacgaacgaaaaactacgcgttttcgcccaacaaacgctattacaatatcaacaattacgccacaccatcgatcaacaaaaaccgtcgctctctaacgaattacatatcttctactcgataaccgctacctacaaccatctaccgccgattctaaatcgcttccgcgcgaaacacccgtcgataaaaattaaacttactactaataatacgacaaatacgataaaaaaaataatcactaataaaacgaatctaacgattacgaataaaccgaaaaccttacccgacgcaataacgttttcgatactaaaaaatctaacaataatactaattacccccgcgctaccctacccgatacgtaatcacttctacaacatacaatatacccgcgatactatacct

SEQ ID NO: 24801 - DNA, 680 bp, Artificial Sequence
  chemically treated genomic DNA (Homo sapiens) CpG-island No: 24801
  misc_feature (60)..(60): n is either a, c, g or t
  misc_feature (63)..(64): n is either a, c, g or t
  misc_feature (84)..(84): n is either a, c, g or t
  misc_feature (107)..(107): n is either a, c, g or t
  misc_feature (119)..(119): n is either a, c, g or t
  misc_feature (224)..(224): n is either a, c, g or t
  misc_feature (267)..(267): n is either a, c, g or t
  misc_feature (488)..(489): n is either a, c, g or t
  misc_feature (530)..(530): n is either a, c, g or t
  misc_feature (572)..(572): n is either a, c, g or t
  misc_feature (601)..(601): n is either a, c, g or t
  misc_feature (611)..(611): n is either a, c, g or t
  misc_feature (636)..(636): n is either a, c, g or t
tgttagttataaaggacgtgttatggtgtcggtcgcggtgtcggtggttttaagaaaganttnnacgatgtagtggttgcggtnttaacgttatatagtgggggtantttttacggcgntgttgtaagggagggataggtgtcgcgttagtacgagtatttagtttttttaacgttgtcgtggagtgttttatcgttattaggtaggggtattgtgtatcgagnacgttgtgtaaggttttacgttgggttttaggtaagagaaggngtggtacgtggtatgtttcgtggtgtggtgtagagtatgtggaagaataagggcgtcgcgttagagaggacgcgatggagcgaatgtagggcgcgatgtgcgatacggtgtggtgggggtcggtgtaaaagcgtgtaggtgaggtgtggtgtgtggtagaagaggtaagatgttttacgtgatgtgcgttataaggggtgtcgcgagagagggtttatcgnnacggtgggagtatcgtggggggggatagaaggtaaggtaancggtgggtttcgtcgcgttatagataaggggtaatagagggnaaacgtggggtgtagtagcgagagatttngtgtagggtntgttcgttaaggtcgggtgtcgtanagttcggtgggtgtaatttagtattaagttagaagggtagaagt

SEQ ID NO: 24802 - DNA, 680 bp, Artificial Sequence
  chemically treated genomic DNA (Homo sapiens) CpG-island No: 24802
  misc_feature (45)..(45): n is either a, c, g or t
  misc_feature (70)..(70): n is either a, c, g or t
  misc_feature (80)..(80): n is either a, c, g or t
  misc_feature (109)..(109): n is either a, c, g or t
  misc_feature (151)..(151): n is either a, c, g or t
  misc_feature (192)..(193): n is either a, c, g or t
  misc_feature (414)..(414): n is either a, c, g or t
  misc_feature (457)..(457): n is either a, c, g or t
  misc_feature (562)..(562): n is either a, c, g or t
  misc_feature (574)..(574): n is either a, c, g or t
  misc_feature (597)..(597): n is either a, c, g or t
  misc_feature (617)..(618): n is either a, c, g or t
  misc_feature (621)..(621): n is either a, c, g or t
acttctacccttctaacttaatactaaattacacccaccgaactntacgacacccgaccttaacgaacanaccctacacnaaatctctcgctactacaccccacgtttnccctctattaccccttatctataacgcgacgaaacccaccgnttaccttaccttctatccccccccacgatactcccaccgtnncgataaaccctctctcgcgacaccccttataacgcacatcacgtaaaacatcttacctcttctaccacacaccacacctcacctacacgcttttacaccgacccccaccacaccgtatcgcacatcgcgccctacattcgctccatcgcgtcctctctaacgcgacgcccttattcttccacatactctacaccacaccacgaaacataccacgtaccacnccttctcttacctaaaacccaacgtaaaaccttacacaacgtnctcgatacacaatacccctacctaataacgataaaacactccacgacaacgttaaaaaaactaaatactcgtactaacgcgacacctatccctcccttacaacancgccgtaaaaantacccccactatataacgttaanaccgcaaccactacatcgtnnaantctttcttaaaaccaccgacaccgcgaccgacaccataacacgtcctttataactaaca

SEQ ID NO: 24803 - DNA, 680 bp, Artificial Sequence
  chemically treated genomic DNA (Homo sapiens) CpG-island No: 24803
  misc_feature (45)..(45): n is either a, c, g or t
  misc_feature (70)..(70): n is either a, c, g or t
  misc_feature (80)..(80): n is either a, c, g or t
  misc_feature (109)..(109): n is either a, c, g or t
  misc_feature (151)..(151): n is either a, c, g or t
  misc_feature (192)..(193): n is either a, c, g or t
  misc_feature (414)..(414): n is either a, c, g or t
  misc_feature (457)..(457): n is either a, c, g or t
  misc_feature (562)..(562): n is either a, c, g or t
  misc_feature (574)..(574): n is either a, c, g or t
  misc_feature (597)..(597): n is either a, c, g or t
  misc_feature (617)..(618): n is either a, c, g or t
  misc_feature (621)..(621): n is either a, c, g or t
atttttatttttttaatttggtattaggttatatttatcgaattntgcgatattcgattttaacgggtanattttatatngaatttttcgttgttatattttacgtttnttttttgttattttttatttgtaacgcgacggaatttatcgnttattttattttttgtttttttttacgatgtttttatcgtnncggtgggttttttttcgcggtattttttgtaacgtatattacgtaggatattttattttttttattatatattatattttatttatacgtttttatatcggtttttattatatcgtgtcgtatatcgcgttttatattcgttttatcgcgttttttttaacgcggcgtttttatttttttatatattttatattatattacggaatatattacgtgttatntttttttttatttggagtttaacgtgagattttatatagcgtnttcggtgtatagtgtttttatttagtgacggtggggtattttacgataacgttgagggagttgggtgttcgtattggcgcgatatttgttttttttttataatancgtcgtggaggntgtttttattatgtggcgttggnatcgtaattattatatcgtnnggnttttttttgggattatcggtatcgcgatcggtattataatacgttttttgtaattagta

SEQ ID NO: 24804 - DNA, 680 bp, Artificial Sequence
  chemically treated genomic DNA (Homo sapiens) CpG-island No: 24804
  misc_feature (60)..(60): n is either a, c, g or t
  misc_feature (63)..(64): n is either a, c, g or t
  misc_feature (84)..(84): n is either a, c, g or t
  misc_feature (107)..(107): n is either a, c, g or t
  misc_feature (119)..(119): n is either a, c, g or t
  misc_feature (224)..(224): n is either a, c, g or t
  misc_feature (267)..(267): n is either a, c, g or t
  misc_feature (488)..(489): n is either a, c, g or t
  misc_feature (530)..(530): n is either a, c, g or t
  misc_feature (572)..(572): n is either a, c, g or t
  misc_feature (601)..(601): n is either a, c, g or t
  misc_feature (611)..(611): n is either a, c, g or t
  misc_feature (636)..(636): n is either a, c, g or t
tactaattacaaaaaacgtattataataccgatcgcgataccgataatcccaaaaaaaanccnnacgatataataattacgatnccaacgccacataataaaaacancctccacgacgntattataaaaaaaaaacaaatatcgcgccaatacgaacacccaactccctcaacgttatcgtaaaataccccaccgtcactaaataaaaacactatacaccgaanacgctatataaaatctcacgttaaactccaaataaaaaaaaanataacacgtaatatattccgtaatataatataaaatatataaaaaaataaaaacgccgcgttaaaaaaaacgcgataaaacgaatataaaacgcgatatacgacacgatataataaaaaccgatataaaaacgtataaataaaatataatatataataaaaaaaataaaatatcctacgtaatatacgttacaaaaaataccgcgaaaaaaaacccaccgnnacgataaaaacatcgtaaaaaaaaacaaaaaataaaataancgataaattccgtcgcgttacaaataaaaaataacaaaaaanaaacgtaaaatataacaacgaaaaattcnatataaaatntacccgttaaaatcgaatatcgcanaattcgataaatataacctaataccaaattaaaaaaataaaaat

SEQ ID NO: 24805 - DNA, 715 bp, Artificial Sequence
  chemically treated genomic DNA (Homo sapiens) CpG-island No: 24805
tcggtttcggtttagttcgttcggttttcggggtaagagttttcgtttacgttattttcgtcgtcgttttttcggttttttagcgaaagagataaagagtcggcgttttaattcgcgaagtcgcggttgtcgggagcggtagatcgggggattttgttttaaaacgaggggcgggcgtagggagggcgaggtggtggtattcgggttaagttgtcgcgcgttcggttgcgcgggtagcgggatacgcggatgtggggcgggtagtttcggcgtatggaagtagtggttttaggcgagagtttgcgggtttcgacggacggacgggcgggtattagcgcgcggtggtcggagttcggtagtttcgcggcgggtcggtcgagcgtttggggtagcgtcgttgggcgggtcggtcgtagttgtatttatcggatcggaagaaggtcgcgatgtcggttaggtttttggtcgttttttttgttttttcgtcggtatcgttttcgtagttcgagttagcgcgttggttagtacgcggcgagggtcggagagacgtaggtagggggtaggtaggtattcgtatagattgtatgtcgtattaatggatatgcgggcggatagtacgcgacgaggtacggtgatatcgatattagaggattttagaagattatatataagatagatttagggagaatgaacgaagaattaggaagtttagata

SEQ ID NO: 24806 - DNA, 715 bp, Artificial Sequence
  chemically treated genomic DNA (Homo sapiens) CpG-island No: 24806
tatctaaacttcctaattcttcgttcattctccctaaatctatcttatatataatcttctaaaatcctctaatatcgatatcaccgtacctcgtcgcgtactatccgcccgcatatccattaatacgacatacaatctatacgaatacctacctaccccctacctacgtctctccgaccctcgccgcgtactaaccaacgcgctaactcgaactacgaaaacgataccgacgaaaaaacaaaaaaaacgaccaaaaacctaaccgacatcgcgaccttcttccgatccgataaatacaactacgaccgacccgcccaacgacgctaccccaaacgctcgaccgacccgccgcgaaactaccgaactccgaccaccgcgcgctaatacccgcccgtccgtccgtcgaaacccgcaaactctcgcctaaaaccactacttccatacgccgaaactacccgccccacatccgcgtatcccgctacccgcgcaaccgaacgcgcgacaacttaacccgaataccaccacctcgccctccctacgcccgcccctcgttttaaaacaaaatcccccgatctaccgctcccgacaaccgcgacttcgcgaattaaaacgccgactctttatctctttcgctaaaaaaccgaaaaaacgacgacgaaaataacgtaaacgaaaactcttaccccgaaaaccgaacgaactaaaccgaaaccga

SEQ ID NO: 24807 - DNA, 715 bp, Artificial Sequence
  chemically treated genomic DNA (Homo sapiens) CpG-island No: 24807
tgtttggattttttggtttttcgtttattttttttgggtttgttttatgtgtggttttttggggttttttgatgtcggtgttatcgtgtttcgtcgcgtgttgttcgttcgtatgtttattgatgcggtatgtagtttgtgcggatgtttgtttgttttttgtttgcgttttttcggttttcgtcgcgtgttggttagcgcgttggttcgggttgcgggggcggtgtcggcgagggggtagaggaggcggttaaggatttggtcgatatcgcggttttttttcgattcggtgagtgtaattgcggtcggttcgtttagcggcgttgttttaagcgttcggtcgattcgtcgcggagttgtcgagtttcggttatcgcgcgttggtgttcgttcgttcgttcgtcggggttcgtaggttttcgtttgggattattgtttttatgcgtcggggttgttcgttttatattcgcgtgtttcgttgttcgcgtagtcgggcgcgcggtagtttggttcgaatgttattatttcgttttttttgcgttcgtttttcgttttagggtagaatttttcggtttgtcgttttcggtagtcgcggtttcgcgggttggggcgtcggttttttgtttttttcgttggaggatcgaggaggcggcggcggagatggcgtgggcggaggtttttatttcggaggtcgagcggattgagtcggggtcgg

SEQ ID NO: 24808 - DNA, 715 bp, Artificial Sequence
  chemically treated genomic DNA (Homo sapiens) CpG-island No: 24808
ccgaccccgactcaatccgctcgacctccgaaataaaaacctccgcccacgccatctccgccgccgcctcctcgatcctccaacgaaaaaaacaaaaaaccgacgccccaacccgcgaaaccgcgactaccgaaaacgacaaaccgaaaaattctaccctaaaacgaaaaacgaacgcaaaaaaaacgaaataataacattcgaaccaaactaccgcgcgcccgactacgcgaacaacgaaacacgcgaatataaaacgaacaaccccgacgcataaaaacaataatcccaaacgaaaacctacgaaccccgacgaacgaacgaacgaacaccaacgcgcgataaccgaaactcgacaactccgcgacgaatcgaccgaacgcttaaaacaacgccgctaaacgaaccgaccgcaattacactcaccgaatcgaaaaaaaaccgcgatatcgaccaaatccttaaccgcctcctctaccccctcgccgacaccgcccccgcaacccgaaccaacgcgctaaccaacacgcgacgaaaaccgaaaaaacgcaaacaaaaaacaaacaaacatccgcacaaactacataccgcatcaataaacatacgaacgaacaacacgcgacgaaacacgataacaccgacatcaaaaaaccccaaaaaaccacacataaaacaaacccaaaaaaaataaacgaaaaaccaaaaaatccaaaca

SEQ ID NO: 24809 - DNA, 845 bp, Artificial Sequence
  chemically treated genomic DNA (Homo sapiens) CpG-island No: 24809
gaattgggcgcggtcggggttcgtttcgtattgttttcgaggtttcgtcgttaatttattttattttaggaggtcgcggtcgcgtttatttatttttcgtcgtatcgttaacgcgcgttttgcggggcgtagagatcggggttcggtcgttttcggggggttttagagataggtgaggggtttcgttgttattgtttagcggtttttacggttcgtaggttcgtcgcgttttgcgttgagcggatatttggcggtcggcggagttttagcggagtcggttttgtaaggttgaggttttagtgcgttcgcgtatgtttcgggtttggtggggcggcgggggcggggttgttaatgaatacgaggggcgggcgcgggacgttggggcggggttgggggcggggcggggcggtagggggagcgttgcgttgagtatttggtcgcgcgcggtcgggtcgcgggggagttttcgttgtagttgttgcgtttttaaggtaagcgggcgcggggttcggttttgcgggcgcggcgcggggggtattcgggggcggagattgggttcgttagttttagtagttatttgcgtcgtagtttttgtttttcgcgttttttcgagttatattttcgggtcgttttgcgcgtttttgagttttcggattgggatgttcggagttcggcgttgcgggttcggtgcgaggacgcgacggggaggttttgtaaaggtcgcgagcgggggttattcgtcggtcgcgtttaggataggtttgttatttttttcgggttttgtgtttggcgttttggttttttttcgcggttacggacgtttttgtagtttttttttttagatt

SEQ ID NO: 24810 - DNA, 845 bp, Artificial Sequence
  chemically treated genomic DNA (Homo sapiens) CpG-island No: 24810
aatctaaaaaaaaaaactacaaaaacgtccgtaaccgcgaaaaaaaaccaaaacgccaaacacaaaacccgaaaaaaataacaaacctatcctaaacgcgaccgacgaataacccccgctcgcgacctttacaaaacctccccgtcgcgtcctcgcaccgaacccgcaacgccgaactccgaacatcccaatccgaaaactcaaaaacgcgcaaaacgacccgaaaatataactcgaaaaaacgcgaaaaacaaaaactacgacgcaaataactactaaaactaacgaacccaatctccgcccccgaataccccccgcgccgcgcccgcaaaaccgaaccccgcgcccgcttaccttaaaaacgcaacaactacaacgaaaactcccccgcgacccgaccgcgcgcgaccaaatactcaacgcaacgctccccctaccgccccgccccgcccccaaccccgccccaacgtcccgcgcccgcccctcgtattcattaacaaccccgcccccgccgccccaccaaacccgaaacatacgcgaacgcactaaaacctcaaccttacaaaaccgactccgctaaaactccgccgaccgccaaatatccgctcaacgcaaaacgcgacgaacctacgaaccgtaaaaaccgctaaacaataacaacgaaacccctcacctatctctaaaaccccccgaaaacgaccgaaccccgatctctacgccccgcaaaacgcgcgttaacgatacgacgaaaaataaataaacgcgaccgcgacctcctaaaataaaataaattaacgacgaaacctcgaaaacaatacgaaacgaaccccgaccgcgcccaattc

SEQ ID NO: 24811 - DNA, 845 bp, Artificial Sequence
  chemically treated genomic DNA (Homo sapiens) CpG-island No: 24811
ggtttggagggaagggttgtaggggcgttcgtggtcgcgaagaaaggttaaagcgttaggtatagggttcggagaaagtgatagatttgttttgggcgcggtcgacgggtgattttcgttcgcggtttttgtaaagttttttcgtcgcgttttcgtatcgagttcgtagcgtcgaatttcgggtattttaattcgggggtttagggacgcgtagggcggttcgggaatgtggttcgggggagcgcggggggtaggggttgcggcgtaggtggttgttggggttgacgggtttagttttcgttttcgggtgtttttcgcgtcgcgttcgtaggatcgagtttcgcgttcgtttattttggagacgtagtaattgtagcggaggttttttcgcgattcggtcgcgcgcgattaagtgtttagcgtagcgttttttttgtcgtttcgtttcgtttttagtttcgttttagcgtttcgcgttcgtttttcgtgtttattggtagtttcgttttcgtcgttttattaggttcggagtatgcgcgggcgtattgagattttagttttataagatcggtttcgttgaggtttcgtcggtcgttaggtattcgtttagcgtagggcgcggcggatttgcgggtcgtgggaatcgttgggtagtggtagcgaggttttttatttgtttttggggtttttcggggacgatcggatttcgatttttgcgtttcgtaggacgcgcgttgacggtgcggcgggggatggatgagcgcggtcgcggttttttggggtggggtgggttggcggcggggtttcgaggatagtgcggggcgagtttcgatcgcgtttagttt

SEQ ID NO: 24812 - DNA, 845 bp, Artificial Sequence
  chemically treated genomic DNA (Homo sapiens) CpG-island No: 24812
aaactaaacgcgatcgaaactcgccccgcactatcctcgaaaccccgccgccaacccaccccaccccaaaaaaccgcgaccgcgctcatccatcccccgccgcaccgtcaacgcgcgtcctacgaaacgcaaaaatcgaaatccgatcgtccccgaaaaaccccaaaaacaaataaaaaacctcgctaccactacccaacgattcccacgacccgcaaatccgccgcgccctacgctaaacgaatacctaacgaccgacgaaacctcaacgaaaccgatcttataaaactaaaatctcaatacgcccgcgcatactccgaacctaataaaacgacgaaaacgaaactaccaataaacacgaaaaacgaacgcgaaacgctaaaacgaaactaaaaacgaaacgaaacgacaaaaaaaacgctacgctaaacacttaatcgcgcgcgaccgaatcgcgaaaaaacctccgctacaattactacgtctccaaaataaacgaacgcgaaactcgatcctacgaacgcgacgcgaaaaacacccgaaaacgaaaactaaacccgtcaaccccaacaaccacctacgccgcaacccctaccccccgcgctcccccgaaccacattcccgaaccgccctacgcgtccctaaacccccgaattaaaatacccgaaattcgacgctacgaactcgatacgaaaacgcgacgaaaaaactttacaaaaaccgcgaacgaaaatcacccgtcgaccgcgcccaaaacaaatctatcactttctccgaaccctatacctaacgctttaacctttcttcgcgaccacgaacgcccctacaacccttccctccaaacc

SEQ ID NO: 24813 - DNA, 505 bp, Artificial Sequence
  chemically treated genomic DNA (Homo sapiens) CpG-island No: 24813
cgagggatatggttcggtcgattacgtacgggggatatggataaggggtaattgagaagagacgaatttaaagggagttgaataacgggaggtggcgaagagcgcgatcgcggagagaagtatgaaattgttttaatttcgatcgtcgcgatagatattaagaagggttttggattttcgcgataaatattacgtggggtataatacgtgttttattacggagattggggtagtgtgacgggaggggaatatagcggtagggagagtgtgtgtgtgtatcgtagtgataggggtattcgggatagggaggtgatgtagcgacgaggtggatatggaattattatgacgagtatagtagaggaatataggcgataagtagtatcgcggggtacggagggtcgagtgttcggatatatatataagatataaggggatgtgttacggataggggggatatggggagggggttatagaagggttgggggcgaaacggagtggatatgag

SEQ ID NO: 24814 - DNA, 505 bp, Artificial Sequence
  chemically treated genomic DNA (Homo sapiens) CpG-island No: 24814
ctcatatccactccgtttcgcccccaacccttctataaccccctccccatatcccccctatccgtaacacatccccttatatcttatatatatatccgaacactcgaccctccgtaccccgcgatactacttatcgcctatattcctctactatactcgtcataataattccatatccacctcgtcgctacatcacctccctatcccgaatacccctatcactacgatacacacacacactctccctaccgctatattcccctcccgtcacactaccccaatctccgtaataaaacacgtattataccccacgtaatatttatcgcgaaaatccaaaacccttcttaatatctatcgcgacgatcgaaattaaaacaatttcatacttctctccgcgatcgcgctcttcgccacctcccgttattcaactccctttaaattcgtctcttctcaattaccccttatccatatcccccgtacgtaatcgaccgaaccatatccctcg

SEQ ID NO: 24815 - DNA, 505 bp, Artificial Sequence
  chemically treated genomic DNA (Homo sapiens) CpG-island No: 24815
tttatatttatttcgtttcgtttttagtttttttgtggttttttttttatattttttttattcgtgatatatttttttatgttttgtgtatatattcggatattcggtttttcgtatttcgcggtattatttgtcgtttgtatttttttattgtattcgttatggtaattttatgtttatttcgtcgttgtattatttttttatttcgggtatttttgttattgcgatatatatatatattttttttatcgttatgtttttttttcgttatattattttagttttcgtggtggggtacgtattgtattttacgtggtgtttatcgcgggagtttagggttttttttggtgtttgtcgcggcggtcggggttggggtaattttatattttttttcgcggtcgcgtttttcgttatttttcgttatttagttttttttgaattcgtttttttttagttgttttttatttatgtttttcgtgcgtagtcggtcgggttatatttttcg

SEQ ID NO: 24816 - DNA, 505 bp, Artificial Sequence
  chemically treated genomic DNA (Homo sapiens) CpG-island No: 24816
cgaaaaatataacccgaccgactacgcacgaaaaacataaataaaaaacaactaaaaaaaaacgaattcaaaaaaaactaaataacgaaaaataacgaaaaacgcgaccgcgaaaaaaaatataaaattaccccaaccccgaccgccgcgacaaacaccaaaaaaaaccctaaactcccgcgataaacaccacgtaaaatacaatacgtaccccaccacgaaaactaaaataatataacgaaaaaaaaacataacgataaaaaaaatatatatatatatcgcaataacaaaaatacccgaaataaaaaaataatacaacgacgaaataaacataaaattaccataacgaatacaataaaaaaatacaaacgacaaataataccgcgaaatacgaaaaaccgaatatccgaatatatacacaaaacataaaaaaatatatcacgaataaaaaaaatataaaaaaaaaaccacaaaaaaactaaaaacgaaacgaaataaatataaa

SEQ ID NO: 24817 - DNA, 864 bp, Artificial Sequence
  chemically treated genomic DNA (Homo sapiens) CpG-island No: 24817
gaataagggcggggcggaaaatggtttgcggaaatgagattgtttgggtaggttaatgaggtacggtcgcgggaggggattaaagtgtgtggttgggattacgcgcgaaaatatgttgtagttttattttaggggcgttattacggtcggttgtagggtgatcgggtcggtggttttagttgttttttattggggatgatttggggatagcgcgttgatcgcgtagtcggcgggtatttacggtaggtcgttggggaggttgttaggtgatgaggacgtgtcgatgggaatgtgtgagttggagaaggtaaagggatagggatcgtagggattattggaaggggcgtgtgcgtatttgggaatcgagggcgtatggcgtttgatgtatattatagaatgtcgggtttgatatgtgattgcgcgtgtgtgagtttattggtaggggtcgatcgtcggcgatagttggttgggatcggggttggggtgttttgttttaattggattagtatatacgacgggcgcgtaaagggttggtgggcgattgtgcgcgttggcggatttgtagtgaggattattgttttatggaatgttggcggcgtttaggtagatttagggagagagattgtttggagtgtcgttgtttgcgaatgagggttggtattatgtatcgtagtgggcgcgtaagcgtatttgagtgacggagtattcgcgtaaggtgtttgtttttgtaaagcgttttgcggttgttgtcgggttaatgacgagttttcgggaaggattgttaattttggtatcgtatgagggggtatgtcggtaatgttttgatgggggggggtaatatatcgtgtgtttaatgaattttta

SEQ ID NO: 24818 - DNA, 864 bp, Artificial Sequence
  chemically treated genomic DNA (Homo sapiens) CpG-island No: 24818
taaaaattcattaaacacacgatatattacccccccccatcaaaacattaccgacataccccctcatacgataccaaaattaacaatccttcccgaaaactcgtcattaacccgacaacaaccgcaaaacgctttacaaaaacaaacaccttacgcgaatactccgtcactcaaatacgcttacgcgcccactacgatacataataccaaccctcattcgcaaacaacgacactccaaacaatctctctccctaaatctacctaaacgccgccaacattccataaaacaataatcctcactacaaatccgccaacgcgcacaatcgcccaccaaccctttacgcgcccgtcgtatatactaatccaattaaaacaaaacaccccaaccccgatcccaaccaactatcgccgacgatcgacccctaccaataaactcacacacgcgcaatcacatatcaaacccgacattctataatatacatcaaacgccatacgccctcgattcccaaatacgcacacgccccttccaataatccctacgatccctatccctttaccttctccaactcacacattcccatcgacacgtcctcatcacctaacaacctccccaacgacctaccgtaaatacccgccgactacgcgatcaacgcgctatccccaaatcatccccaataaaaaacaactaaaaccaccgacccgatcaccctacaaccgaccgtaataacgcccctaaaataaaactacaacatattttcgcgcgtaatcccaaccacacactttaatcccctcccgcgaccgtacctcattaacctacccaaacaatctcatttccgcaaaccattttccgccccgcccttattc

SEQ ID NO: 24819 - DNA, 864 bp, Artificial Sequence
  chemically treated genomic DNA (Homo sapiens) CpG-island No: 24819
taagagtttattaaatatacggtatgttatttttttttattaaagtattgtcggtatatttttttatgcggtgttaaggttggtaatttttttcgaaaattcgttattagttcgatagtaatcgtagaacgttttatagggataaatattttacgcgggtatttcgttatttaaatacgtttacgcgtttattacggtgtataatgttagtttttattcgtaaatagcggtattttaaatagtttttttttttagatttatttgagcgtcgttaatattttatagggtaatggtttttattataagttcgttaacgcgtataatcgtttattaattttttacgcgttcgtcgtatatgttaatttagttggggtaggatattttaatttcggttttagttaattatcgtcggcggtcggtttttattaataggtttatatacgcgtagttatatattaaattcggtattttgtagtgtgtattaaacgttatgcgttttcggtttttaggtacgtatacgttttttttaatagtttttacggtttttgtttttttattttttttagtttatatatttttatcggtacgtttttattatttagtaatttttttagcgatttatcgtgagtattcgtcggttacgcgattaacgcgttgtttttaagttatttttagtgagaagtaattggaattatcggttcggttattttatagtcggtcgtaatagcgtttttaaagtaaggttataatatgttttcgcgcgtagttttagttatatattttaattttttttcgcggtcgtgttttattagtttatttaagtaattttattttcgtaaattatttttcgtttcgtttttattt

SEQ ID NO: 24820 - DNA, 864 bp, Artificial Sequence
  chemically treated genomic DNA (Homo sapiens) CpG-island No: 24820
aaataaaaacgaaacgaaaaataatttacgaaaataaaattacttaaataaactaataaaacacgaccgcgaaaaaaaattaaaatatataactaaaactacgcgcgaaaacatattataaccttactttaaaaacgctattacgaccgactataaaataaccgaaccgataattccaattacttctcactaaaaataacttaaaaacaacgcgttaatcgcgtaaccgacgaatactcacgataaatcgctaaaaaaattactaaataataaaaacgtaccgataaaaatatataaactaaaaaaaataaaaaaacaaaaaccgtaaaaactattaaaaaaaacgtatacgtacctaaaaaccgaaaacgcataacgtttaatacacactacaaaataccgaatttaatatataactacgcgtatataaacctattaataaaaaccgaccgccgacgataattaactaaaaccgaaattaaaatatcctaccccaactaaattaacatatacgacgaacgcgtaaaaaattaataaacgattatacgcgttaacgaacttataataaaaaccattaccctataaaatattaacgacgctcaaataaatctaaaaaaaaaaactatttaaaataccgctatttacgaataaaaactaacattatacaccgtaataaacgcgtaaacgtatttaaataacgaaatacccgcgtaaaatatttatccctataaaacgttctacgattactatcgaactaataacgaattttcgaaaaaaattaccaaccttaacaccgcataaaaaaatataccgacaatactttaataaaaaaaaataacataccgtatatttaataaactctta

SEQ ID NO: 24821 - DNA, 2343 bp, Artificial Sequence
  chemically treated genomic DNA (Homo sapiens) CpG-island No: 24821
atgtttggttttatgttgttagagtagtgttttcgtttgcgggtgatgtatcgtttgacgtttatcggttagtcggttttttttattatatttgtaatgtaattcggttattcggtgtttttcgttgatatgttgatgtttgttagttagttacgttcgttatattgttatcgttttgcggttttattttttacggtgcggtgcgtgatacggtttgtttcgttatagtgttagaggatgattagatttttatttttattttgtgtgagtttttcggttaggttataatgataacgttgcgttcgttcgttaaagtcggttttttgtattagtcggtttagcgtatcgtaattgaagacgttgtggttgtcgttttcgttggttaggttgatgatacgttcggtagtatcgtattttatattgcgcgttagttcgttttgcgtggtgttgatcgtttttttttacgtatcgtattgtgtttcgtttcggttgtcgttcggggtgataacggtagttaggtcgtttgcggcgttgtatttatatcgcgttttacggttttgtgcgttttttatcgaggttaatcggttacggttgttatagcggcggtaaaggttgatgtttttttcgcggtggatcgtcgttatttggtcgaagcggtcgtatttataacgggtttggtagttcgagtagtcggtgaacgttagtaattgttcgtagcggttttaggttatttgtcgggtgttgttcgtcgtattcgttgtcgtcgtcggtaatttattgtgcgcgttatcgtagcggtagcgtattgttttttcgttgcgcgatgttttcgatattagtttgttcggtttattatattttcggcggttttttagttcgttcggggatattatcgtcgttagttggttttcgtcgttatagtaaaatttcgtttttcgttcgttcggtgtggtgatgttcgtgatatcgtcggatattatatttagatcgtattttgtttttcgtttcgtcgcgttcgtttgcgtcgtgagtttttttgtcgcgttaaattgattttgcgtgacgttgtcgttcgcgtgttttttttttattattcgttttagttcgtttttattttgcgtgtgtaggattttacggcggtttaggttgtcggtgatggtgatgcggttttttttatattgatacgtgtaatttaagtttgtcgggtttagttgttttgttattcgttcgtcgttgtcgtaacggtaatagattttcggtcggttcgtgtgacggtgcgttattattcggtttcggtatttattatcgtaagtaaagttgcgtatttgtgtattgttgcggttatatatcgtcgttagttcgtcgcggggcgtttagttatagcgtattagcggcgcggtaggtaaatttttcgggtatttcgggtcgtgcgttagttatacggtagatagacggatgtcgttgtttcggttatattcggtgtaattcggtagggtattaggaaaagcggacggtttcgtttcgtcggaaatggtttgttgtcgggttttttttgttcgttgcgtttgcgtggttagtattagtcggaagtgacgttaggtattattcgttacgtcggtgatttcgtcgttgaatttatcggcggtttcgcggtggaacgtttgtgtgcgttcgaagcggtttattagttcggttagtattcggtacggcggtagcggcgtaggtagtattttattcgttttcggtattcgtttatattaatcgagtagttattacggtttttgcggattgtttgtcgttagataacgatgcggatttaagcggagttttttcggtagcgtttgttagagtgcggttagtcggtgatttttatttagtttcgttacgtcgtcgcgtattagttatagtgattcgttgcggttgtaatcgtttttatcgggaaataggtgtttaaaatataggtttttgtcgtcgttattattgagtattagtgtgttatcgcgtagttgtaagcggatattcgtaggtattttttagtcggggtcgaggttttttatcggcgcgggcgtttttgttcggtaattgttgtaggtgcgggagaggatgaacggtagcgggtcgggtagggcgatgtcggttttatcgggaaggatttttgtatcgagtaggggattgatcggatggtcggacgttatttcgtcggggtatatcgaataggttacgtcggtgggggtattaatacgtatttcggttgaattttgaataatgttatcgttatattgcgttatgttattttgacgcgtcgtcggtttttcgtttatcgtaaaatttttttttattatt

SEQ ID NO: 24822 - DNA, 2343 bp, Artificial Sequence
  chemically treated genomic DNA (Homo sapiens) CpG-island No: 24822
aataataaaaaaaaattttacgataaacgaaaaaccgacgacgcgtcaaaataacataacgcaatataacgataacattattcaaaattcaaccgaaatacgtattaatacccccaccgacgtaacctattcgatataccccgacgaaataacgtccgaccatccgatcaatcccctactcgatacaaaaatccttcccgataaaaccgacatcgccctacccgacccgctaccgttcatcctctcccgcacctacaacaattaccgaacaaaaacgcccgcgccgataaaaaacctcgaccccgactaaaaaatacctacgaatatccgcttacaactacgcgataacacactaatactcaataataacgacgacaaaaacctatattttaaacacctatttcccgataaaaacgattacaaccgcaacgaatcactataactaatacgcgacgacgtaacgaaactaaataaaaatcaccgactaaccgcactctaacaaacgctaccgaaaaaactccgcttaaatccgcatcgttatctaacgacaaacaatccgcaaaaaccgtaataactactcgattaatataaacgaataccgaaaacgaataaaatactacctacgccgctaccgccgtaccgaatactaaccgaactaataaaccgcttcgaacgcacacaaacgttccaccgcgaaaccgccgataaattcaacgacgaaatcaccgacgtaacgaataatacctaacgtcacttccgactaatactaaccacgcaaacgcaacgaacaaaaaaaacccgacaacaaaccatttccgacgaaacgaaaccgtccgcttttcctaataccctaccgaattacaccgaatataaccgaaacaacgacatccgtctatctaccgtataactaacgcacgacccgaaatacccgaaaaatttacctaccgcgccgctaatacgctataactaaacgccccgcgacgaactaacgacgatatataaccgcaacaatacacaaatacgcaactttacttacgataataaataccgaaaccgaataataacgcaccgtcacacgaaccgaccgaaaatctattaccgttacgacaacgacgaacgaataacaaaacaactaaacccgacaaacttaaattacacgtatcaatataaaaaaaaccgcatcaccatcaccgacaacctaaaccgccgtaaaatcctacacacgcaaaataaaaacgaactaaaacgaataataaaaaaaaaacacgcgaacgacaacgtcacgcaaaatcaatttaacgcgacaaaaaaactcacgacgcaaacgaacgcgacgaaacgaaaaacaaaatacgatctaaatataatatccgacgatatcacgaacatcaccacaccgaacgaacgaaaaacgaaattttactataacgacgaaaaccaactaacgacgataatatccccgaacgaactaaaaaaccgccgaaaatataataaaccgaacaaactaatatcgaaaacatcgcgcaacgaaaaaacaatacgctaccgctacgataacgcgcacaataaattaccgacgacgacaacgaatacgacgaacaacacccgacaaataacctaaaaccgctacgaacaattactaacgttcaccgactactcgaactaccaaacccgttataaatacgaccgcttcgaccaaataacgacgatccaccgcgaaaaaaacatcaacctttaccgccgctataacaaccgtaaccgattaacctcgataaaaaacgcacaaaaccgtaaaacgcgatataaatacaacgccgcaaacgacctaactaccgttatcaccccgaacgacaaccgaaacgaaacacaatacgatacgtaaaaaaaaacgatcaacaccacgcaaaacgaactaacgcgcaatataaaatacgatactaccgaacgtatcatcaacctaaccaacgaaaacgacaaccacaacgtcttcaattacgatacgctaaaccgactaatacaaaaaaccgactttaacgaacgaacgcaacgttatcattataacctaaccgaaaaactcacacaaaataaaaataaaaatctaatcatcctctaacactataacgaaacaaaccgtatcacgcaccgcaccgtaaaaaataaaaccgcaaaacgataacaatataacgaacgtaactaactaacaaacatcaacatatcaacgaaaaacaccgaataaccgaattacattacaaatataataaaaaaaaccgactaaccgataaacgtcaaacgatacatcacccgcaaacgaaaacactactctaacaacataaaaccaaacat

SEQ ID NO: 24823 - DNA, 2343 bp, Artificial Sequence
  chemically treated genomic DNA (Homo sapiens) CpG-island No: 24823
aataatagaaaaggattttacgatgagcggaaaatcggcggcgcgttagggtgatatgacgtagtatggcggtagtattgtttagggtttagtcggggtacgtattggtgtttttatcggcgtggtttgttcggtgtgtttcggcggagtgacgttcggttattcggttaattttttgttcggtgtaaaggtttttttcggtgaaatcgatatcgttttgttcggttcgttgtcgtttattttttttcgtatttatagtagttatcggataaaaacgttcgcgtcggtggggagtttcggtttcggttggaaaatgtttgcggatattcgtttatagttgcgcgataatatattgatatttagtgataacggcggtagaagtttgtattttgagtatttgtttttcggtgaggacggttatagtcgtagcgagttattgtggttggtgcgcggcggcgtggcgaaattggatgaaggttatcggttggtcgtattttggtaggcgttgtcggaagaatttcgtttaagttcgtatcgttatttggcgataaatagttcgtaggggtcgtggtggttgttcggttggtgtgagcgggtgtcggaagcggatgaggtgttgtttgcgtcgttgtcgtcgtatcgggtattgatcgggttggtggatcgtttcgggcgtatatagacgttttatcgcgaagtcgtcggtgaatttagcggcgaaattatcggcgtgacggatggtgtttggcgttattttcggttggtattgattacgtaggcgtagcgggtagaagaagttcggtagtaggttattttcggcgggacggaatcgttcgttttttttgatattttgtcgggttatatcgaatatggtcgggataacggtattcgtttgtttgtcgtgtggttgacgtacgattcggaatattcggagaatttatttgtcgcgtcgttggtgcgttatggttggacgtttcgcggcgaattggcggcggtgtatgatcgtagtaatatataggtgcgtagttttatttacgatgataaatatcggggtcggatggtggcgtatcgttatacgggtcgatcggaaatttgttatcgttacgatagcgacgggcgggtgatagaatagttaaattcggtaggtttaagttatacgtattagtatgagaaggatcgtattattattatcgatagtttgaatcgtcgtgaagttttgtatacgtagggtgaaggcgggttgaagcgggtggtgaaaaaggaatacgcggacggtagcgttacgtagagttagtttgacgcggtaggaaggtttacggcgtagacggacgcggcgggacggaggatagagtacggtttgaatgtggtgttcggcgatattacggatattattatatcggacgggcgggagacgaaattttattataacgacgggaattagttgacggcggtggtgttttcggacgggttggagagtcgtcgggaatatgatgaatcgggtaggttggtatcggagatatcgcgtagcggggagatagtacgttatcgttacgatgacgcgtatagtgagttatcggcgacgataacggatgcgacgggtagtattcggtagatgatttggagtcgttacgggtagttgttggcgtttatcgattgttcgggttattagattcgttatgaatacgatcgtttcggttagatgacggcggtttatcgcgaggaaggtattagtttttatcgtcgttatgataatcgtggtcggttaatttcggtgaaagacgtatagggtcgtgaaacgcggtatgaatataacgtcgtaggcgatttgattgtcgttattatttcggacggtaatcggagcgagatatagtacgatgcgtggggaaaggcggttagtattacgtagggcgggttgacgcgtagtatggagtacgatgttgtcggacgtgttattagtttgattaacgagaacggtagttatagcgtttttagttacgatgcgttggatcggttggtataggaaatcggttttgacgggcggacgtaacgttattattatgatttgatcggaaaatttatatagagtgaggatgagggtttggttattttttggtattatgacgaagtagatcgtattacgtatcgtatcgtgaagggtgaaatcgtagagcggtggtagtatgacgaacgtggttggttgatagatattagtatattagcgaagggtatcgggtggtcgggttgtattataggtatgatgagaaaggtcggttgatcggtgagcgttagacggtgtattattcgtagacggaagtattgttttggtagtatgagattagatat

SEQ ID NO: 24824 - DNA, 2343 bp, Artificial Sequence
  chemically treated genomic DNA (Homo sapiens) CpG-island No: 24824
atatctaatctcatactaccaaaacaatacttccgtctacgaataatacaccgtctaacgctcaccgatcaaccgacctttctcatcatacctataatacaacccgaccacccgatacccttcgctaatatactaatatctatcaaccaaccacgttcgtcatactaccaccgctctacgatttcacccttcacgatacgatacgtaatacgatctacttcgtcataataccaaaaaataaccaaaccctcatcctcactctatataaattttccgatcaaatcataataataacgttacgtccgcccgtcaaaaccgatttcctataccaaccgatccaacgcatcgtaactaaaaacgctataactaccgttctcgttaatcaaactaataacacgtccgacaacatcgtactccatactacgcgtcaacccgccctacgtaatactaaccgcctttccccacgcatcgtactatatctcgctccgattaccgtccgaaataataacgacaatcaaatcgcctacgacgttatattcataccgcgtttcacgaccctatacgtctttcaccgaaattaaccgaccacgattatcataacgacgataaaaactaataccttcctcgcgataaaccgccgtcatctaaccgaaacgatcgtattcataacgaatctaataacccgaacaatcgataaacgccaacaactacccgtaacgactccaaatcatctaccgaatactacccgtcgcatccgttatcgtcgccgataactcactatacgcgtcatcgtaacgataacgtactatctccccgctacgcgatatctccgataccaacctacccgattcatcatattcccgacgactctccaacccgtccgaaaacaccaccgccgtcaactaattcccgtcgttataataaaatttcgtctcccgcccgtccgatataataatatccgtaatatcgccgaacaccacattcaaaccgtactctatcctccgtcccgccgcgtccgtctacgccgtaaaccttcctaccgcgtcaaactaactctacgtaacgctaccgtccgcgtattcctttttcaccacccgcttcaacccgccttcaccctacgtatacaaaacttcacgacgattcaaactatcgataataataatacgatccttctcatactaatacgtataacttaaacctaccgaatttaactattctatcacccgcccgtcgctatcgtaacgataacaaatttccgatcgacccgtataacgatacgccaccatccgaccccgatatttatcatcgtaaataaaactacgcacctatatattactacgatcatacaccgccgccaattcgccgcgaaacgtccaaccataacgcaccaacgacgcgacaaataaattctccgaatattccgaatcgtacgtcaaccacacgacaaacaaacgaataccgttatcccgaccatattcgatataacccgacaaaatatcaaaaaaaacgaacgattccgtcccgccgaaaataacctactaccgaacttcttctacccgctacgcctacgtaatcaataccaaccgaaaataacgccaaacaccatccgtcacgccgataatttcgccgctaaattcaccgacgacttcgcgataaaacgtctatatacgcccgaaacgatccaccaacccgatcaatacccgatacgacgacaacgacgcaaacaacacctcatccgcttccgacacccgctcacaccaaccgaacaaccaccacgacccctacgaactatttatcgccaaataacgatacgaacttaaacgaaattcttccgacaacgcctaccaaaatacgaccaaccgataaccttcatccaatttcgccacgccgccgcgcaccaaccacaataactcgctacgactataaccgtcctcaccgaaaaacaaatactcaaaatacaaacttctaccgccgttatcactaaatatcaatatattatcgcgcaactataaacgaatatccgcaaacattttccaaccgaaaccgaaactccccaccgacgcgaacgtttttatccgataactactataaatacgaaaaaaaataaacgacaacgaaccgaacaaaacgatatcgatttcaccgaaaaaaacctttacaccgaacaaaaaattaaccgaataaccgaacgtcactccgccgaaacacaccgaacaaaccacgccgataaaaacaccaatacgtaccccgactaaaccctaaacaatactaccgccatactacgtcatatcaccctaacgcgccgccgattttccgctcatcgtaaaatccttttctattatt

SEQ ID NO: 24825 - DNA, 961 bp, Artificial Sequence
  chemically treated genomic DNA (Homo sapiens) CpG-island No: 24825
  misc_feature (110)..(110): n is either a, c, g or t
tgaataacgcgttaagcgcgatgagttcggtgagtaaagcggtgtagtaaatcgtaggtcggataagacgtttcggcgtcgtattcgataatgtgtaggcgttgaatgtncggatgcggtgtaagtattttattcggtttatagatcggagttaaatatgtaaattattattatcgttttatttaagcgtagttggttttcgtttttgagttgggtcgttgtattcgtcgtgttggtcgtttcgtggtagggcgcggaaatggtttcgtttacgttgattaaagacggcggtaatatggcgacgttcgtcgtcgattttttttcgttcgattttagttagtggtaggattattttatcgaaatggtcgttacgttgtaaatcgtcgtttggggtatcgcgttggcggtggttttttttattttttttggtttgatgagcgtcgaaaatttggtgtcgtggtgggttattagttcgttcgtcgtttgatggacgtttgtcgcgttattaacgaaatggttttcgttatgttgttcgtggtcgtcgtcggtttcggttcgttcgttggcgtgttggcgtgttggcgttgtttatttatattatcggcgtgttttttaagttgtttttcgaagcggtggaagcgattgagttcggttcggtggaaggtattcgcgttatcggtgttaataagttcgaagagattttttacggcgtgttgttataggtgatgttattgttgattttttattttttttatcgtttcgaatttaacgttcgttcggcgatcgtcgtcggtatggtcggcgtaggcgggatcggcgttattttgtgggaagcgattcgcggtttttagttttaataaagttgcgttttgatggtgtttattatcgttacggttagtttgttggatttttttttttaacggttgcgtaagtattttatttgataagcgaggttttgata

SEQ ID NO: 24826 - DNA, 961 bp, Artificial Sequence
  chemically treated genomic DNA (Homo sapiens) CpG-island No: 24826
  misc_feature (852)..(852): n is either a, c, g or t
tatcaaaacctcgcttatcaaataaaatacttacgcaaccgttaaaaaaaaaaatccaacaaactaaccgtaacgataataaacaccatcaaaacgcaactttattaaaactaaaaaccgcgaatcgcttcccacaaaataacgccgatcccgcctacgccgaccataccgacgacgatcgccgaacgaacgttaaattcgaaacgataaaaaaaataaaaaatcaacaataacatcacctataacaacacgccgtaaaaaatctcttcgaacttattaacaccgataacgcgaataccttccaccgaaccgaactcaatcgcttccaccgcttcgaaaaacaacttaaaaaacacgccgataatataaataaacaacgccaacacgccaacacgccaacgaacgaaccgaaaccgacgacgaccacgaacaacataacgaaaaccatttcgttaataacgcgacaaacgtccatcaaacgacgaacgaactaataacccaccacgacaccaaattttcgacgctcatcaaaccaaaaaaaataaaaaaaaccaccgccaacgcgataccccaaacgacgatttacaacgtaacgaccatttcgataaaataatcctaccactaactaaaatcgaacgaaaaaaaatcgacgacgaacgtcgccatattaccgccgtctttaatcaacgtaaacgaaaccatttccgcgccctaccacgaaacgaccaacacgacgaatacaacgacccaactcaaaaacgaaaaccaactacgcttaaataaaacgataataataatttacatatttaactccgatctataaaccgaataaaatacttacaccgcatccgnacattcaacgcctacacattatcgaatacgacgccgaaacgtcttatccgacctacgatttactacaccgctttactcaccgaactcatcgcgcttaacgcgttattca

SEQ ID NO: 24827 - DNA, 961 bp, Artificial Sequence
  chemically treated genomic DNA (Homo sapiens) CpG-island No: 24827
  misc_feature (852)..(852): n is either a, c, g or t
tattaaggtttcgtttattagataaagtgtttacgtaatcgttgagagaggaaatttagtaggttgatcgtgacgatgataagtattattagggcgtagttttgttggaattggaaatcgcgaatcgttttttatagggtgacgtcgatttcgtttgcgtcgattatgtcgacgacggtcgtcgagcggacgttggattcgaagcgatagagggagtaggagattagtagtggtattatttgtggtagtacgtcgtagaggattttttcgagtttgttggtatcggtggcgcgaatgttttttatcgggtcgggtttaatcgtttttatcgtttcggaaagtagtttggagagtacgtcggtggtgtggataaatagcgttagtacgttagtacgttagcgaacgggtcgaggtcgacggcgattacgaatagtatggcgaagattatttcgttaatggcgcggtaggcgtttattaggcggcgaacgggttggtaatttattacggtattaggttttcggcgtttattaggttaaaggggatggagagaattatcgttagcgcggtgttttagacggcgatttgtagcgtgacggttatttcggtgaggtaattttgttattggttgaaatcgggcgggaagaagtcggcggcgaacgtcgttatgttgtcgtcgtttttgattagcgtaagcggggttattttcgcgttttgttacgagacgattaatacggcgagtataacggtttagtttagaagcgagaattagttgcgtttgggtggggcgatggtgatggtttgtatgtttggtttcggtttgtaggtcggataaggtgtttgtatcgtattcgngtatttaacgtttgtatattgtcggatgcgacgtcggggcgttttattcgatttacgatttattgtatcgttttatttatcgaatttatcgcgtttagcgcgttgttta

SEQ ID NO: 24828 - DNA, 961 bp, Artificial Sequence
  chemically treated genomic DNA (Homo sapiens) CpG-island No: 24828
  misc_feature (110)..(110): n is either a, c, g or t
taaacaacgcgctaaacgcgataaattcgataaataaaacgatacaataaatcgtaaatcgaataaaacgccccgacgtcgcatccgacaatatacaaacgttaaatacncgaatacgatacaaacaccttatccgacctacaaaccgaaaccaaacatacaaaccatcaccatcgccccacccaaacgcaactaattctcgcttctaaactaaaccgttatactcgccgtattaatcgtctcgtaacaaaacgcgaaaataaccccgcttacgctaatcaaaaacgacgacaacataacgacgttcgccgccgacttcttcccgcccgatttcaaccaataacaaaattacctcaccgaaataaccgtcacgctacaaatcgccgtctaaaacaccgcgctaacgataattctctccatcccctttaacctaataaacgccgaaaacctaataccgtaataaattaccaacccgttcgccgcctaataaacgcctaccgcgccattaacgaaataatcttcgccatactattcgtaatcgccgtcgacctcgacccgttcgctaacgtactaacgtactaacgctatttatccacaccaccgacgtactctccaaactactttccgaaacgataaaaacgattaaacccgacccgataaaaaacattcgcgccaccgataccaacaaactcgaaaaaatcctctacgacgtactaccacaaataataccactactaatctcctactccctctatcgcttcgaatccaacgtccgctcgacgaccgtcgtcgacataatcgacgcaaacgaaatcgacgtcaccctataaaaaacgattcgcgatttccaattccaacaaaactacgccctaataatacttatcatcgtcacgatcaacctactaaatttcctctctcaacgattacgtaaacactttatctaataaacgaaaccttaata

SEQ ID NO: 24829 - DNA, 680 bp, Artificial Sequence
  chemically treated genomic DNA (Homo sapiens) CpG-island No: 24829
ttttattttaattttttttttagaggggcgaggggatcgatcgcgtttaatgttgcgatcggtttgttttattttttgcgtaataattttaacgtattcgttgttattagtatcgtcgttttcgtatttgttagtattgttagttataattcggttatttttaatagcgtggtgacgaggaagattttttttagttttagcgtaatagtgatgttttggcggatattggcgtgagtggcgcgtgttagtttaattatttgtattaggtcgcgtaggtggttatgggttaatgttgcgtcggcggtttttagcgttacgtttgtgtcgttatttattgtaatttcgatggcggtagtttttatcgttggcgcgtcgttaatatcgttatcgattatcgttagcggcgtatgttgatttagttcggttatcgttttgattttatttttcggtaataggttcgttttaaattttagttttagtttttcggtaattgtcgtcgttgcgcgtggattatcgtcggtgaggattatttttttgacgtttagcgcgtttagtttattgatggtagttgtagtatcggcgcgtagggtattttgtaacgtaatgatattaagtacgttatcgttacgtattattagtattatcgtttgttcggcgttttttagttcgttaattaaagt

SEQ ID NO: 24830 - DNA, 680 bp, Artificial Sequence
  chemically treated genomic DNA (Homo sapiens) CpG-island No: 24830
actttaattaacgaactaaaaaacgccgaacaaacgataatactaataatacgtaacgataacgtacttaatatcattacgttacaaaataccctacgcgccgatactacaactaccatcaataaactaaacgcgctaaacgtcaaaaaaataatcctcaccgacgataatccacgcgcaacgacgacaattaccgaaaaactaaaactaaaatttaaaacgaacctattaccgaaaaataaaatcaaaacgataaccgaactaaatcaacatacgccgctaacgataatcgataacgatattaacgacgcgccaacgataaaaactaccgccatcgaaattacaataaataacgacacaaacgtaacgctaaaaaccgccgacgcaacattaacccataaccacctacgcgacctaatacaaataattaaactaacacgcgccactcacgccaatatccgccaaaacatcactattacgctaaaactaaaaaaaatcttcctcgtcaccacgctattaaaaataaccgaattataactaacaatactaacaaatacgaaaacgacgatactaataacaacgaatacgttaaaattattacgcaaaaaataaaacaaaccgatcgcaacattaaacgcgatcgatcccctcgcccctctaaaaaaaaaattaaaataaaa

SEQ ID NO: 24831 - DNA, 680 bp, Artificial Sequence
  chemically treated genomic DNA (Homo sapiens) CpG-island No: 24831
gttttaattaacgaattggaaagcgtcgggtaaacggtagtgttggtagtacgtaacgatgacgtgtttggtgttattgcgttataggatattttgcgcgtcgatgttgtaattgttattagtgaattgaacgcgttgggcgttaaaggggtgatttttatcggcgataatttacgcgtagcggcggtaattgtcggggagttggggttggagtttaaagcgggtttgttgtcggaagataaagttaaagcggtgatcgagttgaattaatatgcgtcgttggcgatggtcggtgacggtattaacgacgcgttagcgatgaaagttgtcgttatcgggattgtaatgggtagcggtatagacgtggcgttggaaatcgtcgacgtagtattaatttataattatttgcgcggtttggtgtaaatgattgaattggtacgcgttatttacgttaatattcgttagaatattattattgcgttggggttgaaagggatttttttcgttattacgttgttagggatgatcgggttgtggttggtagtgttggtagatacgggggcgacggtgttggtgatagcgaatgcgttaagattgttgcgtaggagataaggtaaatcgatcgtaatattgagcgcgatcggttttttcgtttttttggggagagggttagggtgagg

SEQ ID NO: 24832 - DNA, 680 bp, Artificial Sequence
  chemically treated genomic DNA (Homo sapiens) CpG-island No: 24832
cctcaccctaaccctctccccaaaaaaacgaaaaaaccgatcgcgctcaatattacgatcgatttaccttatctcctacgcaacaatcttaacgcattcgctatcaccaacaccgtcgcccccgtatctaccaacactaccaaccacaacccgatcatccctaacaacgtaataacgaaaaaaatccctttcaaccccaacgcaataataatattctaacgaatattaacgtaaataacgcgtaccaattcaatcatttacaccaaaccgcgcaaataattataaattaatactacgtcgacgatttccaacgccacgtctataccgctacccattacaatcccgataacgacaactttcatcgctaacgcgtcgttaataccgtcaccgaccatcgccaacgacgcatattaattcaactcgatcaccgctttaactttatcttccgacaacaaacccgctttaaactccaaccccaactccccgacaattaccgccgctacgcgtaaattatcgccgataaaaatcacccctttaacgcccaacgcgttcaattcactaataacaattacaacatcgacgcgcaaaatatcctataacgcaataacaccaaacacgtcatcgttacgtactaccaacactaccgtttacccgacgctttccaattcgttaattaaaac

SEQ ID NO: 24833 - DNA, 554 bp, Artificial Sequence
  chemically treated genomic DNA (Homo sapiens) CpG-island No: 24833
cgtcggggttcggtaaacgattatcgttcggttatattttcgatgcgtgaattatagtaacgcgtttttacggttagcgttacgtcgttttattaataatttttgttaggttttttttagttattttcggatagtgttcgagggttaatgcgttgacgttgtcgtttaggttatgtttgcgtattttattagtaaaggtgattatcgtatcgttttcgttacgtttcgttagttacgggtattttttttttacgttgaacggttgcggattaataataattttggtttttgttattttaattttcggttatcggcgggaagaaagttatttcgtcgtcgttagttagcggatggttaaaatttattagcgtttggttgacggtagttagtaatttgttattttttagcgttagcgtttagcgatcgttttgcgtagttatgtgttggcgtaacgttttaatagttgggaaattcgtagttatttcggttgtatttgtttttattaattcgcgtatttgggcgaaaaaaagaattttaattattcgtttttattt

SEQ ID NO: 24834 - DNA, 554 bp, Artificial Sequence
  chemically treated genomic DNA (Homo sapiens) CpG-island No: 24834
aaataaaaacgaataattaaaattctttttttcgcccaaatacgcgaattaataaaaacaaatacaaccgaaataactacgaatttcccaactattaaaacgttacgccaacacataactacgcaaaacgatcgctaaacgctaacgctaaaaaataacaaattactaactaccgtcaaccaaacgctaataaattttaaccatccgctaactaacgacgacgaaataactttcttcccgccgataaccgaaaattaaaataacaaaaaccaaaattattattaatccgcaaccgttcaacgtaaaaaaaaaatacccgtaactaacgaaacgtaacgaaaacgatacgataatcacctttactaataaaatacgcaaacataacctaaacgacaacgtcaacgcattaaccctcgaacactatccgaaaataactaaaaaaaacctaacaaaaattattaataaaacgacgtaacgctaaccgtaaaaacgcgttactataattcacgcatcgaaaatataaccgaacgataatcgtttaccgaaccccgacg

SEQ ID NO: 24835 - DNA, 554 bp, Artificial Sequence
  chemically treated genomic DNA (Homo sapiens) CpG-island No: 24835
aggtggaagcggatgattaaagttttttttttcgtttaggtgcgcgagttggtgggaatagatgtaatcgaagtggttgcggattttttaattgttgaagcgttacgttagtatatggttgcgtagagcgatcgttgggcgttggcgttggaagatggtaaattattggttgtcgttaattagacgttggtgagttttgattattcgttgattgacggcgacgaagtagtttttttttcgtcggtaatcggaggttaagatggtagaaattaaaattgttgttggttcgtagtcgtttagcgtaggagaagagtattcgtggttggcggagcgtgacgaagacggtgcggtagttatttttattggtaaggtgcgtaaatataatttgggcgatagcgttaacgtattaattttcgaatattattcggggatgattgaaaaaggtttggtagaaattgttgatgaagcggcgtaacgttggtcgtgggggcgcgttattgtgatttacgtatcgggaatatggtcgggcgataatcgtttgtcgggtttcggcg

SEQ ID NO: 24836 - DNA, 554 bp, Artificial Sequence
  chemically treated genomic DNA (Homo sapiens) CpG-island No: 24836
cgccgaaacccgacaaacgattatcgcccgaccatattcccgatacgtaaatcacaataacgcgcccccacgaccaacgttacgccgcttcatcaacaatttctaccaaacctttttcaatcatccccgaataatattcgaaaattaatacgttaacgctatcgcccaaattatatttacgcaccttaccaataaaaataactaccgcaccgtcttcgtcacgctccgccaaccacgaatactcttctcctacgctaaacgactacgaaccaacaacaattttaatttctaccatcttaacctccgattaccgacgaaaaaaaaactacttcgtcgccgtcaatcaacgaataatcaaaactcaccaacgtctaattaacgacaaccaataatttaccatcttccaacgccaacgcccaacgatcgctctacgcaaccatatactaacgtaacgcttcaacaattaaaaaatccgcaaccacttcgattacatctattcccaccaactcgcgcacctaaacgaaaaaaaaaactttaatcatccgcttccacct

SEQ ID NO: 24837 - DNA, 609 bp, Artificial Sequence
  chemically treated genomic DNA (Homo sapiens) CpG-island No: 24837
cgttttgtatatgttataaatggttagcgtcgttacggaggtcgcggttaatgtttttatttcgatatcggttttttcggttaggcggtataaggtttttatacgtattcgattgtgtttcggttcggtttgtaaattgattttaattttgttgagtattagcggatgatagagcgggattagattttaggtgcgttttgtcgtttgaatatcggtaatacgcgtagtggtaaatacgtcgtttttgtggtggcgattattaataattatcgttagcgtttcgttgcgtatggtgataaaggttttcgttcgcgttttacgtacggttttcgttttggcggagatattattatgtgcgtttcgttagcggcgtcgatatgggttagttgcgatatatttatttttttaaatgtggatgcgaatattatcggacgcgtatcgggtattagttgcgggcgatgattttttatgcgtacgtcgtttggttaatcgttgggtaattacgttgtggtagtcgtatcgtatatgattgaatttattttaagaatacggaatatatatttttcggtaaaggatagcggagtatatcgggttcgatattgatatata

SEQ ID NO: 24838 - DNA, 609 bp, Artificial Sequence
  chemically treated genomic DNA (Homo sapiens) CpG-island No: 24838
tatatatcaatatcgaacccgatatactccgctatcctttaccgaaaaatatatattccgtattcttaaaataaattcaatcatatacgatacgactaccacaacgtaattacccaacgattaaccaaacgacgtacgcataaaaaatcatcgcccgcaactaatacccgatacgcgtccgataatattcgcatccacatttaaaaaaataaatatatcgcaactaacccatatcgacgccgctaacgaaacgcacataataatatctccgccaaaacgaaaaccgtacgtaaaacgcgaacgaaaacctttatcaccatacgcaacgaaacgctaacgataattattaataatcgccaccacaaaaacgacgtatttaccactacgcgtattaccgatattcaaacgacaaaacgcacctaaaatctaatcccgctctatcatccgctaatactcaacaaaattaaaatcaatttacaaaccgaaccgaaacacaatcgaatacgtataaaaaccttataccgcctaaccgaaaaaaccgatatcgaaataaaaacattaaccgcgacctccgtaacgacgctaaccatttataacatatacaaaacg

SEQ ID NO: 24839 - DNA, 609 bp, Artificial Sequence
  chemically treated genomic DNA (Homo sapiens) CpG-island No: 24839
tgtgtgttaatatcgggttcggtgtgtttcgttattttttgtcgaagagtgtgtatttcgtgtttttagagtgaatttaattatgtgcggtacggttgttataacgtgattgtttagcggttgattaagcggcgtacgtatggaaaattatcgttcgtagttgatgttcggtacgcgttcggtgatgttcgtatttatatttgaagaaataagtatgtcgtaattgatttatatcgacgtcgttggcgaagcgtatatggtgatgttttcgttaaagcggaaatcgtgcgtgaagcgcgggcggaagtttttgttattatgcgtagcgagacgttggcgatgattattgatggtcgttattataaaggcgacgtatttgttattgcgcgtattgtcggtatttaggcggtaaaacgtatttgggatttgatttcgttttgttattcgttgatgtttagtaaagttgaagttaatttataggtcgagtcggagtataatcgggtgcgtatagaaattttatgtcgtttgatcgggaaaatcggtgtcgaaatggaagtattaatcgcggttttcgtggcggcgttgattatttatgatatgtgtaaagcg

SEQ ID NO: 24840 - DNA, 609 bp, Artificial Sequence
  chemically treated genomic DNA (Homo sapiens) CpG-island No: 24840
cgctttacacatatcataaataatcaacgccgccacgaaaaccgcgattaatacttccatttcgacaccgattttcccgatcaaacgacataaaatttctatacgcacccgattatactccgactcgacctataaattaacttcaactttactaaacatcaacgaataacaaaacgaaatcaaatcccaaatacgttttaccgcctaaataccgacaatacgcgcaataacaaatacgtcgcctttataataacgaccatcaataatcatcgccaacgtctcgctacgcataataacaaaaacttccgcccgcgcttcacgcacgatttccgctttaacgaaaacatcaccatatacgcttcgccaacgacgtcgatataaatcaattacgacatacttatttcttcaaatataaatacgaacatcaccgaacgcgtaccgaacatcaactacgaacgataattttccatacgtacgccgcttaatcaaccgctaaacaatcacgttataacaaccgtaccgcacataattaaattcactctaaaaacacgaaatacacactcttcgacaaaaaataacgaaacacaccgaacccgatattaacacaca

SEQ ID NO: 24841 - DNA, 507 bp, Artificial Sequence
  chemically treated genomic DNA (Homo sapiens) CpG-island No: 24841
tgaattaatttattgtcggagtttgtttggtcgcgattggcggtttttggtattattttatcgttggttttgtgatgttcggcgtcgtttggatgttgtggcgtagtaaacgcgtcgcgttttggttatacgtagttttgttgttcggtattatgatttggggcgtttgggaagttggtttcgatttttgggcgttgatttcgcgtagcgatattttggtttttttcggtatttggttgattttgtcgtttgtttggcgtcgtttggttatttttgttagcggcgtagttgtcgtattggtggtcgtattgttgattagcggtggtattttgatttgggtcggatttaacgattcgtaggagattaacggtattttaagcgtcgatgttatatttgttgaagttatttttttcgtagtcgattaggattggtttgtttatggtcgtaattaggaaggttaacgtttttcgtcgttgaaataaattaacgtcgataacgtttataatt

SEQ ID NO: 24842 - DNA, 507 bp, Artificial Sequence
  chemically treated genomic DNA (Homo sapiens) CpG-island No: 24842
aattataaacgttatcgacgttaatttatttcaacgacgaaaaacgttaaccttcctaattacgaccataaacaaaccaatcctaatcgactacgaaaaaaataacttcaacaaatataacatcgacgcttaaaataccgttaatctcctacgaatcgttaaatccgacccaaatcaaaataccaccgctaatcaacaatacgaccaccaatacgacaactacgccgctaacaaaaataaccaaacgacgccaaacaaacgacaaaatcaaccaaataccgaaaaaaaccaaaatatcgctacgcgaaatcaacgcccaaaaatcgaaaccaacttcccaaacgccccaaatcataataccgaacaacaaaactacgtataaccaaaacgcgacgcgtttactacgccacaacatccaaacgacgccgaacatcacaaaaccaacgataaaataataccaaaaaccgccaatcgcgaccaaacaaactccgacaataaattaattca

SEQ ID NO: 24843 - DNA, 507 bp, Artificial Sequence
  chemically treated genomic DNA (Homo sapiens) CpG-island No: 24843
gattatggacgttatcggcgttaatttgttttagcggcgaaaagcgttgatttttttgattacgattataggtaggttagttttgatcggttacgggggagatagttttagtaggtgtggtatcggcgtttaaggtgtcgttgattttttgcggatcgttaaattcggtttaggttaggatattatcgttaattagtagtgcgattattagtgcggtaattgcgtcgttggtaggaatgattaggcgacgttagataaacggtaggattagttagatgtcgaagaagattagaatgtcgttgcgcggagttagcgtttagaagtcgaaattaattttttagacgttttaaattatggtgtcgagtagtagggttgcgtatagttaaagcgcggcgcgtttattgcgttatagtatttaggcgacgtcgagtattataaggttagcgatagggtagtattaggagtcgttaatcgcgattaggtaggtttcggtaatgagttgattta

SEQ ID NO: 24844 - DNA, 507 bp, Artificial Sequence
  chemically treated genomic DNA (Homo sapiens) CpG-island No: 24844
taaatcaactcattaccgaaacctacctaatcgcgattaacgactcctaatactaccctatcgctaaccttataatactcgacgtcgcctaaatactataacgcaataaacgcgccgcgctttaactatacgcaaccctactactcgacaccataatttaaaacgtctaaaaaattaatttcgacttctaaacgctaactccgcgcaacgacattctaatcttcttcgacatctaactaatcctaccgtttatctaacgtcgcctaatcattcctaccaacgacgcaattaccgcactaataatcgcactactaattaacgataatatcctaacctaaaccgaatttaacgatccgcaaaaaatcaacgacaccttaaacgccgataccacacctactaaaactatctcccccgtaaccgatcaaaactaacctacctataatcgtaatcaaaaaaatcaacgcttttcgccgctaaaacaaattaacgccgataacgtccataatc

SEQ ID NO: 24845 - DNA, 515 bp, Artificial Sequence
  chemically treated genomic DNA (Homo sapiens) CpG-island No: 24845
gcgtcgttacgcgtatcgttaggtagacgtttataggttttatgtgttttttgtatttgtttttagtttagttttacgtttagatcgggcgtattaggaacggtaattttttcgtttttaatttttagcggatttcgggttaggcgataatcgtttttttgttaaatttagtgggtatcgatagcggtaggattattcggtgtcgtcgcgtttatatgggtaaatatcgttagagagatatcgaaatggttattagaatggtagatttaggttagttttaagtcgtcgtatagttgcgtatacggattgtatcggaagcgttaaagtgcggtcggtagtggatatttatcgttgattttacgtatgatattttcgtcgttgtggtatttgtagtttatagatagcggtgcggtgaatcggtatattagttcgatagcgtttgttattgttcgttggtaatttcgttgtttaaggttagatatcggatggtttttacgtatataggttttaattta

SEQ ID NO: 24846 - DNA, 515 bp, Artificial Sequence
  chemically treated genomic DNA (Homo sapiens) CpG-island No: 24846
taaattaaaacctatatacgtaaaaaccatccgatatctaaccttaaacaacgaaattaccaacgaacaataacaaacgctatcgaactaatataccgattcaccgcaccgctatctataaactacaaataccacaacgacgaaaatatcatacgtaaaatcaacgataaatatccactaccgaccgcactttaacgcttccgatacaatccgtatacgcaactatacgacgacttaaaactaacctaaatctaccattctaataaccatttcgatatctctctaacgatatttacccatataaacgcgacgacaccgaataatcctaccgctatcgatacccactaaatttaacaaaaaaacgattatcgcctaacccgaaatccgctaaaaattaaaaacgaaaaaattaccgttcctaatacgcccgatctaaacgtaaaactaaactaaaaacaaatacaaaaaacacataaaacctataaacgtctacctaacgatacgcgtaacgacgc

SEQ ID NO: 24847 - DNA, 515 bp, Artificial Sequence
  chemically treated genomic DNA (Homo sapiens) CpG-island No: 24847
tgggttggaatttgtgtacgtgaggattattcggtgtttaattttaagtagcggagttattagcgagtagtggtagacgttgtcggattagtatgtcgatttatcgtatcgttgtttgtggattatagatgttatagcggcggaaatgttatacgtgaggttagcggtagatatttattgtcgatcgtattttgacgttttcggtgtagttcgtgtgcgtagttgtgcgacgatttggggttgatttgggtttgttattttgataattatttcgatatttttttggcgatgtttatttatgtgggcgcggcggtatcgggtaattttatcgttatcgatatttattggatttggtaggagggcgattgtcgtttgattcgaaattcgttggagattaaaaacggaaaaattgtcgtttttgatgcgttcggtttgggcgtggaattggattgggaataggtataaaaggtatatgaggtttataaacgtttgtttggcggtgcgcgtaacgacgt

SEQ ID NO: 24848 - DNA, 515 bp, Artificial Sequence
  chemically treated genomic DNA (Homo sapiens) CpG-island No: 24848
acgtcgttacgcgcaccgccaaacaaacgtttataaacctcatataccttttatacctattcccaatccaattccacgcccaaaccgaacgcatcaaaaacgacaatttttccgtttttaatctccaacgaatttcgaatcaaacgacaatcgccctcctaccaaatccaataaatatcgataacgataaaattacccgataccgccgcgcccacataaataaacatcgccaaaaaaatatcgaaataattatcaaaataacaaacccaaatcaaccccaaatcgtcgcacaactacgcacacgaactacaccgaaaacgtcaaaatacgatcgacaataaatatctaccgctaacctcacgtataacatttccgccgctataacatctataatccacaaacaacgatacgataaatcgacatactaatccgacaacgtctaccactactcgctaataactccgctacttaaaattaaacaccgaataatcctcacgtacacaaattccaaccca

SEQ ID NO: 24849 - DNA, 529 bp, Artificial Sequence
  chemically treated genomic DNA (Homo sapiens) CpG-island No: 24849
cgatttgtacgcggtagatggcgatgagtataaatttttttgcgttgcgaaaggcggcggttttgttaataaaacgtatttttattaggaaattaaagttttgttgattttcggtaaattgaaaaattttttcgtcgagaaaatgcgtattttcggtattgtagtttgttcgtcgtattatatcgcgtttgtgattggcggtacgtttgcggaaattaatttgaaaatcgttaagttagtaagcgtttattattacgatgaattgtcgacggaagggaacgaatatggttaggcgtttcgcgatgtttagttggaataggaattgttggaagaggtttagaaattcggttttggcgcgtagtttggcggtaaatatttcgcgtacgatattcgcgtgattcgtttgttacgttacggcgtattttgttcggtcggtatgggcgttttttgttttgttgatcgtaatattaaagcgaagattaatcgttaggggatttggatcgaaaaattggaatataatttaggttag

SEQ ID NO: 24850 - DNA, 529 bp, Artificial Sequence
  chemically treated genomic DNA (Homo sapiens) CpG-island No: 24850
ctaacctaaattatattccaatttttcgatccaaatcccctaacgattaatcttcgctttaatattacgatcaacaaaacaaaaaacgcccataccgaccgaacaaaatacgccgtaacgtaacaaacgaatcacgcgaatatcgtacgcgaaatatttaccgccaaactacgcgccaaaaccgaatttctaaacctcttccaacaattcctattccaactaaacatcgcgaaacgcctaaccatattcgttcccttccgtcgacaattcatcgtaataataaacgcttactaacttaacgattttcaaattaatttccgcaaacgtaccgccaatcacaaacgcgatataatacgacgaacaaactacaataccgaaaatacgcattttctcgacgaaaaaatttttcaatttaccgaaaatcaacaaaactttaatttcctaataaaaatacgttttattaacaaaaccgccgcctttcgcaacgcaaaaaaatttatactcatcgccatctaccgcgtacaaatcg

SEQ ID NO: 24851 - DNA, 529 bp, Artificial Sequence
  chemically treated genomic DNA (Homo sapiens) CpG-island No: 24851
ttggtttggattatgttttagtttttcgatttagattttttgacggttgattttcgttttgatattacggttagtagagtaggagacgtttatatcgatcgggtaggatgcgtcgtgacgtggtaggcgaattacgcgaatgtcgtgcgcgaagtatttatcgttaaattgcgcgttaagatcgagtttttgggttttttttagtagtttttgttttagttggatatcgcggaacgtttgattatgttcgttttttttcgtcggtagtttatcgtaatagtgagcgtttgttaatttgacggtttttaggttggttttcgtagacgtatcgttaattataaacgcgatatggtacggcgggtaggttgtagtatcgagggtacgtattttttcgacgaggaagttttttagtttgtcgggagttagtagggttttggttttttggtagagatacgttttgttggtagagtcgtcgtttttcgtaacgtaaaggaatttgtatttatcgttatttatcgcgtataggtcg

SEQ ID NO: 24852 - DNA, 529 bp, Artificial Sequence
  chemically treated genomic DNA (Homo sapiens) CpG-island No: 24852
cgacctatacgcgataaataacgataaatacaaattcctttacgttacgaaaaacgacgactctaccaacaaaacgtatctctaccaaaaaaccaaaaccctactaactcccgacaaactaaaaaacttcctcgtcgaaaaaatacgtaccctcgatactacaacctacccgccgtaccatatcgcgtttataattaacgatacgtctacgaaaaccaacctaaaaaccgtcaaattaacaaacgctcactattacgataaactaccgacgaaaaaaaacgaacataatcaaacgttccgcgatatccaactaaaacaaaaactactaaaaaaaacccaaaaactcgatcttaacgcgcaatttaacgataaatacttcgcgcacgacattcgcgtaattcgcctaccacgtcacgacgcatcctacccgatcgatataaacgtctcctactctactaaccgtaatatcaaaacgaaaatcaaccgtcaaaaaatctaaatcgaaaaactaaaacataatccaaaccaa

SEQ ID NO: 24853 - DNA, 644 bp, Artificial Sequence
  chemically treated genomic DNA (Homo sapiens) CpG-island No: 24853
ggggggggtcgggagtggcgggtgtgtggcgggtggtgtaggggggtgagtggggaggtgtggggtgggtgagggataggtaggggtgggggcggggggggtggtggggggagtgggcgatggggagggggggggagatggatgattgggagttcgggtgtcgtggagaggtgtagtgagcgatgggaaggcgagtacggtaattcgtagcgggcgagcgggatgggtcggttagttaggcgtcggagcggtatagtgttagatgagataggcgtagtagaggtgcgggtagcgagcgatggaggtgttggtaggcgaggtgcgcggtgaggtggtgggatggggcggtgtaatgaggttgggtgcgagtgtatggttgtaaggtatttggagcgcgttttcgggtagaggtagtgttttaggcgtttgttagttgtgttttttagcggcggcgattatttcgtcgggcgtttttgtcggagtcgtaggattattatttcgttcgttatttcgttttcgtcgtttagttcggtaatgtttcggcgtattttcgggttaatttggattttcgtaatatcgcgtagataaacgggtacgttatttttattggtttttaaaacgatgtgattaaagtcgtcgagcgt

SEQ ID NO: 24854 - DNA, 644 bp, Artificial Sequence
  chemically treated genomic DNA (Homo sapiens) CpG-island No: 24854
acgctcgacgactttaatcacatcgttttaaaaaccaataaaaataacgtacccgtttatctacgcgatattacgaaaatccaaattaacccgaaaatacgccgaaacattaccgaactaaacgacgaaaacgaaataacgaacgaaataataatcctacgactccgacaaaaacgcccgacgaaataatcgccgccgctaaaaaacacaactaacaaacgcctaaaacactacctctacccgaaaacgcgctccaaataccttacaaccatacactcgcacccaacctcattacaccgccccatcccaccacctcaccgcgcacctcgcctaccaacacctccatcgctcgctacccgcacctctactacgcctatctcatctaacactataccgctccgacgcctaactaaccgacccatcccgctcgcccgctacgaattaccgtactcgccttcccatcgctcactacacctctccacgacacccgaactcccaatcatccatctccccccccctccccatcgcccactccccccaccaccccccccgcccccacccctacctatccctcacccaccccacacctccccactcacccccctacaccacccgccacacacccgccactcccgacccccccc

SEQ ID NO: 24855 - DNA, 644 bp, Artificial Sequence
  chemically treated genomic DNA (Homo sapiens) CpG-island No: 24855
acgttcgacgattttaattatatcgttttaaaagttagtgaaaatggcgtgttcgtttatttgcgcgatgttgcgaaggtttagattggttcggagatgcgtcggggtattgtcgaattaaacggcgaaggcgaagtggcgggcggggtggtgattttgcgatttcggtaaaaacgttcgacgaagtgatcgtcgtcgttgaaggatataattggtaaacgtttgaaatattatttttgttcggaagcgcgttttagatattttataattatatattcgtatttagttttattgtatcgttttattttattattttatcgcgtatttcgtttgttaatatttttatcgttcgttgttcgtatttttgttgcgtttgttttatttggtattgtgtcgtttcggcgtttggttggtcgatttatttcgttcgttcgttgcgggttgtcgtattcgtttttttatcgtttattgtatttttttacggtattcgaatttttaattatttatttttttttttttttttatcgtttattttttttattatttttttcgtttttatttttatttattttttatttattttatatttttttatttatttttttgtattattcgttatatattcgttattttcgatttttttt

SEQ ID NO: 24856 - DNA, 644 bp, Artificial Sequence
  chemically treated genomic DNA (Homo sapiens) CpG-island No: 24856
aaaaaaaatcgaaaataacgaatatataacgaataatacaaaaaaataaataaaaaaatataaaataaataaaaaataaataaaaataaaaacgaaaaaaataataaaaaaaataaacgataaaaaaaaaaaaaaaaataaataattaaaaattcgaataccgtaaaaaaatacaataaacgataaaaaaacgaatacgacaacccgcaacgaacgaacgaaataaatcgaccaaccaaacgccgaaacgacacaataccaaataaaacaaacgcaacaaaaatacgaacaacgaacgataaaaatattaacaaacgaaatacgcgataaaataataaaataaaacgatacaataaaactaaatacgaatatataattataaaatatctaaaacgcgcttccgaacaaaaataatatttcaaacgtttaccaattatatccttcaacgacgacgatcacttcgtcgaacgtttttaccgaaatcgcaaaatcaccaccccgcccgccacttcgccttcgccgtttaattcgacaataccccgacgcatctccgaaccaatctaaaccttcgcaacatcgcgcaaataaacgaacacgccattttcactaacttttaaaacgatataattaaaatcgtcgaacgt

SEQ ID NO: 24857 - DNA, 581 bp, Artificial Sequence
  chemically treated genomic DNA (Homo sapiens) CpG-island No: 24857
atttgcgtcgtagtatgcgcgataagattcgcgagttgtaaaagtagtttgatattatttcgttgtacgttatttacgattagagcgaagtttttgcggtttttgatattggtgttggtgatcgtaataaggggtatatatttatgttagatcggtttatcgtaggatttttatcgttagttcgtttttcgttttatggcgagttttatgggcgatgttaatttgttttcggtaatttttagcgacggatacgttgatatttacggttattatttgtcgcgttcgttgtattttggtatatagggtgaagggatggtcggtgtgcgttcggaagcgattacgtttagcgatcgcggcgaagagagttagcgttgcgtgattcgttatgtcgtttatatggggtcgtagtatgaagtgacggtggaatggtacgggtaggagatattattgtaggttaacgttacgcgtttgtaatcggacgtcggcgagtagtattattttgaaatttattcgtacggtatgtttgttttggcggatgcggtataacgttttgtggttttgtaggtcggataaggcgtttg

SEQ ID NO: 24858 - DNA, 581 bp, Artificial Sequence
  chemically treated genomic DNA (Homo sapiens) CpG-island No: 24858
caaacgccttatccgacctacaaaaccacaaaacgttataccgcatccgccaaaacaaacataccgtacgaataaatttcaaaataatactactcgccgacgtccgattacaaacgcgtaacgttaacctacaataatatctcctacccgtaccattccaccgtcacttcatactacgaccccatataaacgacataacgaatcacgcaacgctaactctcttcgccgcgatcgctaaacgtaatcgcttccgaacgcacaccgaccatcccttcaccctatataccaaaatacaacgaacgcgacaaataataaccgtaaatatcaacgtatccgtcgctaaaaattaccgaaaacaaattaacatcgcccataaaactcgccataaaacgaaaaacgaactaacgataaaaatcctacgataaaccgatctaacataaatatataccccttattacgatcaccaacaccaatatcaaaaaccgcaaaaacttcgctctaatcgtaaataacgtacaacgaaataatatcaaactacttttacaactcgcgaatcttatcgcgcatactacgacgcaaat

SEQ ID NO: 24859 - DNA, 581 bp, Artificial Sequence
  chemically treated genomic DNA (Homo sapiens) CpG-island No: 24859
taagcgttttattcggtttataaaattataaaacgttatgtcgtattcgttagaataaatatgtcgtacggatggattttaagataatattgttcgtcgacgttcggttgtagacgcgtagcgttgatttgtaataatattttttgttcgtgttattttatcgttattttatattgcggttttatataggcgatatggcggattacgtagcgttggtttttttcgtcgcgatcgttgagcgtgatcgttttcgggcgtatatcgattatttttttattttgtgtattaaagtgtagcgggcgcggtagatgatagtcgtagatattaacgtattcgtcgttgaaggttgtcgggaataggttggtatcgtttataaagttcgttataaagcgggaggcgggttggcggtaaagattttgcggtgagtcgatttggtatgagtgtgtattttttgttgcgattattagtattagtattagaaatcgtaaaggtttcgttttgatcgtgggtgacgtatagcgaggtgatattaaattgtttttgtaattcgcggattttgtcgcgtatgttgcgacgtaggt

SEQ ID NO: 24860 - DNA, 581 bp, Artificial Sequence
  chemically treated genomic DNA (Homo sapiens) CpG-island No: 24860
acctacgtcgcaacatacgcgacaaaatccgcgaattacaaaaacaatttaatatcacctcgctatacgtcacccacgatcaaaacgaaacctttacgatttctaatactaatactaataatcgcaacaaaaaatacacactcataccaaatcgactcaccgcaaaatctttaccgccaacccgcctcccgctttataacgaactttataaacgataccaacctattcccgacaaccttcaacgacgaatacgttaatatctacgactatcatctaccgcgcccgctacactttaatacacaaaataaaaaaataatcgatatacgcccgaaaacgatcacgctcaacgatcgcgacgaaaaaaaccaacgctacgtaatccgccatatcgcctatataaaaccgcaatataaaataacgataaaataacacgaacaaaaaatattattacaaatcaacgctacgcgtctacaaccgaacgtcgacgaacaatattatcttaaaatccatccgtacgacatatttattctaacgaatacgacataacgttttataattttataaaccgaataaaacgctta

SEQ ID NO: 24861 - DNA, 849 bp, Artificial Sequence
  chemically treated genomic DNA (Homo sapiens) CpG-island No: 24861
agtgggtggtatatgcgttgcgggtatagggtgtgaatatcgttttcggttattcgggtggcgtaattatgtcggtttacgatgtattgtatgacggcggcgtggagtatttgttatgtcgatatgagtagggtgcggtaatggcggttatcggttatgttcgtgttatcggtaaaattggcgtatgtatcgttacgtttggttcgggcgtaattaatttgataatcgggtttgcggacgtattgttagattttatttttgttgttgttattatcggttaagtgttcgtatcgtttatcggtattgacgtattttaggaagtggatgttttgggattgtcgttagtttgtattaagtatagttttttggtgtagtcgttggaagagttgtcgcgtattatggttgaagtattcgacgttgtttgtttaggtcgttttggttcggttttggtcgatattttaaaagatatttagttagttagcggtgatttggaatcgtggtttattatcgttgaaaacgaagtgatttttttatatgtcgaagttgagtaagcgcgttagatgttggtaaaagcgtaaaaatcgatgttgtacgttggcggtggcgtgggtatggcgtaggtagtttcggttttgcgtgaatttttcgttggtataaaaatgtttgttatttgtacgttgaaagggtttggcgtagtagaagtagatttttcgtattatttgggtatgttgggaattttcggtattaagcgggaaatttcgcgggttcggagtttttatcgtgattttcgtgggtttcgttttaaaatcgttaacggaaatgaaaattttttgtttagataagttttta

SEQ ID NO: 24862 - DNA, 849 bp, Artificial Sequence
  chemically treated genomic DNA (Homo sapiens) CpG-island No: 24862
taaaaacttatctaaacaaaaaattttcatttccgttaacgattttaaaacgaaacccacgaaaatcacgataaaaactccgaacccgcgaaatttcccgcttaataccgaaaattcccaacatacccaaataatacgaaaaatctacttctactacgccaaaccctttcaacgtacaaataacaaacatttttataccaacgaaaaattcacgcaaaaccgaaactacctacgccatacccacgccaccgccaacgtacaacatcgatttttacgcttttaccaacatctaacgcgcttactcaacttcgacatataaaaaaatcacttcgttttcaacgataataaaccacgattccaaatcaccgctaactaactaaatatcttttaaaatatcgaccaaaaccgaaccaaaacgacctaaacaaacaacgtcgaatacttcaaccataatacgcgacaactcttccaacgactacaccaaaaaactatacttaatacaaactaacgacaatcccaaaacatccacttcctaaaatacgtcaataccgataaacgatacgaacacttaaccgataataacaacaacaaaaataaaatctaacaatacgtccgcaaacccgattatcaaattaattacgcccgaaccaaacgtaacgatacatacgccaattttaccgataacacgaacataaccgataaccgccattaccgcaccctactcatatcgacataacaaatactccacgccgccgtcatacaatacatcgtaaaccgacataattacgccacccgaataaccgaaaacgatattcacaccctatacccgcaacgcatataccacccact

SEQ ID NO: 24863 - DNA, 849 bp, Artificial Sequence
  chemically treated genomic DNA (Homo sapiens) CpG-island No: 24863
tgaaaatttgtttgggtaaaaggtttttattttcgttagcggttttaaaacggggtttacgggaattacggtgaaaatttcgggttcgcgaagtttttcgtttggtgtcgggaatttttagtatgtttagatagtacggaaaatttgtttttattgcgttaagtttttttagcgtataggtggtaggtatttttgtgttagcgagaaatttacgtaaagtcggaattgtttgcgttatatttacgttatcgttaacgtatagtatcggtttttgcgtttttgttagtatttggcgcgtttgtttaatttcggtatgtgggaaagttatttcgtttttaacggtggtgaattacggttttaggttatcgttggttaattggatattttttgggatatcgattagaatcggattaggacgatttgagtaggtaacgtcgaatgttttagttatgatgcgcggtaatttttttagcgattgtattagaaagttgtgtttggtataggttaacgataattttaggatatttattttttgaaatgcgttagtgtcgataaacggtgcggatatttgatcggtgatggtaataatagggatggaatttaatagtgcgttcgtaagttcggttattaggttggttgcgttcggattagacgtggcgatatatacgttagttttgtcggtagtacgagtataatcgatagtcgttattgtcgtattttgtttatgtcggtatagtaagtgttttacgtcgtcgttatataatgtatcgtaaatcggtataattgcgttattcggataatcgaaaacggtgtttatattttgtgttcgtaacgtatgtattatttatt

SEQ ID NO: 24864 - DNA, 849 bp, Artificial Sequence
  chemically treated genomic DNA (Homo sapiens) CpG-island No: 24864
aataaataatacatacgttacgaacacaaaatataaacaccgttttcgattatccgaataacgcaattataccgatttacgatacattatataacgacgacgtaaaacacttactataccgacataaacaaaatacgacaataacgactatcgattatactcgtactaccgacaaaactaacgtatatatcgccacgtctaatccgaacgcaaccaacctaataaccgaacttacgaacgcactattaaattccatccctattattaccatcaccgatcaaatatccgcaccgtttatcgacactaacgcatttcaaaaaataaatatcctaaaattatcgttaacctataccaaacacaactttctaatacaatcgctaaaaaaattaccgcgcatcataactaaaacattcgacgttacctactcaaatcgtcctaatccgattctaatcgatatcccaaaaaatatccaattaaccaacgataacctaaaaccgtaattcaccaccgttaaaaacgaaataactttcccacataccgaaattaaacaaacgcgccaaatactaacaaaaacgcaaaaaccgatactatacgttaacgataacgtaaatataacgcaaacaattccgactttacgtaaatttctcgctaacacaaaaatacctaccacctatacgctaaaaaaacttaacgcaataaaaacaaattttccgtactatctaaacatactaaaaattcccgacaccaaacgaaaaacttcgcgaacccgaaattttcaccgtaattcccgtaaaccccgttttaaaaccgctaacgaaaataaaaaccttttacccaaacaaattttca

SEQ ID NO: 24865 - DNA, 657 bp, Artificial Sequence
  chemically treated genomic DNA (Homo sapiens) CpG-island No: 24865
cgtgggtatagaaagtttattcgggtttaagaatgatatagttgtttaagtgtttcgatatcgttcggttgatttttattacgttttagcgtacgtagaatttttacgttttacggtagatcgtcgcggtacggcgtatattagtcgtaggatttacgggcgaaaaatttttttaggttacgtattagcgatattatgttgattttatggttaatcgttatcgttagcgtcgtatttagacggttgttcgttttatcgatattttcgaattttatcggtagattaaggtgcgtttcggttaggaagttagttttcgcgtcgtttggttgttaggttttaaattttagattattacgtatattatcggcgtaattttcgaggatttcgcgtgcggtggtgtcgaacggtagtttttatagtttcggattttttattcgatcggagaagtttattagtttggtgttagtatttttatttttcgagatgttttgatattattttacgtcgttagcgaggatcgtcggaacgttatatagggtttcgacgttgttgatataggtcggtttattttatgcgtcggagttgtcgggaagggtggtttcgagcgtgggttagtacgacgttttttttaggggagttgattaacgttgttttttt

SEQ ID NO: 24866 - DNA, 657 bp, Artificial Sequence
  chemically treated genomic DNA (Homo sapiens) CpG-island No: 24866
aaaaaaacaacgttaatcaactcccctaaaaaaaacgtcgtactaacccacgctcgaaaccacccttcccgacaactccgacgcataaaataaaccgacctatatcaacaacgtcgaaaccctatataacgttccgacgatcctcgctaacgacgtaaaataatatcaaaacatctcgaaaaataaaaatactaacaccaaactaataaacttctccgatcgaataaaaaatccgaaactataaaaactaccgttcgacaccaccgcacgcgaaatcctcgaaaattacgccgataatatacgtaataatctaaaatttaaaacctaacaaccaaacgacgcgaaaactaacttcctaaccgaaacgcaccttaatctaccgataaaattcgaaaatatcgataaaacgaacaaccgtctaaatacgacgctaacgataacgattaaccataaaatcaacataatatcgctaatacgtaacctaaaaaaatttttcgcccgtaaatcctacgactaatatacgccgtaccgcgacgatctaccgtaaaacgtaaaaattctacgtacgctaaaacgtaataaaaatcaaccgaacgatatcgaaacacttaaacaactatatcattcttaaacccgaataaactttctatacccacg

SEQ ID NO: 24867 - DNA, 657 bp, Artificial Sequence
  chemically treated genomic DNA (Homo sapiens) CpG-island No: 24867
gaagaaatagcgttaattaatttttttgggaaggacgtcgtgttaatttacgttcgaagttatttttttcggtaatttcggcgtatggggtaaatcgatttgtgttaataacgtcgaaattttgtgtaacgtttcggcgattttcgttaacggcgtggagtggtattagaatatttcgaaaagtaaagatgttggtattaagttgatgggttttttcggtcgggtgaaaaattcgggattgtgggaattgtcgttcggtattatcgtacgcgagattttcgaagattacgtcggtggtatgcgtgatggtttgaaatttaaagtttggtagttaggcggcgcggggattgattttttgatcgaagcgtattttgatttgtcgatggaattcgaaagtatcggtaaagcgggtagtcgtttgggtacggcgttggcgatggcggttgattatgagattaatatggtgtcgttggtgcgtaatttggaagagtttttcgttcgtgagttttgcggttggtgtacgtcgtgtcgcgacggtttgtcgtggagcgtgaaaattttgcgtgcgttggagcgtggtgaaggttagtcgggcgatatcgaaatatttgagtaattgtgttatttttaggttcgggtaaattttttgtgtttacg

SEQ ID NO: 24868 - DNA, 657 bp, Artificial Sequence
  chemically treated genomic DNA (Homo sapiens) CpG-island No: 24868
cgtaaacacaaaaaatttacccgaacctaaaaataacacaattactcaaatatttcgatatcgcccgactaaccttcaccacgctccaacgcacgcaaaattttcacgctccacgacaaaccgtcgcgacacgacgtacaccaaccgcaaaactcacgaacgaaaaactcttccaaattacgcaccaacgacaccatattaatctcataatcaaccgccatcgccaacgccgtacccaaacgactacccgctttaccgatactttcgaattccatcgacaaatcaaaatacgcttcgatcaaaaaatcaatccccgcgccgcctaactaccaaactttaaatttcaaaccatcacgcataccaccgacgtaatcttcgaaaatctcgcgtacgataataccgaacgacaattcccacaatcccgaatttttcacccgaccgaaaaaacccatcaacttaataccaacatctttacttttcgaaatattctaataccactccacgccgttaacgaaaatcgccgaaacgttacacaaaatttcgacgttattaacacaaatcgatttaccccatacgccgaaattaccgaaaaaaataacttcgaacgtaaattaacacgacgtccttcccaaaaaaattaattaacgctatttcttc

SEQ ID NO: 24869 - DNA, 812 bp, Artificial Sequence
  chemically treated genomic DNA (Homo sapiens) CpG-island No: 24869
gcgggttagagtagtttatcgtcgcgtttttgtttttaaaaatttgtatttatgggtacgttttttttagttttgcggtttgtttttgttaggtttttgacgattttcgttaatgttgtaacgttgagttttggtagcgttttattgtgattcggtgaaaagtagattattcggttggtgtcgcgcgcgttttggtaacgtattagcggatcgtgattttttggcgtatttggcgtgttagatattaaagtcgtaaagttattagtgaaaacgtaagtttcggtgtaatcggggtttttatcgtttgttattcgtatattatttgcgtagaggaagtaatttggatcgtgcgtaggtaatatttgtgtggttggcgttttttgcgttttttgttaggggcgtttagcgcggtgcggtgaaattagaatttattgttcggtgagcgggtagtagcggcgatgtggatgattaacgggatttaattgcgttatggtcgttttttaatcgggatatttttgtggatggcgtgattgttagtgttaagtgttttgcgttattatatcgagatgtgcgacgtacgcgttaggttaggtgtaatcggcggattagtttgcgtttcgttcgttagtcgtaagggtttttatacgaagcggcgtttacggaagttaatcggttgttcgaggttcggcgaagggcgtaattaattcgaaagtaggtttacgtacgtttaggggttaagtgtcgtcgtttgttttagatcgtacgcgagagtgagacgtatatcgggcgggagaacgcggtcggatattggt

SEQ ID NO: 24870 - DNA, 812 bp, Artificial Sequence
  chemically treated genomic DNA (Homo sapiens) CpG-island No: 24870
accaatatccgaccgcgttctcccgcccgatatacgtctcactctcgcgtacgatctaaaacaaacgacgacacttaacccctaaacgtacgtaaacctactttcgaattaattacgcccttcgccgaacctcgaacaaccgattaacttccgtaaacgccgcttcgtataaaaacccttacgactaacgaacgaaacgcaaactaatccgccgattacacctaacctaacgcgtacgtcgcacatctcgatataataacgcaaaacacttaacactaacaatcacgccatccacaaaaatatcccgattaaaaaacgaccataacgcaattaaatcccgttaatcatccacatcgccgctactacccgctcaccgaacaataaattctaatttcaccgcaccgcgctaaacgcccctaacaaaaaacgcaaaaaacgccaaccacacaaatattacctacgcacgatccaaattacttcctctacgcaaataatatacgaataacaaacgataaaaaccccgattacaccgaaacttacgttttcactaataactttacgactttaatatctaacacgccaaatacgccaaaaaatcacgatccgctaatacgttaccaaaacgcgcgcgacaccaaccgaataatctacttttcaccgaatcacaataaaacgctaccaaaactcaacgttacaacattaacgaaaatcgtcaaaaacctaacaaaaacaaaccgcaaaactaaaaaaaacgtacccataaatacaaatttttaaaaacaaaaacgcgacgataaactactctaacccgc

SEQ ID NO: 24871 - DNA, 812 bp, Artificial Sequence
  chemically treated genomic DNA (Homo sapiens) CpG-island No: 24871
gttagtgttcggtcgcgttttttcgttcgatgtgcgttttattttcgcgtgcgatttgggataggcggcggtatttgatttttgggcgtgcgtgggtttgttttcgagttggttacgtttttcgtcgggtttcgggtaatcggttgattttcgtgggcgtcgtttcgtgtgggggtttttgcggttagcgggcggagcgtaggttagttcgtcggttgtatttgatttggcgcgtacgtcgtatatttcgatgtggtggcgtagaatatttggtattggtagttacgttatttatagggatatttcgattaagggacgattatgacgtaattaagtttcgttgattatttatatcgtcgttattattcgtttatcgggtaatggattttggttttatcgtatcgcgttaagcgtttttggtagggggcgtaggaaacgttagttatataggtgttatttgcgtacgatttagattgttttttttgcgtaggtaatgtgcgggtgataggcgatgagaatttcgattatatcgggatttacgtttttattaatgattttgcggttttgatgtttgatacgttagatgcgttagaaagttacgattcgttgatgcgttgttagagcgcgcgcggtattagtcgggtgatttgttttttatcggattatagtaaaacgttgttagagtttagcgttgtagtattgacggaaatcgttaaaagtttggtaggagtaaatcgtagaattggggaaaacgtatttatgggtgtaggtttttgaaaataaaggcgcggcgatgggttgttttaattcgt

SEQ ID NO: 24872 - DNA, 812 bp, Artificial Sequence
  chemically treated genomic DNA (Homo sapiens) CpG-island No: 24872
acgaattaaaacaacccatcgccgcgcctttattttcaaaaacctacacccataaatacgttttccccaattctacgatttactcctaccaaacttttaacgatttccgtcaatactacaacgctaaactctaacaacgttttactataatccgataaaaaacaaatcacccgactaataccgcgcgcgctctaacaacgcatcaacgaatcgtaactttctaacgcatctaacgtatcaaacatcaaaaccgcaaaatcattaataaaaacgtaaatcccgatataatcgaaattctcatcgcctatcacccgcacattacctacgcaaaaaaaacaatctaaatcgtacgcaaataacacctatataactaacgtttcctacgccccctaccaaaaacgcttaacgcgatacgataaaaccaaaatccattacccgataaacgaataataacgacgatataaataatcaacgaaacttaattacgtcataatcgtcccttaatcgaaatatccctataaataacgtaactaccaataccaaatattctacgccaccacatcgaaatatacgacgtacgcgccaaatcaaatacaaccgacgaactaacctacgctccgcccgctaaccgcaaaaacccccacacgaaacgacgcccacgaaaatcaaccgattacccgaaacccgacgaaaaacgtaaccaactcgaaaacaaacccacgcacgcccaaaaatcaaataccgccgcctatcccaaatcgcacgcgaaaataaaacgcacatcgaacgaaaaaacgcgaccgaacactaac

SEQ ID NO: 24873 - DNA, 1230 bp, Artificial Sequence
  chemically treated genomic DNA (Homo sapiens) CpG-island No: 24873
  misc_feature (1002)..(1002): n is either a, c, g or t
tggtcgaaatttgttcgatcggcgtattatcgataaaacgtatttcgagcgttataatcgtaaatgggatatgtagttagcgtcgagtatttgttagtaatgttttatcggttgtaatattagtttcggatgaacgttacggcgaattgcgatcgtatcgaaaatcgttataacggtacggtaaattattattttttttgcgatcgtggtcgtttcggttacggttacgttaatttgaaggatcgttcgcgttagttagtatagcgtcgtggcgatgattttattatttttaacgtcgaataggtaatgtagggcgcggtagatattttgcgttagtcgaagaaagtgatcggtattggttttttcgcgtgttagcgtggaaagtaattttgcgttgcgtgaattggtgggcgaagaaaatttttatatcggtatcgtttacggtgagtaggaacgtttgtaattggcgttgaaagtgttgcgtgaaggcggtatttatatttcggttttgcgcgaaatcgaattttacgatgcggtattggtgttgggcgaagacgttatttagatcggcgcgcgcgtcgcgttggtagtgcgttaggttgtgaaaggtaaagcgcgcgaaatggcggtagtatagaaagtggttgattggtagattgcggtaatttttaatatcggttaacgtgcgaagtattcgttgtttgttattaacgttgatgatattcgtttggatgatatcgcggcgtggatttatcgcgtatcggttgaagattaggcgcgtttaggttttgttatcgtttatgcgttggataattttgtattagcggttgacggtatcgaatttgagttgtaaagtaaaatcgacgttatcgtgtaggtattggtaggtgcgaagaaatcgttgattattttcgggacgaacgtcggtagtttagaggtgatttaggcggcggttaacgtcgcgaaagttttgaaaggtcgcggcgttgacgtcggtattanttatgattgttcgtttcgttaatagtatggggttgggtattatgggtggcggttcgtttgaagaagcgttaatcgaattggaaatcggacgcgtcgacgcggtggtggtgttggaaaacgatttgtatcgttacgtttttgttattcgcgtgaatgttgcgttggttaaagtatcgttggtgatggtggttgattattaacgtatagcgattatggaaaacgtttatt

SEQ ID NO: 24874 - DNA, 1230 bp, Artificial Sequence
  chemically treated genomic DNA (Homo sapiens) CpG-island No: 24874
  misc_feature (229)..(229): n is either a, c, g or t
aataaacgttttccataatcgctatacgttaataatcaaccaccatcaccaacgatactttaaccaacgcaacattcacgcgaataacaaaaacgtaacgatacaaatcgttttccaacaccaccaccgcgtcgacgcgtccgatttccaattcgattaacgcttcttcaaacgaaccgccacccataatacccaaccccatactattaacgaaacgaacaatcataantaataccgacgtcaacgccgcgacctttcaaaactttcgcgacgttaaccgccgcctaaatcacctctaaactaccgacgttcgtcccgaaaataatcaacgatttcttcgcacctaccaatacctacacgataacgtcgattttactttacaactcaaattcgataccgtcaaccgctaatacaaaattatccaacgcataaacgataacaaaacctaaacgcgcctaatcttcaaccgatacgcgataaatccacgccgcgatatcatccaaacgaatatcatcaacgttaataacaaacaacgaatacttcgcacgttaaccgatattaaaaattaccgcaatctaccaatcaaccactttctatactaccgccatttcgcgcgctttacctttcacaacctaacgcactaccaacgcgacgcgcgcgccgatctaaataacgtcttcgcccaacaccaataccgcatcgtaaaattcgatttcgcgcaaaaccgaaatataaataccgccttcacgcaacactttcaacgccaattacaaacgttcctactcaccgtaaacgataccgatataaaaattttcttcgcccaccaattcacgcaacgcaaaattactttccacgctaacacgcgaaaaaaccaataccgatcactttcttcgactaacgcaaaatatctaccgcgccctacattacctattcgacgttaaaaataataaaatcatcgccacgacgctatactaactaacgcgaacgatccttcaaattaacgtaaccgtaaccgaaacgaccacgatcgcaaaaaaaataataatttaccgtaccgttataacgattttcgatacgatcgcaattcgccgtaacgttcatccgaaactaatattacaaccgataaaacattactaacaaatactcgacgctaactacatatcccatttacgattataacgctcgaaatacgttttatcgataatacgccgatcgaacaaatttcgacca

SEQ ID NO: 24875 - DNA, 1230 bp, Artificial Sequence
  chemically treated genomic DNA (Homo sapiens) CpG-island No: 24875
  misc_feature (229)..(229): n is either a, c, g or t
gatgggcgttttttataatcgttgtgcgttgatgattaattattattattagcggtgttttagttagcgtagtatttacgcggatagtagaagcgtgacgatgtagatcgttttttaatattattatcgcgtcggcgcgttcggtttttagttcggttaacgtttttttaagcgaatcgttatttataatgtttagttttatgttgttgacggaacgggtaattatggntgatatcgacgttagcgtcgcgattttttagggttttcgcgacgttagtcgtcgtttgaattatttttaagttatcggcgttcgtttcggagataattaacggttttttcgtatttgttagtgtttgtacgatgacgtcgattttgttttgtagtttaggttcgatatcgttaatcgttggtgtagagttatttagcgtatgggcgatggtaaaatttaaacgcgtttgatttttaatcggtgcgcggtaagtttacgtcgcgatattatttagacgggtgttattaacgttggtaataaatagcggatgtttcgtacgttgatcgatgttgaggattgtcgtaatttgttagttagttattttttgtgttgtcgttatttcgcgcgttttattttttatagtttgacgtattgttagcgcgacgcgcgcgtcggtttgggtaacgttttcgtttagtattagtatcgtatcgtaagattcgatttcgcgtagagtcggagtataaatgtcgtttttacgtagtatttttagcgttagttgtagacgtttttgtttatcgtgagcgatatcggtgtagaagtttttttcgtttattagtttacgtagcgtaaagttgttttttacgttggtacgcgggagaattaatatcgattatttttttcgattgacgtagaatatttgtcgcgttttgtattgtttgttcggcgttgagggtaatgaaattatcgttacgacgttgtattggttgacgcggacgattttttaggttgacgtaatcgtaatcgaaacgattacggtcgtagaggaagtagtggtttatcgtatcgttgtaacggttttcgatacgatcgtagttcgtcgtaacgtttattcggggttgatgttatagtcgatggaatattgttggtagatgttcggcgttaattgtatattttatttacggttgtaacgttcggagtgcgttttgtcggtaatacgtcggtcgggtaaatttcgatta

SEQ ID NO: 24876 - DNA, 1230 bp, Artificial Sequence
  chemically treated genomic DNA (Homo sapiens) CpG-island No: 24876
  misc_feature (1002)..(1002): n is either a, c, g or t
taatcgaaatttacccgaccgacgtattaccgacaaaacgcactccgaacgttacaaccgtaaataaaatatacaattaacgccgaacatctaccaacaatattccatcgactataacatcaaccccgaataaacgttacgacgaactacgatcgtatcgaaaaccgttacaacgatacgataaaccactacttcctctacgaccgtaatcgtttcgattacgattacgtcaacctaaaaaatcgtccgcgtcaaccaatacaacgtcgtaacgataatttcattaccctcaacgccgaacaaacaatacaaaacgcgacaaatattctacgtcaatcgaaaaaaataatcgatattaattctcccgcgtaccaacgtaaaaaacaactttacgctacgtaaactaataaacgaaaaaaacttctacaccgatatcgctcacgataaacaaaaacgtctacaactaacgctaaaaatactacgtaaaaacgacatttatactccgactctacgcgaaatcgaatcttacgatacgatactaatactaaacgaaaacgttacccaaaccgacgcgcgcgtcgcgctaacaatacgtcaaactataaaaaataaaacgcgcgaaataacgacaacacaaaaaataactaactaacaaattacgacaatcctcaacatcgatcaacgtacgaaacatccgctatttattaccaacgttaataacacccgtctaaataatatcgcgacgtaaacttaccgcgcaccgattaaaaatcaaacgcgtttaaattttaccatcgcccatacgctaaataactctacaccaacgattaacgatatcgaacctaaactacaaaacaaaatcgacgtcatcgtacaaacactaacaaatacgaaaaaaccgttaattatctccgaaacgaacgccgataacttaaaaataattcaaacgacgactaacgtcgcgaaaaccctaaaaaatcgcgacgctaacgtcgatatcanccataattacccgttccgtcaacaacataaaactaaacattataaataacgattcgcttaaaaaaacgttaaccgaactaaaaaccgaacgcgccgacgcgataataatattaaaaaacgatctacatcgtcacgcttctactatccgcgtaaatactacgctaactaaaacaccgctaataataataattaatcatcaacgcacaacgattataaaaaacgcccatc

SEQ ID NO: 24877 - DNA, 568 bp, Artificial Sequence
  chemically treated genomic DNA (Homo sapiens) CpG-island No: 24877
tacgtcggagatggcgcgtacgataataaacgggacgttgaaattgtggtagatatgggcgattgtcgtcgtttttatttttatagtaatggtttgtgggaagttgtggcggattttcgttagattaatagaatcgttgatgaaagcgtcgtcgttaataattaggttacgtatagcgttaagatttagttcggtaatgtaggttttagcggtagcgattagtttatcgttagttttaaagtttgtcggatagtttggtaattgatcgtatttataattaaatgtcgtgatattcgcgtcgtgataacgtgtttcgttcgagataacgatatcgtttatttttaacgttggtgttaggttatcggtagaatcggtgttaataattatatttggtttgtagtgttttaatagtaaagtgggatttagcgtcgtagcgattttagcgatgttcgattttagaagcgtaaattcggttttatttaggtgggcgggatagattcgtaacggtcgagatgatagttcgacggtttcgatttggtacgtaataggtaattttttttttatggtt

SEQ ID NO: 24878 - DNA, 568 bp, Artificial Sequence
  chemically treated genomic DNA (Homo sapiens) CpG-island No: 24878
aaccataaaaaaaaaattacctattacgtaccaaatcgaaaccgtcgaactatcatctcgaccgttacgaatctatcccgcccacctaaataaaaccgaatttacgcttctaaaatcgaacatcgctaaaatcgctacgacgctaaatcccactttactattaaaacactacaaaccaaatataattattaacaccgattctaccgataacctaacaccaacgttaaaaataaacgatatcgttatctcgaacgaaacacgttatcacgacgcgaatatcacgacatttaattataaatacgatcaattaccaaactatccgacaaactttaaaactaacgataaactaatcgctaccgctaaaacctacattaccgaactaaatcttaacgctatacgtaacctaattattaacgacgacgctttcatcaacgattctattaatctaacgaaaatccgccacaacttcccacaaaccattactataaaaataaaaacgacgacaatcgcccatatctaccacaatttcaacgtcccgtttattatcgtacgcgccatctccgacgta

SEQ ID NO: 24879 - DNA, 568 bp, Artificial Sequence
  chemically treated genomic DNA (Homo sapiens) CpG-island No: 24879
ggttatggaagagaagttatttgttgcgtgttaaatcggaatcgtcgaattattatttcggtcgttgcgaatttatttcgtttatttgaatggaatcgagtttgcgtttttgaaatcgggtatcgttaaagtcgttgcggcgttgggttttattttgttgttggaatattgtaagttagatgtgattattaatatcggttttgtcggtggtttggtattaacgttgaaagtgggcgatatcgttgtttcggacgaagtacgttattacgacgcggatgttacggtatttggttatgaatacggttagttattaggttgttcggtaggttttaaagttgacgataaattgatcgttgtcgttgaggtttgtattgtcgaattgaattttaacgttgtacgtggtttgattgttagcggcgacgtttttattaacggttttgttggtttggcgaaaattcgttataattttttataggttattgttgtagagatggaagcgacggtaatcgtttatgtttgttataattttaacgtttcgtttgttgtcgtacgcgttattttcgacgtg

SEQ ID NO: 24880 - DNA, 568 bp, Artificial Sequence
  chemically treated genomic DNA (Homo sapiens) CpG-island No: 24880
cacgtcgaaaataacgcgtacgacaacaaacgaaacgttaaaattataacaaacataaacgattaccgtcgcttccatctctacaacaataacctataaaaaattataacgaattttcgccaaaccaacaaaaccgttaataaaaacgtcgccgctaacaatcaaaccacgtacaacgttaaaattcaattcgacaatacaaacctcaacgacaacgatcaatttatcgtcaactttaaaacctaccgaacaacctaataactaaccgtattcataaccaaataccgtaacatccgcgtcgtaataacgtacttcgtccgaaacaacgatatcgcccactttcaacgttaataccaaaccaccgacaaaaccgatattaataatcacatctaacttacaatattccaacaacaaaataaaacccaacgccgcaacgactttaacgatacccgatttcaaaaacgcaaactcgattccattcaaataaacgaaataaattcgcaacgaccgaaataataattcgacgattccgatttaacacgcaacaaataacttctcttccataacc

SEQ ID NO: 24881 - DNA, 765 bp, Artificial Sequence
  chemically treated genomic DNA (Homo sapiens) CpG-island No: 24881
gagttgcgttatttatatcgattttcgagatcgatttcgtttcgaacgggtcgattttatcgtcgttcggtattagtatagcgcggaaattacgcggaatgttattaattttcggtgcgtcgtaattgcgtaaattacgcgttaacgggtgattttcggcgttataaatgattttttcgtttatattgtggtcgatagtacgtagggtggtatcgtagatttgttttaacgttaattttggattgatcggtgtatcgtagtttagtaaggcgtagaatttatttaggcggattttattcgtacgcgtgttgacggtaattttagcgaagtttgcgttatacgggaaggcgaaattaggcgtgatataattgttagtttttattagtgaattaaagtcggtgtcggtttcgtttttatgggtaatattttcgaaattaatttcgttttttttgtcgcgtacgacgttcggcgttgttagttgaatatttgttattggtttatttaatatttgcgcgtcgtggaatagaattttttttcgtagatttttcgttgttaaacgcgtcgcgttattcgagaagtaagtatcggacgaggtatatgcgtttttattaaataacgtatgatcggtattatcggagataatatgtacgttttgcggtgggtagtgtagtatttttgttgttagtttcgttattatagtatttagattagtattaatattcgtatcgttagaatgaacgataaaggtgtcgttcgattttagtt

SEQ ID NO: 24882 - DNA, 765 bp, Artificial Sequence
  chemically treated genomic DNA (Homo sapiens) CpG-island No: 24882
aactaaaatcgaacgacacctttatcgttcattctaacgatacgaatattaatactaatctaaatactataataacgaaactaacaacaaaaatactacactacccaccgcaaaacgtacatattatctccgataataccgatcatacgttatttaataaaaacgcatatacctcgtccgatacttacttctcgaataacgcgacgcgtttaacaacgaaaaatctacgaaaaaaaattctattccacgacgcgcaaatattaaataaaccaataacaaatattcaactaacaacgccgaacgtcgtacgcgacaaaaaaaacgaaattaatttcgaaaatattacccataaaaacgaaaccgacaccgactttaattcactaataaaaactaacaattatatcacgcctaatttcgccttcccgtataacgcaaacttcgctaaaattaccgtcaacacgcgtacgaataaaatccgcctaaataaattctacgccttactaaactacgatacaccgatcaatccaaaattaacgttaaaacaaatctacgataccaccctacgtactatcgaccacaatataaacgaaaaaatcatttataacgccgaaaatcacccgttaacgcgtaatttacgcaattacgacgcaccgaaaattaataacattccgcgtaatttccgcgctatactaataccgaacgacgataaaatcgacccgttcgaaacgaaatcgatctcgaaaatcgatataaataacgcaactc

SEQ ID NO: 24883 - DNA, 765 bp, Artificial Sequence
  chemically treated genomic DNA (Homo sapiens) CpG-island No: 24883
aattggaatcggacggtatttttatcgtttattttggcggtgcggatattggtattggtttggatattgtagtgacgaaattggtagtagaagtgttgtattgtttatcgtaggacgtgtatgttattttcggtgatatcgattatgcgttgtttgataaaggcgtatatgtttcgttcggtatttgtttttcgggtaacgcggcgcgtttggtagcggaaaatttacgggagaaaattttgttttacggcgcgtaaatgttgggtgagttagtggtagatgtttaattggtaacgtcgggcgtcgtgcgcggtaagaaaggcgaagttagtttcggggatattgtttataaaggcgaaatcggtatcggttttggtttattggtgggaattggtagttatattacgtttgatttcgttttttcgtatggcgtaaatttcgttgaagttgtcgttaatacgcgtacgggtgaaattcgtttggataaattttacgttttgttggattgcggtatatcggttaatttagagttagcgttgggataaatttacggtgttattttgcgtgttatcggttatagtatgagcgaagagattatttatgacgtcgaaggttattcgttaacgcgtgatttacgtagttacggcgtatcgaaaattggtgatatttcgcgtgattttcgcgttgtgttggtgtcgagcgacgataaagtcggttcgttcggggcgaaatcgatttcggaaatcggtgtaaatggcgtagttt

SEQ ID NO: 24884 - DNA, 765 bp, Artificial Sequence
  chemically treated genomic DNA (Homo sapiens) CpG-island No: 24884
aaactacgccatttacaccgatttccgaaatcgatttcgccccgaacgaaccgactttatcgtcgctcgacaccaacacaacgcgaaaatcacgcgaaatatcaccaattttcgatacgccgtaactacgtaaatcacgcgttaacgaataaccttcgacgtcataaataatctcttcgctcatactataaccgataacacgcaaaataacaccgtaaatttatcccaacgctaactctaaattaaccgatataccgcaatccaacaaaacgtaaaatttatccaaacgaatttcacccgtacgcgtattaacgacaacttcaacgaaatttacgccatacgaaaaaacgaaatcaaacgtaatataactaccaattcccaccaataaaccaaaaccgataccgatttcgcctttataaacaatatccccgaaactaacttcgcctttcttaccgcgcacgacgcccgacgttaccaattaaacatctaccactaactcacccaacatttacgcgccgtaaaacaaaattttctcccgtaaattttccgctaccaaacgcgccgcgttacccgaaaaacaaataccgaacgaaacatatacgcctttatcaaacaacgcataatcgatatcaccgaaaataacatacacgtcctacgataaacaatacaacacttctactaccaatttcgtcactacaatatccaaaccaataccaatatccgcaccgccaaaataaacgataaaaataccgtccgattccaatt

SEQ ID NO: 24885 - DNA, 537 bp, Artificial Sequence
  chemically treated genomic DNA (Homo sapiens) CpG-island No: 24885
gtacggaaatatatatcgtataggtagtagtacggttcgttattgtatgcgcgtagcgtaggtaattattagcgtagttgtcggtaagtatttatcggtatagattcgatgtatcgtatcgttatgtagagtaaaattttcgttttatcggggtgaagttggagtttttaatttatcggttggatgtcgattgaggttggagttttcgtcgttaaagtttttaaggttgtaagattcggataggttcgtattttatcggggaatcggacgttttgaattaaggattttaggttgaatattttttgttttattgtcgtatagggtatcgcgcgtataacggacgtaggatttaatcgtagtagttagttaacggtaagtacgttatacggttaaatgttatttagatattcgtttcgtcgcgtttcgatattttttagcggaaaatttacgaacgttatgttgtttataggtattatattacgaggtaggaaatagtttataaaaagttacgaaaggttatcgtttttcgcgggttat

SEQ ID NO: 24886 - DNA, 537 bp, Artificial Sequence
  chemically treated genomic DNA (Homo sapiens) CpG-island No: 24886
ataacccgcgaaaaacgataacctttcgtaactttttataaactatttcctacctcgtaatataatacctataaacaacataacgttcgtaaattttccgctaaaaaatatcgaaacgcgacgaaacgaatatctaaataacatttaaccgtataacgtacttaccgttaactaactactacgattaaatcctacgtccgttatacgcgcgataccctatacgacaataaaacaaaaaatattcaacctaaaatccttaattcaaaacgtccgattccccgataaaatacgaacctatccgaatcttacaaccttaaaaactttaacgacgaaaactccaacctcaatcgacatccaaccgataaattaaaaactccaacttcaccccgataaaacgaaaattttactctacataacgatacgatacatcgaatctataccgataaatacttaccgacaactacgctaataattacctacgctacgcgcatacaataacgaaccgtactactacctatacgatatatatttccgtac

SEQ ID NO: 24887 - DNA, 537 bp, Artificial Sequence
  chemically treated genomic DNA (Homo sapiens) CpG-island No: 24887
gtgattcgcgagaaacgatggtttttcgtgattttttgtgagttgttttttgtttcgtagtgtggtgtttgtaggtagtatggcgttcgtgggtttttcgttggggagtgtcggggcgcggcggggcgggtatttaggtggtatttggtcgtatggcgtgtttgtcgttggttgattgttgcggttgggttttgcgttcgttgtgcgcgcggtgttttgtgcgatagtgaggtaaggagtgtttagtttgaggtttttgatttaggacgttcggtttttcggtgaggtgcggatttattcggattttatagttttgggggttttgacggcgggagttttagttttagtcgatatttagtcggtggattagggattttagttttatttcggtgggacggaggttttattttgtatgacgatgcgatgtatcgggtttgtgtcggtgagtgtttgtcggtagttgcgttggtgattgtttgcgttgcgcgtatgtaatggcggatcgtgttgttgtttatgcggtatgtgttttcgtgt

SEQ ID NO: 24888 - DNA, 537 bp, Artificial Sequence
  chemically treated genomic DNA (Homo sapiens) CpG-island No: 24888
acacgaaaacacataccgcataaacaacaacacgatccgccattacatacgcgcaacgcaaacaatcaccaacgcaactaccgacaaacactcaccgacacaaacccgatacatcgcatcgtcatacaaaataaaacctccgtcccaccgaaataaaactaaaatccctaatccaccgactaaatatcgactaaaactaaaactcccgccgtcaaaacccccaaaactataaaatccgaataaatccgcacctcaccgaaaaaccgaacgtcctaaatcaaaaacctcaaactaaacactccttacctcactatcgcacaaaacaccgcgcgcacaacgaacgcaaaacccaaccgcaacaatcaaccaacgacaaacacgccatacgaccaaataccacctaaatacccgccccgccgcgccccgacactccccaacgaaaaacccacgaacgccatactacctacaaacaccacactacgaaacaaaaaacaactcacaaaaaatcacgaaaaaccatcgtttctcgcgaatcac

SEQ ID NO: 24889 - DNA, 642 bp, Artificial Sequence
  chemically treated genomic DNA (Homo sapiens) CpG-island No: 24889
gtagtagacgacgttcgcggtttttaacgaatagtagcgcgcggttagtacgattcgtacgatcggtacgatcgatacggtgaacgtaagatttagaatttatcgggatatcgtagttaattattaggttgatacgtttaacgtttaggttacgggttgtaacgtcggtcgtaattaggatgtttagacgattattttttaggcgttttagtgtttgtttacgtagcgtttggatttatgttatcgtttagcgcggcgttgttgtagtttgttacgtttaagagttttagttatttttagagtcgcgtttttggtacgaacgaagataagtcgtcgtattaaaatttttcgcgttttaggaaacgtattagtgtttcgtgttcgcgtatattttagatagtttagtagttttggttgatgttcggacgggtagttacgttggattgaatgcgtattttttgcggtttttttataaagcggcgggtaatgcgacgaatcgttttcggtatggttgtagagaatagagcggtttgatgatttttcgggatttgcgttataatggttttaacgttttcgatgaagtttatgcgtagtatgtcgttagttttatttttagtaagttatgattcggtttagttttag

SEQ ID NO: 24890 - DNA, 642 bp, Artificial Sequence
  chemically treated genomic DNA (Homo sapiens) CpG-island No: 24890
ctaaaactaaaccgaatcataacttactaaaaataaaactaacgacatactacgcataaacttcatcgaaaacgttaaaaccattataacgcaaatcccgaaaaatcatcaaaccgctctattctctacaaccataccgaaaacgattcgtcgcattacccgccgctttataaaaaaaccgcaaaaaatacgcattcaatccaacgtaactacccgtccgaacatcaaccaaaactactaaactatctaaaatatacgcgaacacgaaacactaatacgtttcctaaaacgcgaaaaattttaatacgacgacttatcttcgttcgtaccaaaaacgcgactctaaaaataactaaaactcttaaacgtaacaaactacaacaacgccgcgctaaacgataacataaatccaaacgctacgtaaacaaacactaaaacgcctaaaaaataatcgtctaaacatcctaattacgaccgacgttacaacccgtaacctaaacgttaaacgtatcaacctaataattaactacgatatcccgataaattctaaatcttacgttcaccgtatcgatcgtaccgatcgtacgaatcgtactaaccgcgcgctactattcgttaaaaaccgcgaacgtcgtctactac

SEQ ID NO: 24891 - DNA, 642 bp, Artificial Sequence
  chemically treated genomic DNA (Homo sapiens) CpG-island No: 24891
ttaaaattgagtcgagttatggtttattgagaatgaagttgacgatatgttgcgtatgggttttatcgaagacgttgaaattattatggcgtagatttcggaaggttattagatcgttttgttttttgtaattatgtcggaagcgattcgtcgtattattcgtcgttttatgaaagagtcgtaggaagtgcgtatttagtttagcgtgattattcgttcggatattagttagagttattggattgtttggggtatgcgcgaatacgaagtattggtacgttttttggaacgcggaagattttgatgcggcgatttattttcgttcgtattaaaaacgcgattttggaagtggttgaagtttttgagcgtaataggttataatagcgtcgcgttgaacggtgatatgaatttaggcgttgcgtgaatagatattggaacgtttgaaagatggtcgtttggatattttgattgcgatcgacgttgtagttcgtggtttggacgttgagcgtattagtttggtagttaattacgatatttcgatggattttgagttttacgtttatcgtatcggtcgtatcggtcgtgcgggtcgtgttggtcgcgcgttgttgttcgttgagaatcgcgagcgtcgtttgttgt

SEQ ID NO: 24892 - DNA, 642 bp, Artificial Sequence
  chemically treated genomic DNA (Homo sapiens) CpG-island No: 24892
acaacaaacgacgctcgcgattctcaacgaacaacaacgcgcgaccaacacgacccgcacgaccgatacgaccgatacgataaacgtaaaactcaaaatccatcgaaatatcgtaattaactaccaaactaatacgctcaacgtccaaaccacgaactacaacgtcgatcgcaatcaaaatatccaaacgaccatctttcaaacgttccaatatctattcacgcaacgcctaaattcatatcaccgttcaacgcgacgctattataacctattacgctcaaaaacttcaaccacttccaaaatcgcgtttttaatacgaacgaaaataaatcgccgcatcaaaatcttccgcgttccaaaaaacgtaccaatacttcgtattcgcgcataccccaaacaatccaataactctaactaatatccgaacgaataatcacgctaaactaaatacgcacttcctacgactctttcataaaacgacgaataatacgacgaatcgcttccgacataattacaaaaaacaaaacgatctaataaccttccgaaatctacgccataataatttcaacgtcttcgataaaacccatacgcaacatatcgtcaacttcattctcaataaaccataactcgactcaattttaa

SEQ ID NO: 24893 - DNA, 527 bp, Artificial Sequence
  chemically treated genomic DNA (Homo sapiens) CpG-island No: 24893
tttatcgagaaataacgcggcgaaaattattatttagaacggtatggtatagtttaggatcgttatttttttcgtattttcgttgattaacgtttattgcgttagattaattatttcgtaggtttgtaatagggtaatggttaaggtgtatttaaacggtgtcgggcgtatttcgcgattacgtaatataaggacgatgaataatacgagagcgtcgaatatgtagcgtacggcggtaaagtcgaaggtatcgatgtaattggtgatttgttttttgataatttagttataattttatattacgtgtgatttaaatacgttatgattgttagtgcgttgttttttttgcggtcgattgagaatttcggttatttcgtcgttattaattcgttatatcgttttttacgttatatttcgttaagggttttatacgttaaggtagtatttttatatgttcgaattaataattcggtttacggaattttttacgacgttttttatatttttattttttttttattatattt

SEQ ID NO: 24894 - DNA, 527 bp, Artificial Sequence
  chemically treated genomic DNA (Homo sapiens) CpG-island No: 24894
aaatataataaaaaaaaaataaaaatataaaaaacgtcgtaaaaaattccgtaaaccgaattattaattcgaacatataaaaatactaccttaacgtataaaacccttaacgaaatataacgtaaaaaacgatataacgaattaataacgacgaaataaccgaaattctcaatcgaccgcaaaaaaaacaacgcactaacaatcataacgtatttaaatcacacgtaatataaaattataactaaattatcaaaaaacaaatcaccaattacatcgataccttcgactttaccgccgtacgctacatattcgacgctctcgtattattcatcgtccttatattacgtaatcgcgaaatacgcccgacaccgtttaaatacaccttaaccattaccctattacaaacctacgaaataattaatctaacgcaataaacgttaatcaacgaaaatacgaaaaaaataacgatcctaaactataccataccgttctaaataataattttcgccgcgttatttctcgataaa

SEQ ID NO: 24895 - DNA, 527 bp, Artificial Sequence
  chemically treated genomic DNA (Homo sapiens) CpG-island No: 24895
gggtgtggtggggggggggtgggggtgtgggggacgtcgtgggggatttcgtgggtcgagttgttaattcgggtatgtaaggatattgttttggcgtgtaggatttttggcggggtgtggcgtggggaacggtgtggcgggttagtggcggcggagtaatcgggatttttagtcggtcgtagagagagtaacgtattggtaattatggcgtgtttgggttatacgtgatgtggagttatagttggattgttaggaagtaagttattagttatatcggtgttttcgattttatcgtcgtacgttgtatgttcggcgttttcgtgttatttatcgtttttgtattacgtggtcgcggaatgcgttcgatatcgtttaaatatattttagttattgttttgttataaatttgcgggatggttggtttggcgtagtgggcgttggttagcggaggtgcggggaaggtggcgattttgagttatattatgtcgttttgggtggtgattttcgtcgcgttgtttttcggtgaa

SEQ ID NO: 24896 - DNA, 527 bp, Artificial Sequence
  chemically treated genomic DNA (Homo sapiens) CpG-island No: 24896
ttcaccgaaaaacaacgcgacgaaaatcaccacccaaaacgacataatataactcaaaatcgccaccttccccgcacctccgctaaccaacgcccactacgccaaaccaaccatcccgcaaatttataacaaaacaataactaaaatatatttaaacgatatcgaacgcattccgcgaccacgtaatacaaaaacgataaataacacgaaaacgccgaacatacaacgtacgacgataaaatcgaaaacaccgatataactaataacttacttcctaacaatccaactataactccacatcacgtataacccaaacacgccataattaccaatacgttactctctctacgaccgactaaaaatcccgattactccgccgccactaacccgccacaccgttccccacgccacaccccgccaaaaatcctacacgccaaaacaatatccttacatacccgaattaacaactcgacccacgaaatcccccacgacgtcccccacacccccaccccccccccaccacaccc

SEQ ID NO: 24897 - DNA, 556 bp, Artificial Sequence
  chemically treated genomic DNA (Homo sapiens) CpG-island No: 24897
attatcgggttagtgtcgaagtcgaagttttttgcgtcgagaatcgtcgttttgatgatatcgatattcgtttttaggtcgttatcgatttgtaaacggattttgtgacgtaagtcgttagtaattagcgtttgttgggttttaataagttttagtttttacggatagtttgcgtattttatcgatgaaagcggatttgcgtcggtgtcgtcgttatagtttgcgatggtgattaagttcgtataagtttttgttacgttagtcgcgatggtgtttattttcggttcggaaattagttttacggagattatcgttttcgggttaatttgtttgaggtcgaaaatgagttgcgttaagttttcgatagagtagatatcgtggtgcggcggcggggagattagcgttatttcgggtatcgaatagcgtagtttggcgattaaggcgtgattttattattcggtaattgagcgttttcgtttggtttcgcgttttgggcgaattttatttgaatgacgtttcggttgatagataagtcggattaattttaagcgaacgg

SEQ ID NO: 24898 - DNA, 556 bp, Artificial Sequence
  chemically treated genomic DNA (Homo sapiens) CpG-island No: 24898
ccgttcgcttaaaattaatccgacttatctatcaaccgaaacgtcattcaaataaaattcgcccaaaacgcgaaaccaaacgaaaacgctcaattaccgaataataaaatcacgccttaatcgccaaactacgctattcgatacccgaaataacgctaatctccccgccgccgcaccacgatatctactctatcgaaaacttaacgcaactcattttcgacctcaaacaaattaacccgaaaacgataatctccgtaaaactaatttccgaaccgaaaataaacaccatcgcgactaacgtaacaaaaacttatacgaacttaatcaccatcgcaaactataacgacgacaccgacgcaaatccgctttcatcgataaaatacgcaaactatccgtaaaaactaaaacttattaaaacccaacaaacgctaattactaacgacttacgtcacaaaatccgtttacaaatcgataacgacctaaaaacgaatatcgatatcatcaaaacgacgattctcgacgcaaaaaacttcgacttcgacactaacccgataat

SEQ ID NO: 24899 - DNA, 556 bp, Artificial Sequence
  chemically treated genomic DNA (Homo sapiens) CpG-island No: 24899
tcgttcgtttggggttaattcggtttatttgttaatcggaacgttatttagataaaattcgtttagggcgcgaagttaggcgaaggcgtttagttgtcgggtgataaagttacgttttaatcgttaaattgcgttattcggtgttcggagtgacgttgattttttcgtcgtcgtattacgatatttattttatcgaggatttagcgtagtttattttcgattttaagtaggttaattcgaaagcgatgattttcgtgaagttggttttcgaatcgggagtaggtattatcgcgattggcgtggtaaaagtttatgcggatttgattattatcgtaggttatgacggcggtatcggcgtaagttcgtttttatcggtgaaatacgtaggttgttcgtgggagttggggtttgttgaaatttagtaggcgttggttgttaacggtttgcgttataagattcgtttgtaggtcgatggcggtttgaaaacgggtgtcgatattattaaggcggcgattttcggcgtagaaagtttcggtttcggtattggttcgatggt

SEQ ID NO: 24900 - DNA, 556 bp, Artificial Sequence
  chemically treated genomic DNA (Homo sapiens) CpG-island No: 24900
accatcgaaccaataccgaaaccgaaactttctacgccgaaaatcgccgccttaataatatcgacacccgttttcaaaccgccatcgacctacaaacgaatcttataacgcaaaccgttaacaaccaacgcctactaaatttcaacaaaccccaactcccacgaacaacctacgtatttcaccgataaaaacgaacttacgccgataccgccgtcataacctacgataataatcaaatccgcataaacttttaccacgccaatcgcgataatacctactcccgattcgaaaaccaacttcacgaaaatcatcgctttcgaattaacctacttaaaatcgaaaataaactacgctaaatcctcgataaaataaatatcgtaatacgacgacgaaaaaatcaacgtcactccgaacaccgaataacgcaatttaacgattaaaacgtaactttatcacccgacaactaaacgccttcgcctaacttcgcgccctaaacgaattttatctaaataacgttccgattaacaaataaaccgaattaaccccaaacgaacga

SEQ ID NO: 24901 - DNA, 532 bp, Artificial Sequence
  chemically treated genomic DNA (Homo sapiens) CpG-island No: 24901
  misc_feature (273)..(274): n is either a, c, g or t
  misc_feature (292)..(292): n is either a, c, g or t
  misc_feature (298)..(298): n is either a, c, g or t
ttggtttgtgtattacgatcgcgatgataaatggtttgtcgtacgttaatacgatgttagtcgcgggcgtcgtttagcgtttagttatcgaatagttttatttgaattttattttcgtagcgttgtgttattgcgtggtttttttttatcgtcgcgagcggcgcggcgtagatgatggttatttagttagcgtttgcgttaaacgtttgttgcgcgagcgttttattaggcgtcggcgattttttatgtgtagtagacgatgattttatgtgnnggttatcgagttcgtaantttcgntagattagtgtcgtagatgtcggaggggcgtattatattcgtcggtaattcgtattattatggtgcgtttgtatatatttaatgtcggagagtagtcgtgaatgacgttatttttcgttcgtaggcgaaaattcgtaaggcgttgacgtcgttattagaaattcgtaatttgattaaattttacgatggttaatatgcggtggatgatgttagtttgattatttataaaggtga

SEQ ID NO: 24902 - DNA, 532 bp, Artificial Sequence
  chemically treated genomic DNA (Homo sapiens) CpG-island No: 24902
  misc_feature (235)..(235): n is either a, c, g or t
  misc_feature (241)..(241): n is either a, c, g or t
  misc_feature (259)..(260): n is either a, c, g or t
tcacctttataaataatcaaactaacatcatccaccgcatattaaccatcgtaaaatttaatcaaattacgaatttctaataacgacgtcaacgccttacgaattttcgcctacgaacgaaaaataacgtcattcacgactactctccgacattaaatatatacaaacgcaccataataatacgaattaccgacgaatataatacgcccctccgacatctacgacactaatctancgaaanttacgaactcgataaccnncacataaaatcatcgtctactacacataaaaaatcgccgacgcctaataaaacgctcgcgcaacaaacgtttaacgcaaacgctaactaaataaccatcatctacgccgcgccgctcgcgacgataaaaaaaaaccacgcaataacacaacgctacgaaaataaaattcaaataaaactattcgataactaaacgctaaacgacgcccgcgactaacatcgtattaacgtacgacaaaccatttatcatcgcgatcgtaatacacaaaccaa

SEQ ID NO: 24903 - DNA, 532 bp, Artificial Sequence
  chemically treated genomic DNA (Homo sapiens) CpG-island No: 24903
  misc_feature (235)..(235): n is either a, c, g or t
  misc_feature (241)..(241): n is either a, c, g or t
  misc_feature (259)..(260): n is either a, c, g or t
ttatttttgtagatggttaggttgatattatttatcgtatgttgattatcgtaggatttggttaggttgcggatttttaatagcggcgttagcgttttacgggttttcgtttgcgggcgagggatagcgttatttacggttgtttttcggtattgaatgtgtgtaagcgtattataatggtgcgaattgtcggcgggtgtggtgcgttttttcggtatttacgatattgatttancggaanttacgagttcggtgattnntatataaagttatcgtttgttgtatatggaaggtcgtcgacgtttggtgaaacgttcgcgtaataggcgtttggcgtaggcgttaattggatgattattatttgcgtcgcgtcgttcgcgacggtagaaaaaggttacgtaatggtataacgttgcgggggtgaaatttagatagagttgttcggtaattggacgttggacgacgttcgcgattggtatcgtattggcgtgcggtaggttatttattatcgcggtcgtgatgtataggttag

SEQ ID NO: 24904 - DNA, 532 bp, Artificial Sequence
  chemically treated genomic DNA (Homo sapiens) CpG-island No: 24904
  misc_feature (273)..(274): n is either a, c, g or t
  misc_feature (292)..(292): n is either a, c, g or t
  misc_feature (298)..(298): n is either a, c, g or t
ctaacctatacatcacgaccgcgataataaataacctaccgcacgccaatacgataccaatcgcgaacgtcgtccaacgtccaattaccgaacaactctatctaaatttcacccccgcaacgttataccattacgtaacctttttctaccgtcgcgaacgacgcgacgcaaataataatcatccaattaacgcctacgccaaacgcctattacgcgaacgtttcaccaaacgtcgacgaccttccatatacaacaaacgataactttatatannaatcaccgaactcgtaanttccgntaaatcaatatcgtaaataccgaaaaaacgcaccacacccgccgacaattcgcaccattataatacgcttacacacattcaataccgaaaaacaaccgtaaataacgctatccctcgcccgcaaacgaaaacccgtaaaacgctaacgccgctattaaaaatccgcaacctaaccaaatcctacgataatcaacatacgataaataatatcaacctaaccatctacaaaaataa

SEQ ID NO: 24905 - DNA, 716 bp, Artificial Sequence
  chemically treated genomic DNA (Homo sapiens) CpG-island No: 24905
  misc_feature (139)..(139): n is either a, c, g or t
ggcggtttcggttacgttagcggttatagcgtggtgtattaggtattggaagaagagttggtcgagtggtttggttattcgcgggtattgttgtttatttttggtttcgtcgttattaggtagttattgtcgcgatgantgcgaaagaggatcgtattgttgtcgatcggtttagttatgttttattgttggaagttgttagtttaagttcgtcgtagtttcgtcgttttgtttataacgatttatttatttggcgcgattgtttgtttttttttttcggggtagtaaatggtggtgatagaaggcgtgtttagtatggacggcgatagtgcgttattggcggaaatttagtaggtaacgtaatagtataatggttggttgatggtcgatgatgtttacggtacgggcgttatcggggagtaggggcgcggtagttgttggttgtaaaaggtaaaattagaattgttggtagtgatttttggtaaaggatttggcgttagcggggtagcggtgttttgttttagtacggtggcggattatttgttgtaattcgttcgttattttatttatagtattagtatgtcgttcgtttaggcgtaggtattacgtgcgtcgttgcggttattcgtagtgatgagggtgatgtacggcgcgaaaaattggcggtatttattacgcgttttcgtgttcggagtattaggattttgtcgtttacg

SEQ ID NO: 24906 - DNA, 716 bp, Artificial Sequence
  chemically treated genomic DNA (Homo sapiens) CpG-island No: 24906
  misc_feature (578)..(578): n is either a, c, g or t
cgtaaacgacaaaatcctaatactccgaacacgaaaacgcgtaataaataccgccaatttttcgcgccgtacatcaccctcatcactacgaataaccgcaacgacgcacgtaatacctacgcctaaacgaacgacatactaatactataaataaaataacgaacgaattacaacaaataatccgccaccgtactaaaacaaaacaccgctaccccgctaacgccaaatcctttaccaaaaatcactaccaacaattctaattttaccttttacaaccaacaactaccgcgcccctactccccgataacgcccgtaccgtaaacatcatcgaccatcaaccaaccattatactattacgttacctactaaatttccgccaataacgcactatcgccgtccatactaaacacgccttctatcaccaccatttactaccccgaaaaaaaaaaacaaacaatcgcgccaaataaataaatcgttataaacaaaacgacgaaactacgacgaacttaaactaacaacttccaacaataaaacataactaaaccgatcgacaacaatacgatcctctttcgcantcatcgcgacaataactacctaataacgacgaaaccaaaaataaacaacaatacccgcgaataaccaaaccactcgaccaactcttcttccaatacctaatacaccacgctataaccgctaacgtaaccgaaaccgcc

SEQ ID NO: 24907 - DNA, 716 bp, Artificial Sequence
  chemically treated genomic DNA (Homo sapiens) CpG-island No: 24907
  misc_feature (578)..(578): n is either a, c, g or t
cgtaaacggtaaaattttgatatttcgggtacgaaaacgcgtaatgagtgtcgttagtttttcgcgtcgtgtattatttttattattgcgaatgatcgtagcgacgtacgtaatgtttgcgtttgagcgggcggtatattggtgttgtagataaggtggcgggcgaattgtagtagataattcgttatcgtattggagtaaagtatcgttgtttcgttgacgttaaattttttgttaaaagttattattagtaattttggttttattttttgtagttagtagttgtcgcgtttttgtttttcgataacgttcgtgtcgtgggtattatcgattattaattagttattgtgttgttgcgttatttgttggattttcgttagtggcgtattatcgtcgtttatgttgaatacgttttttgttattattatttgttgtttcggaagggggaagtaagtaatcgcgttaaatgagtgaatcgttatgagtaaaacggcgaagttgcgacgggtttaaattggtagtttttagtaatgaggtatggttaagtcggtcggtagtaatacggttttttttcgtanttatcgcggtaataattgtttgatagcggcgaaattagagataaatagtagtgttcgcgaatagttaagttattcggttagttttttttttagtgtttgatgtattacgttataatcgttgacgtgatcggagtcgtt

SEQ ID NO: 24908 - DNA, 716 bp, Artificial Sequence
  chemically treated genomic DNA (Homo sapiens) CpG-island No: 24908
  misc_feature (139)..(139): n is either a, c, g or t
aacgactccgatcacgtcaacgattataacgtaatacatcaaacactaaaaaaaaaactaaccgaataacttaactattcgcgaacactactatttatctctaatttcgccgctatcaaacaattattaccgcgataantacgaaaaaaaaccgtattactaccgaccgacttaaccatacctcattactaaaaactaccaatttaaacccgtcgcaacttcgccgttttactcataacgattcactcatttaacgcgattacttacttcccccttccgaaacaacaaataataataacaaaaaacgtattcaacataaacgacgataatacgccactaacgaaaatccaacaaataacgcaacaacacaataactaattaataatcgataatacccacgacacgaacgttatcgaaaaacaaaaacgcgacaactactaactacaaaaaataaaaccaaaattactaataataacttttaacaaaaaatttaacgtcaacgaaacaacgatactttactccaatacgataacgaattatctactacaattcgcccgccaccttatctacaacaccaatataccgcccgctcaaacgcaaacattacgtacgtcgctacgatcattcgcaataataaaaataatacacgacgcgaaaaactaacgacactcattacgcgttttcgtacccgaaatatcaaaattttaccgtttacg

SEQ ID NO: 24909 - DNA, 993 bp, Artificial Sequence
  chemically treated genomic DNA (Homo sapiens) CpG-island No: 24909
ggaaacggcgttcggtttaggtcgtttgcgggcgttgggtttgtagtcgttgtaggtcgggttttgagttttggcgttcgggaggtttttgagtcggttttcgagttagttttcgggcgcggggttcggttgggggggttcggaattttgggttggttttacgtaaattcgtttggggcgagtttcggtttttcggtagcggtgggaaagggcgcgagcggttagttatggcgcgcggatttttttcgtcggcggcgttatagcggcgtttttttttgttttagcgcgtgcggcggtgcgtggtacgagggcggtagcgacgttagttttagtagcgcggggcggcggcgcgcgcgaggtcgttggaacgagcgtcggttgtgtacgcggcgcgtcgtcgtcgaacgcgcgtgcgtattcggtagttttcggcgtttcggtttcgttttcggcgtaggtttcgttttcggttcgttttcgggcggttttgcgggcgtaggcgcggtattttcggagttttgcgtaggcgttggcgtgggcgaggcggggttcggggttcgcggtcgttgtagtcgcgcggggatttggggtttttttgggatagcggcggcggcggtgggcggatcgtggcgcggggacgagcggtcggttagcggcgtgtcggagtcggtgttatttgcgggagaggaaggcgtgagcggcgcgcggagttcgggcgttggggcgggaggggttttttcgggggttttagttgttttcgagttcggcggttttcgttttttttttcgcggcgtattttaggttcggcgttcgttggggtttttttttaggattcgggttcgcggggtagaggcggaagtagtaatagcgaagttttagttcggtttcgttacgttttttcgtcgggggtttcgggatagcggttttttcggcgtaggaaggtttcgttttaggttttgtagcgcgggaggttaaggtttttaaggggatttg

SEQ ID NO: 24910 - DNA, 993 bp, Artificial Sequence
  chemically treated genomic DNA (Homo sapiens) CpG-island No: 24910
caaatccccttaaaaaccttaacctcccgcgctacaaaacctaaaacgaaaccttcctacgccgaaaaaaccgctatcccgaaacccccgacgaaaaaacgtaacgaaaccgaactaaaacttcgctattactacttccgcctctaccccgcgaacccgaatcctaaaaaaaaaccccaacgaacgccgaacctaaaatacgccgcgaaaaaaaaaacgaaaaccgccgaactcgaaaacaactaaaacccccgaaaaaacccctcccgccccaacgcccgaactccgcgcgccgctcacgccttcctctcccgcaaataacaccgactccgacacgccgctaaccgaccgctcgtccccgcgccacgatccgcccaccgccgccgccgctatcccaaaaaaaccccaaatccccgcgcgactacaacgaccgcgaaccccgaaccccgcctcgcccacgccaacgcctacgcaaaactccgaaaataccgcgcctacgcccgcaaaaccgcccgaaaacgaaccgaaaacgaaacctacgccgaaaacgaaaccgaaacgccgaaaactaccgaatacgcacgcgcgttcgacgacgacgcgccgcgtacacaaccgacgctcgttccaacgacctcgcgcgcgccgccgccccgcgctactaaaactaacgtcgctaccgccctcgtaccacgcaccgccgcacgcgctaaaacaaaaaaaaacgccgctataacgccgccgacgaaaaaaatccgcgcgccataactaaccgctcgcgccctttcccaccgctaccgaaaaaccgaaactcgccccaaacgaatttacgtaaaaccaacccaaaattccgaacccccccaaccgaaccccgcgcccgaaaactaactcgaaaaccgactcaaaaacctcccgaacgccaaaactcaaaacccgacctacaacgactacaaacccaacgcccgcaaacgacctaaaccgaacgccgtttcc

SEQ ID NO: 24911 - DNA, 993 bp, Artificial Sequence
  chemically treated genomic DNA (Homo sapiens) CpG-island No: 24911
taggtttttttggggattttgatttttcgcgttgtagggtttggggcgggatttttttgcgtcgaggaggtcgttgtttcgggattttcggcggggggacgtggcggggtcgggttggggtttcgttgttgttgttttcgtttttgtttcgcgaattcgggttttgggaggaggttttagcggacgtcgagtttggggtgcgtcgcgggaggggaggcgagagtcgtcgggttcggggatagttgaggttttcggggaggtttttttcgttttagcgttcgggtttcgcgcgtcgtttacgtttttttttttcgtaggtgatatcggtttcgatacgtcgttaatcggtcgttcgttttcgcgttacggttcgtttatcgtcgtcgtcgttgttttagagaaattttagattttcgcgcggttatagcgatcgcgagtttcgagtttcgtttcgtttacgttagcgtttgcgtagaatttcgagagtgtcgcgtttgcgttcgtagagtcgttcgagggcgagtcgggggcggggtttgcgtcgggggcggggtcggagcgtcgagggttgtcgagtgcgtacgcgcgttcggcggcggcgcgtcgcgtgtatagtcggcgttcgttttagcggtttcgcgcgcgtcgtcgtttcgcgttgttgaagttggcgtcgttgtcgttttcgtgttacgtatcgtcgtacgcgttggagtaggaggagacgtcgttgtgacgtcgtcggcgggaagggttcgcgcgttatggttggtcgttcgcgtttttttttatcgttgtcgggaaatcgaggttcgttttaaacggatttgcgtgaaattagtttaaggtttcgggtttttttaatcgagtttcgcgttcggggattgattcggggatcgatttagggatttttcgagcgttaggatttagggttcgatttgtagcggttgtaggtttagcgttcgtaagcggtttgggtcgagcgtcgttttt

SEQ ID NO: 24912 - DNA, 993 bp, Artificial Sequence
  chemically treated genomic DNA (Homo sapiens) CpG-island No: 24912
aaaaacgacgctcgacccaaaccgcttacgaacgctaaacctacaaccgctacaaatcgaaccctaaatcctaacgctcgaaaaatccctaaatcgatccccgaatcaatccccgaacgcgaaactcgattaaaaaaacccgaaaccttaaactaatttcacgcaaatccgtttaaaacgaacctcgatttcccgacaacgataaaaaaaaacgcgaacgaccaaccataacgcgcgaacccttcccgccgacgacgtcacaacgacgtctcctcctactccaacgcgtacgacgatacgtaacacgaaaacgacaacgacgccaacttcaacaacgcgaaacgacgacgcgcgcgaaaccgctaaaacgaacgccgactatacacgcgacgcgccgccgccgaacgcgcgtacgcactcgacaaccctcgacgctccgaccccgcccccgacgcaaaccccgcccccgactcgccctcgaacgactctacgaacgcaaacgcgacactctcgaaattctacgcaaacgctaacgtaaacgaaacgaaactcgaaactcgcgatcgctataaccgcgcgaaaatctaaaatttctctaaaacaacgacgacgacgataaacgaaccgtaacgcgaaaacgaacgaccgattaacgacgtatcgaaaccgatatcacctacgaaaaaaaaaaacgtaaacgacgcgcgaaacccgaacgctaaaacgaaaaaaacctccccgaaaacctcaactatccccgaacccgacgactctcgcctcccctcccgcgacgcaccccaaactcgacgtccgctaaaacctcctcccaaaacccgaattcgcgaaacaaaaacgaaaacaacaacaacgaaaccccaacccgaccccgccacgtccccccgccgaaaatcccgaaacaacgacctcctcgacgcaaaaaaatcccgccccaaaccctacaacgcgaaaaatcaaaatccccaaaaaaaccta

SEQ ID NO: 24913 - DNA, 950 bp, Artificial Sequence
  chemically treated genomic DNA (Homo sapiens) CpG-island No: 24913
gcgagcgcgcgaggcggagatttggagggagaggagttgcggagaggggttaggcggggagggagagagagaattaggtttcggtttagggaggagagagatagcgcgcgcgaggcggagatttggaggagaggagttgcggagaggggttaggcggggagagagagagagcgagttaggtttaggtttagggaggagagagatagcgcgcgcgaggcggagatttggagggagaggagttgcggagaggggttaggcggggagggagagagagaattaggtttaggtttagggaggagagagatagcgcgcgcgaggcggagatttggaggagaggagttgcggagaggggttaggcggggagagagagagagcgagttaggtttaggtttagggaggagagagatagcgcgcgcgaggcggagatttggagggagaggagttgcggagaggggttaggcggggagggagagagttaggtttaggtttagggaggagagagatagcgcgcgcgaggcggagatttggagggagaggagttgcggagaggggttaggcggggagagagagagcgagttaggtttaggtttagggaggagagagatagcgcgcgcgaggcggagatttggagggagaggagttgcggagaggggttaggcggggagggagagagatagcgcgcgcgaggcggagatttggagggagaggagttgcggagaggggttaggcggcgggaggttcgggagcgttatatgtgtgtggattcggggagggcggcggggggtcgtttttcggggtcgtttgtttgtaggaaggagtttacggatttgttgttgaggcggaagggtattaggcggtagaaggtgtcgggagagtagggaatttgcgtgcgggttttttgcgaggggattatcgttttttcgggagatagttagggcggtagtttggtt

SEQ ID NO: 24914 - DNA, 950 bp, Artificial Sequence
  chemically treated genomic DNA (Homo sapiens) CpG-island No: 24914
aaccaaactaccgccctaactatctcccgaaaaaacgataatcccctcgcaaaaaacccgcacgcaaattccctactctcccgacaccttctaccgcctaatacccttccgcctcaacaacaaatccgtaaactccttcctacaaacaaacgaccccgaaaaacgaccccccgccgccctccccgaatccacacacatataacgctcccgaacctcccgccgcctaacccctctccgcaactcctctccctccaaatctccgcctcgcgcgcgctatctctctccctccccgcctaacccctctccgcaactcctctccctccaaatctccgcctcgcgcgcgctatctctctcctccctaaacctaaacctaactcgctctctctctccccgcctaacccctctccgcaactcctctccctccaaatctccgcctcgcgcgcgctatctctctcctccctaaacctaaacctaactctctccctccccgcctaacccctctccgcaactcctctccctccaaatctccgcctcgcgcgcgctatctctctcctccctaaacctaaacctaactcgctctctctctctccccgcctaacccctctccgcaactcctctcctccaaatctccgcctcgcgcgcgctatctctctcctccctaaacctaaacctaattctctctctccctccccgcctaacccctctccgcaactcctctccctccaaatctccgcctcgcgcgcgctatctctctcctccctaaacctaaacctaactcgctctctctctctccccgcctaacccctctccgcaactcctctcctccaaatctccgcctcgcgcgcgctatctctctcctccctaaaccgaaacctaattctctctctccctccccgcctaacccctctccgcaactcctctccctccaaatctccgcctcgcgcgctcgc

SEQ ID NO: 24915 - DNA, 950 bp, Artificial Sequence
  chemically treated genomic DNA (Homo sapiens) CpG-island No: 24915
ggttaggttgtcgttttggttgtttttcggggagacggtggttttttcgtagagggttcgtacgtagattttttattttttcggtattttttgtcgtttgatgttttttcgttttagtagtaagttcgtggatttttttttgtaggtagacggtttcgaggagcggtttttcgtcgtttttttcgagtttatatatatgtaacgttttcgggtttttcgtcgtttaattttttttcgtagtttttttttttttaggttttcgtttcgcgcgcgttgttttttttttttttcgtttaattttttttcgtagtttttttttttttaggttttcgtttcgcgcgcgttgttttttttttttttggatttgaatttggttcgtttttttttttttcgtttaattttttttcgtagtttttttttttttaggttttcgtttcgcgcgcgttgttttttttttttttggatttgaatttggtttttttttttttcgtttaattttttttcgtagtttttttttttttaggttttcgtttcgcgcgcgttgttttttttttttttggatttgaatttggttcgtttttttttttttttcgtttaattttttttcgtagttttttttttttaggttttcgtttcgcgcgcgttgttttttttttttttggatttgaatttggtttttttttttttttttcgtttaattttttttcgtagtttttttttttttaggttttcgtttcgcgcgcgttgttttttttttttttggatttgaatttggttcgtttttttttttttttcgtttaattttttttcgtagttttttttttttaggttttcgtttcgcgcgcgttgttttttttttttttggatcggaatttggtttttttttttttttttcgtttaattttttttcgtagtttttttttttttaggttttcgtttcgcgcgttcgt

SEQ ID NO: 24916 - DNA, 950 bp, Artificial Sequence
  chemically treated genomic DNA (Homo sapiens) CpG-island No: 24916
acgaacgcgcgaaacgaaaacctaaaaaaaaaaaaactacgaaaaaaaattaaacgaaaaaaaaaaaaaaaaaccaaattccgatccaaaaaaaaaaaaaacaacgcgcgcgaaacgaaaacctaaaaaaaaaaaactacgaaaaaaaattaaacgaaaaaaaaaaaaaaacgaaccaaattcaaatccaaaaaaaaaaaaaacaacgcgcgcgaaacgaaaacctaaaaaaaaaaaaactacgaaaaaaaattaaacgaaaaaaaaaaaaaaaaaccaaattcaaatccaaaaaaaaaaaaaacaacgcgcgcgaaacgaaaacctaaaaaaaaaaaactacgaaaaaaaattaaacgaaaaaaaaaaaaaaacgaaccaaattcaaatccaaaaaaaaaaaaaacaacgcgcgcgaaacgaaaacctaaaaaaaaaaaaactacgaaaaaaaattaaacgaaaaaaaaaaaaaccaaattcaaatccaaaaaaaaaaaaaacaacgcgcgcgaaacgaaaacctaaaaaaaaaaaaactacgaaaaaaaattaaacgaaaaaaaaaaaaacgaaccaaattcaaatccaaaaaaaaaaaaaacaacgcgcgcgaaacgaaaacctaaaaaaaaaaaaactacgaaaaaaaattaaacgaaaaaaaaaaaaaacaacgcgcgcgaaacgaaaacctaaaaaaaaaaaaactacgaaaaaaaattaaacgacgaaaaacccgaaaacgttacatatatataaactcgaaaaaaacgacgaaaaaccgctcctcgaaaccgtctacctacaaaaaaaaatccacgaacttactactaaaacgaaaaaacatcaaacgacaaaaaataccgaaaaaataaaaaatctacgtacgaaccctctacgaaaaaaccaccgtctccccgaaaaacaaccaaaacgacaacctaacc

SEQ ID NO: 24917 - DNA, 542 bp, Artificial Sequence
  chemically treated genomic DNA (Homo sapiens) CpG-island No: 24917
  misc_feature (245)..(245): n is either a, c, g or t
  misc_feature (409)..(409): n is either a, c, g or t
gggcgtttttcgtcgaggttcgcgggttggggtagcgcgggtgggggtatacgtttgggttattcgtatatagatcgattatttaggcggtcggtgtagttaagttttattgtaggggtcgttttcgtagcggagtcgatttcgttttattcgtaatgcgtttcgcggattcggtagtttcggtttttttttcgagaagcgcgtaggtgcggcggtaggggcgcgtttttttcggtatcgcgatnagttattatcgcgggcgttcgtttattttttttttatttttttcgtagtcgtcggcgtcgttacgcgatggggttagttaggtttcgcgtgcgagtagcgttttcgttttcgttcgttcgggtagggcgttaggagttttaggagcgcggggagcgttaggatngtcgtggtttggggaatggggttcggggttcgcgcgggcgtttcgggtgtatacggggcgggcggattcggttacggtttttttaggttttttcgtttttttgagtttgggggttttatttgaggttcgtttt

SEQ ID NO: 24918 - DNA, 542 bp, Artificial Sequence
  chemically treated genomic DNA (Homo sapiens) CpG-island No: 24918
  misc_feature (134)..(134): n is either a, c, g or t
  misc_feature (298)..(298): n is either a, c, g or t
aaaacgaacctcaaataaaacccccaaactcaaaaaaacgaaaaaacctaaaaaaaccgtaaccgaatccgcccgccccgtatacacccgaaacgcccgcgcgaaccccgaaccccattccccaaaccacgacnatcctaacgctccccgcgctcctaaaactcctaacgccctacccgaacgaacgaaaacgaaaacgctactcgcacgcgaaacctaactaaccccatcgcgtaacgacgccgacgactacgaaaaaaataaaaaaaaaataaacgaacgcccgcgataataactnatcgcgataccgaaaaaaacgcgcccctaccgccgcacctacgcgcttctcgaaaaaaaaaccgaaactaccgaatccgcgaaacgcattacgaataaaacgaaatcgactccgctacgaaaacgacccctacaataaaacttaactacaccgaccgcctaaataatcgatctatatacgaataacccaaacgtatacccccacccgcgctaccccaacccgcgaacctcgacgaaaaacgccc

SEQ ID NO: 24919 - DNA, 542 bp, Artificial Sequence
  chemically treated genomic DNA (Homo sapiens) CpG-island No: 24919
  misc_feature (134)..(134): n is either a, c, g or t
  misc_feature (298)..(298): n is either a, c, g or t
ggggcggattttaggtgggatttttaggtttaggagggcggggggatttggggaggtcgtggtcgggttcgttcgtttcgtgtgtattcggagcgttcgcgcggatttcgagttttattttttaggttacggtngttttggcgtttttcgcgtttttggggtttttggcgttttgttcgggcgggcgggggcgggagcgttgttcgtacgcgaggtttggttggttttatcgcgtgacggcgtcggcggttgcgggggaagtaggggggaagtgggcgggcgttcgcggtggtggttnatcgcgatgtcgggaggggcgcgtttttgtcgtcgtatttacgcgtttttcggggaaaaggtcggggttgtcgggttcgcggggcgtattgcgggtgggacggggtcggtttcgttgcgggagcgatttttgtaatggggtttggttgtatcggtcgtttgggtggtcggtttgtgtgcgggtgatttaggcgtgtgtttttattcgcgttgttttagttcgcggatttcggcggggagcgttt

SEQ ID NO: 24920 - DNA, 542 bp, Artificial Sequence
  chemically treated genomic DNA (Homo sapiens) CpG-island No: 24920
  misc_feature (245)..(245): n is either a, c, g or t
  misc_feature (409)..(409): n is either a, c, g or t
aaacgctccccgccgaaatccgcgaactaaaacaacgcgaataaaaacacacgcctaaatcacccgcacacaaaccgaccacccaaacgaccgatacaaccaaaccccattacaaaaatcgctcccgcaacgaaaccgaccccgtcccacccgcaatacgccccgcgaacccgacaaccccgaccttttccccgaaaaacgcgtaaatacgacgacaaaaacgcgcccctcccgacatcgcgatnaaccaccaccgcgaacgcccgcccacttcccccctacttcccccgcaaccgccgacgccgtcacgcgataaaaccaaccaaacctcgcgtacgaacaacgctcccgcccccgcccgcccgaacaaaacgccaaaaaccccaaaaacgcgaaaaacgccaaaacnaccgtaacctaaaaaataaaactcgaaatccgcgcgaacgctccgaatacacacgaaacgaacgaacccgaccacgacctccccaaatccccccgccctcctaaacctaaaaatcccacctaaaatccgcccc

SEQ ID NO: 24921 - DNA, 612 bp, Artificial Sequence
  chemically treated genomic DNA (Homo sapiens) CpG-island No: 24921
gcgattgaggaagagcgttcgggagtggaggtttttagttacggagtttattcgggtagttagcgattggggaagagcgttcgcgagtggaggtttttagatacggagtttattcgggtagttagcgattggggaagagcgttcgggagtggaggtttttagttacggagtttattcgggtagttagcgattgaggaagagcgttcgcgagtggaggtttttagttacggagtttattcgggtagttagcgattgaggaagagcgttcgggagtggaggtcgttagttacggagtttattcgggtagttagcgattgaggaagagcgttcgtaagtggaggtttttagttacggagtttattcgggtagttagcgattgaggaagagcgttcgcgagtggaggtttttagttacggagtttattcgggtagttagcgattgaggaagagcgttcgcgagtggaggtttttagttacggagtttattcgggtagttagcgattggggaagagcgttcgggagtggaggtttttagttacggagtttattcgggtagttagcgattggggaagagcgttcgggagtggaggtttttagttacggagtttattcg

SEQ ID NO: 24922 - DNA, 612 bp, Artificial Sequence
  chemically treated genomic DNA (Homo sapiens) CpG-island No: 24922
cgaataaactccgtaactaaaaacctccactcccgaacgctcttccccaatcgctaactacccgaataaactccgtaactaaaaacctccactcccgaacgctcttccccaatcgctaactacccgaataaactccgtaactaaaaacctccactcgcgaacgctcttcctcaatcgctaactacccgaataaactccgtaactaaaaacctccactcgcgaacgctcttcctcaatcgctaactacccgaataaactccgtaactaaaaacctccacttacgaacgctcttcctcaatcgctaactacccgaataaactccgtaactaacgacctccactcccgaacgctcttcctcaatcgctaactacccgaataaactccgtaactaaaaacctccactcgcgaacgctcttcctcaatcgctaactacccgaataaactccgtaactaaaaacctccactcccgaacgctcttccccaatcgctaactacccgaataaactccgtatctaaaaacctccactcgcgaacgctcttccccaatcgctaactacccgaataaactccgtaactaaaaacctccactcccgaacgctcttcctcaatcgc

SEQ ID NO: 24923 - DNA, 612 bp, Artificial Sequence
  chemically treated genomic DNA (Homo sapiens) CpG-island No: 24923
cgggtggatttcgtgattgagggtttttattttcgggcgtttttttttagtcgttgattgttcgggtggatttcgtgattgagggtttttattttcgggcgtttttttttagtcgttgattgttcgggtggatttcgtgattgagggtttttattcgcgggcgtttttttttagtcgttgattgttcgggtggatttcgtgattgagggtttttattcgcgggcgtttttttttagtcgttgattgttcgggtggatttcgtgattgagggtttttatttgcgggcgtttttttttagtcgttgattgttcgggtggatttcgtgattgacggtttttattttcgggcgtttttttttagtcgttgattgttcgggtggatttcgtgattgagggtttttattcgcgggcgtttttttttagtcgttgattgttcgggtggatttcgtgattgagggtttttattttcgggcgtttttttttagtcgttgattgttcgggtggatttcgtgtttgagggtttttattcgcgggcgtttttttttagtcgttgattgttcgggtggatttcgtgattgagggtttttattttcgggcgtttttttttagtcgt

SEQ ID NO: 24924 - DNA, 612 bp, Artificial Sequence
  chemically treated genomic DNA (Homo sapiens) CpG-island No: 24924
acgactaaaaaaaaacgcccgaaaataaaaaccctcaatcacgaaatccacccgaacaatcaacgactaaaaaaaaacgcccgcgaataaaaaccctcaaacacgaaatccacccgaacaatcaacgactaaaaaaaaacgcccgaaaataaaaaccctcaatcacgaaatccacccgaacaatcaacgactaaaaaaaaacgcccgcgaataaaaaccctcaatcacgaaatccacccgaacaatcaacgactaaaaaaaaacgcccgaaaataaaaaccgtcaatcacgaaatccacccgaacaatcaacgactaaaaaaaaacgcccgcaaataaaaaccctcaatcacgaaatccacccgaacaatcaacgactaaaaaaaaacgcccgcgaataaaaaccctcaatcacgaaatccacccgaacaatcaacgactaaaaaaaaacgcccgcgaataaaaaccctcaatcacgaaatccacccgaacaatcaacgactaaaaaaaaacgcccgaaaataaaaaccctcaatcacgaaatccacccgaacaatcaacgactaaaaaaaaacgcccgaaaataaaaaccctcaatcacgaaatccacccg

SEQ ID NO: 24925 - DNA, 677 bp, Artificial Sequence
  chemically treated genomic DNA (Homo sapiens) CpG-island No: 24925
gttagcgattggggaagagcgttcgcgagtggaggtttttagttacggagtttattcgggtagttagcgattgaggaagagcgttcgcgagtggaggtcgttagttacggagtttattcgggtagttagcgattgaggaagagcgttcgcgagtggaggtttttagttacggagtttattcgggtagttagcgattgaggaagagcgttcgcgagtggaggtttttagttacggagtttattcgggtagttagcgattgaggaagagcgttcgggagtggaggtttttagttacggagtttattcgggtagttagcgattgaggaagagcgttcgggagtggaggtttttagttacggagtttattcgggtagttagcgattgaggaagagcgttcgggagtggaggtttttagttacggagtttattcgggtagttagcgattgaggaagagcgttcgcgagtggaggtttttagttacggagtttattcgggtagttagcgattgaggaagagcgttcgcgagtggaggtttttagttacggagtttattcgggtagttagcgattgaggaagagcgttcgcgagtggaggtcgttagttacggagtttatttaggtttggtatgtggttgtgtttatttttatgcgtagggtcggagtgttgacggggtataga

SEQ ID NO: 24926 - DNA, 677 bp, Artificial Sequence
  chemically treated genomic DNA (Homo sapiens) CpG-island No: 24926
tctataccccgtcaacactccgaccctacgcataaaaataaacacaaccacataccaaacctaaataaactccgtaactaacgacctccactcgcgaacgctcttcctcaatcgctaactacccgaataaactccgtaactaaaaacctccactcgcgaacgctcttcctcaatcgctaactacccgaataaactccgtaactaaaaacctccactcgcgaacgctcttcctcaatcgctaactacccgaataaactccgtaactaaaaacctccactcccgaacgctcttcctcaatcgctaactacccgaataaactccgtaactaaaaacctccactcccgaacgctcttcctcaatcgctaactacccgaataaactccgtaactaaaaacctccactcccgaacgctcttcctcaatcgctaactacccgaataaactccgtaactaaaaacctccactcgcgaacgctcttcctcaatcgctaactacccgaataaactccgtaactaaaaacctccactcgcgaacgctcttcctcaatcgctaactacccgaataaactccgtaactaacgacctccactcgcgaacgctcttcctcaatcgctaactacccgaataaactccgtaactaaaaacctccactcgcgaacgctcttccccaatcgctaac

SEQ ID NO: 24927 - DNA, 677 bp, Artificial Sequence
  chemically treated genomic DNA (Homo sapiens) CpG-island No: 24927
tttgtgtttcgttagtatttcggttttacgtatagaggtggatatagttatatgttaggtttgggtggatttcgtgattgacggtttttattcgcgggcgtttttttttagtcgttgattgttcgggtggatttcgtgattgagggtttttattcgcgggcgtttttttttagtcgttgattgttcgggtggatttcgtgattgagggtttttattcgcgggcgtttttttttagtcgttgattgttcgggtggatttcgtgattgagggtttttattttcgggcgtttttttttagtcgttgattgttcgggtggatttcgtgattgagggtttttattttcgggcgtttttttttagtcgttgattgttcgggtggatttcgtgattgagggtttttattttcgggcgtttttttttagtcgttgattgttcgggtggatttcgtgattgagggtttttattcgcgggcgtttttttttagtcgttgattgttcgggtggatttcgtgattgagggtttttattcgcgggcgtttttttttagtcgttgattgttcgggtggatttcgtgattgacggtttttattcgcgggcgtttttttttagtcgttgattgttcgggtggatttcgtgattgagggtttttattcgcgggcgtttttttttagtcgttgat

SEQ ID NO: 24928 - DNA, 677 bp, Artificial Sequence
  chemically treated genomic DNA (Homo sapiens) CpG-island No: 24928
atcaacgactaaaaaaaaacgcccgcgaataaaaaccctcaatcacgaaatccacccgaacaatcaacgactaaaaaaaaacgcccgcgaataaaaaccgtcaatcacgaaatccacccgaacaatcaacgactaaaaaaaaacgcccgcgaataaaaaccctcaatcacgaaatccacccgaacaatcaacgactaaaaaaaaacgcccgcgaataaaaaccctcaatcacgaaatccacccgaacaatcaacgactaaaaaaaaacgcccgaaaataaaaaccctcaatcacgaaatccacccgaacaatcaacgactaaaaaaaaacgcccgaaaataaaaaccctcaatcacgaaatccacccgaacaatcaacgactaaaaaaaaacgcccgaaaataaaaaccctcaatcacgaaatccacccgaacaatcaacgactaaaaaaaaacgcccgcgaataaaaaccctcaatcacgaaatccacccgaacaatcaacgactaaaaaaaaacgcccgcgaataaaaaccctcaatcacgaaatccacccgaacaatcaacgactaaaaaaaaacgcccgcgaataaaaaccgtcaatcacgaaatccacccaaacctaacatataactatatccacctctatacgtaaaaccgaaatactaacgaaacacaaa

SEQ ID NO: 24929 - DNA, 633 bp, Artificial Sequence
  chemically treated genomic DNA (Homo sapiens) CpG-island No: 24929
agtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtggagcgtggggagggtcggcgatggcgcggggagtattgtgagtttttagggtatagagttgcgttgttgtttttaaagataaagttggtttttgtgtttttgtg

SEQ ID NO: 24930 - DNA, 633 bp, Artificial Sequence
  chemically treated genomic DNA (Homo sapiens) CpG-island No: 24930
cacaaaaacacaaaaaccaactttatctttaaaaacaacaacgcaactctataccctaaaaactcacaatactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccactccccgcgccatcgccgaccctccccacgctccact

SEQ ID NO: 24931 - DNA, 633 bp, Artificial Sequence
  chemically treated genomic DNA (Homo sapiens) CpG-island No: 24931
tatagggatatagggattagttttgtttttaaaaataataacgtaattttgtgttttggggatttatagtgtttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatttttcgcgttatcgtcgattttttttacgttttatt

SEQ ID NO: 24932 - DNA, 633 bp, Artificial Sequence
  chemically treated genomic DNA (Homo sapiens) CpG-island No: 24932
aataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaataaaacgtaaaaaaaatcgacgataacgcgaaaaacactataaatccccaaaacacaaaattacgttattatttttaaaaacaaaactaatccctatatccctata

SEQ ID NO: 24933 - DNA, 880 bp, Artificial Sequence
  chemically treated genomic DNA (Homo sapiens) CpG-island No: 24933
ggacgtcgcgtttgtatttgttatatttgtatttatttcgttttgcgttcgtgtatattttggttttgtttcgttttgcgtttgtttcgttttgtattcgtgtgttcgtgtacgttttggttttgttttattttgcgtttttttcgttttgcgttcgtgtacgttttggttttgtttcgttttgcgtttttttcgttttgcgttcgtgtacgttttggttttgtttcgttttgcgtttttttcgttttgcgttcgtgtacgttttggttttgtttcgttttgcgtttttatcgttttgcgttcgtgtacgttttggttttgtttcgttttgcgtttttttcgttttgcgttcgtgtacgttttggttttgtttcgttttgcgtttttttcgttttgcgttcgtgtacgttttggttttgtttcgttttgcgtttgtttcgttttgtattcgtgtgttcgtgtacgttttggttttgttttattttgcgtttttttcgttttgcgttcgtgtacgttttggttttgtttcgttttgcgtttttttcgttttgcgttcgtgtacgttttggttttgtttcgttttgcgtttgtttcgttttgtattcgtgtgttcgtgtacgttttggttttgttttattttgcgtttttttcgttttgcgttcgtgtacgttttggttttgttttattttgcgtttttttcgttttgtgttcgtgtacgttttggttttgtttcgttttgcgtttttttcgttttgttttcgtgtacgttttggttttgtttcgttttgcgtttttttcgttttgtttttatgtacgttttggttttgttttattttgcgtttttttcgttttgtttttatgtacgttttggttttgtttt

SEQ ID NO: 24934 - DNA, 880 bp, Artificial Sequence
  chemically treated genomic DNA (Homo sapiens) CpG-island No: 24934
aaaacaaaaccaaaacgtacataaaaacaaaacgaaaaaaacgcaaaataaaacaaaaccaaaacgtacataaaaacaaaacgaaaaaaacgcaaaacgaaacaaaaccaaaacgtacacgaaaacaaaacgaaaaaaacgcaaaacgaaacaaaaccaaaacgtacacgaacacaaaacgaaaaaaacgcaaaataaaacaaaaccaaaacgtacacgaacgcaaaacgaaaaaaacgcaaaataaaacaaaaccaaaacgtacacgaacacacgaatacaaaacgaaacaaacgcaaaacgaaacaaaaccaaaacgtacacgaacgcaaaacgaaaaaaacgcaaaacgaaacaaaaccaaaacgtacacgaacgcaaaacgaaaaaaacgcaaaataaaacaaaaccaaaacgtacacgaacacacgaatacaaaacgaaacaaacgcaaaacgaaacaaaaccaaaacgtacacgaacgcaaaacgaaaaaaacgcaaaacgaaacaaaaccaaaacgtacacgaacgcaaaacgaaaaaaacgcaaaacgaaacaaaaccaaaacgtacacgaacgcaaaacgataaaaacgcaaaacgaaacaaaaccaaaacgtacacgaacgcaaaacgaaaaaaacgcaaaacgaaacaaaaccaaaacgtacacgaacgcaaaacgaaaaaaacgcaaaacgaaacaaaaccaaaacgtacacgaacgcaaaacgaaaaaaacgcaaaataaaacaaaaccaaaacgtacacgaacacacgaatacaaaacgaaacaaacgcaaaacgaaacaaaaccaaaatatacacgaacgcaaaacgaaataaatacaaatataacaaatacaaacgcgacgtcc

SEQ ID NO: 24935 - DNA, 880 bp, Artificial Sequence
  chemically treated genomic DNA (Homo sapiens) CpG-island No: 24935
gaggtagggttagagcgtgtatgggggtagggcgaggagggcgtagggtgaggtagggttagagcgtgtatgggggtagggcgaggagggcgtagggcgaggtagggttagagcgtgtacgggggtagggcgaggagggcgtagggcgaggtagggttagagcgtgtacggatatagggcgaggagggcgtagggtgaggtagggttagagcgtgtacgggcgtagggcgaggagggcgtagggtgaggtagggttagagcgtgtacgaatatacgggtgtagggcgaggtaggcgtagggcgaggtagggttagagcgtgtacggacgtagggcgaggagggcgtagggcgaggtagggttagagcgtgtacgggcgtagggcgaggagggcgtagggtgaggtagggttagagcgtgtacgaatatacgggtgtagggcgaggtaggcgtagggcgaggtagggttagagcgtgtacggacgtagggcgaggagggcgtagggcgaggtagggttagagcgtgtacgggcgtagggcgaggagggcgtagggcgaggtagggttagagcgtgtacgggcgtagggcgatgagggcgtagggcgaggtagggttagagcgtgtacgggcgtagggcgaggagggcgtagggcgaggtagggttagagcgtgtacgggcgtagggcgaggagggcgtagggcgaggtagggttagagcgtgtacgggcgtagggcgaggagggcgtagggtgaggtagggttagagcgtgtacgaatatacgggtgtagggcgaggtaggcgtagggcgaggtagggttagagtgtgtacgggcgtagggcgaggtgggtgtagatgtggtaggtgtagacgcggcgttt

SEQ ID NO: 24936 - DNA, 880 bp, Artificial Sequence
  chemically treated genomic DNA (Homo sapiens) CpG-island No: 24936
aaacgccgcgtctacacctaccacatctacacccacctcgccctacgcccgtacacactctaaccctacctcgccctacgcctacctcgccctacacccgtatattcgtacacgctctaaccctacctcaccctacgccctcctcgccctacgcccgtacacgctctaaccctacctcgccctacgccctcctcgccctacgcccgtacacgctctaaccctacctcgccctacgccctcctcgccctacgcccgtacacgctctaaccctacctcgccctacgccctcatcgccctacgcccgtacacgctctaaccctacctcgccctacgccctcctcgccctacgcccgtacacgctctaaccctacctcgccctacgccctcctcgccctacgtccgtacacgctctaaccctacctcgccctacgcctacctcgccctacacccgtatattcgtacacgctctaaccctacctcaccctacgccctcctcgccctacgcccgtacacgctctaaccctacctcgccctacgccctcctcgccctacgtccgtacacgctctaaccctacctcgccctacgcctacctcgccctacacccgtatattcgtacacgctctaaccctacctcaccctacgccctcctcgccctacgcccgtacacgctctaaccctacctcaccctacgccctcctcgccctatatccgtacacgctctaaccctacctcgccctacgccctcctcgccctacccccgtacacgctctaaccctacctcgccctacgccctcctcgccctacccccatacacgctctaaccctacctcaccctacgccctcctcgccctacccccatacacgctctaaccctacctc

SEQ ID NO: 24937 - DNA, 1954 bp, Artificial Sequence
  chemically treated genomic DNA (Homo sapiens) CpG-island No: 24937
  misc_feature (465)..(465): n is either a, c, g or t
  misc_feature (639)..(639): n is either a, c, g or t
  misc_feature (718)..(718): n is either a, c, g or t
  misc_feature (754)..(754): n is either a, c, g or t
agaagaggtcggattattatatttataataaacgggggcgcgaaggaagtagcgcgacgatgaggtaagcgaaataagtagggcggtatatcgattatacgtagatgatgaagataagatcggtcggtcgttagtagtttaattagattaattgtacgatcgagtttacgacgtaggatcgttgatagagtagttagtagacggcgtatacgacgagtatagggatcgatgtatagagcgtcgagtaagaggtagagtagagagttagacgtgtacggtatatatcgaagcgaggtgagacgtacggatttacgagacgagtaagtaatagacgaacggtacgcgtaggcgtacgaagagacgaattaagagcgggtcgtacggtagattaggatagttgatattgtattatacgagtaggcgtgtgtagtatataggtttacgcgcggatgttgtgttaggttngcgcgtttataggagtaacgtaagcgttgtatatagcgttaggtacggtacgtttgcgtaggatatgcgtattacgtagatagagtacgcgacgtgtagtttacgagttgattatatttcgacgtcgtttttgttcgtaattaggatagcgtatacgtttataaattagttcgnatttacgttagtacgtcggtatcgtgtcgatggtgtcgttgcggtgtcgtggttgttatacgtttcgcgcgttttgttncgttgtcgtgcgtttatcgtttttcggttcgagtgnttaagtcgtcgagtcggaggtcgaggtggttacgttcgcgcgatagattcgacgaagtcgttagttacgatgttcgttagagttggttttacgtttacgttgtgttcggtcgtttttacgttttgttgtgtttgtgtatcgcgcgtgcgtttttgtttatttttcgttgtcggtgcgttacggttgagtcgtcgtatgcgcgttcgtgttcgttgatatttgtatgttgcggttttgttagcgcgcgtcgtgcgtttacgttcgtttttgattagtgtcgcggttcgttgtttcgttgcgtacgttttttcgttatttgttatcgcggcgcgtgtcgcgtatttatcgtagcgttgttagtgtggtcggtttttgtttttatgttggtgttcggttcggttttatcgttttagcgttcgttttgtttttttttcgcgtttttagattttgtaagcgtatttcgtattacgtcggtcgtgcgtttttttttgtttttatgtgttcgtagtatatatttttttcgttatagtcggcgcgtgcgttcgtttatttagcgtttcgatcggtttagtttatcgtgtgtttagtatcgttattcgtttgttgtcgtcgtattacggtagtttttcgtgtgacgtgcgttttagtcgatatttcgttttacgttttgcgtttttcggtttttttttttagcgtttcgcgatacgcggttgttcgtttgttgttcgttttatcgtttgtcgttttatttacgcgacgtcgttgtttcgattcgtcgcgttttcgttttatttttatttttcgttttttttttcgtttagtgttagtatcgtgtttacggtttttttcgcgcgtcgttcgttatttacgtcgtttcgttgtttgtgcgttttttcgttggtcgcgcgttttttcgtgttcgcgtcgtcgtttttagttttgatttacgtacgcgttcgttgcgcgttattcgttttttattcgcgttcggtggtgcgcgcgttagtggtcgtagtgcgttttagtttcgtcgttcgtttttttggttttgttgtacgacgtattagcgacgtttcgttgttttatgtttatatttttgcgtattattatgcgtaatattatattatttattttttatcgtttattatagtattcgttagtattatatagttgtaatacgtttgcgtatattgttgattt

SEQ ID NO: 24938 - DNA, 1954 bp, Artificial Sequence
  chemically treated genomic DNA (Homo sapiens) CpG-island No: 24938
  misc_feature (1201)..(1201): n is either a, c, g or t
  misc_feature (1237)..(1237): n is either a, c, g or t
  misc_feature (1316)..(1316): n is either a, c, g or t
  misc_feature (1490)..(1490): n is either a, c, g or t
aaatcaacaatatacgcaaacgtattacaactatataatactaacgaatactataataaacgataaaaaataaataatataatattacgcataataatacgcaaaaatataaacataaaacaacgaaacgtcgctaatacgtcgtacaacaaaaccaaaaaaacgaacgacgaaactaaaacgcactacgaccactaacgcgcgcaccaccgaacgcgaataaaaaacgaataacgcgcaacgaacgcgtacgtaaatcaaaactaaaaacgacgacgcgaacacgaaaaaacgcgcgaccaacgaaaaaacgcacaaacaacgaaacgacgtaaataacgaacgacgcgcgaaaaaaaccgtaaacacgatactaacactaaacgaaaaaaaaaacgaaaaataaaaataaaacgaaaacgcgacgaatcgaaacaacgacgtcgcgtaaataaaacgacaaacgataaaacgaacaacaaacgaacaaccgcgtatcgcgaaacgctaaaaaaaaaaaccgaaaaacgcaaaacgtaaaacgaaatatcgactaaaacgcacgtcacacgaaaaactaccgtaatacgacgacaacaaacgaataacgatactaaacacacgataaactaaaccgatcgaaacgctaaataaacgaacgcacgcgccgactataacgaaaaaaatatatactacgaacacataaaaacaaaaaaaaacgcacgaccgacgtaatacgaaatacgcttacaaaatctaaaaacgcgaaaaaaaaacaaaacgaacgctaaaacgataaaaccgaaccgaacaccaacataaaaacaaaaaccgaccacactaacaacgctacgataaatacgcgacacgcgccgcgataacaaataacgaaaaaacgtacgcaacgaaacaacgaaccgcgacactaatcaaaaacgaacgtaaacgcacgacgcgcgctaacaaaaccgcaacatacaaatatcaacgaacacgaacgcgcatacgacgactcaaccgtaacgcaccgacaacgaaaaataaacaaaaacgcacgcgcgatacacaaacacaacaaaacgtaaaaacgaccgaacacaacgtaaacgtaaaaccaactctaacgaacatcgtaactaacgacttcgtcgaatctatcgcgcgaacgtaaccacctcgacctccgactcgacgacttaancactcgaaccgaaaaacgataaacgcacgacaacgnaacaaaacgcgcgaaacgtataacaaccacgacaccgcaacgacaccatcgacacgataccgacgtactaacgtaaatncgaactaatttataaacgtatacgctatcctaattacgaacaaaaacgacgtcgaaatataatcaactcgtaaactacacgtcgcgtactctatctacgtaatacgcatatcctacgcaaacgtaccgtacctaacgctatatacaacgcttacgttactcctataaacgcgcnaacctaacacaacatccgcgcgtaaacctatatactacacacgcctactcgtataatacaatatcaactatcctaatctaccgtacgacccgctcttaattcgtctcttcgtacgcctacgcgtaccgttcgtctattacttactcgtctcgtaaatccgtacgtctcacctcgcttcgatatataccgtacacgtctaactctctactctacctcttactcgacgctctatacatcgatccctatactcgtcgtatacgccgtctactaactactctatcaacgatcctacgtcgtaaactcgatcgtacaattaatctaattaaactactaacgaccgaccgatcttatcttcatcatctacgtataatcgatataccgccctacttatttcgcttacctcatcgtcgcgctacttccttcgcgcccccgtttattataaatataataatccgacctcttct

SEQ ID NO: 24939 - DNA, 1954 bp, Artificial Sequence
  chemically treated genomic DNA (Homo sapiens) CpG-island No: 24939
  misc_feature (1201)..(1201): n is either a, c, g or t
  misc_feature (1237)..(1237): n is either a, c, g or t
  misc_feature (1316)..(1316): n is either a, c, g or t
  misc_feature (1490)..(1490): n is either a, c, g or t
gaattaataatgtgcgtaggcgtgttgtagttgtgtggtattggcgagtgttatagtggacgataggaagtgagtggtatgatgttgcgtatagtggtgcgtaggaatgtgagtatgagatagcgagacgtcgttgatgcgtcgtgtagtagagttaggagagcgggcggcgggattgggacgtattgcggttattgacgcgcgtattatcgagcgcgagtgagggacgagtagcgcgtagcgagcgcgtgcgtggattagggttgagagcggcgacgcgagtacgaggaggcgcgcggttagcggaggagcgtataggtagcgaagcggcgtgagtagcgagcggcgcgcggaggagatcgtaagtacggtgttggtattggacgggaggaggaacgagaggtaggagtggaacgagaacgcgacgagtcgaggtagcgacgtcgcgtgggtggggcggtaggcgatagagcgggtagtagacgaatagtcgcgtgtcgcgaggcgttagagagagagatcgagaggcgtagagcgtagagcgaggtgtcgattgaggcgtacgttatacgagaggttgtcgtagtacgacggtagtagacggatggcggtgttaggtatacggtagattaggtcggtcggagcgttgagtggacgagcgtacgcgtcgattgtgacggggagggtgtgtgttgcgagtatatgagagtagaggagggcgtacgatcgacgtagtgcggagtacgtttgtagggtttagagacgcgaagggagggtagaacggacgttggagcggtaggatcggatcggatattagtatggagataggagtcgattatattgataacgttgcggtgagtgcgcggtacgcgtcgcggtggtaggtggcgaggagacgtgcgtagcggagtagcgagtcgcggtattggttagggacgggcgtgaacgtacggcgcgcgttggtagggtcgtagtatgtaggtgttagcggatacgagcgcgtatgcggcgatttagtcgtgacgtatcggtagcggggagtagataggggcgtacgcgcgatgtataggtatagtaggacgtagggacgatcgagtatagcgtggacgtgaggttagttttgacgagtatcgtgattgacgatttcgtcgagtttgtcgcgcgagcgtggttatttcgattttcgattcgacgatttgantattcgagtcgagggacgatggacgtacgatagcgnagtaagacgcgcgaggcgtgtgatagttacggtatcgtagcgatattatcggtacggtatcgacgtattggcgtgagtncgagttggtttgtgagcgtgtgcgttgttttgattacggatagagacggcgtcgggatgtggttagttcgtggattgtacgtcgcgtgttttgtttgcgtggtgcgtatgttttgcgtagacgtatcgtgtttgacgttgtgtgtagcgtttacgttgtttttgtaggcgcgtnagtttaatatagtattcgcgcgtgagtttgtgtattgtatacgtttattcgtgtagtgtagtgttagttgttttagtttatcgtgcgattcgtttttagttcgttttttcgtgcgtttacgcgtatcgttcgtttgttgtttattcgtttcgtgggttcgtgcgttttatttcgtttcggtgtgtgtcgtgtacgtttggttttttattttattttttgttcggcgttttgtatatcgatttttgtgttcgtcgtatgcgtcgtttgttggttgttttgttagcgattttgcgtcgtgaattcgatcgtatagttagtttgattgagttattgacggtcggtcgattttatttttattatttgcgtgtggtcgatgtgtcgttttatttgtttcgtttgttttatcgtcgcgttgtttttttcgcgttttcgtttattataaatatagtgattcggtttttttt

SEQ ID NO: 24940 - DNA, 1954 bp, Artificial Sequence
  chemically treated genomic DNA (Homo sapiens) CpG-island No: 24940
  misc_feature (465)..(465): n is either a, c, g or t
  misc_feature (639)..(639): n is either a, c, g or t
  misc_feature (718)..(718): n is either a, c, g or t
  misc_feature (754)..(754): n is either a, c, g or t
aaaaaaaaccgaatcactatatttataataaacgaaaacgcgaaaaaaacaacgcgacgataaaacaaacgaaacaaataaaacgacacatcgaccacacgcaaataataaaaataaaatcgaccgaccgtcaataactcaatcaaactaactatacgatcgaattcacgacgcaaaatcgctaacaaaacaaccaacaaacgacgcatacgacgaacacaaaaatcgatatacaaaacgccgaacaaaaaataaaataaaaaaccaaacgtacacgacacacaccgaaacgaaataaaacgcacgaacccacgaaacgaataaacaacaaacgaacgatacgcgtaaacgcacgaaaaaacgaactaaaaacgaatcgcacgataaactaaaacaactaacactacactacacgaataaacgtatacaatacacaaactcacgcgcgaatactatattaaactnacgcgcctacaaaaacaacgtaaacgctacacacaacgtcaaacacgatacgtctacgcaaaacatacgcaccacgcaaacaaaacacgcgacgtacaatccacgaactaaccacatcccgacgccgtctctatccgtaatcaaaacaacgcacacgctcacaaaccaactcgnactcacgccaatacgtcgataccgtaccgataatatcgctacgataccgtaactatcacacgcctcgcgcgtcttactncgctatcgtacgtccatcgtccctcgactcgaatantcaaatcgtcgaatcgaaaatcgaaataaccacgctcgcgcgacaaactcgacgaaatcgtcaatcacgatactcgtcaaaactaacctcacgtccacgctatactcgatcgtccctacgtcctactatacctatacatcgcgcgtacgcccctatctactccccgctaccgatacgtcacgactaaatcgccgcatacgcgctcgtatccgctaacacctacatactacgaccctaccaacgcgcgccgtacgttcacgcccgtccctaaccaataccgcgactcgctactccgctacgcacgtctcctcgccacctaccaccgcgacgcgtaccgcgcactcaccgcaacgttatcaatataatcgactcctatctccatactaatatccgatccgatcctaccgctccaacgtccgttctaccctcccttcgcgtctctaaaccctacaaacgtactccgcactacgtcgatcgtacgccctcctctactctcatatactcgcaacacacaccctccccgtcacaatcgacgcgtacgctcgtccactcaacgctccgaccgacctaatctaccgtatacctaacaccgccatccgtctactaccgtcgtactacgacaacctctcgtataacgtacgcctcaatcgacacctcgctctacgctctacgcctctcgatctctctctctaacgcctcgcgacacgcgactattcgtctactacccgctctatcgcctaccgccccacccacgcgacgtcgctacctcgactcgtcgcgttctcgttccactcctacctctcgttcctcctcccgtccaataccaacaccgtacttacgatctcctccgcgcgccgctcgctactcacgccgcttcgctacctatacgctcctccgctaaccgcgcgcctcctcgtactcgcgtcgccgctctcaaccctaatccacgcacgcgctcgctacgcgctactcgtccctcactcgcgctcgataatacgcgcgtcaataaccgcaatacgtcccaatcccgccgcccgctctcctaactctactacacgacgcatcaacgacgtctcgctatctcatactcacattcctacgcaccactatacgcaacatcataccactcacttcctatcgtccactataacactcgccaataccacacaactacaacacgcctacgcacattattaattc

SEQ ID NO: 24941 - DNA, 731 bp, Artificial Sequence
  chemically treated genomic DNA (Homo sapiens) CpG-island No: 24941
  misc_feature (317)..(317): n is either a, c, g or t
  misc_feature (324)..(324): n is either a, c, g or t
  misc_feature (583)..(583): n is either a, c, g or t
ttggtatacgattagagagacggagagacgagtagagatttttataggagatacgacgcgagacgtatgtaaggacggagcggagatataaagcgtaagagatagtacgaagataatataaagacgtacgatagaagtcgtaatatatattagagtagagtacgtagtacgtgtaataacggatttaatcgagcggattatacggataatagacgtatatatatacgtaggtagagtatagaagagtaatatatagtgaggatacggagataggattagtatagtaatgtaggaggatatacggacgagagtttatncgacgangcgatacgcgagagatttacgtaagatagcgatttagacgtaaagatcgaggagtagataggaagagcgaacgaacgtaatagtaagtaagatatagagaattgatcggagaaatatcggaacgaacgaagcgaagtatgataagcgagtagtagaagacgaggagatagtatacgacgaggcgaatgagtagtagtttatatagaattcgaaagagagataacgaatattagatagagagatgcgagtagattagagngtacgagagatacgaggaaggatagatacgaaagagagtagagagtatacgcgtagtagcgacgaatcgtttagcggcgtaagttgagtagcgattatagaggataggatagaagagagtagacgatagacgtcgcgagcgcgtaagt

SEQ ID NO: 24942 - DNA, 731 bp, Artificial Sequence
  chemically treated genomic DNA (Homo sapiens) CpG-island No: 24942
  misc_feature (149)..(149): n is either a, c, g or t
  misc_feature (408)..(408): n is either a, c, g or t
  misc_feature (415)..(415): n is either a, c, g or t
acttacgcgctcgcgacgtctatcgtctactctcttctatcctatcctctataatcgctactcaacttacgccgctaaacgattcgtcgctactacgcgtatactctctactctctttcgtatctatccttcctcgtatctctcgtacnctctaatctactcgcatctctctatctaatattcgttatctctctttcgaattctatataaactactactcattcgcctcgtcgtatactatctcctcgtcttctactactcgcttatcatacttcgcttcgttcgttccgatatttctccgatcaattctctatatcttacttactattacgttcgttcgctcttcctatctactcctcgatctttacgtctaaatcgctatcttacgtaaatctctcgcgtatcgcntcgtcgnataaactctcgtccgtatatcctcctacattactatactaatcctatctccgtatcctcactatatattactcttctatactctacctacgtatatatatacgtctattatccgtataatccgctcgattaaatccgttattacacgtactacgtactctactctaatatatattacgacttctatcgtacgtctttatattatcttcgtactatctcttacgctttatatctccgctccgtccttacatacgtctcgcgtcgtatctcctataaaaatctctactcgtctctccgtctctctaatcgtataccaa

SEQ ID NO: 24943 - DNA, 731 bp, Artificial Sequence
  chemically treated genomic DNA (Homo sapiens) CpG-island No: 24943
  misc_feature (149)..(149): n is either a, c, g or t
  misc_feature (408)..(408): n is either a, c, g or t
  misc_feature (415)..(415): n is either a, c, g or t
gtttgcgcgttcgcggcgtttgtcgtttgtttttttttgttttgttttttatgatcgttgtttagtttgcgtcgttgagcggttcgtcgttgttacgcgtgtgttttttgttttttttcgtgtttgttttttttcgtgtttttcgtgtnttttggtttgttcgtatttttttgtttagtgttcgttgtttttttttcgagttttgtgtgagttgttgtttattcgtttcgtcgtgtgttgttttttcgttttttgttgttcgtttgttatgtttcgtttcgttcgtttcgatgttttttcgattagttttttgtgttttgtttattgttgcgttcgttcgttttttttgtttatttttcggtttttgcgtttgggtcgttgttttgcgtaggtttttcgcgtgtcgtntcgtcgngtggattttcgttcgtgtgtttttttgtattgttgtgttggttttattttcgtgtttttattgtgtgttgtttttttgtgttttatttacgtatgtgtatgcgtttgttgttcgtatagttcgttcggttgagttcgttgttgtacgtgttgcgtgttttattttgatgtgtgttgcggtttttgtcgtgcgtttttgtgttgttttcgtgttgttttttgcgttttgtgttttcgtttcgtttttgtatgcgtttcgcgtcgtgttttttgtaagagtttttgttcgttttttcgtttttttggtcgtgtgttag

SEQ ID NO: 24944 - DNA, 731 bp, Artificial Sequence
  chemically treated genomic DNA (Homo sapiens) CpG-island No: 24944
  misc_feature (317)..(317): n is either a, c, g or t
  misc_feature (324)..(324): n is either a, c, g or t
  misc_feature (583)..(583): n is either a, c, g or t
ctaacacacgaccaaaaaaacgaaaaaacgaacaaaaactcttacaaaaaacacgacgcgaaacgcatacaaaaacgaaacgaaaacacaaaacgcaaaaaacaacacgaaaacaacacaaaaacgcacgacaaaaaccgcaacacacatcaaaataaaacacgcaacacgtacaacaacgaactcaaccgaacgaactatacgaacaacaaacgcatacacatacgtaaataaaacacaaaaaaacaacacacaataaaaacacgaaaataaaaccaacacaacaatacaaaaaaacacacgaacgaaaatccacncgacganacgacacgcgaaaaacctacgcaaaacaacgacccaaacgcaaaaaccgaaaaataaacaaaaaaaacgaacgaacgcaacaataaacaaaacacaaaaaactaatcgaaaaaacatcgaaacgaacgaaacgaaacataacaaacgaacaacaaaaaacgaaaaaacaacacacgacgaaacgaataaacaacaactcacacaaaactcgaaaaaaaaacaacgaacactaaacaaaaaaatacgaacaaaccaaaanacacgaaaaacacgaaaaaaaacaaacacgaaaaaaaacaaaaaacacacgcgtaacaacgacgaaccgctcaacgacgcaaactaaacaacgatcataaaaaacaaaacaaaaaaaaacaaacgacaaacgccgcgaacgcgcaaac

SEQ ID NO: 24945 - DNA, 689 bp, Artificial Sequence
  chemically treated genomic DNA (Homo sapiens) CpG-island No: 24945
acgatagttagtatcgtttggtgttttatacgcggatatagtatggcgagttattggtcgagagtcgttatttttacgattcgttgggacggcgaatggtaaaacgggtttggcggcgggagcgtgatttgacggggtggatgtcgttgtcgcgtaaatcggaggtgacgtggtatggttgggacggagataggttgacgacggtgtagattgatattatacgtatttagacggtatacgagtcgggaagttttacgtcgtttattcgggtcgagatagagaacggcgagcgggaaaaagcgtagcggcgtagtttggtagagacgttttagtaggaagggagtgagaacggttacggcgtggtgttttcggttgaattggtgcggttgttggataggttggaggaagaaattcgggtagatcgcgtgagtagtgaaagtcgggcgtggtttgcgtagtgcgggttgacggtggagtaattggttagataggtggagtcggaatatatatcggcgcgaaaagtttatttttattattgcgattatcggggtttgtcgttggcgtttattagcgaagacggtaatacggcgtggcgcggggagtatgatgaatggggtaattagtttaatgaggagaattcgtattagttgtattagtcgtatcgtttgataaggtagtagtatgatgag

SEQ ID NO: 24946 - DNA, 689 bp, Artificial Sequence
  chemically treated genomic DNA (Homo sapiens) CpG-island No: 24946
ctcatcatactactaccttatcaaacgatacgactaatacaactaatacgaattctcctcattaaactaattaccccattcatcatactccccgcgccacgccgtattaccgtcttcgctaataaacgccaacgacaaaccccgataatcgcaataataaaaataaacttttcgcgccgatatatattccgactccacctatctaaccaattactccaccgtcaacccgcactacgcaaaccacgcccgactttcactactcacgcgatctacccgaatttcttcctccaacctatccaacaaccgcaccaattcaaccgaaaacaccacgccgtaaccgttctcactcccttcctactaaaacgtctctaccaaactacgccgctacgctttttcccgctcgccgttctctatctcgacccgaataaacgacgtaaaacttcccgactcgtataccgtctaaatacgtataatatcaatctacaccgtcgtcaacctatctccgtcccaaccataccacgtcacctccgatttacgcgacaacgacatccaccccgtcaaatcacgctcccgccgccaaacccgttttaccattcgccgtcccaacgaatcgtaaaaataacgactctcgaccaataactcgccatactatatccgcgtataaaacaccaaacgatactaactatcgt

SEQ ID NO: 24947 - DNA, 689 bp, Artificial Sequence
  chemically treated genomic DNA (Homo sapiens) CpG-island No: 24947
tttattatgttgttgttttgttagacggtacggttggtgtagttgatgcgggttttttttattaagttggttgttttatttattatatttttcgcgttacgtcgtattgtcgttttcgttgatgagcgttagcggtaggtttcggtggtcgtagtggtaaaaatgaatttttcgcgtcggtgtgtatttcggttttatttgtttggttagttgttttatcgttagttcgtattgcgtaagttacgttcggtttttattgtttacgcggtttgttcggatttttttttttagtttgtttagtagtcgtattagtttagtcgggaatattacgtcgtggtcgtttttattttttttttgttggagcgtttttgttaggttgcgtcgttgcgttttttttcgttcgtcgttttttgtttcgattcggatgagcggcgtgaagtttttcggttcgtatatcgtttggatacgtgtggtgttagtttgtatcgtcgttagtttgttttcgttttagttatattacgttattttcggtttacgcgatagcgatatttatttcgttaggttacgttttcgtcgttagattcgttttgttattcgtcgttttagcgggtcgtagaggtagcggttttcgattagtggttcgttatgttgtattcgcgtgtagaatattaggcggtgttggttgtcgt

SEQ ID NO: 24948 - DNA, 689 bp, Artificial Sequence
  chemically treated genomic DNA (Homo sapiens) CpG-island No: 24948
acgacaaccaacaccgcctaatattctacacgcgaatacaacataacgaaccactaatcgaaaaccgctacctctacgacccgctaaaacgacgaataacaaaacgaatctaacgacgaaaacgtaacctaacgaaataaatatcgctatcgcgtaaaccgaaaataacgtaatataactaaaacgaaaacaaactaacgacgatacaaactaacaccacacgtatccaaacgatatacgaaccgaaaaacttcacgccgctcatccgaatcgaaacaaaaaacgacgaacgaaaaaaaacgcaacgacgcaacctaacaaaaacgctccaacaaaaaaaaaataaaaacgaccacgacgtaatattcccgactaaactaatacgactactaaacaaactaaaaaaaaaaatccgaacaaaccgcgtaaacaataaaaaccgaacgtaacttacgcaatacgaactaacgataaaacaactaaccaaacaaataaaaccgaaatacacaccgacgcgaaaaattcatttttaccactacgaccaccgaaacctaccgctaacgctcatcaacgaaaacgacaatacgacgtaacgcgaaaaatataataaataaaacaaccaacttaataaaaaaaacccgcatcaactacaccaaccgtaccgtctaacaaaacaacaacataataaa

SEQ ID NO: 24949 - DNA, 545 bp, Artificial Sequence
  chemically treated genomic DNA (Homo sapiens) CpG-island No: 24949
ttagcgtttttttttttattagtcgcgttatttattagtcgtcgtaatacgttcgttagtcgcgtttcgttgttcggttagtaaattttttattcgttcgtttggttttttacggtaaattttaatattttcgtttgtaatattgttcgcgtcgttttcgtatttattgcggtttatttaggtcggtaatataattacgtttggcgtattttatatatatcgtggtacgtcgtcgtttttttttcgttacgagtgtgcgtttaaattatcgtttttgtagacgttgtacgttttttttattgtatttgtgtttataattagtatatatacgtaggcggtgtttcgttattatattttttttcgcgttcgtatttattgtttttattattgtacgtattgtatttaattcgcgtttaatatttaatcggtttatggtcgggttttggcggttgtatagttgttaatatgtcgtagtttatttttttagcggtaattggtacgtttattttgcggttgtatgtatatggataatatatatttaacgt

SEQ ID NO: 24950 - DNA, 545 bp, Artificial Sequence
  chemically treated genomic DNA (Homo sapiens) CpG-island No: 24950
acgttaaatatatattatccatatacatacaaccgcaaaataaacgtaccaattaccgctaaaaaaataaactacgacatattaacaactatacaaccgccaaaacccgaccataaaccgattaaatattaaacgcgaattaaatacaatacgtacaataataaaaacaataaatacgaacgcgaaaaaaaatataataacgaaacaccgcctacgtatatatactaattataaacacaaatacaataaaaaaaacgtacaacgtctacaaaaacgataatttaaacgcacactcgtaacgaaaaaaaaacgacgacgtaccacgatatatataaaatacgccaaacgtaattatattaccgacctaaataaaccgcaataaatacgaaaacgacgcgaacaatattacaaacgaaaatattaaaatttaccgtaaaaaaccaaacgaacgaataaaaaatttactaaccgaacaacgaaacgcgactaacgaacgtattacgacgactaataaataacgcgactaataaaaaaaaaaacgctaa

SEQ ID NO: 24951 - DNA, 545 bp, Artificial Sequence
  chemically treated genomic DNA (Homo sapiens) CpG-island No: 24951
gcgttgaatgtatattatttatatatatgtaatcgtagagtgggcgtattagttgtcgttggggagatgggttacggtatgttggtaattatgtaatcgttagggttcgattatgagtcggttagatattgggcgcgagttgaatatagtgcgtgtagtggtgggagtagtgaatgcgggcgcgggaagggatgtggtgacggggtatcgtttgcgtatgtgtgttggttgtgggtataggtgtagtggggaaggcgtgtagcgtttgtaggagcggtggtttgggcgtatattcgtggcggggaaaaaacggcggcgtattacggtgtgtgtggagtgcgttaggcgtggttgtgttgtcggtttgggtgggtcgtaatgggtgcggaaacggcgcgggtagtgttgtaggcgaaagtgttggagtttgtcgtggggagttagacgggcgagtggggagtttgttggtcgggtagcggagcgcggttggcgggcgtgttgcggcggttggtgggtggcgcgattggtgaaggggaaggcgttgg

SEQ ID NO: 24952 - DNA, 545 bp, Artificial Sequence
  chemically treated genomic DNA (Homo sapiens) CpG-island No: 24952
ccaacgccttccccttcaccaatcgcgccacccaccaaccgccgcaacacgcccgccaaccgcgctccgctacccgaccaacaaactccccactcgcccgtctaactccccacgacaaactccaacactttcgcctacaacactacccgcgccgtttccgcacccattacgacccacccaaaccgacaacacaaccacgcctaacgcactccacacacaccgtaatacgccgccgttttttccccgccacgaatatacgcccaaaccaccgctcctacaaacgctacacgccttccccactacacctatacccacaaccaacacacatacgcaaacgataccccgtcaccacatcccttcccgcgcccgcattcactactcccaccactacacgcactatattcaactcgcgcccaatatctaaccgactcataatcgaaccctaacgattacataattaccaacataccgtaacccatctccccaacgacaactaatacgcccactctacgattacatatatataaataatatacattcaacgc

SEQ ID NO: 24953 - DNA, 601 bp, Artificial Sequence
  chemically treated genomic DNA (Homo sapiens) CpG-island No: 24953
tgttggcggaagtgggtttggtgggtaaagcgtcgggtcgttataatttgtattttggcggtaatcgtattgggatacgtattttacggatgtataaagaaaatattatcgagtcggaaattttggcgtcgtttgatgaattgatagggcgttgggcgaaagagcgcgaagcgggtgaaggtttcggcgattttacggtgcgtgcgggtattattcgttcggtgttcgattcggcgcgtgatttgtgggattaattattagttcggttttgtaggtttgataagaacgcgtgagcgtcgtattaggtaaggtaaatagtgaggaatttatgtttaaattcgatttaaacgttttgaacgaattgtcgaaggtagatcgtattttggcgttggcggaaattaacgtcgaattggaaaaattggacgttgaaggtcgcgtagtttgggcgttggataatttgttcggtgaatatgtatttttttttagttttggtatttaggcggcggtgagtttgtatttggtgaattaaattcgttcggatatttcggtgatttttatcgatacgggttatttgttttcggaaatttaacgttttattgat

SEQ ID NO: 24954 - DNA, 601 bp, Artificial Sequence
  chemically treated genomic DNA (Homo sapiens) CpG-island No: 24954
atcaataaaacgttaaatttccgaaaacaaataacccgtatcgataaaaatcaccgaaatatccgaacgaatttaattcaccaaatacaaactcaccgccgcctaaataccaaaactaaaaaaaaatacatattcaccgaacaaattatccaacgcccaaactacgcgaccttcaacgtccaatttttccaattcgacgttaatttccgccaacgccaaaatacgatctaccttcgacaattcgttcaaaacgtttaaatcgaatttaaacataaattcctcactatttaccttacctaatacgacgctcacgcgttcttatcaaacctacaaaaccgaactaataattaatcccacaaatcacgcgccgaatcgaacaccgaacgaataatacccgcacgcaccgtaaaatcgccgaaaccttcacccgcttcgcgctctttcgcccaacgccctatcaattcatcaaacgacgccaaaatttccgactcgataatattttctttatacatccgtaaaatacgtatcccaatacgattaccgccaaaatacaaattataacgacccgacgctttacccaccaaacccacttccgccaaca

SEQ ID NO: 24955 - DNA, 601 bp, Artificial Sequence
  chemically treated genomic DNA (Homo sapiens) CpG-island No: 24955
gttaataaagcgttaggttttcgggaataagtaattcgtatcggtgaggattatcggaatattcgggcgaatttgatttattagatgtaggtttatcgtcgtttgaatgttaaagttggaagaaagtatatatttatcgggtagattatttagcgtttaggttacgcggtttttagcgtttagtttttttagttcggcgttagttttcgttagcgttagaatgcgatttattttcggtagttcgtttagggcgtttagatcgagtttggatatagattttttattgtttgttttgtttgatgcgacgtttacgcgtttttattaggtttataagatcgggttgatggttaattttataaattacgcgtcggatcgagtatcgggcgaatgatgttcgtacgtatcgtaaagtcgtcgaagtttttattcgtttcgcgttttttcgtttagcgttttattagtttattaagcgacgttaggattttcggttcggtgatgttttttttatatattcgtgggatacgtgttttaatgcggttgtcgttaagatgtaggttgtagcgattcggcgttttatttattaggtttattttcgttagta

SEQ ID NO: 24956 - DNA, 601 bp, Artificial Sequence
  chemically treated genomic DNA (Homo sapiens) CpG-island No: 24956
tactaacgaaaataaacctaataaataaaacgccgaatcgctacaacctacatcttaacgacaaccgcattaaaacacgtatcccacgaatatataaaaaaaacatcaccgaaccgaaaatcctaacgtcgcttaataaactaataaaacgctaaacgaaaaaacgcgaaacgaataaaaacttcgacgactttacgatacgtacgaacatcattcgcccgatactcgatccgacgcgtaatttataaaattaaccatcaacccgatcttataaacctaataaaaacgcgtaaacgtcgcatcaaacaaaacaaacaataaaaaatctatatccaaactcgatctaaacgccctaaacgaactaccgaaaataaatcgcattctaacgctaacgaaaactaacgccgaactaaaaaaactaaacgctaaaaaccgcgtaacctaaacgctaaataatctacccgataaatatatactttcttccaactttaacattcaaacgacgataaacctacatctaataaatcaaattcgcccgaatattccgataatcctcaccgatacgaattacttattcccgaaaacctaacgctttattaac

SEQ ID NO: 24957 - DNA, 639 bp, Artificial Sequence
  chemically treated genomic DNA (Homo sapiens) CpG-island No: 24957
ggcggcggcggcggtaaaacgttaagatttaggtttcggcgaagcggttacgtttgcgggaaagtaaaatagttgagtaatttaaaaaatgaggaaatttcgggtgttttgcggggaaggacggagggttttgagaaatagggaggttgcggcggaaagaggggcggtgtcgtcggagagtagggtcgacgatggaaagcgagtagcggcgggagcggaaagcgaggatatggacgtgggcggggaagaagatttagaggtttttgggggtcggcgaaattgagaaaattcgacgggggcgaaagggggtcgggtagcgcggtatttgtagagatcgtttaggacgttgtcgggaatttttattcgtttggtttttatgatgaggatttattagtaggaatagtgtatttcggtttcgcgcggatcggggattgacggtacggtattagagatttcggttcgtcggagagttggtagatcgagggagtcgcgggtagagacgattttaacggagacgagaaggggaaggggcgggattcgtttattttcgtttcgtttttttagttttggattttaagattgggttaaggttcggggcggagttttcggagttacgtttttgttcgtttgaaaggttta

SEQ ID NO: 24958 - DNA, 639 bp, Artificial Sequence
  chemically treated genomic DNA (Homo sapiens) CpG-island No: 24958
taaacctttcaaacgaacaaaaacgtaactccgaaaactccgccccgaaccttaacccaatcttaaaatccaaaactaaaaaaacgaaacgaaaataaacgaatcccgccccttccccttctcgtctccgttaaaatcgtctctacccgcgactccctcgatctaccaactctccgacgaaccgaaatctctaataccgtaccgtcaatccccgatccgcgcgaaaccgaaatacactattcctactaataaatcctcatcataaaaaccaaacgaataaaaattcccgacaacgtcctaaacgatctctacaaataccgcgctacccgaccccctttcgcccccgtcgaattttctcaatttcgccgacccccaaaaacctctaaatcttcttccccgcccacgtccatatcctcgctttccgctcccgccgctactcgctttccatcgtcgaccctactctccgacgacaccgcccctctttccgccgcaacctccctatttctcaaaaccctccgtccttccccgcaaaacacccgaaatttcctcattttttaaattactcaactattttactttcccgcaaacgtaaccgcttcgccgaaacctaaatcttaacgttttaccgccgccgccgcc

SEQ ID NO: 24959 - DNA, 639 bp, Artificial Sequence
  chemically treated genomic DNA (Homo sapiens) CpG-island No: 24959
tgggttttttaagcgagtaggggcgtgatttcgggggtttcgtttcgagttttggtttagttttggggtttaaggttgagggagcgggacggaagtgagcgggtttcgttttttttttttttcgttttcgttggagtcgtttttgttcgcggttttttcggtttgttagtttttcggcgagtcggagtttttagtgtcgtatcgttagttttcggttcgcgcggagtcgggatgtattgtttttgttggtgggtttttattatggagattaaacgggtggagattttcggtagcgttttggacgatttttgtaggtatcgcgttattcgattttttttcgttttcgtcgggtttttttagtttcgtcgatttttagaggtttttgggttttttttttcgtttacgtttatgttttcgtttttcgttttcgtcgttgttcgttttttatcgtcgattttgtttttcgacgatatcgttttttttttcgtcgtagtttttttgttttttaaggtttttcgttttttttcgtagaatattcggaatttttttattttttaagttatttaattattttgttttttcgtaggcgtagtcgtttcgtcggagtttgggttttagcgttttgtcgtcgtcgtcgtt

SEQ ID NO: 24960 - DNA, 639 bp, Artificial Sequence
  chemically treated genomic DNA (Homo sapiens) CpG-island No: 24960
aacgacgacgacgacaaaacgctaaaacccaaactccgacgaaacgactacgcctacgaaaaaacaaaataattaaataacttaaaaaataaaaaaattccgaatattctacgaaaaaaaacgaaaaaccttaaaaaacaaaaaaactacgacgaaaaaaaaaacgatatcgtcgaaaaacaaaatcgacgataaaaaacgaacaacgacgaaaacgaaaaacgaaaacataaacgtaaacgaaaaaaaaaacccaaaaacctctaaaaatcgacgaaactaaaaaaacccgacgaaaacgaaaaaaaatcgaataacgcgatacctacaaaaatcgtccaaaacgctaccgaaaatctccacccgtttaatctccataataaaaacccaccaacaaaaacaatacatcccgactccgcgcgaaccgaaaactaacgatacgacactaaaaactccgactcgccgaaaaactaacaaaccgaaaaaaccgcgaacaaaaacgactccaacgaaaacgaaaaaaaaaaaaaacgaaacccgctcacttccgtcccgctccctcaaccttaaaccccaaaactaaaccaaaactcgaaacgaaacccccgaaatcacgcccctactcgcttaaaaaaccca

SEQ ID NO: 24961 - DNA, 580 bp, Artificial Sequence
  chemically treated genomic DNA (Homo sapiens) CpG-island No: 24961
ttcgtggttttattagcggcggcgattttcggttatttattaagagcgatgaagtttttgtttacgtcggttttggtttcgagtttggttagaaggttagttatgtagtttttttcgtgtaggaatcggtcgaattttttttttatggtcgtagatatggcggggatcgtttcgtcgttcggggttgtttttagtgtcggatagattggagcggcgattgcggcggagtagcggtaggcggggatcgcggcgcgtttacgcgttttttattcgttttcgttcgtttcgttcggtcgtcgcgcgttttttttcggtcgtcgcgcgttttttttttttcgtttagcgttagggggatagcgttatattttggcgggggcgggtttgtaatttcgcggacgttgcgaggtggtttgtttgttgatagttttaatttattgcggggtaaaaaggatgtggcgtgggggcgtgtattttgtgtttttcgtgggttttttttttaaatcggattattgtaaaaagtaggtagaaaggaggtaggcgtttttgttgttttcgtttgtaatttattgcgatgagtttg

SEQ ID NO: 24962 - DNA, 580 bp, Artificial Sequence
  chemically treated genomic DNA (Homo sapiens) CpG-island No: 24962
caaactcatcgcaataaattacaaacgaaaacaacaaaaacgcctacctcctttctacctactttttacaataatccgatttaaaaaaaaaacccacgaaaaacacaaaatacacgcccccacgccacatcctttttaccccgcaataaattaaaactatcaacaaacaaaccacctcgcaacgtccgcgaaattacaaacccgcccccgccaaaatataacgctatccccctaacgctaaacgaaaaaaaaaaaacgcgcgacgaccgaaaaaaaacgcgcgacgaccgaacgaaacgaacgaaaacgaataaaaaacgcgtaaacgcgccgcgatccccgcctaccgctactccgccgcaatcgccgctccaatctatccgacactaaaaacaaccccgaacgacgaaacgatccccgccatatctacgaccataaaaaaaaaattcgaccgattcctacacgaaaaaaactacataactaaccttctaaccaaactcgaaaccaaaaccgacgtaaacaaaaacttcatcgctcttaataaataaccgaaaatcgccgccgctaataaaaccacgaa

SEQ ID NO: 24963 - DNA, 580 bp, Artificial Sequence
  chemically treated genomic DNA (Homo sapiens) CpG-island No: 24963
taaatttatcgtagtgaattgtaggcgggagtaataaggacgtttgttttttttttgtttgttttttgtaatagttcgatttgagaaggggatttacgagagatataaaatgtacgtttttacgttatattttttttatttcgtaatgggttaagattgttaataggtaggttatttcgtagcgttcgcggagttgtaggttcgttttcgttagggtgtggcgttgtttttttggcgttgggcgggggaggaggggcgcgcggcggtcgaggaggggcgcgcggcggtcgggcggggcgagcggaggcgagtggaggacgcgtagacgcgtcgcggttttcgtttgtcgttgtttcgtcgtagtcgtcgttttagtttattcggtattaggaatagtttcgagcggcgagacggttttcgttatgtttgcggttatgagggagaggttcgatcggtttttgtacgagaagaattgtatgattgattttttggttaagttcgaggttaaaatcggcgtgaataggagttttatcgtttttggtgggtggtcgggggtcgtcgtcgttggtagggttacggg

SEQ ID NO: 24964 - DNA, 580 bp, Artificial Sequence
  chemically treated genomic DNA (Homo sapiens) CpG-island No: 24964
cccgtaaccctaccaacgacgacgacccccgaccacccaccaaaaacgataaaactcctattcacgccgattttaacctcgaacttaaccaaaaaatcaatcatacaattcttctcgtacaaaaaccgatcgaacctctccctcataaccgcaaacataacgaaaaccgtctcgccgctcgaaactattcctaataccgaataaactaaaacgacgactacgacgaaacaacgacaaacgaaaaccgcgacgcgtctacgcgtcctccactcgcctccgctcgccccgcccgaccgccgcgcgcccctcctcgaccgccgcgcgcccctcctcccccgcccaacgccaaaaaaacaacgccacaccctaacgaaaacgaacctacaactccgcgaacgctacgaaataacctacctattaacaatcttaacccattacgaaataaaaaaaatataacgtaaaaacgtacattttatatctctcgtaaatccccttctcaaatcgaactattacaaaaaacaaacaaaaaaaaaacaaacgtccttattactcccgcctacaattcactacgataaattta

SEQ ID NO: 24965 - DNA, 567 bp, Artificial Sequence
  chemically treated genomic DNA (Homo sapiens) CpG-island No: 24965
gtttttgtcgttggcgttgaagtataatttagcggagaattggcggtttgcgtcggatcgtgcggtttcggtaatttgtatttaattaacggtttgttcgattgttatcgtaattacgtttcggtattggcgattgtcgtttatattttttttagcgaaattggtagcggttatttttaggaaatttatttataagagttatttcgcgaatgtagttattattgcgagttggtttttagttcggagtagattttataagtattggcgattgttatgcgtaaagcggtgtttaatcgtggcgtttcggttgtcgtgttattaggcgacgtggcgttaaaatttgcgttagaaggggtaattatgtattggtattatgcgttataattagtcgtgacgtcggaagaagaagagttacgtaaattggcgtaattgttgcgttattttagtaatatcgttttgatgtgtggtagcggttgcgcgggggcgtataaagagttagttgagtttgtcgggaaaattaaagcgtttattgtttatgttttgcgcggtaaagaatatgtcgaatat

SEQ ID NO: 24966 - DNA, 567 bp, Artificial Sequence
  chemically treated genomic DNA (Homo sapiens) CpG-island No: 24966
atattcgacatattctttaccgcgcaaaacataaacaataaacgctttaattttcccgacaaactcaactaactctttatacgcccccgcgcaaccgctaccacacatcaaaacgatattactaaaataacgcaacaattacgccaatttacgtaactcttcttcttccgacgtcacgactaattataacgcataataccaatacataattaccccttctaacgcaaattttaacgccacgtcgcctaataacacgacaaccgaaacgccacgattaaacaccgctttacgcataacaatcgccaatacttataaaatctactccgaactaaaaaccaactcgcaataataactacattcgcgaaataactcttataaataaatttcctaaaaataaccgctaccaatttcgctaaaaaaaatataaacgacaatcgccaataccgaaacgtaattacgataacaatcgaacaaaccgttaattaaatacaaattaccgaaaccgcacgatccgacgcaaaccgccaattctccgctaaattatacttcaacgccaacgacaaaaac

SEQ ID NO: 24967 - DNA, 567 bp, Artificial Sequence
  chemically treated genomic DNA (Homo sapiens) CpG-island No: 24967
gtattcgatatgttttttatcgcgtagggtatgaataataggcgttttaattttttcggtaaatttaattaattttttatgcgttttcgcgtagtcgttgttatatattagggcgatattgttggaataacgtagtagttgcgttagtttgcgtaattttttttttttcggcgttacgattggttgtggcgtatgatattagtgtatggttgttttttttggcgtaggttttaacgttacgtcgtttggtaatacgataatcgaaacgttacggttaagtatcgttttgcgtatggtaatcgttagtatttgtgggatttgtttcgggttggaaattagttcgtaatagtgattatattcgcggaatagtttttgtgggtgggttttttggaaatagtcgttgttaatttcgttggagggaatatgagcggtaatcgttagtatcggaacgtgattgcggtggtaatcgaataggtcgttgattaagtgtaggttgtcggggtcgtacgattcggcgtagatcgttagtttttcgttaagttgtgttttagcgttagcggtaaaggt

SEQ ID NO: 24968 - DNA, 567 bp, Artificial Sequence
  chemically treated genomic DNA (Homo sapiens) CpG-island No: 24968
acctttaccgctaacgctaaaacacaacttaacgaaaaactaacgatctacgccgaatcgtacgaccccgacaacctacacttaatcaacgacctattcgattaccaccgcaatcacgttccgatactaacgattaccgctcatattccctccaacgaaattaacaacgactatttccaaaaaacccacccacaaaaactattccgcgaatataatcactattacgaactaatttccaacccgaaacaaatcccacaaatactaacgattaccatacgcaaaacgatacttaaccgtaacgtttcgattatcgtattaccaaacgacgtaacgttaaaacctacgccaaaaaaaacaaccatacactaatatcatacgccacaaccaatcgtaacgccgaaaaaaaaaaaattacgcaaactaacgcaactactacgttattccaacaatatcgccctaatatataacaacgactacgcgaaaacgcataaaaaattaattaaatttaccgaaaaaattaaaacgcctattattcataccctacgcgataaaaaacatatcgaatac

SEQ ID NO: 24969 - DNA, 512 bp, Artificial Sequence
  chemically treated genomic DNA (Homo sapiens) CpG-island No: 24969
ggtgcgaattgtatcgttaaattgttttttaacgttgcgtattgatttgtaggtcgatattttgcgtatcgagtggggcgatgcgtattattatatttttagatttaagggtgtttgtaacggcgggttggtttatttttattttttatttgttttttatgcgggggttttttgacgagttgtcgcgttttggcgggagtgtttaagtaggttttgtaaataatgtagcgtgattgtagggattagcggcgcgatagtcgtgagatcgtttttcgttagtagttgacgtattcgggaagcggatatcggtattttttggtaacgtagtcgtttaattttaattagttcgatgggcggtgcggagatagtcggcgtttttagttagtagcgtatattttggttgtattgggcggtaacgcgataaaagggtttagtatcgataaagcggtgagttatatttagcgcgggagcgaggtattgacggaaaatttttagattaatttcggtgtaat

SEQ ID NO: 24970 - DNA, 512 bp, Artificial Sequence
  chemically treated genomic DNA (Homo sapiens) CpG-island No: 24970
attacaccgaaattaatctaaaaattttccgtcaatacctcgctcccgcgctaaatataactcaccgctttatcgatactaaacccttttatcgcgttaccgcccaatacaaccaaaatatacgctactaactaaaaacgccgactatctccgcaccgcccatcgaactaattaaaattaaacgactacgttaccaaaaaataccgatatccgcttcccgaatacgtcaactactaacgaaaaacgatctcacgactatcgcgccgctaatccctacaatcacgctacattatttacaaaacctacttaaacactcccgccaaaacgcgacaactcgtcaaaaaacccccgcataaaaaacaaataaaaaataaaaataaaccaacccgccgttacaaacacccttaaatctaaaaatataataatacgcatcgccccactcgatacgcaaaatatcgacctacaaatcaatacgcaacgttaaaaaacaatttaacgatacaattcgcacc

SEQ ID NO: 24971 - DNA, 512 bp, Artificial Sequence
  chemically treated genomic DNA (Homo sapiens) CpG-island No: 24971
gttatatcgaaattgatttgaagatttttcgttagtatttcgttttcgcgttgggtgtaatttatcgttttgtcggtattgaatttttttgtcgcgttatcgtttagtataattaggatatgcgttattggttggaaacgtcgattattttcgtatcgtttatcgaattggttgaaattgagcggttgcgttattaggagatgtcgatattcgtttttcgggtacgttaattgttggcgaaaaacgattttacggttatcgcgtcgttggtttttgtagttacgttgtattatttgtagaatttgtttgagtattttcgttaggacgcggtagttcgttaaaagattttcgtatgagaaataggtgaaaaatgaaaataaattagttcgtcgttgtaggtatttttgagtttggggatgtgatgatacgtatcgttttattcgatacgtaggatatcgatttgtaaattaatacgtagcgttgagaaatagtttggcgatgtaattcgtatt

SEQ ID NO: 24972 - DNA, 512 bp, Artificial Sequence
  chemically treated genomic DNA (Homo sapiens) CpG-island No: 24972
aatacgaattacatcgccaaactatttctcaacgctacgtattaatttacaaatcgatatcctacgtatcgaataaaacgatacgtatcatcacatccccaaactcaaaaatacctacaacgacgaactaatttattttcatttttcacctatttctcatacgaaaatcttttaacgaactaccgcgtcctaacgaaaatactcaaacaaattctacaaataatacaacgtaactacaaaaaccaacgacgcgataaccgtaaaatcgtttttcgccaacaattaacgtacccgaaaaacgaatatcgacatctcctaataacgcaaccgctcaatttcaaccaattcgataaacgatacgaaaataatcgacgtttccaaccaataacgcatatcctaattatactaaacgataacgcgacaaaaaaattcaataccgacaaaacgataaattacacccaacgcgaaaacgaaatactaacgaaaaatcttcaaatcaatttcgatataac

SEQ ID NO: 24973 - DNA, 751 bp, Artificial Sequence
  chemically treated genomic DNA (Homo sapiens) CpG-island No: 24973
gcgagtttcggttttagtcggttcgtattggtttgcgttaggtttagttcgtagggttcgtttatagtcggtggttcgcgtcgtcgttcggtgttcgcgggtttggtgttggcgggggcgcggggttcggcgcggtcgtttcggttttatttagcggttcgcgtcggggagagggagcgtatttattttagacgcgtttcgggagtcgttggaagagttcgggaaaggaggcggagtcgcgcgaatgaatggagtcggcggttgttcgttggcgattttcggtcggttttaggtcgtatagttcgcggttgttagggcgagtgcggttgtttttcgttcgtttcggacgttcggtttttcgtcgcgggtcggtcgcggtttatcgtgtttttcgacgacgtgacgtattagcgtcgtagcgtttttagttttcgttttcgtttcgcgttcgcgtttatcgcgaattttttcgttcgttagcgcggagcggttttttttcggagtttgggacgtcgttttgtttttttttagtttcggtttttaggcgtcggttcggtaggtgcgggtttggttagttcgggggcgttacgcggttttcgtttcgttattcgcgtttttttttttcgtttcggtcgtcgttattcggtagcgcgacgtttagtttagggtaatggtttggtattaaagagtgattttggtttagatataaaaatagatgcggttaagtcgcgggggttgtaacgttgatttt

SEQ ID NO: 24974 - DNA, 751 bp, Artificial Sequence
  chemically treated genomic DNA (Homo sapiens) CpG-island No: 24974
aaaatcaacgttacaacccccgcgacttaaccgcatctatttttatatctaaaccaaaatcactctttaataccaaaccattaccctaaactaaacgtcgcgctaccgaataacgacgaccgaaacgaaaaaaaaaaacgcgaataacgaaacgaaaaccgcgtaacgcccccgaactaaccaaacccgcacctaccgaaccgacgcctaaaaaccgaaactaaaaaaaaacaaaacgacgtcccaaactccgaaaaaaaaccgctccgcgctaacgaacgaaaaaattcgcgataaacgcgaacgcgaaacgaaaacgaaaactaaaaacgctacgacgctaatacgtcacgtcgtcgaaaaacacgataaaccgcgaccgacccgcgacgaaaaaccgaacgtccgaaacgaacgaaaaacaaccgcactcgccctaacaaccgcgaactatacgacctaaaaccgaccgaaaatcgccaacgaacaaccgccgactccattcattcgcgcgactccgcctcctttcccgaactcttccaacgactcccgaaacgcgtctaaaataaatacgctccctctccccgacgcgaaccgctaaataaaaccgaaacgaccgcgccgaaccccgcgcccccgccaacaccaaacccgcgaacaccgaacgacgacgcgaaccaccgactataaacgaaccctacgaactaaacctaacgcaaaccaatacgaaccgactaaaaccgaaactcgc

SEQ ID NO: 24975 - DNA, 751 bp, Artificial Sequence
  chemically treated genomic DNA (Homo sapiens) CpG-island No: 24975
aaaattagcgttgtagttttcgcggtttaatcgtatttatttttatatttaagttaaggttattttttaatattaggttattgttttgagttgggcgtcgcgttgtcgggtgacggcggtcggggcggagagagggggcgcgggtggcgaggcgggggtcgcgtgacgttttcgggttggttaagttcgtatttgtcgggtcggcgtttgaaagtcggggttggagggaggtagggcggcgttttaggtttcgaggaggggtcgtttcgcgttggcgggcggggggattcgcggtgggcgcgggcgcggagcggaagcgaaggttggaggcgttgcggcgttagtgcgttacgtcgtcggagggtacggtgggtcgcggtcgattcgcgacgaggagtcgggcgttcggggcgagcgggaggtagtcgtattcgttttggtagtcgcgagttgtgcggtttgggatcggtcggaggtcgttagcgagtagtcgtcggttttatttattcgcgcggtttcgttttttttttcgggtttttttagcggttttcggggcgcgtttgaggtgagtgcgtttttttttttcggcgcggatcgttgggtgaggtcgagacggtcgcgtcgggtttcgcgttttcgttagtattagattcgcggatatcgagcggcgacgcgggttatcggttgtgggcggattttgcgggttgggtttggcgtagattagtgcgggtcgattggaatcggggttcgt

SEQ ID NO: 24976 - DNA, 751 bp, Artificial Sequence
  chemically treated genomic DNA (Homo sapiens) CpG-island No: 24976
acgaaccccgattccaatcgacccgcactaatctacgccaaacccaacccgcaaaatccgcccacaaccgataacccgcgtcgccgctcgatatccgcgaatctaatactaacgaaaacgcgaaacccgacgcgaccgtctcgacctcacccaacgatccgcgccgaaaaaaaaaaacgcactcacctcaaacgcgccccgaaaaccgctaaaaaaacccgaaaaaaaaaacgaaaccgcgcgaataaataaaaccgacgactactcgctaacgacctccgaccgatcccaaaccgcacaactcgcgactaccaaaacgaatacgactacctcccgctcgccccgaacgcccgactcctcgtcgcgaatcgaccgcgacccaccgtaccctccgacgacgtaacgcactaacgccgcaacgcctccaaccttcgcttccgctccgcgcccgcgcccaccgcgaatccccccgcccgccaacgcgaaacgacccctcctcgaaacctaaaacgccgccctacctccctccaaccccgactttcaaacgccgacccgacaaatacgaacttaaccaacccgaaaacgtcacgcgacccccgcctcgccacccgcgccccctctctccgccccgaccgccgtcacccgacaacgcgacgcccaactcaaaacaataacctaatattaaaaaataaccttaacttaaatataaaaataaatacgattaaaccgcgaaaactacaacgctaatttt

SEQ ID NO: 24977 - DNA, 592 bp, Artificial Sequence
  chemically treated genomic DNA (Homo sapiens) CpG-island No: 24977
tcgagggtcggggtacgttttatttgtcgtaggtttaagaggtcggcgggatcgtcgggcgaaagttcgggattttcggcggagtttcgggttggtcgcggagtcgggcgaggcgcgagtttcggatacggtttaggggtaggcgaggaagacggcgtaggcggtagcgagtagtagtagtagtagtagtttcgcgattagggtttaaggtagtacgcggtaggcgcgagcgcggggcgcgggaggttacggggtttcggggtttagtgaagcgttagaggcgtattttatgtacgagagattgcgggaagatatagcgcgtcgttttttatagttgtttggttataaaaggaggttacgttttttcgttcgcggttacgttttttcgttcgcggttacgtttttttttagtttagagttttttttttcgttttcgtgattttgcggaattttttttattcggattttttttcgtttttcgttttttttttcgttttcggttttttaagttcggttttaggtttttttttttttgttgtttttttatcgttttggttttttttttttgtcgttttttttcggtatttttgtg

SEQ ID NO: 24978 - DNA, 592 bp, Artificial Sequence
  chemically treated genomic DNA (Homo sapiens) CpG-island No: 24978
cacaaaaataccgaaaaaaaacgacaaaaaaaaaaaaccaaaacgataaaaaaacaacaaaaaaaaaaaaacctaaaaccgaacttaaaaaaccgaaaacgaaaaaaaaaacgaaaaacgaaaaaaaatccgaataaaaaaaattccgcaaaatcacgaaaacgaaaaaaaaaactctaaactaaaaaaaaacgtaaccgcgaacgaaaaaacgtaaccgcgaacgaaaaaacgtaacctccttttataaccaaacaactataaaaaacgacgcgctatatcttcccgcaatctctcgtacataaaatacgcctctaacgcttcactaaaccccgaaaccccgtaacctcccgcgccccgcgctcgcgcctaccgcgtactaccttaaaccctaatcgcgaaactactactactactactactcgctaccgcctacgccgtcttcctcgcctacccctaaaccgtatccgaaactcgcgcctcgcccgactccgcgaccaacccgaaactccgccgaaaatcccgaactttcgcccgacgatcccgccgacctcttaaacctacgacaaataaaacgtaccccgaccctcga

SEQ ID NO: 24979 - DNA, 592 bp, Artificial Sequence
  chemically treated genomic DNA (Homo sapiens) CpG-island No: 24979
tatagagatatcgggaaagagcggtagagagggagaattagggcgatggagagatagtagggagaaaggaatttggagtcgagtttggaaggtcggaaacggaaaggagagcgaaaagcggagagagattcgagtggagaaaatttcgtagagttacggggacgaggggaaaggttttgggttgggaaggggcgtggtcgcgggcggaggggcgtggtcgcgggcggaggggcgtggtttttttttgtagttaagtagttataaaaagcggcgcgttgtgttttttcgtagtttttcgtatatggaatacgtttttgacgttttattggatttcgaagtttcgtggtttttcgcgtttcgcgttcgcgtttgtcgcgtattgttttgggttttggtcgcggggttgttgttgttgttgttgttcgttgtcgtttgcgtcgtttttttcgtttgtttttgggtcgtgttcggggttcgcgtttcgttcggtttcgcggttagttcgagatttcgtcgagggtttcgagttttcgttcgacgatttcgtcggttttttggatttgcggtaggtgagacgtgtttcgattttcgg

SEQ ID NO: 24980 - DNA, 592 bp, Artificial Sequence
  chemically treated genomic DNA (Homo sapiens) CpG-island No: 24980
ccgaaaatcgaaacacgtctcacctaccgcaaatccaaaaaaccgacgaaatcgtcgaacgaaaactcgaaaccctcgacgaaatctcgaactaaccgcgaaaccgaacgaaacgcgaaccccgaacacgacccaaaaacaaacgaaaaaaacgacgcaaacgacaacgaacaacaacaacaacaacaaccccgcgaccaaaacccaaaacaatacgcgacaaacgcgaacgcgaaacgcgaaaaaccacgaaacttcgaaatccaataaaacgtcaaaaacgtattccatatacgaaaaactacgaaaaaacacaacgcgccgctttttataactacttaactacaaaaaaaaaccacgcccctccgcccgcgaccacgcccctccgcccgcgaccacgccccttcccaacccaaaacctttcccctcgtccccgtaactctacgaaattttctccactcgaatctctctccgcttttcgctctcctttccgtttccgaccttccaaactcgactccaaattcctttctccctactatctctccatcgccctaattctccctctctaccgctctttcccgatatctctata

SEQ ID NO: 24981 - DNA, 573 bp, Artificial Sequence
  chemically treated genomic DNA (Homo sapiens) CpG-island No: 24981
ggatgatagcggaatggggtttcggtagattgataggattagtcgtggaaggggcgggtttattttttttttgaattcgcgagttaaagttacgttggtgttggtgattatttaggttgagcgttgggtatttttagtttcgggcgattttttggcgttatttttaggttgagagttatgattaggcgagtttcggtcgtgggatcgaagattttttatttttagtattttaattttttcgattttgttttcgttgtgtttcgttgggatattcgttttcggggtttttcgcggtttaggagtcgtatttgtcgggtggagacgcggggttggtttggggtgcgggagtaggaggttttcggtttaatcgtttttaatttatttttgttttcgacgttttgttttcgcgtttaatgttttgttcgatttagtttcggttttttatttttttttttcgcgtttttacgtttttttttttttcggttttgtcgtgaatgtttttaagttttagagtatcggaatttttcgcgcgttttggtttttgggttttagtttcgtgtagttttggattgg

SEQ ID NO: 24982 - DNA, 573 bp, Artificial Sequence
  chemically treated genomic DNA (Homo sapiens) CpG-island No: 24982
ccaatccaaaactacacgaaactaaaacccaaaaaccaaaacgcgcgaaaaattccgatactctaaaacttaaaaacattcacgacaaaaccgaaaaaaaaaaaaacgtaaaaacgcgaaaaaaaaaaataaaaaaccgaaactaaatcgaacaaaacattaaacgcgaaaacaaaacgtcgaaaacaaaaataaattaaaaacgattaaaccgaaaacctcctactcccgcaccccaaaccaaccccgcgtctccacccgacaaatacgactcctaaaccgcgaaaaaccccgaaaacgaatatcccaacgaaacacaacgaaaacaaaatcgaaaaaattaaaatactaaaaataaaaaatcttcgatcccacgaccgaaactcgcctaatcataactctcaacctaaaaataacgccaaaaaatcgcccgaaactaaaaatacccaacgctcaacctaaataatcaccaacaccaacgtaactttaactcgcgaattcaaaaaaaaaataaacccgccccttccacgactaatcctatcaatctaccgaaaccccattccgctatcatcc

SEQ ID NO: 24983 - DNA, 573 bp, Artificial Sequence
  chemically treated genomic DNA (Homo sapiens) CpG-island No: 24983
ttagtttaggattgtacggagttggggtttaggagttaaggcgcgcggggagtttcggtgttttaggatttgggagtatttacggtagaatcggggaaggaaagagcgtggagacgcgggaaggggagatgggaggtcggaattggatcgggtagggtattaagcgcgggaatagaacgtcggaagtaggaatgggttggaggcggttggatcgaagattttttattttcgtattttagattagtttcgcgtttttattcggtaggtgcggtttttggatcgcggaagatttcggaggcggatattttaacgaggtatagcgagggtagggtcggggaggttagagtgttgagggtgggaggttttcggttttacggtcgaagttcgtttagttatggtttttagtttggaagtaacgttaagaaatcgttcgagattgggaatgtttagcgtttagtttggatgattattagtattaacgtggttttggttcgcgggtttaagagaaagatgggttcgttttttttacgattgattttgttagtttatcgaagttttatttcgttgttattt

SEQ ID NO: 24984 - DNA, 573 bp, Artificial Sequence
  chemically treated genomic DNA (Homo sapiens) CpG-island No: 24984
aaataacaacgaaataaaacttcgataaactaacaaaatcaatcgtaaaaaaaacgaacccatctttctcttaaacccgcgaaccaaaaccacgttaatactaataatcatccaaactaaacgctaaacattcccaatctcgaacgatttcttaacgttacttccaaactaaaaaccataactaaacgaacttcgaccgtaaaaccgaaaacctcccaccctcaacactctaacctccccgaccctaccctcgctatacctcgttaaaatatccgcctccgaaatcttccgcgatccaaaaaccgcacctaccgaataaaaacgcgaaactaatctaaaatacgaaaataaaaaatcttcgatccaaccgcctccaacccattcctacttccgacgttctattcccgcgcttaataccctacccgatccaattccgacctcccatctccccttcccgcgtctccacgctctttccttccccgattctaccgtaaatactcccaaatcctaaaacaccgaaactccccgcgcgccttaactcctaaaccccaactccgtacaatcctaaactaa

SEQ ID NO: 24985 - DNA, 644 bp, Artificial Sequence
  chemically treated genomic DNA (Homo sapiens) CpG-island No: 24985
tcgatttgcgtaagttggtcgttaatatggtttttttttttcgtttgtatttttttatgttcggtttcgtatttttgattagtcggggtagttagtagtatcgggttttgacggtgttcgagtttatttagtagatgttcgatgttaagaatatgatggcggcgtgcgattcgcgttacggtcgttatttgatcgtggtcgtcgtgtttcggggtcgtatgtttatgaaggaggtggacgagtagatgttgagcgtgtagagtaagaatagtagttatttcgtggagtggatttttaataacgtgaagacggtcgtgtgcgatatttcgtttcgcggtttgaagatggtcgcgatttttatcggtaatagtacggttatttaggagttgtttaagcgtattttcgagtagtttacggttatgtttcggcgtaaggtttttttgtattggtatacgggcgagggtatggacgagatggagtttatcgaggtcgagagtaatatgaatgatttggtatttgagtattagtagtattaggacgttacggtcgaggagggcgagttcgaggaggaggcggaggaggaggtggtttaggttgtttttatcgttttttatttgttttttcgaggtttttgatttttgatt

SEQ ID NO: 24986 - DNA, 644 bp, Artificial Sequence
  chemically treated genomic DNA (Homo sapiens) CpG-island No: 24986
aatcaaaaatcaaaaacctcgaaaaaacaaataaaaaacgataaaaacaacctaaaccacctcctcctccgcctcctcctcgaactcgccctcctcgaccgtaacgtcctaatactactaatactcaaataccaaatcattcatattactctcgacctcgataaactccatctcgtccataccctcgcccgtataccaatacaaaaaaaccttacgccgaaacataaccgtaaactactcgaaaatacgcttaaacaactcctaaataaccgtactattaccgataaaaatcgcgaccatcttcaaaccgcgaaacgaaatatcgcacacgaccgtcttcacgttattaaaaatccactccacgaaataactactattcttactctacacgctcaacatctactcgtccacctccttcataaacatacgaccccgaaacacgacgaccacgatcaaataacgaccgtaacgcgaatcgcacgccgccatcatattcttaacatcgaacatctactaaataaactcgaacaccgtcaaaacccgatactactaactaccccgactaatcaaaaatacgaaaccgaacataaaaaaatacaaacgaaaaaaaaaaaccatattaacgaccaacttacgcaaatcga

SEQ ID NO: 24987 - DNA, 644 bp, Artificial Sequence
  chemically treated genomic DNA (Homo sapiens) CpG-island No: 24987
gattaaaggttagaagtttcgaggggataggtgggaagcgatgggagtagtttaggttattttttttttcgtttttttttcgaattcgtttttttcggtcgtggcgttttggtattgttggtatttagatattaggttatttatgttgttttcggtttcggtgaattttatttcgtttatgttttcgttcgtgtattagtgtaagaaggttttgcgtcggaatatggtcgtgaattgttcggagatgcgtttgaatagtttttggatggtcgtgttgttgtcgatgaaggtcgcggttatttttaggtcgcggggcgggatgtcgtatacggtcgtttttacgttgttggggatttattttacgaagtagttgttgtttttgttttgtacgtttagtatttgttcgtttattttttttatggatatgcggtttcggaatacggcggttacggttaggtagcggtcgtggcgcgggtcgtacgtcgttattatgtttttggtatcgaatatttgttgggtgagttcgggtatcgttagggttcggtattgttggttgtttcggttggttaggggtgcgaagtcgggtatgaagaagtgtaggcgaggaaagggaattatgttgacggttagtttgcgtaggtcgg

SEQ ID NO: 24988 - DNA, 644 bp, Artificial Sequence
  chemically treated genomic DNA (Homo sapiens) CpG-island No: 24988
ccgacctacgcaaactaaccgtcaacataattccctttcctcgcctacacttcttcatacccgacttcgcacccctaaccaaccgaaacaaccaacaataccgaaccctaacgatacccgaactcacccaacaaatattcgataccaaaaacataataacgacgtacgacccgcgccacgaccgctacctaaccgtaaccgccgtattccgaaaccgcatatccataaaaaaaataaacgaacaaatactaaacgtacaaaacaaaaacaacaactacttcgtaaaataaatccccaacaacgtaaaaacgaccgtatacgacatcccgccccgcgacctaaaaataaccgcgaccttcatcgacaacaacacgaccatccaaaaactattcaaacgcatctccgaacaattcacgaccatattccgacgcaaaaccttcttacactaatacacgaacgaaaacataaacgaaataaaattcaccgaaaccgaaaacaacataaataacctaatatctaaataccaacaataccaaaacgccacgaccgaaaaaaacgaattcgaaaaaaaaacgaaaaaaaaaataacctaaactactcccatcgcttcccacctatcccctcgaaacttctaacctttaatc

SEQ ID NO: 24989 - DNA, 563 bp, Artificial Sequence
  chemically treated genomic DNA (Homo sapiens) CpG-island No: 24989
tttttagacgtacgtaagaatcgtgtattatttcgttcgttttttgttcgttcgcgttttatatttttttcgttcggtcgtagaaatagaagatttaggagcgatgtttttttattgtttttttttttcgttcgcgcgttttttttttcggtttttattttgattgggaaatagaaaattaacgcgcggcgcggttgtaaagtcggttttttattggttagcgttttttgggttgagttcgttcgtttcgtttttttttttatttaggcggggttttttcgtagattttcgattgtttttagttcgtagttttatcgtttgttaggagattttaaaggggtcgcggtcgtaattagacgttgagcggcgtggggagggggtggtttagtgattcgggcgcggggttgaggattttagtggtcgagcgttggaggtagggttttagtttgtcgtattcgttgtatttgcggaatgtttttattgttagtttcgggcgtagtttttcgatttattattagggggaagggagtttagattatttgatagcgaatattcgataataa

SEQ ID NO: 24990 - DNA, 563 bp, Artificial Sequence
  chemically treated genomic DNA (Homo sapiens) CpG-island No: 24990
ttattatcgaatattcgctatcaaataatctaaactcccttccccctaataataaatcgaaaaactacgcccgaaactaacaataaaaacattccgcaaatacaacgaatacgacaaactaaaaccctacctccaacgctcgaccactaaaatcctcaaccccgcgcccgaatcactaaaccaccccctccccacgccgctcaacgtctaattacgaccgcgacccctttaaaatctcctaacaaacgataaaactacgaactaaaaacaatcgaaaatctacgaaaaaaccccgcctaaataaaaaaaaaaacgaaacgaacgaactcaacccaaaaaacgctaaccaataaaaaaccgactttacaaccgcgccgcgcgttaattttctatttcccaatcaaaataaaaaccgaaaaaaaaaacgcgcgaacgaaaaaaaaaaacaataaaaaaacatcgctcctaaatcttctatttctacgaccgaacgaaaaaaatataaaacgcgaacgaacaaaaaacgaacgaaataatacacgattcttacgtacgtctaaaaa

SEQ ID NO: 24991 - DNA, 563 bp, Artificial Sequence
  chemically treated genomic DNA (Homo sapiens) CpG-island No: 24991
ttgttatcgagtattcgttgttaagtggtttgggtttttttttttttaatggtggatcgagaaattgcgttcgaaattagtagtagggatatttcgtaggtgtagcgagtgcgataggttggggttttgtttttagcgttcgattattgggatttttaatttcgcgttcgggttattgagttattttttttttacgtcgtttagcgtttgattgcggtcgcggtttttttaagattttttggtaggcggtgggattgcgggttggaggtagtcgggggtttgcggggaggtttcgtttaggtgggagaagaggcggggcgggcgggtttagtttaggaggcgttgattaataggaaatcgattttgtagtcgcgtcgcgcgttgattttttgttttttagttagagtgggaatcgagaaaggaagcgcgcgggcgggaagaagggatagtgggagagtatcgtttttggattttttgtttttgcggtcgagcggggaaggtgtaaggcgcgggcgggtagagagcgagcgagatggtgtacggtttttgcgtgcgtttgggaa

SEQ ID NO: 24992 - DNA, 563 bp, Artificial Sequence
  chemically treated genomic DNA (Homo sapiens) CpG-island No: 24992
ttcccaaacgcacgcaaaaaccgtacaccatctcgctcgctctctacccgcccgcgccttacaccttccccgctcgaccgcaaaaacaaaaaatccaaaaacgatactctcccactatcccttcttcccgcccgcgcgcttcctttctcgattcccactctaactaaaaaacaaaaaatcaacgcgcgacgcgactacaaaatcgatttcctattaatcaacgcctcctaaactaaacccgcccgccccgcctcttctcccacctaaacgaaacctccccgcaaacccccgactacctccaacccgcaatcccaccgcctaccaaaaaatcttaaaaaaaccgcgaccgcaatcaaacgctaaacgacgtaaaaaaaaaataactcaataacccgaacgcgaaattaaaaatcccaataatcgaacgctaaaaacaaaaccccaacctatcgcactcgctacacctacgaaatatccctactactaatttcgaacgcaatttctcgatccaccattaaaaaaaaaaaaacccaaaccacttaacaacgaatactcgataacaa

SEQ ID NO: 24993 - DNA, 511 bp, Artificial Sequence
  chemically treated genomic DNA (Homo sapiens) CpG-island No: 24993
tatatttgcgcgttttcgcggttttttttttcgtatttttattaagggattggggtttcgttataggtgcgtttatagcgcggtttcgttttttttttgatttcgtttttttagcgaggtttaggtgtataagtcggaagtgcgtttttttaggtgagtgattaaatttttcgggttacgtgatagggcggagtcggtggggtcggatttatagaacgatcgacggatcgagggttcgagggagggatacggattaggaatttgagttaggttaaagacgttcgggttaggtaggaaggtaggacgtatcgttaggtttgttttttcgttcgtttattttgttcgtttcgtttcgtttcgtttcgttttttttttttttttagtttaggaacgcgtttttgggagttaatttttaatcgttgatttttggcggttggggcggggcgggatttatgggtgttttggcgttagttgttttttttgtgggtttgcgtcggggtttttatttcga

SEQ ID NO: 24994 - DNA, 511 bp, Artificial Sequence
  chemically treated genomic DNA (Homo sapiens) CpG-island No: 24994
tcgaaataaaaaccccgacgcaaacccacaaaaaaaacaactaacgccaaaacacccataaatcccgccccgccccaaccgccaaaaatcaacgattaaaaattaactcccaaaaacgcgttcctaaactaaaaaaaaaaaaaaaacgaaacgaaacgaaacgaaacgaacaaaataaacgaacgaaaaaacaaacctaacgatacgtcctaccttcctacctaacccgaacgtctttaacctaactcaaattcctaatccgtatccctccctcgaaccctcgatccgtcgatcgttctataaatccgaccccaccgactccgccctatcacgtaacccgaaaaatttaatcactcacctaaaaaaacgcacttccgacttatacacctaaacctcgctaaaaaaacgaaatcaaaaaaaaaacgaaaccgcgctataaacgcacctataacgaaaccccaatcccttaataaaaatacgaaaaaaaaaaccgcgaaaacgcgcaaatata

SEQ ID NO: 24995 - DNA, 511 bp, Artificial Sequence
  chemically treated genomic DNA (Homo sapiens) CpG-island No: 24995
tcggggtggggatttcggcgtaggtttataggagagataattggcgttagggtatttatgagtttcgtttcgttttagtcgttagaggttagcgattaaagattaatttttaggagcgcgtttttgggttggggaaaggaaggggacgggacgggacgggacgggacgggtagggtggacgggcgagggggtaggtttagcggtgcgttttgtttttttatttggttcgggcgtttttgatttagtttaggtttttggttcgtgtttttttttcgaattttcggttcgtcggtcgttttgtgggttcgattttatcggtttcgttttgttacgtgattcggaaagtttagttatttatttgggagagcgtattttcggtttgtgtatttgagtttcgttgagagggcggagttaagaagggggcggggtcgcgttgtgggcgtatttgtaacgggattttagttttttaatggggatgcggggagggagatcgcggaagcgcgtaggtgtg

SEQ ID NO: 24996 - DNA, 511 bp, Artificial Sequence
  chemically treated genomic DNA (Homo sapiens) CpG-island No: 24996
cacacctacgcgcttccgcgatctccctccccgcatccccattaaaaaactaaaatcccgttacaaatacgcccacaacgcgaccccgcccccttcttaactccgccctctcaacgaaactcaaatacacaaaccgaaaatacgctctcccaaataaataactaaactttccgaatcacgtaacaaaacgaaaccgataaaatcgaacccacaaaacgaccgacgaaccgaaaattcgaaaaaaaaacacgaaccaaaaacctaaactaaatcaaaaacgcccgaaccaaataaaaaaacaaaacgcaccgctaaacctaccccctcgcccgtccaccctacccgtcccgtcccgtcccgtcccgtccccttcctttccccaacccaaaaacgcgctcctaaaaattaatctttaatcgctaacctctaacgactaaaacgaaacgaaactcataaataccctaacgccaattatctctcctataaacctacgccgaaatccccaccccga

SEQ ID NO: 24997 - DNA, 540 bp, Artificial Sequence
  chemically treated genomic DNA (Homo sapiens) CpG-island No: 24997
  misc_feature (125)..(125): n is either a, c, g or t
  misc_feature (176)..(176): n is either a, c, g or t
ggagggtcgagattggtagggaatggaatcgatttatcggttttttatatgtgttagcggtgacgacgcgatttttcgaagttggtatcggtacgtgtggtattttattcgaattcgttgagtgnttcgtttcgaggagaggcgagaatacgaagtagtatagggagacgcgatanggagtaatttttttgcgtggtgatagaggttaggattattaatatgaaaggtagtaggcgaagagacgtcgaggttcgagtggaaggtggtcgtcgtggcgtaattcgtttggataatgtatttaagtggatttgtgattttgaggggcgcgacgggcggagttaatcgatggagaggtatgcgtacgtgttcgttgtgttttggatttttttcgtaacgtttagtttgtggtaggaatatttattgttcgattcgagtcgatgtaggtgaggattaagggtgttacgtacgagttatttaggttttacgtgtttttttttttattttttacgagagaggttttgcgataaagattattttaaa

SEQ ID NO: 24998 - DNA, 540 bp, Artificial Sequence
  chemically treated genomic DNA (Homo sapiens) CpG-island No: 24998
  misc_feature (365)..(365): n is either a, c, g or t
  misc_feature (416)..(416): n is either a, c, g or t
tttaaaataatctttatcgcaaaacctctctcgtaaaaaataaaaaaaaaaacacgtaaaacctaaataactcgtacgtaacacccttaatcctcacctacatcgactcgaatcgaacaataaatattcctaccacaaactaaacgttacgaaaaaaatccaaaacacaacgaacacgtacgcatacctctccatcgattaactccgcccgtcgcgcccctcaaaatcacaaatccacttaaatacattatccaaacgaattacgccacgacgaccaccttccactcgaacctcgacgtctcttcgcctactacctttcatattaataatcctaacctctatcaccacgcaaaaaaattactccntatcgcgtctccctatactacttcgtattctcgcctctcctcgaaacgaancactcaacgaattcgaataaaataccacacgtaccgataccaacttcgaaaaatcgcgtcgtcaccgctaacacatataaaaaaccgataaatcgattccattccctaccaatctcgaccctcc

SEQ ID NO: 24999 - DNA, 540 bp, Artificial Sequence
  chemically treated genomic DNA (Homo sapiens) CpG-island No: 24999
  misc_feature (365)..(365): n is either a, c, g or t
  misc_feature (416)..(416): n is either a, c, g or t
tttggaatgatttttgtcgtagaatttttttcgtaaagaatgggaggggaagtacgtgagatttagatgattcgtgcgtagtatttttagtttttatttatatcgattcgagtcggataatggatatttttattataaattagacgttgcggaggggatttaaggtatagcgagtacgtgcgtatgtttttttatcggttgatttcgttcgtcgcgttttttaaagttataggtttatttgggtgtattgtttaagcggattgcgttacgacgattattttttattcgagtttcggcgttttttcgtttattgttttttatgttgatgattttggtttttattattacgtagaagggttattttntgtcgcgtttttttatattatttcgtgttttcgttttttttcgaggcgagntatttagcgagttcgagtggagtgttatacgtgtcgatgttaatttcggagggtcgcgtcgttatcgttggtatatgtgagaggtcgatggatcgattttattttttattagtttcgatttttt

SEQ ID NO: 25000 - DNA, 540 bp, Artificial Sequence
  chemically treated genomic DNA (Homo sapiens) CpG-island No: 25000
  misc_feature (125)..(125): n is either a, c, g or t
  misc_feature (176)..(176): n is either a, c, g or t
aaaaaatcgaaactaataaaaaataaaatcgatccatcgacctctcacatataccaacgataacgacgcgaccctccgaaattaacatcgacacgtataacactccactcgaactcgctaaatanctcgcctcgaaaaaaaacgaaaacacgaaataatataaaaaaacgcgacanaaaataacccttctacgtaataataaaaaccaaaatcatcaacataaaaaacaataaacgaaaaaacgccgaaactcgaataaaaaataatcgtcgtaacgcaatccgcttaaacaatacacccaaataaacctataactttaaaaaacgcgacgaacgaaatcaaccgataaaaaaacatacgcacgtactcgctataccttaaatcccctccgcaacgtctaatttataataaaaatatccattatccgactcgaatcgatataaataaaaactaaaaatactacgcacgaatcatctaaatctcacgtacttcccctcccattctttacgaaaaaaattctacgacaaaaatcattccaaa

SEQ ID NO: 25001 - DNA, 753 bp, Artificial Sequence
  chemically treated genomic DNA (Homo sapiens) CpG-island No: 25001
ttcgttacgggtacgtagtcgcgtcgtaatattttgcgttagcgtatcgttaagggaatattttagtaggtaataagggttatgcggttgttgtttaagtaacgttgttagatgcgtttcgtagattttatttaggtttgtcgtcgtttgtatggggttattggggcgcggtgattgaatgtcgataatcgattattgtggatcgagataacgcgagagtacgttgaattgttaggtaaaatcggacgtaggatggaaataaaatagcgtcgggttattatttttacgtaacggtagaatggtttcgaattttatacgtcgggtgttgttttttttagtattaataatcgttgttagtttggcgatagttgacgcgattattatttgtttcggcgtatattgtcggcgtaattgtcgaattaattgcgttgttagtttattgttagtagcgaatgacgttatcgaaagaaatagattagcggatcgttagagttgatgaagtagcgtcgaaggttgcgtatgtgttggaagcgggtattcgcgagtcgatgattatgcgggttaattaggcgttgtatgcgtaattatattttataaaagaatttattttttggcgttaggttgacggcggatatgatgcgttttgttggcgcggtggtttgatgtaggggttaatcgatttttggtaattatttttttatgataggagttgaatatggtatttagtaattttttcgatgattcgtagggagt

SEQ ID NO: 25002 - DNA, 753 bp, Artificial Sequence
  chemically treated genomic DNA (Homo sapiens) CpG-island No: 25002
actccctacgaatcatcgaaaaaattactaaataccatattcaactcctatcataaaaaaataattaccaaaaatcgattaacccctacatcaaaccaccgcgccaacaaaacgcatcatatccgccgtcaacctaacgccaaaaaataaattcttttataaaatataattacgcatacaacgcctaattaacccgcataatcatcgactcgcgaatacccgcttccaacacatacgcaaccttcgacgctacttcatcaactctaacgatccgctaatctatttctttcgataacgtcattcgctactaacaataaactaacaacgcaattaattcgacaattacgccgacaatatacgccgaaacaaataataatcgcgtcaactatcgccaaactaacaacgattattaatactaaaaaaaacaacacccgacgtataaaattcgaaaccattctaccgttacgtaaaaataataacccgacgctattttatttccatcctacgtccgattttacctaacaattcaacgtactctcgcgttatctcgatccacaataatcgattatcgacattcaatcaccgcgccccaataaccccatacaaacgacgacaaacctaaataaaatctacgaaacgcatctaacaacgttacttaaacaacaaccgcataacccttattacctactaaaatattcccttaacgatacgctaacgcaaaatattacgacgcgactacgtacccgtaacgaa

SEQ ID NO: 25003 - DNA, 753 bp, Artificial Sequence
  chemically treated genomic DNA (Homo sapiens) CpG-island No: 25003
gttttttgcggattatcgaagggattattgaatgttatatttaatttttgttatggaaaagtggttgttagaggtcgattagtttttgtattaagttatcgcgttaataaagcgtattatgttcgtcgttaatttgacgttagaaaatggatttttttatggggtgtaattgcgtatatagcgtttgattggttcgtatgattatcggttcgcgaatattcgtttttagtatatgcgtaattttcggcgttattttattagttttggcggttcgttagtttatttttttcggtggcgttattcgttattggtaatgaattggtagcgtagttaattcggtagttgcgtcggtagtgtacgtcggggtaagtgatggtcgcgttaattgtcgttaaattggtaacgattattgatgttgaagaagatagtattcggcgtatgggattcgaaattattttgtcgttgcgtgaaggtaatggttcgacgttgttttgtttttattttgcgttcggttttgtttggtagtttagcgtgttttcgcgttatttcgatttataatggtcgattatcggtatttagttatcgcgttttaatggttttatgtagacggcggtaaatttggatgaagtttgcgaagcgtatttggtaacgttatttgaataataatcgtatggtttttattatttgttggggtatttttttggcggtacgttggcgtagggtattgcggcgcgattgcgtgttcgtggcgaa

SEQ ID NO: 25004 - DNA, 753 bp, Artificial Sequence
  chemically treated genomic DNA (Homo sapiens) CpG-island No: 25004
ttcgccacgaacacgcaatcgcgccgcaataccctacgccaacgtaccgccaaaaaaataccccaacaaataataaaaaccatacgattattattcaaataacgttaccaaatacgcttcgcaaacttcatccaaatttaccgccgtctacataaaaccattaaaacgcgataactaaataccgataatcgaccattataaatcgaaataacgcgaaaacacgctaaactaccaaacaaaaccgaacgcaaaataaaaacaaaacaacgtcgaaccattaccttcacgcaacgacaaaataatttcgaatcccatacgccgaatactatcttcttcaacatcaataatcgttaccaatttaacgacaattaacgcgaccatcacttaccccgacgtacactaccgacgcaactaccgaattaactacgctaccaattcattaccaataacgaataacgccaccgaaaaaaataaactaacgaaccgccaaaactaataaaataacgccgaaaattacgcatatactaaaaacgaatattcgcgaaccgataatcatacgaaccaatcaaacgctatatacgcaattacaccccataaaaaaatccattttctaacgtcaaattaacgacgaacataatacgctttattaacgcgataacttaatacaaaaactaatcgacctctaacaaccacttttccataacaaaaattaaatataacattcaataatcccttcgataatccgcaaaaaac

SEQ ID NO: 25005 - DNA, 579 bp, Artificial Sequence
  chemically treated genomic DNA (Homo sapiens) CpG-island No: 25005
cgattttcggtttgtacgtcggttttcgtcgtagtcgtcgttttttacgatcgtttcggttatgacgtattttatggtcggttcgggtttggttattttgtcgttgcgtaggtttattacgtaggttgcgattttcgcgtttttatatttcgttcggagcgttttatgtatcggggtcgtcgttcgggttagtttgcggagtatggcgcgggtagcgttcgattttttatttcggcgggagttgttgatttttttattttttagcgaaggcggcgagagcgacgtggtcggtgcggttagaatttttagagttgggaagtagtcgttttgggtcgggggtttagggagcgagtttcgtggtacgttgggagttgtagttcgcgttttttcgcggcgggcgtgcgcgagcgtttgcgaacgggtttcgtggtacgttgggagttgtagtacgggttgcgtcgcggcggagaattagcgagttcgtgatgttgaagtagaaggttttgtttattgaaggagaaatcgaggtcgagcgagtgtgtgtgtgtgtgtgtgtgtgtgtgtgtgtgtgtgtgtgtg

SEQ ID NO: 25006 - DNA, 579 bp, Artificial Sequence
  chemically treated genomic DNA (Homo sapiens) CpG-island No: 25006
cacacacacacacacacacacacacacacacacacacacacactcgctcgacctcgatttctccttcaataaacaaaaccttctacttcaacatcacgaactcgctaattctccgccgcgacgcaacccgtactacaactcccaacgtaccacgaaacccgttcgcaaacgctcgcgcacgcccgccgcgaaaaaacgcgaactacaactcccaacgtaccacgaaactcgctccctaaacccccgacccaaaacgactacttcccaactctaaaaattctaaccgcaccgaccacgtcgctctcgccgccttcgctaaaaaataaaaaaatcaacaactcccgccgaaataaaaaatcgaacgctacccgcgccatactccgcaaactaacccgaacgacgaccccgatacataaaacgctccgaacgaaatataaaaacgcgaaaatcgcaacctacgtaataaacctacgcaacgacaaaataaccaaacccgaaccgaccataaaatacgtcataaccgaaacgatcgtaaaaaacgacgactacgacgaaaaccgacgtacaaaccgaaaatcg

SEQ ID NO: 25007 - DNA, 579 bp, Artificial Sequence
  chemically treated genomic DNA (Homo sapiens) CpG-island No: 25007
tatatatatatatatatatatatatatatatatatatatatattcgttcggtttcggttttttttttaatgagtagaattttttgttttagtattacgggttcgttggtttttcgtcgcgacgtagttcgtattataatttttagcgtgttacggggttcgttcgtagacgttcgcgtacgttcgtcgcgagggagcgcgaattataatttttagcgtgttacggggttcgttttttggattttcggtttagggcggttgttttttagttttaggaattttggtcgtatcgattacgtcgttttcgtcgttttcgttggggagtagaggagttagtagttttcgtcggggtggggagtcgggcgttgttcgcgttatgtttcgtagattggttcgagcggcggtttcggtatatggggcgtttcgggcggggtgtgggagcgcgggggtcgtagtttacgtggtgggtttgcgtagcgataaggtgattaggttcgggtcggttatgaggtgcgttatggtcgaggcggtcgtgggggacgacgattacggcgaagatcggcgtgtaggtcgggggtcg

SEQ ID NO: 25008 - DNA, 579 bp, Artificial Sequence
  chemically treated genomic DNA (Homo sapiens) CpG-island No: 25008
cgacccccgacctacacgccgatcttcgccgtaatcgtcgtcccccacgaccgcctcgaccataacgcacctcataaccgacccgaacctaatcaccttatcgctacgcaaacccaccacgtaaactacgacccccgcgctcccacaccccgcccgaaacgccccatataccgaaaccgccgctcgaaccaatctacgaaacataacgcgaacaacgcccgactccccaccccgacgaaaactactaactcctctactccccaacgaaaacgacgaaaacgacgtaatcgatacgaccaaaattcctaaaactaaaaaacaaccgccctaaaccgaaaatccaaaaaacgaaccccgtaacacgctaaaaattataattcgcgctccctcgcgacgaacgtacgcgaacgtctacgaacgaaccccgtaacacgctaaaaattataatacgaactacgtcgcgacgaaaaaccaacgaacccgtaatactaaaacaaaaaattctactcattaaaaaaaaaaccgaaaccgaacgaatatatatatatatatatatatatatatatatatatatatata

SEQ ID NO: 25009 - DNA, 508 bp, Artificial Sequence
  chemically treated genomic DNA (Homo sapiens) CpG-island No: 25009
gtgttgcggtcggcgtggttcggagattagttttttaatttcgaggtggggtggattcgggtgtttcgcggttatagttttttttcgtttttagaagcgtagtttcgcggttcgttcgtcgttcgcgagggtcgtattttgttttcggtttttagcggcgtttggttacgttttcggcgggtggagtcgggcggggcgtcgggtaggtttttttgcgtttcgcggcggcggtagcggcggcgacggcgatatggagagcggggtttacggcgcggttaaggcgggcggttttttcgatttgcggcgttttttgacgtagtcgtaggtggtggcgcgcgtcgtgtgtttggtgagttcggggagggcgggtcgagggtattttggggatttttttttcgtcgttaggttcggcgggggttttaggttacgagcgtttggaattgttgttggttttatttattgttgaattcggggggtggtttgttttttgtgttttgtggtgtttgtt

SEQ ID NO: 25010 - DNA, 508 bp, Artificial Sequence
  chemically treated genomic DNA (Homo sapiens) CpG-island No: 25010
aacaaacaccacaaaacacaaaaaacaaaccaccccccgaattcaacaataaataaaaccaacaacaattccaaacgctcgtaacctaaaacccccgccgaacctaacgacgaaaaaaaaatccccaaaataccctcgacccgccctccccgaactcaccaaacacacgacgcgcgccaccacctacgactacgtcaaaaaacgccgcaaatcgaaaaaaccgcccgccttaaccgcgccgtaaaccccgctctccatatcgccgtcgccgccgctaccgccgccgcgaaacgcaaaaaaacctacccgacgccccgcccgactccacccgccgaaaacgtaaccaaacgccgctaaaaaccgaaaacaaaatacgaccctcgcgaacgacgaacgaaccgcgaaactacgcttctaaaaacgaaaaaaaactataaccgcgaaacacccgaatccaccccacctcgaaattaaaaaactaatctccgaaccacgccgaccgcaacac

SEQ ID NO: 25011 - DNA, 508 bp, Artificial Sequence
  chemically treated genomic DNA (Homo sapiens) CpG-island No: 25011
aataaatattataaaatataaggaataaattatttttcgaatttaataataagtggagttaatagtaattttaagcgttcgtggtttagggttttcgtcgggtttggcgacggagagggggtttttagggtgttttcggttcgtttttttcgggtttattaagtatacggcgcgcgttattatttgcggttgcgttaggaagcgtcgtaggtcgaaggagtcgttcgttttggtcgcgtcgtaggtttcgttttttatgtcgtcgtcgtcgtcgttgtcgtcgtcgcggaacgtagaggaatttgttcggcgtttcgttcgattttattcgtcgggggcgtggttaggcgtcgttagggatcgagggtaaagtgcggttttcgcgagcggcgggcgagtcgcgggattgcgtttttagaggcggggaggggttgtggtcgcggagtattcgggtttattttatttcggggttgaggggttagttttcgggttacgtcggtcgtagtat

SEQ ID NO: 25012 - DNA, 508 bp, Artificial Sequence
  chemically treated genomic DNA (Homo sapiens) CpG-island No: 25012
atactacgaccgacgtaacccgaaaactaacccctcaaccccgaaataaaataaacccgaatactccgcgaccacaacccctccccgcctctaaaaacgcaatcccgcgactcgcccgccgctcgcgaaaaccgcactttaccctcgatccctaacgacgcctaaccacgcccccgacgaataaaatcgaacgaaacgccgaacaaattcctctacgttccgcgacgacgacaacgacgacgacgacgacataaaaaacgaaacctacgacgcgaccaaaacgaacgactccttcgacctacgacgcttcctaacgcaaccgcaaataataacgcgcgccgtatacttaataaacccgaaaaaaacgaaccgaaaacaccctaaaaaccccctctccgtcgccaaacccgacgaaaaccctaaaccacgaacgcttaaaattactattaactccacttattattaaattcgaaaaataatttattccttatattttataatatttatt

SEQ ID NO: 25013 - DNA, 943 bp, Artificial Sequence
  chemically treated genomic DNA (Homo sapiens) CpG-island No: 25013
cgattgatgcgggtattatttggtgggagggcgatttgttttaggtaagtcggattggaaaaagttgtataattattcgtagtcgcgtttgatcgtcgaagagtaagcgtttttcgacggttcggtagaagaagtttgtcggatggcgaatgatttttagattatttatgagttggcggatttgtcgtcggagttgtgggcgtattttaaagagtatcgttttttcgcgatgattattaaaaaagagtacggcgggttggagttttcggtttatgtttagtttcgcgtgttgtaaaaatttttcggcgtgagcgggattttggcgattatcgtcggcgtgttaaatttattaggttcgggcgaattgttgtaatattacggtattgacgagtagaaagattattatttgtcgcgtttggcgcgtggttaggagattttttgttttgtattgattagttcggaagcgggtttcgatgcgggcgcgatttcggatatcgggattgtttgtatgggcgaatggtagggttagtaggtgttggggatgcgtttgatttggaataaacgttatattacgttggtatcgattgcgatcgtgtttgggttggcgtttaaatttttcgattcggaaaaattattcggcggtgtagaagatttaggtattatttgtgcgttgattttaattattacgtcgggcgtggaaattggtcgtcgttatttttcgttgaacgtatcgttttagaacggatcgacgcgcggtaaagatgttttcgtgtcgatcgattatattatcggcgggtcgaaaatggtcgggtaaggttggcggatgttggtggagtgtttttcggtaggtttagttagaagttgcgaattttgttgttatcgacgtgatcgatatgtttgaataatagtttatcgaacgcgttgacgttattgtttttcgtcg

SEQ ID NO: 25014 - DNA, 943 bp, Artificial Sequence
  chemically treated genomic DNA (Homo sapiens) CpG-island No: 25014
cgacgaaaaacaataacgtcaacgcgttcgataaactattattcaaacatatcgatcacgtcgataacaacaaaattcgcaacttctaactaaacctaccgaaaaacactccaccaacatccgccaaccttacccgaccattttcgacccgccgataatataatcgatcgacacgaaaacatctttaccgcgcgtcgatccgttctaaaacgatacgttcaacgaaaaataacgacgaccaatttccacgcccgacgtaataattaaaatcaacgcacaaataatacctaaatcttctacaccgccgaataatttttccgaatcgaaaaatttaaacgccaacccaaacacgatcgcaatcgataccaacgtaatataacgtttattccaaatcaaacgcatccccaacacctactaaccctaccattcgcccatacaaacaatcccgatatccgaaatcgcgcccgcatcgaaacccgcttccgaactaatcaatacaaaacaaaaaatctcctaaccacgcgccaaacgcgacaaataataatctttctactcgtcaataccgtaatattacaacaattcgcccgaacctaataaatttaacacgccgacgataatcgccaaaatcccgctcacgccgaaaaatttttacaacacgcgaaactaaacataaaccgaaaactccaacccgccgtactcttttttaataatcatcgcgaaaaaacgatactctttaaaatacgcccacaactccgacgacaaatccgccaactcataaataatctaaaaatcattcgccatccgacaaacttcttctaccgaaccgtcgaaaaacgcttactcttcgacgatcaaacgcgactacgaataattatacaactttttccaatccgacttacctaaaacaaatcgccctcccaccaaataatacccgcatcaatcg

SEQ ID NO: 25015 - DNA, 943 bp, Artificial Sequence
  chemically treated genomic DNA (Homo sapiens) CpG-island No: 25015
cggcgaagaataatgacgttaacgcgttcgataaattgttgtttaaatatatcggttacgtcggtagtaataaagttcgtagtttttggttgggtttatcgagaggtattttattagtattcgttagttttgttcggttattttcggttcgtcgatgatgtaatcgatcggtacgaagatatttttatcgcgcgtcggttcgttttggaacggtacgtttagcgggaagtggcgacgattaatttttacgttcggcgtggtggttgggattagcgtataggtaatgtttaaattttttgtatcgtcgagtaattttttcgggtcggagagtttaaacgttagtttaagtacggtcgtaatcggtgttagcgtaatgtagcgtttgttttaggttagacgtatttttagtatttgttggttttgttattcgtttatgtagataatttcggtgttcggaatcgcgttcgtatcggaattcgttttcgggttggttagtgtaaagtaggggattttttgattacgcgttagacgcggtagatagtgatttttttgttcgttagtgtcgtaatgttgtaatagttcgttcgggtttaatgagtttggtacgtcgacggtaatcgttaggatttcgtttacgtcggagagtttttgtagtacgcgagattgggtataagtcgagaattttagttcgtcgtatttttttttgatgattatcgcgaagaaacgatgttttttaaggtacgtttataatttcggcggtagattcgttagtttatgggtgatttggaaattattcgttattcggtaggttttttttatcgggtcgtcgagaaacgtttgtttttcggcggttaggcgcggttgcggatagttatgtagttttttttagttcggtttgtttggaataagtcgtttttttattaggtggtgttcgtattaatcg

SEQ ID NO: 25016 - DNA, 943 bp, Artificial Sequence
  chemically treated genomic DNA (Homo sapiens) CpG-island No: 25016
cgattaatacgaacaccacctaataaaaaaacgacttattccaaacaaaccgaactaaaaaaaactacataactatccgcaaccgcgcctaaccgccgaaaaacaaacgtttctcgacgacccgataaaaaaaacctaccgaataacgaataatttccaaatcacccataaactaacgaatctaccgccgaaattataaacgtaccttaaaaaacatcgtttcttcgcgataatcatcaaaaaaaaatacgacgaactaaaattctcgacttatacccaatctcgcgtactacaaaaactctccgacgtaaacgaaatcctaacgattaccgtcgacgtaccaaactcattaaacccgaacgaactattacaacattacgacactaacgaacaaaaaaatcactatctaccgcgtctaacgcgtaatcaaaaaatcccctactttacactaaccaacccgaaaacgaattccgatacgaacgcgattccgaacaccgaaattatctacataaacgaataacaaaaccaacaaatactaaaaatacgtctaacctaaaacaaacgctacattacgctaacaccgattacgaccgtacttaaactaacgtttaaactctccgacccgaaaaaattactcgacgatacaaaaaatttaaacattacctatacgctaatcccaaccaccacgccgaacgtaaaaattaatcgtcgccacttcccgctaaacgtaccgttccaaaacgaaccgacgcgcgataaaaatatcttcgtaccgatcgattacatcatcgacgaaccgaaaataaccgaacaaaactaacgaatactaataaaatacctctcgataaacccaaccaaaaactacgaactttattactaccgacgtaaccgatatatttaaacaacaatttatcgaacgcgttaacgtcattattcttcgccg

SEQ ID NO: 25017 - DNA, 679 bp, Artificial Sequence
  chemically treated genomic DNA (Homo sapiens) CpG-island No: 25017
atgtcgttaacgtggttaacgattagcggaatttcggttttttttgtcgtttttagtagattttttgttagacgtgttgttagtttatttagcgtttcgtgaacgttcggttgcgcgattttatttagataggcgaaattcgttgttatcgtaatcgggttatcggaaagcgtattcgtttgatagatcggattcgtcggggttagcgtatttattatattacgacgattatcgaatgcgtttatcggtattttatcgtcgatgattttgtcgaggtaggttaaatttggtattacgtcgtaataattttgtgcgttagttagcgttacgcggaaatcggttattattttatcgatgattagtaacgcgttaaattcgtcgatagcgcgcgcggttacggaaatcgtggaggtttttagtttgtcgattattacgttagtcgtcgtattggtaaagaagtaggttttttttagcgaattattcgttgttagcgttgtcgttaggacgttaattatcgtgtcgttcgtatcggtaacgttatatattttaggcgatagggtgcgttgttttagcgtttgggtagcggtggtaattttttttattgaaggttttattcgtataaaggaaaagcgattattatatcgacgcgtatataaagtttgtcgatttaattggcgat

SEQ ID NO: 25018 - DNA, 679 bp, Artificial Sequence
  chemically treated genomic DNA (Homo sapiens) CpG-island No: 25018
atcgccaattaaatcgacaaactttatatacgcgtcgatataataatcgcttttcctttatacgaataaaaccttcaataaaaaaaattaccaccgctacccaaacgctaaaacaacgcaccctatcgcctaaaatatataacgttaccgatacgaacgacacgataattaacgtcctaacgacaacgctaacaacgaataattcgctaaaaaaaacctacttctttaccaatacgacgactaacgtaataatcgacaaactaaaaacctccacgatttccgtaaccgcgcgcgctatcgacgaatttaacgcgttactaatcatcgataaaataataaccgatttccgcgtaacgctaactaacgcacaaaattattacgacgtaataccaaatttaacctacctcgacaaaatcatcgacgataaaataccgataaacgcattcgataatcgtcgtaatataataaatacgctaaccccgacgaatccgatctatcaaacgaatacgctttccgataacccgattacgataacaacgaatttcgcctatctaaataaaatcgcgcaaccgaacgttcacgaaacgctaaataaactaacaacacgtctaacaaaaaatctactaaaaacgacaaaaaaaaccgaaattccgctaatcgttaaccacgttaacgacat

SEQ ID NO: 25019 - DNA, 679 bp, Artificial Sequence
  chemically treated genomic DNA (Homo sapiens) CpG-island No: 25019
atcgttagttagatcggtagattttgtatgcgcgtcgatgtagtagtcgttttttttttgtgcgggtaaaatttttagtagaagggattgttatcgttgtttagacgttggggtaacgtattttgtcgtttgaagtgtatgacgttatcggtgcgggcgatacggtgattggcgttttggcggtaacgttggtagcgggtaattcgttggaagaagtttgtttttttgttaatgcggcggttggcgtggtggtcggtaaattgggaatttttacggttttcgtgatcgcgcgcgttgtcgacgaatttggcgcgttgttgattatcgatgaagtgatgatcggttttcgcgtagcgttagttggcgtataggattattacggcgtagtgttagatttaatttgtttcggtaaaattatcggcggtggaatgtcggtaggcgtattcggtggtcgtcgtgatgtaatggatgcgttggtttcgacgggttcggtttattaggcgggtacgtttttcggtaattcgattgcgatggtagcgggtttcgtttgtttgaatgaagtcgcgtagtcgggcgtttacgaaacgttggatgagttgataatacgtttggtagaaggtttgttggaagcggtagaagaagtcggaatttcgttggtcgttaattacgttggcggtat

SEQ ID NO: 25020 - DNA, 679 bp, Artificial Sequence
  chemically treated genomic DNA (Homo sapiens) CpG-island No: 25020
ataccgccaacgtaattaacgaccaacgaaattccgacttcttctaccgcttccaacaaaccttctaccaaacgtattatcaactcatccaacgtttcgtaaacgcccgactacgcgacttcattcaaacaaacgaaacccgctaccatcgcaatcgaattaccgaaaaacgtacccgcctaataaaccgaacccgtcgaaaccaacgcatccattacatcacgacgaccaccgaatacgcctaccgacattccaccgccgataattttaccgaaacaaattaaatctaacactacgccgtaataatcctatacgccaactaacgctacgcgaaaaccgatcatcacttcatcgataatcaacaacgcgccaaattcgtcgacaacgcgcgcgatcacgaaaaccgtaaaaattcccaatttaccgaccaccacgccaaccgccgcattaacaaaaaaacaaacttcttccaacgaattacccgctaccaacgttaccgccaaaacgccaatcaccgtatcgcccgcaccgataacgtcatacacttcaaacgacaaaatacgttaccccaacgtctaaacaacgataacaatcccttctactaaaaattttacccgcacaaaaaaaaaacgactactacatcgacgcgcatacaaaatctaccgatctaactaacgat

SEQ ID NO: 25021 - DNA, 742 bp, Artificial Sequence
  chemically treated genomic DNA (Homo sapiens) CpG-island No: 25021
tttcgtcggggtttttttcgttttttttttacggtatatgcgtagattttgatgcgacgttggcgcgttttattatgtttataaatttgtgtttgaacggtaacggataaggcgttacgtcgtattcggtagtgtgtattaatgttggattttataatatataatcgcgatatcgtgtagcggatggatgattcggtggtgcgcgaaagcggcgaaatgttgcgtcgttcgcgggggtatgtgtcggatgcgttggttttgttttcgggttttaaaaatgtttcgtttgtgttgtgtttcggcgcggatttgaaaaatattttttgtttggtgcgcggtgaataagcggtgttgagttagtatttgggcgatttaagtgacgatggtatttagatgtagtggcgcgaagcgttacgtttgatgtaaaatatttacgattttatttcgtaatacgttgtgtatgacgcgtattcgggttatgtttttagttagtgggcgcgtgaaatgaatttgtcgacgtaaacggtattgtattattatgtttatgtagcggcgtgtttggtagagtattagtggtcgttggatggcggtgatgttattgttttgacgttcgacggtatcggtatgggggagaacggcgttttgtggggcggcgagtgttgttataattgaatattattcgttttcgggttttttcgtagtcggatttttacgttatcgtcgttattaattgggagacgga

SEQ ID NO: 25022 - DNA, 742 bp, Artificial Sequence
  chemically treated genomic DNA (Homo sapiens) CpG-island No: 25022
tccgtctcccaattaataacgacgataacgtaaaaatccgactacgaaaaaacccgaaaacgaataatattcaattataacaacactcgccgccccacaaaacgccgttctcccccataccgataccgtcgaacgtcaaaacaataacatcaccgccatccaacgaccactaatactctaccaaacacgccgctacataaacataataatacaataccgtttacgtcgacaaattcatttcacgcgcccactaactaaaaacataacccgaatacgcgtcatacacaacgtattacgaaataaaatcgtaaatattttacatcaaacgtaacgcttcgcgccactacatctaaataccatcgtcacttaaatcgcccaaatactaactcaacaccgcttattcaccgcgcaccaaacaaaaaatatttttcaaatccgcgccgaaacacaacacaaacgaaacatttttaaaacccgaaaacaaaaccaacgcatccgacacatacccccgcgaacgacgcaacatttcgccgctttcgcgcaccaccgaatcatccatccgctacacgatatcgcgattatatattataaaatccaacattaatacacactaccgaatacgacgtaacgccttatccgttaccgttcaaacacaaatttataaacataataaaacgcgccaacgtcgcatcaaaatctacgcatataccgtaaaaaaaaaacgaaaaaaaccccgacgaaa

SEQ ID NO: 25023 - DNA, 742 bp, Artificial Sequence
  chemically treated genomic DNA (Homo sapiens) CpG-island No: 25023
ttcgttttttagttaatgacggcgatggcgtagaagttcggttgcgggaagattcggaaacgggtagtgtttaattgtagtagtattcgtcgttttataaagcgtcgtttttttttatatcgatatcgtcgagcgttaaagtaatgatattatcgttatttagcggttattgatgttttgttagatacgtcgttgtatgggtatgatgatgtagtatcgtttgcgtcggtagatttattttacgcgtttattggttggagatatagttcggatgcgcgttatgtataacgtattgcggggtaaaatcgtagatgttttgtattaggcgtaacgtttcgcgttattgtatttggatgttatcgttatttaaatcgtttagatgttgatttaatatcgtttgtttatcgcgtattaggtagaaggtattttttagattcgcgtcgagatatagtataggcggaatatttttaaagttcggaggtaaagttagcgtattcggtatatattttcgcgaacggcgtagtatttcgtcgttttcgcgtattatcgaattatttattcgttgtacgatgtcgcggttatgtattgtaagatttagtattggtgtatattgtcggatgcggcgtgacgttttattcgttatcgtttaggtataagtttgtaggtatgataagacgcgttagcgtcgtattaggatttgcgtatatatcgtgagggaaaggcgaaaagaatttcggcgagg

SEQ ID NO: 25024 - DNA, 742 bp, Artificial Sequence
  chemically treated genomic DNA (Homo sapiens) CpG-island No: 25024
cctcgccgaaattcttttcgcctttccctcacgatatatacgcaaatcctaatacgacgctaacgcgtcttatcatacctacaaacttatacctaaacgataacgaataaaacgtcacgccgcatccgacaatatacaccaatactaaatcttacaatacataaccgcgacatcgtacaacgaataaataattcgataatacgcgaaaacgacgaaatactacgccgttcgcgaaaatatataccgaatacgctaactttacctccgaactttaaaaatattccgcctatactatatctcgacgcgaatctaaaaaataccttctacctaatacgcgataaacaaacgatattaaatcaacatctaaacgatttaaataacgataacatccaaatacaataacgcgaaacgttacgcctaatacaaaacatctacgattttaccccgcaatacgttatacataacgcgcatccgaactatatctccaaccaataaacgcgtaaaataaatctaccgacgcaaacgatactacatcatcatacccatacaacgacgtatctaacaaaacatcaataaccgctaaataacgataatatcattactttaacgctcgacgatatcgatataaaaaaaaacgacgctttataaaacgacgaatactactacaattaaacactacccgtttccgaatcttcccgcaaccgaacttctacgccatcgccgtcattaactaaaaaacgaa

SEQ ID NO: 25025 - DNA, 765 bp, Artificial Sequence
  chemically treated genomic DNA (Homo sapiens) CpG-island No: 25025
  misc_feature (300)..(300): n is either a, c, g or t
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgatngtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacggttgattaagtttattttttattttcgggtaataagggcgcgtgcgttatttatttttttgttcgtttatatttaacgagggaaggtgagatggaggggaagaaaggttatagggataagtgagtagagcggttacgtgtggtt

SEQ ID NO: 25026 - DNA, 765 bp, Artificial Sequence
  chemically treated genomic DNA (Homo sapiens) CpG-island No: 25026
  misc_feature (466)..(466): n is either a, c, g or t
aaccacacgtaaccgctctactcacttatccctataacctttcttcccctccatctcaccttccctcgttaaatataaacgaacaaaaaaataaataacgcacgcgcccttattacccgaaaataaaaaataaacttaatcaaccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacnatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 25027 - DNA, 765 bp, Artificial Sequence
  chemically treated genomic DNA (Homo sapiens) CpG-island No: 25027
  misc_feature (466)..(466): n is either a, c, g or t
ggttatacgtagtcgttttgtttatttatttttgtggtttttttttttttttattttattttttttcgttgaatatggacgggtaaaaaagtggatagcgtacgcgtttttattgttcggggatggggagtaagtttagttagtcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtnattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 25028 - DNA, 765 bp, Artificial Sequence
  chemically treated genomic DNA (Homo sapiens) CpG-island No: 25028
  misc_feature (300)..(300): n is either a, c, g or t
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaatnactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgactaactaaacttactccccatccccgaacaataaaaacgcgtacgctatccacttttttacccgtccatattcaacgaaaaaaaataaaataaaaaaaaaaaaaaaccacaaaaataaataaacaaaacgactacgtataacc

SEQ ID NO: 25029 - DNA, 940 bp, Artificial Sequence
  chemically treated genomic DNA (Homo sapiens) CpG-island No: 25029
ttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtgtttacgtcggcggttttttttttacggatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgtattgggtttttacgtcggcggttttttttttattgatttcgtattgggtttttacgtcggcggttttttttttattgatttcgtattgggtttttatggtttttttcgtcgagttggtggtttttttataggatttagatgatggtttagt

SEQ ID NO: 25030 - DNA, 940 bp, Artificial Sequence
  chemically treated genomic DNA (Homo sapiens) CpG-island No: 25030
actaaaccatcatctaaatcctataaaaaaaccaccaactcgacgaaaaaaaccataaaaacccaatacgaaatcaataaaaaaaaaaccgccgacgtaaaaacccaatacgaaatcaataaaaaaaaaaccgccgacgtaaaaacccaatacgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatccgtaaaaaaaaaaccgccgacgtaaacacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaa

SEQ ID NO: 25031 - DNA, 940 bp, Artificial Sequence
  chemically treated genomic DNA (Homo sapiens) CpG-island No: 25031
gttgagttattatttgggttttatggaaagattattaattcgacggaaaaggttatggagatttagtgcggggttagtggagaaaaggtcgtcgacgtggagatttagtgcggggttagtggagaaaaggtcgtcgacgtggagatttagtgcggggtcggtggagaaaaggtcgtcgacgtggggatttagcgcggggtcggtggagaaaaggtcgtcgacgtggggatttagcgcggggtcggtggagaaaaggtcgtcgacgtggggatttagcgcggggtcggtggagaaaaggtcgtcgacgtggagatttagcgcggggtcggtggagaaaaggtcgtcgacgtggggatttagcgcggggtcggtggagaaaaggtcgtcgacgtggagatttagcgcggggttcgtggagaaaaggtcgtcgacgtggatatttagcgcggggtcggtggagaaaaggtcgtcgacgtggggatttagcgcggggtcggtggagaaaaggtcgtcgacgtggggatttagcgcggggtcggtggagaaaaggtcgtcgacgtggggatttagcgcggggtcggtggagaaaaggtcgtcgacgtggggatttagcgcggggtcggtggagaaaaggtcgtcgacgtggggatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtgg

SEQ ID NO: 25032 - DNA, 940 bp, Artificial Sequence
  chemically treated genomic DNA (Homo sapiens) CpG-island No: 25032
ccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatccccacgtcgacgaccttttctccaccgaccccgcgctaaatccccacgtcgacgaccttttctccaccgaccccgcgctaaatccccacgtcgacgaccttttctccaccgaccccgcgctaaatccccacgtcgacgaccttttctccaccgaccccgcgctaaatccccacgtcgacgaccttttctccaccgaccccgcgctaaatatccacgtcgacgaccttttctccacgaaccccgcgctaaatctccacgtcgacgaccttttctccaccgaccccgcgctaaatccccacgtcgacgaccttttctccaccgaccccgcgctaaatctccacgtcgacgaccttttctccaccgaccccgcgctaaatccccacgtcgacgaccttttctccaccgaccccgcgctaaatccccacgtcgacgaccttttctccaccgaccccgcgctaaatccccacgtcgacgaccttttctccaccgaccccgcactaaatctccacgtcgacgaccttttctccactaaccccgcactaaatctccacgtcgacgaccttttctccactaaccccgcactaaatctccataaccttttccgtcgaattaataatctttccataaaacccaaataataactcaac

SEQ ID NO: 25033 - DNA, 821 bp, Artificial Sequence
  chemically treated genomic DNA (Homo sapiens) CpG-island No: 25033
  misc_feature (638)..(638): n is either a, c, g or t
  misc_feature (729)..(729): n is either a, c, g or t
agggttcgcgtgaagtcgttaggtagcgttggatttcgttttatgtagtttaagtttagcgggagtttttaagttcgaattcgtcgcgggtgtaaattttttttataaataagtggttcgcggtttagtttgtaaagtttagttcgggcgttgaatttagtagcgttcgagttggatttcggagtttgttttttttaagtttcgggttcgttttttcgcgggcgcgaggtatttttgagttcgtttcggttttttagatttttagggatcggttgtcggggggttttgagttcgtttcgtttcggttttcgttttcgtcgcggggaattttgggattgtcgttttcgttcgtgtcggaagtttcggcgcggtagcgcgatacgaggttttttagatttagtcgggtagtgtcgttagcgaggcgggtagagttgttcgggtggtatttcgcgtattttgtgtttcggaggtatcgtgaagaagttttttttacgaatatattttagacggatttgttcgtattttagatttgggtttcgttatgtcgagcgttggtttcgttttttttgcgcgtaggcgtagacgcggacggtttcgcggcgtaggcgcgaaagttttttttcgggtttttttttttnagtaacggttattaagagacgttttcgcgggttcgttttaggcgttgggttttagggatggtttcgattgttgtagttcgggttttatttnagggtgaagttcgggtagtcgattcggttgcgtcgtagtgggaggttacggcgatattttaggtgaaggttttttaggtgagacgggttttt

SEQ ID NO: 25034 - DNA, 821 bp, Artificial Sequence
  chemically treated genomic DNA (Homo sapiens) CpG-island No: 25034
  misc_feature (93)..(93): n is either a, c, g or t
  misc_feature (184)..(184): n is either a, c, g or t
aaaaacccgtctcacctaaaaaaccttcacctaaaatatcgccgtaacctcccactacgacgcaaccgaatcgactacccgaacttcaccctnaaataaaacccgaactacaacaatcgaaaccatccctaaaacccaacgcctaaaacgaacccgcgaaaacgtctcttaataaccgttactnaaaaaaaaaaacccgaaaaaaaactttcgcgcctacgccgcgaaaccgtccgcgtctacgcctacgcgcaaaaaaaacgaaaccaacgctcgacataacgaaacccaaatctaaaatacgaacaaatccgtctaaaatatattcgtaaaaaaaacttcttcacgatacctccgaaacacaaaatacgcgaaataccacccgaacaactctacccgcctcgctaacgacactacccgactaaatctaaaaaacctcgtatcgcgctaccgcgccgaaacttccgacacgaacgaaaacgacaatcccaaaattccccgcgacgaaaacgaaaaccgaaacgaaacgaactcaaaaccccccgacaaccgatccctaaaaatctaaaaaaccgaaacgaactcaaaaatacctcgcgcccgcgaaaaaacgaacccgaaacttaaaaaaaacaaactccgaaatccaactcgaacgctactaaattcaacgcccgaactaaactttacaaactaaaccgcgaaccacttatttataaaaaaaatttacacccgcgacgaattcgaacttaaaaactcccgctaaacttaaactacataaaacgaaatccaacgctacctaacgacttcacgcgaaccct

SEQ ID NO: 25035 - DNA, 821 bp, Artificial Sequence
  chemically treated genomic DNA (Homo sapiens) CpG-island No: 25035
  misc_feature (93)..(93): n is either a, c, g or t
  misc_feature (184)..(184): n is either a, c, g or t
gggaattcgttttatttggaagatttttatttggggtatcgtcgtggttttttattacggcgtagtcgggtcggttgttcgggttttattttnaaataaggttcgaattgtagtagtcggagttatttttggagtttagcgtttagggcggattcgcgggagcgttttttggtaatcgttgttnaggagaggaagttcgggaaggagttttcgcgtttgcgtcgcggggtcgttcgcgtttgcgtttgcgcgtaagagaggcggggttagcgttcggtatggcggagtttagatttggagtgcgagtagattcgtttgaagtgtattcgtaaggagggtttttttacggtgttttcggaatatagggtgcgcggggtgttattcgggtagttttgttcgtttcgttagcggtattgttcggttgggtttggggagtttcgtgtcgcgttgtcgcgtcgaggttttcggtacgggcgggaacgatagttttagagtttttcgcggcgggggcggaagtcggggcggggcgggtttaggatttttcgatagtcggtttttggagatttgaggggtcggggcgggtttagggatgtttcgcgttcgcggagagacgggttcgggatttgggaagagtaagtttcgggatttagttcgggcgttgttgggtttagcgttcgagttgggttttgtaggttgagtcgcgagttatttgtttgtggggagaatttatattcgcgacgagttcgagtttgaaggttttcgttgggtttgggttgtatggagcggggtttagcgttgtttggcggttttacgcgaatttt

SEQ ID NO: 25036 - DNA, 821 bp, Artificial Sequence
  chemically treated genomic DNA (Homo sapiens) CpG-island No: 25036
  misc_feature (638)..(638): n is either a, c, g or t
  misc_feature (729)..(729): n is either a, c, g or t
aaaattcgcgtaaaaccgccaaacaacgctaaaccccgctccatacaacccaaacccaacgaaaaccttcaaactcgaactcgtcgcgaatataaattctccccacaaacaaataactcgcgactcaacctacaaaacccaactcgaacgctaaacccaacaacgcccgaactaaatcccgaaacttactcttcccaaatcccgaacccgtctctccgcgaacgcgaaacatccctaaacccgccccgacccctcaaatctccaaaaaccgactatcgaaaaatcctaaacccgccccgccccgacttccgcccccgccgcgaaaaactctaaaactatcgttcccgcccgtaccgaaaacctcgacgcgacaacgcgacacgaaactccccaaacccaaccgaacaataccgctaacgaaacgaacaaaactacccgaataacaccccgcgcaccctatattccgaaaacaccgtaaaaaaaccctccttacgaatacacttcaaacgaatctactcgcactccaaatctaaactccgccataccgaacgctaaccccgcctctcttacgcgcaaacgcaaacgcgaacgaccccgcgacgcaaacgcgaaaactccttcccgaacttcctctcctnaacaacgattaccaaaaaacgctcccgcgaatccgccctaaacgctaaactccaaaaataactccgactactacaattcgaaccttatttnaaaataaaacccgaacaaccgacccgactacgccgtaataaaaaaccacgacgataccccaaataaaaatcttccaaataaaacgaattccc

SEQ ID NO: 25037 - DNA, 958 bp, Artificial Sequence
  chemically treated genomic DNA (Homo sapiens) CpG-island No: 25037
  misc_feature (55)..(55): n is either a, c, g or t
  misc_feature (631)..(631): n is either a, c, g or t
ttcgaaaatcggggagttaggggaattcgaaaggttttggggggaaggggttttncgggttcgaagggttcgaggtttcgggggtaaaggatttcgggttgggggtcgggggtttgggaagggtttcggtcggtggtcgggggtcgaggttcgggagaaggggtttcgggtcggtggtagaggttttggggaaggggtttcgggtcggggatcgagggtcgaggttcgggaaaaggggtttcgggttggtggtttaggtattggggaaggggtttcgggtcgggtatcgggggacgaggttcggaaaaagggttttaggtcgtgtcgaggtttggggatggggttcgggtcgggattcggggaggacgatcgggaaaagggtttaagtcgggtgtttaaggttttggggatggggttcgggggatcgacggtcgaggtcgagtttttttgagttttgttcgcggatttaggatgggcggagtttacgttagtgggagaagcggttcgttcgcgcgcgagttttcggaggacggtcgtagatcgtcgttaagcggtttaatgggttataatgataggagtagtattcggagagggagaaggaacgttaatttcggcggtgttagttttcgtnggcgatcgaatcgattaagttgtattcggcggggattttcggggtcgtcgttttattttcggtcgtacgggatgttttcgcgagaggatggtggtcggtttcgttagaggggcggggcgcggttgcgcggcgcgcggtcgttatggtgacgtacgtcgttggcgcgaggattttttgtgagtcgttttcggtttcgcggtcgcggaggtgtggggattcgggtttgcgtcggagggggcggtgggtttatttatgggtttttttaaaagtaaagagaaatttaggaaaggtaaaggaggcgtaggcgttgggtttttcgcgttttcg

SEQ ID NO: 25038 - DNA, 958 bp, Artificial Sequence
  chemically treated genomic DNA (Homo sapiens) CpG-island No: 25038
  misc_feature (328)..(328): n is either a, c, g or t
  misc_feature (904)..(904): n is either a, c, g or t
cgaaaacgcgaaaaacccaacgcctacgcctcctttacctttcctaaatttctctttacttttaaaaaaacccataaataaacccaccgccccctccgacgcaaacccgaatccccacacctccgcgaccgcgaaaccgaaaacgactcacaaaaaatcctcgcgccaacgacgtacgtcaccataacgaccgcgcgccgcgcaaccgcgccccgcccctctaacgaaaccgaccaccatcctctcgcgaaaacatcccgtacgaccgaaaataaaacgacgaccccgaaaatccccgccgaatacaacttaatcgattcgatcgccnacgaaaactaacaccgccgaaattaacgttccttctccctctccgaatactactcctatcattataacccattaaaccgcttaacgacgatctacgaccgtcctccgaaaactcgcgcgcgaacgaaccgcttctcccactaacgtaaactccgcccatcctaaatccgcgaacaaaactcaaaaaaactcgacctcgaccgtcgatcccccgaaccccatccccaaaaccttaaacacccgacttaaacccttttcccgatcgtcctccccgaatcccgacccgaaccccatccccaaacctcgacacgacctaaaaccctttttccgaacctcgtcccccgatacccgacccgaaaccccttccccaatacctaaaccaccaacccgaaaccccttttcccgaacctcgaccctcgatccccgacccgaaaccccttccccaaaacctctaccaccgacccgaaaccccttctcccgaacctcgacccccgaccaccgaccgaaacccttcccaaacccccgacccccaacccgaaatcctttacccccgaaacctcgaacccttcgaacccgnaaaaccccttccccccaaaacctttcgaattcccctaactccccgattttcgaa

SEQ ID NO: 25039 - DNA, 958 bp, Artificial Sequence
  chemically treated genomic DNA (Homo sapiens) CpG-island No: 25039
  misc_feature (328)..(328): n is either a, c, g or t
  misc_feature (904)..(904): n is either a, c, g or t
cggagacgcggggagtttagcgtttgcgttttttttattttttttgggtttttttttgtttttggaaaggtttatgggtgagtttatcgtttttttcgacgtaagttcgggtttttatattttcgcggtcgcggagtcgggagcgatttataaaaggttttcgcgttagcggcgtgcgttattatggcgatcgcgcgtcgcgtagtcgcgtttcgtttttttggcgggatcggttattattttttcgcgagagtatttcgtgcgatcggaagtggggcggcgatttcggaagttttcgtcgggtgtagtttggtcggttcgatcgttngcgggaattgatatcgtcggagttggcgtttttttttttttttcgagtgttgtttttgttattgtggtttattggatcgtttaacgacggtttgcggtcgtttttcggggattcgcgcgcgggcgggtcgttttttttattggcgtgggtttcgtttattttgggttcgcgggtaggatttaggagagttcggtttcgatcgtcgatttttcggattttatttttagggttttgaatattcgatttggatttttttttcggtcgtttttttcggatttcgattcggattttatttttaggtttcgatacgatttgggatttttttttcgagtttcgtttttcgatattcgattcggaattttttttttagtgtttagattattaattcgggattttttttttcgggtttcgattttcgattttcgattcggaattttttttttagggtttttattatcgattcgggattttttttttcgggtttcgattttcgattatcgatcgggattttttttaggttttcgatttttaattcgagattttttattttcggggtttcggatttttcggattcgngggattttttttttttaaggtttttcggatttttttgatttttcgattttcggg

SEQ ID NO: 25040 - DNA, 958 bp, Artificial Sequence
  chemically treated genomic DNA (Homo sapiens) CpG-island No: 25040
  misc_feature (55)..(55): n is either a, c, g or t
  misc_feature (631)..(631): n is either a, c, g or t
cccgaaaatcgaaaaatcaaaaaaatccgaaaaaccttaaaaaaaaaaaatcccncgaatccgaaaaatccgaaaccccgaaaataaaaaatctcgaattaaaaatcgaaaacctaaaaaaaatcccgatcgataatcgaaaatcgaaacccgaaaaaaaaaatcccgaatcgataataaaaaccctaaaaaaaaaattccgaatcgaaaatcgaaaatcgaaacccgaaaaaaaaaatcccgaattaataatctaaacactaaaaaaaaaattccgaatcgaatatcgaaaaacgaaactcgaaaaaaaaatcccaaatcgtatcgaaacctaaaaataaaatccgaatcgaaatccgaaaaaaacgaccgaaaaaaaaatccaaatcgaatattcaaaaccctaaaaataaaatccgaaaaatcgacgatcgaaaccgaactctcctaaatcctacccgcgaacccaaaataaacgaaacccacgccaataaaaaaaacgacccgcccgcgcgcgaatccccgaaaaacgaccgcaaaccgtcgttaaacgatccaataaaccacaataacaaaaacaacactcgaaaaaaaaaaaaaaacgccaactccgacgatatcaattcccgcnaacgatcgaaccgaccaaactacacccgacgaaaacttccgaaatcgccgccccacttccgatcgcacgaaatactctcgcgaaaaaataataaccgatcccgccaaaaaaacgaaacgcgactacgcgacgcgcgatcgccataataacgcacgccgctaacgcgaaaaccttttataaatcgctcccgactccgcgaccgcgaaaatataaaaacccgaacttacgtcgaaaaaaacgataaactcacccataaacctttccaaaaacaaaaaaaaacccaaaaaaaataaaaaaaacgcaaacgctaaactccccgcgtctccg

SEQ ID NO: 25041 - DNA, 1551 bp, Artificial Sequence
  chemically treated genomic DNA (Homo sapiens) CpG-island No: 25041
gatgggatgttttatgtgatgggtgattagatatttcgtgttagcgggagacggaatgtttcgtgtgacgggtgacgggatgttttatgtgatgggtgagatgttttgtgtgattggtgagatgttttatgtgacgggtgatgggatgtttcgtgtgataggtgacgggatgttttatgtgatgggttacgggatgtttcgtgtgacgggtgacgggatgtttcgtgtgataggtgatgggatgtttcgtgtgatgggtgagatgttttatgttagcgggtgacgggatgtttcgtgtgatgggtgagatgttttatgtgacgggtgatgggatgtttcgtgtgacgggtgatggtatgtttcgtgtgacgggtgatgggatgtttcgtgtgatgggtgacgggatgtttcgtgttataggtgacgggatgtttcgtgtgacgggtgagatgttttgtgttagcgggtgatgggatgtttcgtgtgatgggtgagatgttttgtgttagcgggtgacgggatgtttcgtgtgataggtgagatgtttcgtgtgatgggtgatgggatgttttatgtgacgggtgatgggatgtttcgtgtgataggtgagatgtttcgtgttagcgggtgacgggatgtttcgtgtgatgggtgagatgttttgtgtgatgggtgatgggatgtttcgtgtgacgggtgatgggatgtttcgtgtgacgggtgagatgttttgtgttagcgggtgacgggatgtttcgtgtgatgggtgagatgtttcgtgtgatgggtgagatgttttgtgtgatgggtgatgggatgtttcgtgtgacgggtgatgggatgttttatgtgacgggtgatgggatgtttcgtgtgacgggtgatgggatgtttcgtgtgacgggtgagatgttttgtgttagcgggtgacgggatgtttcgtgtgatgggtgagatgttttgtgtttgtaggtgatgggatgtttcgtgtgatgggggagatgtttcgtgttagcgggtgacgggatgtttcgtgtgacgggtgagatgttttgtgttagcgggtgacgggatgtttcgtgtgacgggtgagatgttttgtgttagcgggtgacgggatgttttgtgtgatgggtgagatgtttcgtgtttgtaggtgatgggatgtttcgtgtgacgggtgagatgtttcgtgttagcgggtgataggatgtttcgtgtgatgggtgagatgtttcgtgtgatgggatgtttcgtgtgacgggtgacgggatgttttatgtgacgggtgagatgttttgtgttagcgggtgacgggatgtttcgtgtgatgggtgagatgtttcgtgttagtaggtgacgggatgtttcgtgtgatgggtgagatgtttcgtgtgatgggtgtgggatgtttcgtgtgacgggtgaatgtttcgtgttagcgggtgacgggatgtttcgtgtgatgggtgaatgttttgtgtgatgggtgatgggatgtttcgtgtgatgggtgatgggatgttttatgtgatagatacgggatgtttt

SEQ ID NO: 25042 - DNA, 1551 bp, Artificial Sequence
  chemically treated genomic DNA (Homo sapiens) CpG-island No: 25042
aaaacatcccgtatctatcacataaaacatcccatcacccatcacacgaaacatcccatcacccatcacacaaaacattcacccatcacacgaaacatcccgtcacccgctaacacgaaacattcacccgtcacacgaaacatcccacacccatcacacgaaacatctcacccatcacacgaaacatcccgtcacctactaacacgaaacatctcacccatcacacgaaacatcccgtcacccgctaacacaaaacatctcacccgtcacataaaacatcccgtcacccgtcacacgaaacatcccatcacacgaaacatctcacccatcacacgaaacatcctatcacccgctaacacgaaacatctcacccgtcacacgaaacatcccatcacctacaaacacgaaacatctcacccatcacacaaaacatcccgtcacccgctaacacaaaacatctcacccgtcacacgaaacatcccgtcacccgctaacacaaaacatctcacccgtcacacgaaacatcccgtcacccgctaacacgaaacatctcccccatcacacgaaacatcccatcacctacaaacacaaaacatctcacccatcacacgaaacatcccgtcacccgctaacacaaaacatctcacccgtcacacgaaacatcccatcacccgtcacacgaaacatcccatcacccgtcacataaaacatcccatcacccgtcacacgaaacatcccatcacccatcacacaaaacatctcacccatcacacgaaacatctcacccatcacacgaaacatcccgtcacccgctaacacaaaacatctcacccgtcacacgaaacatcccatcacccgtcacacgaaacatcccatcacccatcacacaaaacatctcacccatcacacgaaacatcccgtcacccgctaacacgaaacatctcacctatcacacgaaacatcccatcacccgtcacataaaacatcccatcacccatcacacgaaacatctcacctatcacacgaaacatcccgtcacccgctaacacaaaacatctcacccatcacacgaaacatcccatcacccgctaacacaaaacatctcacccgtcacacgaaacatcccgtcacctataacacgaaacatcccgtcacccatcacacgaaacatcccatcacccgtcacacgaaacataccatcacccgtcacacgaaacatcccatcacccgtcacataaaacatctcacccatcacacgaaacatcccgtcacccgctaacataaaacatctcacccatcacacgaaacatcccatcacctatcacacgaaacatcccgtcacccgtcacacgaaacatcccgtaacccatcacataaaacatcccgtcacctatcacacgaaacatcccatcacccgtcacataaaacatctcaccaatcacacaaaacatctcacccatcacataaaacatcccgtcacccgtcacacgaaacattccgtctcccgctaacacgaaatatctaatcacccatcacataaaacatcccatc

SEQ ID NO: 25043 - DNA, 1551 bp, Artificial Sequence
  chemically treated genomic DNA (Homo sapiens) CpG-island No: 25043
ggaatatttcgtatttgttatatggaatattttattatttattatacggaatattttattatttattatatagaatatttatttattatacggaatatttcgttattcgttgatacggaatatttattcgttatacggaatattttatatttattatacggaatattttatttattatacggaatatttcgttatttgttgatacggaatattttatttattatacggaatatttcgttattcgttgatatagaatattttattcgttatatggaatatttcgttattcgttatacggaatattttattatacggaatattttatttattatacggaatattttgttattcgttgatacggaatattttattcgttatacggaatattttattatttgtagatacggaatattttatttattatatagaatatttcgttattcgttgatatagaatattttattcgttatacggaatatttcgttattcgttgatatagaatattttattcgttatacggaatatttcgttattcgttgatacggaatattttttttattatacggaatattttattatttgtagatatagaatattttatttattatacggaatatttcgttattcgttgatatagaatattttattcgttatacggaatattttattattcgttatacggaatattttattattcgttatatggaatattttattattcgttatacggaatattttattatttattatatagaatattttatttattatacggaatattttatttattatacggaatatttcgttattcgttgatatagaatattttattcgttatacggaatattttattattcgttatacggaatattttattatttattatatagaatattttatttattatacggaatatttcgttattcgttgatacggaatattttatttgttatacggaatattttattattcgttatatggaatattttattatttattatacggaatattttatttgttatacggaatatttcgttattcgttgatatagaatattttatttattatacggaatattttattattcgttgatatagaatattttattcgttatacggaatatttcgttatttgtaatacggaatatttcgttatttattatacggaatattttattattcgttatacggaatatgttattattcgttatacggaatattttattattcgttatatggaatattttatttattatacggaatatttcgttattcgttgatatggaatattttatttattatacggaatattttattatttgttatacggaatatttcgttattcgttatacggaatatttcgtaatttattatatggaatatttcgttatttgttatacggaatattttattattcgttatatggaatattttattaattatatagaatattttatttattatatggaatatttcgttattcgttatacggaatatttcgtttttcgttgatacggaatatttgattatttattatatggaatattttatt

SEQ ID NO: 25044 - DNA, 1551 bp, Artificial Sequence
  chemically treated genomic DNA (Homo sapiens) CpG-island No: 25044
aataaaatattccatataataaataatcaaatattccgtatcaacgaaaaacgaaatattccgtataacgaataacgaaatattccatataataaataaaatattctatataattaataaaatattccatataacgaataataaaatattccgtataacaaataacgaaatattccatataataaattacgaaatattccgtataacgaataacgaaatattccgtataacaaataataaaatattccgtataataaataaaatattccatatcaacgaataacgaaatattccgtataataaataaaatattccatataacgaataataaaatattccgtataacgaataataacatattccgtataacgaataataaaatattccgtataataaataacgaaatattccgtattacaaataacgaaatattccgtataacgaataaaatattctatatcaacgaataataaaatattccgtataataaataaaatattctatatcaacgaataacgaaatattccgtataacaaataaaatattccgtataataaataataaaatattccatataacgaataataaaatattccgtataacaaataaaatattccgtatcaacgaataacgaaatattccgtataataaataaaatattctatataataaataataaaatattccgtataacgaataataaaatattccgtataacgaataaaatattctatatcaacgaataacgaaatattccgtataataaataaaatattccgtataataaataaaatattctatataataaataataaaatattccgtataacgaataataaaatattccatataacgaataataaaatattccgtataacgaataataaaatattccgtataacgaataaaatattctatatcaacgaataacgaaatattccgtataataaataaaatattctatatctacaaataataaaatattccgtataataaaaaaaatattccgtatcaacgaataacgaaatattccgtataacgaataaaatattctatatcaacgaataacgaaatattccgtataacgaataaaatattctatatcaacgaataacgaaatattctatataataaataaaatattccgtatctacaaataataaaatattccgtataacgaataaaatattccgtatcaacgaataacaaaatattccgtataataaataaaatattccgtataataaaatattccgtataacgaataacgaaatattccatataacgaataaaatattctatatcaacgaataacgaaatattccgtataataaataaaatattccgtatcaacaaataacgaaatattccgtataataaataaaatattccgtataataaatataaaatattccgtataacgaataaatattccgtatcaacgaataacgaaatattccgtataataaataaatattctatataataaataataaaatattccgtataataaataataaaatattccatataacaaatacgaaatattcc

SEQ ID NO: 25045 - DNA, 909 bp, Artificial Sequence
  chemically treated genomic DNA (Homo sapiens) CpG-island No: 25045
gggggcgttggtatcgcgggtggaatttcggtcggcggggtttcgttattggttttggttcgtttcgttcgtttcgttttgtttttcgtttcgtttttttttcgtttcgtttcgtttttagcgcgtcgagcggagtttaacgtcgggttttttaggaatttcgggtcgggtagtattcgcgggattttgttggcgtttttcgttgttatgaagcgggatcggttgggtcgttttttgttttttgggtcgtttcgatagtgcggggtttcggacggcggcggcggcgttagtcggattcggggtcgttttttttttagcggtgggtcgagggtggacggggcgacggcgcggcgcgtttggggttcggtggggttttgcggggacgcgggcgaggacggcgcggacgaggtaggtgggttcgcggttcgggcgtggcgggttggggtcgcggtaggggttgttcgtgggaggagtcgtattgacgttcggaagtcggcgcggttttttttttattcggttaagggcgtagcggattcggggttgcgtcgggataggcgttgggcggtcggttcggtttttttcgcgtttcgtgacgtcggcgtcgtcggttcggttttttcggtcgcgggttcggttagaagggattcggcgtgaggagcgttgttatcgcgggtaggtcgttttggggtgttcgcgcgtgggaatcgtttttttttgtttcgtgttttcgcggagtcggaaaggaggcggtatttgtaattggtagataggaaatcgcggcgttttttggagggcgtagcgtttgtttcgggtttcgcggtcgttgggaggagggtgtagttttaggttttatttttgaagttgtttcgttggagaggttttagaggtttttgaaatttgaaagatttt

SEQ ID NO: 25046 - DNA, 909 bp, Artificial Sequence
  chemically treated genomic DNA (Homo sapiens) CpG-island No: 25046
aaaatctttcaaatttcaaaaacctctaaaacctctccaacgaaacaacttcaaaaataaaacctaaaactacaccctcctcccaacgaccgcgaaacccgaaacaaacgctacgccctccaaaaaacgccgcgatttcctatctaccaattacaaataccgcctcctttccgactccgcgaaaacacgaaacaaaaaaaaacgattcccacgcgcgaacaccccaaaacgacctacccgcgataacaacgctcctcacgccgaatcccttctaaccgaacccgcgaccgaaaaaaccgaaccgacgacgccgacgtcacgaaacgcgaaaaaaaccgaaccgaccgcccaacgcctatcccgacgcaaccccgaatccgctacgcccttaaccgaataaaaaaaaaaccgcgccgacttccgaacgtcaatacgactcctcccacgaacaacccctaccgcgaccccaacccgccacgcccgaaccgcgaacccacctacctcgtccgcgccgtcctcgcccgcgtccccgcaaaaccccaccgaaccccaaacgcgccgcgccgtcgccccgtccaccctcgacccaccgctaaaaaaaaaacgaccccgaatccgactaacgccgccgccgccgtccgaaaccccgcactatcgaaacgacccaaaaaacaaaaaacgacccaaccgatcccgcttcataacaacgaaaaacgccaacaaaatcccgcgaatactacccgacccgaaattcctaaaaaacccgacgttaaactccgctcgacgcgctaaaaacgaaacgaaacgaaaaaaaaacgaaacgaaaaacaaaacgaaacgaacgaaacgaaccaaaaccaataacgaaaccccgccgaccgaaattccacccgcgataccaacgccccc

SEQ ID NO: 25047 - DNA, 909 bp, Artificial Sequence
  chemically treated genomic DNA (Homo sapiens) CpG-island No: 25047
gaaattttttaaattttaaaggtttttaaggtttttttagcgaagtaattttaagagtgaaatttggaattgtattttttttttagcgatcgcgagattcggggtaggcgttgcgttttttaggaaacgtcgcggttttttgtttgttaattgtaggtgtcgtttttttttcggtttcgcgagggtacgaagtaggggagggcgatttttacgcgcgggtattttagggcgatttgttcgcggtgatagcgttttttacgtcgggttttttttggtcgagttcgcggtcggggaggtcgggtcggcgacgtcggcgttacggagcgcgaggaaaatcgagtcggtcgtttagcgtttatttcgacgtagtttcgagttcgttacgtttttggtcgggtggaggagaggtcgcgtcggttttcgggcgttagtgcggttttttttacgagtaatttttgtcgcgattttaattcgttacgttcgggtcgcggatttatttgtttcgttcgcgtcgttttcgttcgcgttttcgtaggattttatcgggttttaggcgcgtcgcgtcgtcgtttcgtttattttcggtttatcgttaagggaagggcggtttcgagttcggttgacgtcgtcgtcgtcgttcgaggtttcgtattgtcgggacgatttaggagataggaagcggtttagtcggtttcgttttatggtagcggaggacgttagtagaatttcgcgggtgttgttcggttcgaggtttttagaggattcggcgttaggtttcgttcggcgcgttggaagcgaggcggggcgggggaggggcggagcgagaagtaaagcgaggcgggcggggcgggttagggttagtggcgggatttcgtcggtcgaggttttattcgcggtgttagcgttttt

SEQ ID NO: 25048 - DNA, 909 bp, Artificial Sequence
  chemically treated genomic DNA (Homo sapiens) CpG-island No: 25048
aaaaacgctaacaccgcgaataaaacctcgaccgacgaaatcccgccactaaccctaacccgccccgcccgcctcgctttacttctcgctccgcccctcccccgccccgcctcgcttccaacgcgccgaacgaaacctaacgccgaatcctctaaaaacctcgaaccgaacaacacccgcgaaattctactaacgtcctccgctaccataaaacgaaaccgactaaaccgcttcctatctcctaaatcgtcccgacaatacgaaacctcgaacgacgacgacgacgtcaaccgaactcgaaaccgcccttcccttaacgataaaccgaaaataaacgaaacgacgacgcgacgcgcctaaaacccgataaaatcctacgaaaacgcgaacgaaaacgacgcgaacgaaacaaataaatccgcgacccgaacgtaacgaattaaaatcgcgacaaaaattactcgtaaaaaaaaccgcactaacgcccgaaaaccgacgcgacctctcctccacccgaccaaaaacgtaacgaactcgaaactacgtcgaaataaacgctaaacgaccgactcgattttcctcgcgctccgtaacgccgacgtcgccgacccgacctccccgaccgcgaactcgaccaaaaaaaacccgacgtaaaaaacgctatcaccgcgaacaaatcgccctaaaatacccgcgcgtaaaaatcgccctcccctacttcgtaccctcgcgaaaccgaaaaaaaaacgacacctacaattaacaaacaaaaaaccgcgacgtttcctaaaaaacgcaacgcctaccccgaatctcgcgatcgctaaaaaaaaaatacaattccaaatttcactcttaaaattacttcgctaaaaaaaccttaaaaacctttaaaatttaaaaaatttc

SEQ ID NO: 25049 - DNA, 1425 bp, Artificial Sequence
  chemically treated genomic DNA (Homo sapiens) CpG-island No: 25049
cgtatttatttgtaatatggtagtgtgcgtttttagatcggagtaattatcggtgtcgttcgaattttagtaatcgtgtttaagggtgacgttagattttgttggcgatagaggttcgtcgtatcgttgcgtacgttacgttttagttagttatttttttcgtcgttacgggttagtcgggtaaggtgtcgttattttgcggacgcgtcgtagttatatcggatgcgattatggcgtttttgtaggtttttagcgtttgcgttggatcgttcgttgtagttttaaatttcgtattatatacgtagtattatcgcgttttttatcgacggtggttgagattttgtttgcgggattaatttattaaacgttcgttgcgttgttgcggtatcgttaagttgcgtttgtgttagcgttacgcgtcgttgtgtgtttagtagaggacggttatcggtagtcggagtatgtattttgattatgtatggtatattagtgttacgttcgacgtgtttgttatacggttagcgaatatcgcgatttttagttagatttaagaatggcgatcggtagttacgatggtttattacgacgtataggatatatcgtgatatgatagacgcgaggtcggacggtgtaattacgtcgttgttggcgttttacgtgtagattagcgtgaggttaatacggcgtggaaggtggattgcgtaggcgtagtatcgatttatcgtttgttgtttattattgtcgttttttttgtatggcggttagcggttatttagtatttgatcgattcgtagtcgattaattagtttttgaatattgttgttttattgcgtacgcggtaggttattgatatgtttagcgtcgttttgttttggttatgattagagaggtatagttcgtaagcgtaaatttgtttcgggtcgttcgatttttgttgcgttagattgcgtattaacgtatcggtttggttgcgttgttcggtttgttagagattttgcgaaagtcggtaagtaatttatacgttgtcggggtttagcgttagtcgttgtcgttgaagtgttgtcgtttgcgtttatttgttttggttttttagtgtttttgtttgttgtgttagacggtcgttttgtaggttgcgttcgatattattaatgttacgtcgttaattggtagagagcgaggcgataaacgttttagttttttttggcgattgttggcggtaaatatttgttagttcgcgtacggcgttagtgttgtcgttgtttatacgtaaggtttgttgataataacgttcggcggcgggataattttttcgcgttatcgttatatcgtttagttttagtattgtataattgtcggtgttatcgatattacgcgtttgttggaataggcgttttgttcggttaggattattggtttttagcgtag

SEQ ID NO: 25050 - DNA, 1425 bp, Artificial Sequence
  chemically treated genomic DNA (Homo sapiens) CpG-island No: 25050
ctacgctaaaaaccaataatcctaaccgaacaaaacgcctattccaacaaacgcgtaatatcgataacaccgacaattatacaatactaaaactaaacgatataacgataacgcgaaaaaattatcccgccgccgaacgttattatcaacaaaccttacgtataaacaacgacaacactaacgccgtacgcgaactaacaaatatttaccgccaacaatcgccaaaaaaaactaaaacgtttatcgcctcgctctctaccaattaacgacgtaacattaataatatcgaacgcaacctacaaaacgaccgtctaacacaacaaacaaaaacactaaaaaaccaaaacaaataaacgcaaacgacaacacttcaacgacaacgactaacgctaaaccccgacaacgtataaattacttaccgactttcgcaaaatctctaacaaaccgaacaacgcaaccaaaccgatacgttaatacgcaatctaacgcaacaaaaatcgaacgacccgaaacaaatttacgcttacgaactatacctctctaatcataaccaaaacaaaacgacgctaaacatatcaataacctaccgcgtacgcaataaaacaacaatattcaaaaactaattaatcgactacgaatcgatcaaatactaaataaccgctaaccgccatacaaaaaaaacgacaataataaacaacaaacgataaatcgatactacgcctacgcaatccaccttccacgccgtattaacctcacgctaatctacacgtaaaacgccaacaacgacgtaattacaccgtccgacctcgcgtctatcatatcacgatatatcctatacgtcgtaataaaccatcgtaactaccgatcgccattcttaaatctaactaaaaatcgcgatattcgctaaccgtataacaaacacgtcgaacgtaacactaatataccatacataatcaaaatacatactccgactaccgataaccgtcctctactaaacacacaacgacgcgtaacgctaacacaaacgcaacttaacgataccgcaacaacgcaacgaacgtttaataaattaatcccgcaaacaaaatctcaaccaccgtcgataaaaaacgcgataatactacgtatataatacgaaatttaaaactacaacgaacgatccaacgcaaacgctaaaaacctacaaaaacgccataatcgcatccgatataactacgacgcgtccgcaaaataacgacaccttacccgactaacccgtaacgacgaaaaaaataactaactaaaacgtaacgtacgcaacgatacgacgaacctctatcgccaacaaaatctaacgtcacccttaaacacgattactaaaattcgaacgacaccgataattactccgatctaaaaacgcacactaccatattacaaataaatacg

SEQ ID NO: 25051 - DNA, 1425 bp, Artificial Sequence
  chemically treated genomic DNA (Homo sapiens) CpG-island No: 25051
ttgcgttgaaagttaataattttgatcgggtagaacgtttgttttagtaggcgcgtaatgtcgataatatcgatagttatgtagtgttggggttgggcgatgtggcgatggcgcgaaaagattatttcgtcgtcgaacgttattattagtagattttgcgtatggatagcggtaatattaacgtcgtgcgcgggttggtaaatatttatcgttagtaatcgttagaaaaagttgaagcgtttatcgtttcgttttttgttagttagcggcgtagtattgatgatatcgaacgtagtttgtaaaacgatcgtttggtatagtaggtagaggtattggaaaattagggtaaatgggcgtaggcggtagtattttagcggtaacgattggcgttggatttcggtagcgtatggattatttatcgattttcgtaggatttttggtaggtcggataacgtagttaggtcgatacgttaatgcgtaatttggcgtagtagaagtcgaacgattcggagtaggtttacgtttacgggttgtatttttttggttatgattaggatagagcggcgttgggtatattaatagtttgtcgcgtgcgtagtggaatagtaatatttaggagttggttaatcgattgcgaatcgattaggtgttggataatcgttaatcgttatgtagagaaagcggtaatagtaggtagtaagcggtaagtcgatgttgcgtttacgtaatttattttttacgtcgtattgattttacgttggtttgtacgtggggcgttaataacgacgtgattatatcgttcgatttcgcgtttgttatattacgatatgttttgtacgtcgtggtagattatcgtaattgtcgatcgttatttttggatttgattggaagtcgcgatattcgttagtcgtgtgataaatacgtcgggcgtggtattgatatgttatgtatggttagaatatatgtttcgattatcgataatcgttttttgttgaatatatagcggcgcgtggcgttggtataggcgtagtttggcgatatcgtagtagcgtagcggacgtttaataagttgatttcgtaggtaaaattttagttatcgtcgatggaaagcgcgatggtgttgcgtgtatggtgcgaagtttgaagttgtagcgggcgatttaacgtaggcgttggaaatttataaagacgttatggtcgtattcggtgtgattacgacgcgttcgtaggataacgatattttattcgattgattcgtaacgacgagaaagatgattggttgaaacgtggcgtgcgtagcgatgcggcggatttttatcgttagtaggatttaacgttatttttgagtacgattattggggttcgagcggtatcggtggttatttcgatttgaaagcgtatattattatgttgtaggtggatgcg

SEQ ID NO: 25052 - DNA, 1425 bp, Artificial Sequence
  chemically treated genomic DNA (Homo sapiens) CpG-island No: 25052
cgcatccacctacaacataataatatacgctttcaaatcgaaataaccaccgataccgctcgaaccccaataatcgtactcaaaaataacgttaaatcctactaacgataaaaatccgccgcatcgctacgcacgccacgtttcaaccaatcatctttctcgtcgttacgaatcaatcgaataaaatatcgttatcctacgaacgcgtcgtaatcacaccgaatacgaccataacgtctttataaatttccaacgcctacgttaaatcgcccgctacaacttcaaacttcgcaccatacacgcaacaccatcgcgctttccatcgacgataactaaaattttacctacgaaatcaacttattaaacgtccgctacgctactacgatatcgccaaactacgcctataccaacgccacgcgccgctatatattcaacaaaaaacgattatcgataatcgaaacatatattctaaccatacataacatatcaataccacgcccgacgtatttatcacacgactaacgaatatcgcgacttccaatcaaatccaaaaataacgatcgacaattacgataatctaccacgacgtacaaaacatatcgtaatataacaaacgcgaaatcgaacgatataatcacgtcgttattaacgccccacgtacaaaccaacgtaaaatcaatacgacgtaaaaaataaattacgtaaacgcaacatcgacttaccgcttactacctactattaccgctttctctacataacgattaacgattatccaacacctaatcgattcgcaatcgattaaccaactcctaaatattactattccactacgcacgcgacaaactattaatatacccaacgccgctctatcctaatcataaccaaaaaaatacaacccgtaaacgtaaacctactccgaatcgttcgacttctactacgccaaattacgcattaacgtatcgacctaactacgttatccgacctaccaaaaatcctacgaaaatcgataaataatccatacgctaccgaaatccaacgccaatcgttaccgctaaaatactaccgcctacgcccatttaccctaattttccaatacctctacctactataccaaacgatcgttttacaaactacgttcgatatcatcaatactacgccgctaactaacaaaaaacgaaacgataaacgcttcaactttttctaacgattactaacgataaatatttaccaacccgcgcacgacgttaatattaccgctatccatacgcaaaatctactaataataacgttcgacgacgaaataatcttttcgcgccatcgccacatcgcccaaccccaacactacataactatcgatattatcgacattacgcgcctactaaaacaaacgttctacccgatcaaaattattaactttcaacgcaa

SEQ ID NO: 25053 - DNA, 521 bp, Artificial Sequence
  chemically treated genomic DNA (Homo sapiens) CpG-island No: 25053
agggcgttcgttaattgggcgttcgtattgaagttattcgtattgtggtattttcgttgaacggttgtatggcggtattggcgggaattgtgtttgttttcgtagattggttttatttttaattagatcggtatcgggttggagatgaaagtaattgtagtttgcgtgttgggcggtattagtttgttcggtggtttcggtgcgattattggtgcggtattcggcgtatggtttttgacgtagatcgatagcgtattggtgttgttgcgtatttcggtatggtggaatgattttatcgcgggtttggttttgttggcggtgttggtgtttgatggacgtttgcgttgtgcgttggaacgtaatttacggcggtaaaaatatgttcgttttatgacgttatcgttattcgttaaattcgtttcgttaggtaaaaaacgggaggtcgtataatgcgtattcgttacggttgggaattggtttttgtcgtattgttcgttattgagattgtcgtatttggtgta

SEQ ID NO: 25054 - DNA, 521 bp, Artificial Sequence
  chemically treated genomic DNA (Homo sapiens) CpG-island No: 25054
tacaccaaatacgacaatctcaataacgaacaatacgacaaaaaccaattcccaaccgtaacgaatacgcattatacgacctcccgttttttacctaacgaaacgaatttaacgaataacgataacgtcataaaacgaacatatttttaccgccgtaaattacgttccaacgcacaacgcaaacgtccatcaaacaccaacaccgccaacaaaaccaaacccgcgataaaatcattccaccataccgaaatacgcaacaacaccaatacgctatcgatctacgtcaaaaaccatacgccgaataccgcaccaataatcgcaccgaaaccaccgaacaaactaataccgcccaacacgcaaactacaattactttcatctccaacccgataccgatctaattaaaaataaaaccaatctacgaaaacaaacacaattcccgccaataccgccatacaaccgttcaacgaaaataccacaatacgaataacttcaatacgaacgcccaattaacgaacgccct

SEQ ID NO: 25055 - DNA, 521 bp, Artificial Sequence
  chemically treated genomic DNA (Homo sapiens) CpG-island No: 25055
tgtattaaatgcgataattttaataacgagtagtgcggtaagagttagtttttaatcgtagcgaatacgtattatgcggtttttcgttttttatttgacgaagcgggtttaacggatggcggtggcgttataaagcgggtatatttttgtcgtcgtagattacgttttagcgtataacgtaggcgtttattaaatattagtatcgttagtagaattagattcgcgataaaattattttattatgtcggaatgcgtaatagtattagtacgttatcgatttgcgttaggaattatgcgtcgagtatcgtattaatgatcgtatcggaattatcgagtaaattaatgtcgtttagtacgtaggttgtaattgtttttatttttagttcggtatcggtttggttggggataaaattaatttgcgagagtaaatataattttcgttagtgtcgttatgtagtcgtttaacgaaaatgttataatgcgaatggttttagtacgaacgtttagttgacgagcgtttt

SEQ ID NO: 25056 - DNA, 521 bp, Artificial Sequence
  chemically treated genomic DNA (Homo sapiens) CpG-island No: 25056
aaaacgctcgtcaactaaacgttcgtactaaaaccattcgcattataacattttcgttaaacgactacataacgacactaacgaaaattatatttactctcgcaaattaattttatccccaaccaaaccgataccgaactaaaaataaaaacaattacaacctacgtactaaacgacattaatttactcgataattccgatacgatcattaatacgatactcgacgcataattcctaacgcaaatcgataacgtactaatactattacgcattccgacataataaaataattttatcgcgaatctaattctactaacgatactaatatttaataaacgcctacgttatacgctaaaacgtaatctacgacgacaaaaatatacccgctttataacgccaccgccatccgttaaacccgcttcgtcaaataaaaaacgaaaaaccgcataatacgtattcgctacgattaaaaactaactcttaccgcactactcgttattaaaattatcgcatttaataca

SEQ ID NO: 25057 - DNA, 510 bp, Artificial Sequence
  chemically treated genomic DNA (Homo sapiens) CpG-island No: 25057
taatagcgcgttaaagtaggtacggttatatcgtcgtcgttgtagttattgacgaagacggaattaggtttttaggcgtcggtttatgcggtgcgcgcgggagaggtcgcgcgtttatatcgtcgcgttaaggtcgtattggttgtcgttggtaagttgtagcgtttgtttttttgatgtgaaacgcgtgattattagtatcggatcgaaaattttttcgcgatttaaggacgtattcgggtttatatttataaagatgtcgggtcgatgcggtagttagttcggcgttacggttatttaataatagttgttttttgttttcgttttttcgaataaagttatggatcgagtcggcgtgggcgtagtcgattaaggtgtttatggtggttgcgggattaagtggattgttcggttgttagttttgcgtttgttgttttaatagggttaagaatttatcgggcgaatgttttttttttaataataagggcgtttcgggaattttatattgtt

SEQ ID NO: 25058 - DNA, 510 bp, Artificial Sequence
  chemically treated genomic DNA (Homo sapiens) CpG-island No: 25058
aacaatataaaattcccgaaacgcccttattattaaaaaaaaaacattcgcccgataaattcttaaccctattaaaacaacaaacgcaaaactaacaaccgaacaatccacttaatcccgcaaccaccataaacaccttaatcgactacgcccacgccgactcgatccataactttattcgaaaaaacgaaaacaaaaaacaactattattaaataaccgtaacgccgaactaactaccgcatcgacccgacatctttataaatataaacccgaatacgtccttaaatcgcgaaaaaattttcgatccgatactaataatcacgcgtttcacatcaaaaaaacaaacgctacaacttaccaacgacaaccaatacgaccttaacgcgacgatataaacgcgcgacctctcccgcgcgcaccgcataaaccgacgcctaaaaacctaattccgtcttcgtcaataactacaacgacgacgatataaccgtacctactttaacgcgctatta

SEQ ID NO: 25059 - DNA, 510 bp, Artificial Sequence
  chemically treated genomic DNA (Homo sapiens) CpG-island No: 25059
aatagtgtggaattttcgaaacgtttttgttgttggaaagagagtattcgttcgatgaatttttagttttgttaaaatagtaggcgtaaaattggtagtcgggtaatttatttgatttcgtaattattatgggtattttaatcgattgcgtttacgtcgattcggtttatagttttattcgggaaggcgaaagtaaagggtaattgttgttggatggtcgtaacgtcgggttggttgtcgtatcggttcgatatttttgtggatgtggattcgaatgcgtttttaagtcgcgaagagattttcggttcggtgttggtggttacgcgttttatattagaagaataggcgttatagtttgttaacgatagttagtacggttttggcgcggcggtatggacgcgcgatttttttcgcgcgtatcgtatgagtcgacgtttgaaagtttggtttcgttttcgttaataattataacgacggcgatatgatcgtgtttgttttggcgcgttgttg

SEQ ID NO: 25060 - DNA, 510 bp, Artificial Sequence
  chemically treated genomic DNA (Homo sapiens) CpG-island No: 25060
caacaacgcgccaaaacaaacacgatcatatcgccgtcgttataattattaacgaaaacgaaaccaaactttcaaacgtcgactcatacgatacgcgcgaaaaaaatcgcgcgtccataccgccgcgccaaaaccgtactaactatcgttaacaaactataacgcctattcttctaatataaaacgcgtaaccaccaacaccgaaccgaaaatctcttcgcgacttaaaaacgcattcgaatccacatccacaaaaatatcgaaccgatacgacaaccaacccgacgttacgaccatccaacaacaattaccctttactttcgccttcccgaataaaactataaaccgaatcgacgtaaacgcaatcgattaaaatacccataataattacgaaatcaaataaattacccgactaccaattttacgcctactattttaacaaaactaaaaattcatcgaacgaatactctctttccaacaacaaaaacgtttcgaaaattccacactatt

SEQ ID NO: 25061 - DNA, 572 bp, Artificial Sequence
  chemically treated genomic DNA (Homo sapiens) CpG-island No: 25061
cgttagcggcgtgcgtaagtcgtgatttattttcgttattagtagcgtgcggttattcgttagttgtttaatattagtcgttatatggttaaaggtacgggtaacggaacgtattttcgaagcgttatatttacgtagcggcggcggaataatttttttattaatttgtaaggttgcgtgttcgagatcgattaacggtcggttttggatacgaataaatagttacgtttcgtttatcgttaatagtataatcgttagcgtatagcggaatagcggagagaaatcgttttgatgaatttcggttagcggtacgcgtatttagatattgggcgatagttaggtttttagttagacgataggcgaatttttgttgattttaacgcgtattttcgtcgggtcgtttagttgttgcgttatttgatggtttaagaatttatagtgttgcgtttaacgtagatttgttttttcggtagtttcgttggagtagagagagatttttagtttacggtagatttttcgacggaaagcgggaggtataattaattgcgtgtcgttttttagttgtagtttgt

SEQ ID NO: 25062 - DNA, 572 bp, Artificial Sequence
  chemically treated genomic DNA (Homo sapiens) CpG-island No: 25062
acaaactacaactaaaaaacgacacgcaattaattatacctcccgctttccgtcgaaaaatctaccgtaaactaaaaatctctctctactccaacgaaactaccgaaaaaacaaatctacgttaaacgcaacactataaattcttaaaccatcaaataacgcaacaactaaacgacccgacgaaaatacgcgttaaaatcaacaaaaattcgcctatcgtctaactaaaaacctaactatcgcccaatatctaaatacgcgtaccgctaaccgaaattcatcaaaacgatttctctccgctattccgctatacgctaacgattatactattaacgataaacgaaacgtaactatttattcgtatccaaaaccgaccgttaatcgatctcgaacacgcaaccttacaaattaataaaaaaattattccgccgccgctacgtaaatataacgcttcgaaaatacgttccgttacccgtacctttaaccatataacgactaatattaaacaactaacgaataaccgcacgctactaataacgaaaataaatcacgacttacgcacgccgctaacg

SEQ ID NO: 25063 - DNA, 572 bp, Artificial Sequence
  chemically treated genomic DNA (Homo sapiens) CpG-island No: 25063
ataaattgtaattggaggacggtacgtagttggttgtgtttttcgtttttcgtcgggagatttatcgtgagttggggatttttttttattttaacgaggttgtcgaagaggtaggtttgcgttgggcgtaatattatgaatttttaagttattagatggcgtagtaattgggcggttcgacggaagtgcgcgttgaggttaataaaagttcgtttgtcgtttggttgaaaatttggttgtcgtttaatatttgggtacgcgtgtcgttgatcgaaatttattagggcgattttttttcgttgtttcgttatacgttggcgattatgttattggcgataggcggggcgtggttgtttattcgtatttagaatcgatcgttggtcgatttcgaatacgtagttttgtaggttggtaaagggattatttcgtcgtcgttgcgtgagtatggcgtttcggaggtgcgtttcgttattcgtgtttttaattatatggcggttggtgttaagtaattggcggatgatcgtacgttgttgatggcgggggtaagttacgatttgcgtacgtcgttgacg

SEQ ID NO: 25064 - DNA, 572 bp, Artificial Sequence
  chemically treated genomic DNA (Homo sapiens) CpG-island No: 25064
cgtcaacgacgtacgcaaatcgtaacttacccccgccatcaacaacgtacgatcatccgccaattacttaacaccaaccgccatataattaaaaacacgaataacgaaacgcacctccgaaacgccatactcacgcaacgacgacgaaataatccctttaccaacctacaaaactacgtattcgaaatcgaccaacgatcgattctaaatacgaataaacaaccacgccccgcctatcgccaataacataatcgccaacgtataacgaaacaacgaaaaaaaatcgccctaataaatttcgatcaacgacacgcgtacccaaatattaaacgacaaccaaattttcaaccaaacgacaaacgaacttttattaacctcaacgcgcacttccgtcgaaccgcccaattactacgccatctaataacttaaaaattcataatattacgcccaacgcaaacctacctcttcgacaacctcgttaaaataaaaaaaaatccccaactcacgataaatctcccgacgaaaaacgaaaaacacaaccaactacgtaccgtcctccaattacaatttat

SEQ ID NO: 25065 - DNA, 501 bp, Artificial Sequence
  chemically treated genomic DNA (Homo sapiens) CpG-island No: 25065
atgaaaaagagtgcgttaaacgcggtgatgattattaggagatttttgtttagtaggttcgggaaattatggagcgtcgtgttgcgggtttgaaattatcggtatgggtcgttgtagtttttgaggtcggagtgaaaaaattaaacgaggaggagtaagatggcgtacgagttgcgtaatttttcgtatattgttattcgattagagttaatttagttggtatttttttaggttgttttcgttttttggaaattgaatcgggttttcgaaggaagcgtgattacgcggcggataatcgtttttttaagttagtaaagaaatatttgataggtttgtcgggatgttataaatttgcgacgttttataaagtacgtttaggattcgttagtatttgcgcgtgcggtcgagtagttattgcgaatagtttcgcgaaagttgtttatacgatatattaagtttagcggtaatataacgtagtagggattgtttaaaagtcgagta

SEQ ID NO: 25066 - DNA, 501 bp, Artificial Sequence
  chemically treated genomic DNA (Homo sapiens) CpG-island No: 25066
tactcgacttttaaacaatccctactacgttatattaccgctaaacttaatatatcgtataaacaactttcgcgaaactattcgcaataactactcgaccgcacgcgcaaatactaacgaatcctaaacgtactttataaaacgtcgcaaatttataacatcccgacaaacctatcaaatatttctttactaacttaaaaaaacgattatccgccgcgtaatcacgcttccttcgaaaacccgattcaatttccaaaaaacgaaaacaacctaaaaaaataccaactaaattaactctaatcgaataacaatatacgaaaaattacgcaactcgtacgccatcttactcctcctcgtttaattttttcactccgacctcaaaaactacaacgacccataccgataatttcaaacccgcaacacgacgctccataatttcccgaacctactaaacaaaaatctcctaataatcatcaccgcgtttaacgcactctttttcat

SEQ ID NO: 25067 - DNA, 501 bp, Artificial Sequence
  chemically treated genomic DNA (Homo sapiens) CpG-island No: 25067
tattcgatttttgaatagtttttgttgcgttatattgtcgttgggtttggtgtgtcgtatgagtagttttcgcgaaattattcgtaatagttattcgatcgtacgcgtaagtgttaacgagttttgggcgtattttatggggcgtcgtaagtttgtggtatttcgataggtttgttagatgtttttttgttggtttgaagaggcgattgttcgtcgcgtggttacgtttttttcgaaagttcggtttagtttttaggaggcgagaatagtttgggggaatgttaattggattggttttggtcgaatggtaatatgcggaagattacgtagttcgtgcgttattttgttttttttcgtttgatttttttatttcggttttaaaagttgtagcggtttatgtcggtggttttagattcgtagtacgacgttttatggtttttcggatttgttgggtaaaaattttttgataattattatcgcgtttggcgtatttttttttat

SEQ ID NO: 25068 - DNA, 501 bp, Artificial Sequence
  chemically treated genomic DNA (Homo sapiens) CpG-island No: 25068
ataaaaaaaaatacgccaaacgcgataataattatcaaaaaatttttacccaacaaatccgaaaaaccataaaacgtcgtactacgaatctaaaaccaccgacataaaccgctacaacttttaaaaccgaaataaaaaaatcaaacgaaaaaaaacaaaataacgcacgaactacgtaatcttccgcatattaccattcgaccaaaaccaatccaattaacattcccccaaactattctcgcctcctaaaaactaaaccgaactttcgaaaaaaacgtaaccacgcgacgaacaatcgcctcttcaaaccaacaaaaaaacatctaacaaacctatcgaaataccacaaacttacgacgccccataaaatacgcccaaaactcgttaacacttacgcgtacgatcgaataactattacgaataatttcgcgaaaactactcatacgacacaccaaacccaacgacaatataacgcaacaaaaactattcaaaaatcgaata

SEQ ID NO: 25069 - DNA, 573 bp, Artificial Sequence
  chemically treated genomic DNA (Homo sapiens) CpG-island No: 25069
  misc_feature (93)..(93): n is either a, c, g or t
atcgcggcgatgacgttaaattttagatcgtttgcggtatttgcgttattagaatcgaggcgcgtcgttaataaaatgtcggttatcgtcgtntataatttcgaaagggtaaagataagaatgcgtattcgacgaacgttgatgtcgtataattgcgtcgtcgtagtattatcgttaacggtaaaaatcgagcgttcgaaggcggttttgcggttgatgaatataaatagcgtaaataatataattatgattagcgcggatatcggtatatcgagaaattgttcgtttagttagtttagtatttcgtttttattaatcggtattggtagtgcgttcgttataaatagttttatttcgcgtagggcgttttatagttttagtgtggtaacgaaatttggtatattaaatacgtcgcgtagtatttcggttagcgtttttattagcgcgtttaatagtaatattagtaggtacgttatcgttagcggaattttaaattgtagtaaaaatgttaggtatatcgagataaaagttatttatcggtttaacgttgatattaattttatcggagataat

SEQ ID NO: 25070 - DNA, 573 bp, Artificial Sequence
  chemically treated genomic DNA (Homo sapiens) CpG-island No: 25070
  misc_feature (481)..(481): n is either a, c, g or t
attatctccgataaaattaatatcaacgttaaaccgataaataacttttatctcgatatacctaacatttttactacaatttaaaattccgctaacgataacgtacctactaatattactattaaacgcgctaataaaaacgctaaccgaaatactacgcgacgtatttaatataccaaatttcgttaccacactaaaactataaaacgccctacgcgaaataaaactatttataacgaacgcactaccaataccgattaataaaaacgaaatactaaactaactaaacgaacaatttctcgatataccgatatccgcgctaatcataattatattatttacgctatttatattcatcaaccgcaaaaccgccttcgaacgctcgatttttaccgttaacgataatactacgacgacgcaattatacgacatcaacgttcgtcgaatacgcattcttatctttaccctttcgaaattatanacgacgataaccgacattttattaacgacgcgcctcgattctaataacgcaaataccgcaaacgatctaaaatttaacgtcatcgccgcgat

SEQ ID NO: 25071 - DNA, 573 bp, Artificial Sequence
  chemically treated genomic DNA (Homo sapiens) CpG-island No: 25071
  misc_feature (481)..(481): n is either a, c, g or t
attattttcggtgaaattgatgttagcgttgggtcgatgggtggtttttgtttcggtgtgtttggtatttttgttgtaatttgaagtttcgttggcggtggcgtgtttgttggtgttgttgttaggcgcgttgatgggaacgttggtcggggtgttgcgcggcgtgtttaatgtattaagtttcgttgttatattggggttgtggagcgttttgcgcggaatggggttgtttatgacgaacgtattgttagtgtcgattgatgaaaacgaggtgttggattggttgggcggataatttttcggtgtgtcggtattcgcgttgattatgattgtgttgtttgcgttgtttgtgtttattagtcgtaaaatcgttttcgggcgttcggtttttgtcgttggcggtaatgttacggcggcgtagttgtgcggtattaacgttcgtcgggtgcgtatttttatttttattttttcgggattatangcggcggtgatcggtattttgttggcggcgcgtttcggttttggtaacgtaggtgtcgtaaacggtttggagtttgacgttatcgtcgcggt

SEQ ID NO: 25072 - DNA, 573 bp, Artificial Sequence
  chemically treated genomic DNA (Homo sapiens) CpG-island No: 25072
  misc_feature (93)..(93): n is either a, c, g or t
accgcgacgataacgtcaaactccaaaccgtttacgacacctacgttaccaaaaccgaaacgcgccgccaacaaaataccgatcaccgccgcntataatcccgaaaaaataaaaataaaaatacgcacccgacgaacgttaataccgcacaactacgccgccgtaacattaccgccaacgacaaaaaccgaacgcccgaaaacgattttacgactaataaacacaaacaacgcaaacaacacaatcataatcaacgcgaataccgacacaccgaaaaattatccgcccaaccaatccaacacctcgttttcatcaatcgacactaacaatacgttcgtcataaacaaccccattccgcgcaaaacgctccacaaccccaatataacaacgaaacttaatacattaaacacgccgcgcaacaccccgaccaacgttcccatcaacgcgcctaacaacaacaccaacaaacacgccaccgccaacgaaacttcaaattacaacaaaaataccaaacacaccgaaacaaaaaccacccatcgacccaacgctaacatcaatttcaccgaaaataat

SEQ ID NO: 25073 - DNA, 753 bp, Artificial Sequence
  chemically treated genomic DNA (Homo sapiens) CpG-island No: 25073
gcgatggatttgttgatttattacgattggtcgggaaatattcgtgagttggaaaacgcggtggaacgggtagtggtgttgttgatcggggaatatattttcgaacgcgagttgtcgttggcgattgttagtacgtcgatttcgttgggataaagttaggatatttagtcgttggtggaagtggaaaaagaggtgattttggcggcgttggagaaaacgggcggtaataaaatcgaagtcgttcgttagttagggattacgcgtaaaacgttattggtaaaattgtcgcgttagttttgttcgcgttcgatagcgcgttagtcgatattttttcggtagaagtagtcgttttagtggatatcggttattaaggtataggcgcgtttttgcgtttttgttacggtatgatttagcgcggtgacgtatagtacgcgttcgtcgttggttattatttgttcgttattcgttagttttgtgttcgcgtggaatattttgtcgtttgttattttttttagcggtaggtcgtggattacgttatcggtgcggtaattattcggatatttattcgtagttattattacgtcgagagaagcgcgtttattttattcggacgttttttcgtttagtttgtttttataggtcgttaggtagagtttaattagatcggattttatgcgtagtataatcggttgggttttcggatcgttaaagcggtagttaaatttaataattttcggattgttttgtttgtcg

SEQ ID NO: 25074 - DNA, 753 bp, Artificial Sequence
  chemically treated genomic DNA (Homo sapiens) CpG-island No: 25074
cgacaaacaaaacaatccgaaaattattaaatttaactaccgctttaacgatccgaaaacccaaccgattatactacgcataaaatccgatctaattaaactctacctaacgacctataaaaacaaactaaacgaaaaaacgtccgaataaaataaacgcgcttctctcgacgtaataataactacgaataaatatccgaataattaccgcaccgataacgtaatccacgacctaccgctaaaaaaaataacaaacgacaaaatattccacgcgaacacaaaactaacgaataacgaacaaataataaccaacgacgaacgcgtactatacgtcaccgcgctaaatcataccgtaacaaaaacgcaaaaacgcgcctataccttaataaccgatatccactaaaacgactacttctaccgaaaaaatatcgactaacgcgctatcgaacgcgaacaaaactaacgcgacaattttaccaataacgttttacgcgtaatccctaactaacgaacgacttcgattttattaccgcccgttttctccaacgccgccaaaatcacctctttttccacttccaccaacgactaaatatcctaactttatcccaacgaaatcgacgtactaacaatcgccaacgacaactcgcgttcgaaaatatattccccgatcaacaacaccactacccgttccaccgcgttttccaactcacgaatatttcccgaccaatcgtaataaatcaacaaatccatcgc

SEQ ID NO: 25075 - DNA, 753 bp, Artificial Sequence
  chemically treated genomic DNA (Homo sapiens) CpG-island No: 25075
cgataaatagggtaattcgaaggttattgaatttaattgtcgttttggcgattcggaaatttagtcgattatgttgcgtatgaagttcgatttggttgagttttgtttggcggtttgtgaaagtaaattggacgagaaaacgttcgagtgggatgaacgcgtttttttcggcgtggtgatggttgcgggtggatattcgggtgattatcgtatcggtgacgtgatttacggtttgtcgttggaagaagtggtaggcggtaaagtgttttacgcgggtataaaattggcggatgacgagtaggtagtgattaacggcgggcgcgtattgtgcgttatcgcgttgggttatatcgtggtagaagcgtagaaacgcgtttatgttttaatgatcgatatttattgggacgattgtttttgtcggaaagatatcggttggcgcgttatcgaacgcgagtagaattaacgcgatagttttgttaatagcgttttgcgcgtgatttttaattgacgggcggtttcggttttgttgtcgttcgttttttttagcgtcgttagaattatttttttttttatttttattaacggttgaatattttgattttgttttagcgggatcggcgtattggtaatcgttagcggtagttcgcgttcggaaatatatttttcggttagtagtattattgttcgttttatcgcgttttttagtttacgaatatttttcggttagtcgtaatgaattaatagatttatcgt

SEQ ID NO: 25076 - DNA, 753 bp, Artificial Sequence
  chemically treated genomic DNA (Homo sapiens) CpG-island No: 25076
acgataaatctattaattcattacgactaaccgaaaaatattcgtaaactaaaaaacgcgataaaacgaacaataatactactaaccgaaaaatatatttccgaacgcgaactaccgctaacgattaccaatacgccgatcccgctaaaacaaaatcaaaatattcaaccgttaataaaaataaaaaaaaaaataattctaacgacgctaaaaaaaacgaacgacaacaaaaccgaaaccgcccgtcaattaaaaatcacgcgcaaaacgctattaacaaaactatcgcgttaattctactcgcgttcgataacgcgccaaccgatatctttccgacaaaaacaatcgtcccaataaatatcgatcattaaaacataaacgcgtttctacgcttctaccacgatataacccaacgcgataacgcacaatacgcgcccgccgttaatcactacctactcgtcatccgccaattttatacccgcgtaaaacactttaccgcctaccacttcttccaacgacaaaccgtaaatcacgtcaccgatacgataatcacccgaatatccacccgcaaccatcaccacgccgaaaaaaacgcgttcatcccactcgaacgttttctcgtccaatttactttcacaaaccgccaaacaaaactcaaccaaatcgaacttcatacgcaacataatcgactaaatttccgaatcgccaaaacgacaattaaattcaataaccttcgaattaccctatttatcg

SEQ ID NO: 25077 - DNA, 865 bp, Artificial Sequence
  chemically treated genomic DNA (Homo sapiens) CpG-island No: 25077
tattacggttatgcgcgtttcggtattgcggatatattttggggttcgcgcgatgtgtcggtgacggattttttcggtaatcggttgacgtttattaacgtcgttagtatttgtagcgtttttagtatagatttcgcgtcgtcgattttattttatgtagtagttgtcgcgttttcggtgatattagatgtttttcgcgggtgatgatgtcgaaggcgtttatatggtagggtaggtcgatgggtaggatggttagtacgtttagcgacgcgtagtagcgcgttatttttatcggtattatatgtagtgaattagtttgttgtagtagggtcgtgatgagtagtagggtcgtcgtgtcgacgttgttggacggcggttttagcgcggttcggcggaatattagtttttagcgatggcgtagtacgttgtcggtgggcggtaggatttagggttggtcggttaggttagcgagtttgaggttgttttttttgagtagcggatgatttacgcgcgttacggcgtaggcgggttcgacggttaatttttcgtagtgtaggtcggcggcgttttttttttcgacgatgcggtcgattatgaagtttaatttgtttcgttgtagtatgtttagtaattgtttgttcgattttatgtgtacgtcgatgcgtaagcggggcgtttgtagtttgatgcgcgaaatggcgcgcggtagtagatttatggtcggggttatgatgacgtttatttcgatttggtcggttaagtcgttttttagcgagacgatgtcgtcgtgcgttgtcgatagcgaggttagggttatgcgcgtatggcggattatggtttcgtcgtatagcgtgggttttatgtt

SEQ ID NO: 25078 - DNA, 865 bp, Artificial Sequence
  chemically treated genomic DNA (Homo sapiens) CpG-island No: 25078
aacataaaacccacgctatacgacgaaaccataatccgccatacgcgcataaccctaacctcgctatcgacaacgcacgacgacatcgtctcgctaaaaaacgacttaaccgaccaaatcgaaataaacgtcatcataaccccgaccataaatctactaccgcgcgccatttcgcgcatcaaactacaaacgccccgcttacgcatcgacgtacacataaaatcgaacaaacaattactaaacatactacaacgaaacaaattaaacttcataatcgaccgcatcgtcgaaaaaaaaaacgccgccgacctacactacgaaaaattaaccgtcgaacccgcctacgccgtaacgcgcgtaaatcatccgctactcaaaaaaaacaacctcaaactcgctaacctaaccgaccaaccctaaatcctaccgcccaccgacaacgtactacgccatcgctaaaaactaatattccgccgaaccgcgctaaaaccgccgtccaacaacgtcgacacgacgaccctactactcatcacgaccctactacaacaaactaattcactacatataataccgataaaaataacgcgctactacgcgtcgctaaacgtactaaccatcctacccatcgacctaccctaccatataaacgccttcgacatcatcacccgcgaaaaacatctaatatcaccgaaaacgcgacaactactacataaaataaaatcgacgacgcgaaatctatactaaaaacgctacaaatactaacgacgttaataaacgtcaaccgattaccgaaaaaatccgtcaccgacacatcgcgcgaaccccaaaatatatccgcaataccgaaacgcgcataaccgtaata

SEQ ID NO: 25079 - DNA, 865 bp, Artificial Sequence
  chemically treated genomic DNA (Homo sapiens) CpG-island No: 25079
ggtatggagtttacgttgtacggcgagattatgattcgttatgcgcgtatggttttgatttcgttgtcggtagcgtacgacgatatcgtttcgttgaagaacggtttggtcggttaggtcgaagtgggcgttattatgatttcggttatgggtttgttgtcgcgcgttatttcgcgtattaagttgtaggcgtttcgtttgcgtatcggcgtgtatatggagtcgagtaagtagttgttggatatgttgtagcggggtaagttggattttatgatcggtcgtatcgtcgaagaggaagacgtcgtcggtttgtattacgaggagttgatcgtcgagttcgtttgcgtcgtggcgcgcgtaggttattcgttgtttaaggaagataattttaagttcgttgatttggtcgattagttttggattttgtcgtttatcggtagcgtgttgcgttatcgttgggagttgatgtttcgtcgagtcgcgttggagtcgtcgtttaataacgtcgatacgacggttttgttgtttattacggttttgttgtagtagattgatttattgtatgtgatgtcggtggaggtggcgcgttattacgcgtcgttgaacgtgttggttattttgtttatcgatttgttttgttatatggacgttttcggtattattattcgcgaggggtatttgatgttatcgggggcgcggtagttgttgtatgaggtgaggtcggcggcgcgggatttgtattgaaggcgttataggtattgacggcgttggtgaacgttagtcggttgtcgaagggattcgttatcgatatatcgcgcgaattttagggtgtgttcgtaatgtcggggcgcgtatggtcgtagtg

SEQ ID NO: 25080 - DNA, 865 bp, Artificial Sequence
  chemically treated genomic DNA (Homo sapiens) CpG-island No: 25080
cactacgaccatacgcgccccgacattacgaacacaccctaaaattcgcgcgatatatcgataacgaatcccttcgacaaccgactaacgttcaccaacgccgtcaatacctataacgccttcaatacaaatcccgcgccgccgacctcacctcatacaacaactaccgcgcccccgataacatcaaatacccctcgcgaataataataccgaaaacgtccatataacaaaacaaatcgataaacaaaataaccaacacgttcaacgacgcgtaataacgcgccacctccaccgacatcacatacaataaatcaatctactacaacaaaaccgtaataaacaacaaaaccgtcgtatcgacgttattaaacgacgactccaacgcgactcgacgaaacatcaactcccaacgataacgcaacacgctaccgataaacgacaaaatccaaaactaatcgaccaaatcaacgaacttaaaattatcttccttaaacaacgaataacctacgcgcgccacgacgcaaacgaactcgacgatcaactcctcgtaatacaaaccgacgacgtcttcctcttcgacgatacgaccgatcataaaatccaacttaccccgctacaacatatccaacaactacttactcgactccatatacacgccgatacgcaaacgaaacgcctacaacttaatacgcgaaataacgcgcgacaacaaacccataaccgaaatcataataacgcccacttcgacctaaccgaccaaaccgttcttcaacgaaacgatatcgtcgtacgctaccgacaacgaaatcaaaaccatacgcgcataacgaatcataatctcgccgtacaacgtaaactccatacc

SEQ ID NO: 25081 - DNA, 1002 bp, Artificial Sequence
  chemically treated genomic DNA (Homo sapiens) CpG-island No: 25081
ttcgcgttttacgtcgtattgtcgttttcgttgataagcgttagcggtagttttcggtggtcgtagtgataaagatgagtttttcgcgtcggtgtgtatttcggttttatttgtttggttagttgttttatcgttagttcgtattgcgtaagttacgttcggtttttattgtttacgcggtttgttcggatttttttttttagtttgtttagtagtcgtattagtttagtcgggaatattacgtcgtggtcgtttttattttttttttgttggagcgtttttgttaggttgcgtcgttgcgttttttttcgttcgtcgttttttgtttcgattcggatgagcggcgtgaagtttttcggttcgtatatcgtttggatacgtgtggtgttagtttgtatcgtcgttagtttgttttcgttttagttatattacgttattttcggtttacgcgatagcgatatttatttcgttaggttacgttttcgtcgttagattcgttttgttattcgtcgttttagcgggtcgtagaggtagcggttttcgattagtggttcgttatgttgtattcgcgtgtagaatattaggcggtgttggttgtcgtagtggtagtggtgggttcgttcgtcgttcgttcgtattatattcgtcgggatgcggttcgtttttttcgttagtttgtcgtatttatcgtggcggtagatatagtgcgtatttttcgcgatgcggttattcggttatattgtgagtgtattgttcgggtgtagtttcgggttcggtagtcggttgttcgtcgggttcgtggtatacgggatgcggatgtttaggtttggtgcgagggtgcgtatattttttagtttgttcgtggcgttgtagtcgtattttcgcgtttgtcgcgggtcgttgatgcgtattaggtcgtcgttgttattttattcgtagttacggttatatattaggttgtttaggtgttggttttgtaattggtttgcgggggtgtatgtg

SEQ ID NO: 25082 - DNA, 1002 bp, Artificial Sequence
  chemically treated genomic DNA (Homo sapiens) CpG-island No: 25082
cacatacacccccgcaaaccaattacaaaaccaacacctaaacaacctaatatataaccgtaactacgaataaaataacaacgacgacctaatacgcatcaacgacccgcgacaaacgcgaaaatacgactacaacgccacgaacaaactaaaaaatatacgcaccctcgcaccaaacctaaacatccgcatcccgtataccacgaacccgacgaacaaccgactaccgaacccgaaactacacccgaacaatacactcacaatataaccgaataaccgcatcgcgaaaaatacgcactatatctaccgccacgataaatacgacaaactaacgaaaaaaacgaaccgcatcccgacgaatataatacgaacgaacgacgaacgaacccaccactaccactacgacaaccaacaccgcctaatattctacacgcgaatacaacataacgaaccactaatcgaaaaccgctacctctacgacccgctaaaacgacgaataacaaaacgaatctaacgacgaaaacgtaacctaacgaaataaatatcgctatcgcgtaaaccgaaaataacgtaatataactaaaacgaaaacaaactaacgacgatacaaactaacaccacacgtatccaaacgatatacgaaccgaaaaacttcacgccgctcatccgaatcgaaacaaaaaacgacgaacgaaaaaaaacgcaacgacgcaacctaacaaaaacgctccaacaaaaaaaaaataaaaacgaccacgacgtaatattcccgactaaactaatacgactactaaacaaactaaaaaaaaaaatccgaacaaaccgcgtaaacaataaaaaccgaacgtaacttacgcaatacgaactaacgataaaacaactaaccaaacaaataaaaccgaaatacacaccgacgcgaaaaactcatctttatcactacgaccaccgaaaactaccgctaacgcttatcaacgaaaacgacaatacgacgtaaaacgcgaa

SEQ ID NO: 25083 - DNA, 1002 bp, Artificial Sequence
  chemically treated genomic DNA (Homo sapiens) CpG-island No: 25083
tatatatattttcgtaggttagttatagagttagtatttgaatagtttggtgtatgatcgtgattacgggtggagtgataacggcgatttggtgcgtattagcggttcgcgatagacgcgggaatacggttatagcgttacgggtaggttggagagtgtgcgtattttcgtattagatttggatattcgtatttcgtatgttacggattcggcgggtaatcggttgtcggattcggagttgtattcggatagtatatttatagtgtggtcggataatcgtatcgcggaggatgcgtattatgtttatcgttacgatgaatacggtaggttgacggagaagacggatcgtatttcggcgggtgtgatacggacggacgacgagcggatttattattattattacgatagttagtatcgtttggtgttttatacgcggatatagtatggcgagttattggtcgagagtcgttatttttacgattcgttgggacggcgaatggtaaaacgggtttggcggcgggagcgtgatttgacggggtggatgtcgttgtcgcgtaaatcggaggtgacgtggtatggttgggacggagataggttgacgacggtgtagattgatattatacgtatttagacggtatacgagtcgggaagttttacgtcgtttattcgggtcgagatagagaacggcgagcgggaaaaagcgtagcggcgtagtttggtagagacgttttagtaggaagggagtgagaacggttacggcgtggtgttttcggttgaattggtgcggttgttggataggttggaggaagaaattcgggtagatcgcgtgagtagtgaaagtcgggcgtggtttgcgtagtgcgggttgacggtggagtaattggttagataggtggagtcggaatatatatcggcgcgaaaagtttatttttattattgcgattatcggggattgtcgttggcgtttattagcgaagacggtaatacggcgtggagcgcgga

SEQ ID NO: 25084 - DNA, 1002 bp, Artificial Sequence
  chemically treated genomic DNA (Homo sapiens) CpG-island No: 25084
tccgcgctccacgccgtattaccgtcttcgctaataaacgccaacgacaatccccgataatcgcaataataaaaataaacttttcgcgccgatatatattccgactccacctatctaaccaattactccaccgtcaacccgcactacgcaaaccacgcccgactttcactactcacgcgatctacccgaatttcttcctccaacctatccaacaaccgcaccaattcaaccgaaaacaccacgccgtaaccgttctcactcccttcctactaaaacgtctctaccaaactacgccgctacgctttttcccgctcgccgttctctatctcgacccgaataaacgacgtaaaacttcccgactcgtataccgtctaaatacgtataatatcaatctacaccgtcgtcaacctatctccgtcccaaccataccacgtcacctccgatttacgcgacaacgacatccaccccgtcaaatcacgctcccgccgccaaacccgttttaccattcgccgtcccaacgaatcgtaaaaataacgactctcgaccaataactcgccatactatatccgcgtataaaacaccaaacgatactaactatcgtaataataataataaatccgctcgtcgtccgtccgtatcacacccgccgaaatacgatccgtcttctccgtcaacctaccgtattcatcgtaacgataaacataatacgcatcctccgcgatacgattatccgaccacactataaatatactatccgaatacaactccgaatccgacaaccgattacccgccgaatccgtaacatacgaaatacgaatatccaaatctaatacgaaaatacgcacactctccaacctacccgtaacgctataaccgtattcccgcgtctatcgcgaaccgctaatacgcaccaaatcgccgttatcactccacccgtaatcacgatcatacaccaaactattcaaatactaactctataactaacctacgaaaatatatata

SEQ ID NO: 25085 - DNA, 537 bp, Artificial Sequence
  chemically treated genomic DNA (Homo sapiens) CpG-island No: 25085
  misc_feature (355)..(355): n is either a, c, g or t
ggggcgttggtgtcgatttacggtacgttggtgatttcgtttatcgcgttgttgatcgtcgtttcggtgagtttcggtatcgttttgtttttgattgagtttgcgtttggttggttgaaacgttcgttgggtatcgttattgagttgttggtagttattttaagtatcgtttacggtatgtggggtttgtttatttttgcgtcgttgttcgtcgtttatttttaggagtcggtcggtaatattatgtcgaatatttcgattgttggcgcgttgttttttggtttcgtatttggtatcggtattttcgcggtaggcgtgattttcgttattatgattatttcgtatattgcggcgngtatgcgtgatgtgttcgaataaatttcggtgatggataaagagtcggtttacggtattggttgtattatttgggaagttatttggcgtatcgttttttcgtttattaaaatggtgttatcggcggtattatgttgggttgggttcggcgttcggtgaaattatggcggtgattttattatt

SEQ ID NO: 25086 - DNA, 537 bp, Artificial Sequence
  chemically treated genomic DNA (Homo sapiens) CpG-island No: 25086
  misc_feature (183)..(183): n is either a, c, g or t
aataataaaatcaccgccataatttcaccgaacgccgaacccaacccaacataataccgccgataacaccattttaataaacgaaaaaacgatacgccaaataacttcccaaataatacaaccaataccgtaaaccgactctttatccatcaccgaaatttattcgaacacatcacgcatacncgccgcaatatacgaaataatcataataacgaaaatcacgcctaccgcgaaaataccgataccaaatacgaaaccaaaaaacaacgcgccaacaatcgaaatattcgacataatattaccgaccgactcctaaaaataaacgacgaacaacgacgcaaaaataaacaaaccccacataccgtaaacgatacttaaaataactaccaacaactcaataacgatacccaacgaacgtttcaaccaaccaaacgcaaactcaatcaaaaacaaaacgataccgaaactcaccgaaacgacgatcaacaacgcgataaacgaaatcaccaacgtaccgtaaatcgacaccaacgcccc

SEQ ID NO: 25087 - DNA, 537 bp, Artificial Sequence
  chemically treated genomic DNA (Homo sapiens) CpG-island No: 25087
  misc_feature (183)..(183): n is either a, c, g or t
aatgataaggttatcgttatggttttatcgagcgtcgggtttagtttagtatgatgtcgtcgataatattattttggtgaacggaagaacgatacgttagataattttttaggtggtgtagttaatatcgtaggtcgattttttatttattatcggggtttgttcgaatatattacgtatatncgtcgtaatgtacggaataattatgatggcgaggattacgtttgtcgcgaggatatcgatattaaatgcggggttagagaatagcgcgttaataatcgggatattcgatatgatattgtcgatcggtttttgaaagtaaacggcgaatagcggcgtaaagataaataggttttatatgtcgtaaacgatatttggaatggttgttagtagtttaatggcgatatttagcgggcgttttagttagttaggcgtaagtttagttaggaatagggcgatatcgaaatttatcgggacggcgattagtagcgcgataaacgaagttattaacgtatcgtagatcggtattagcgtttt

SEQ ID NO: 25088 - DNA, 537 bp, Artificial Sequence
  chemically treated genomic DNA (Homo sapiens) CpG-island No: 25088
  misc_feature (355)..(355): n is either a, c, g or t
aaaacgctaataccgatctacgatacgttaataacttcgtttatcgcgctactaatcgccgtcccgataaatttcgatatcgccctattcctaactaaacttacgcctaactaactaaaacgcccgctaaatatcgccattaaactactaacaaccattccaaatatcgtttacgacatataaaacctatttatctttacgccgctattcgccgtttactttcaaaaaccgatcgacaatatcatatcgaatatcccgattattaacgcgctattctctaaccccgcatttaatatcgatatcctcgcgacaaacgtaatcctcgccatcataattattccgtacattacgacgnatatacgtaatatattcgaacaaaccccgataataaataaaaaatcgacctacgatattaactacaccacctaaaaaattatctaacgtatcgttcttccgttcaccaaaataatattatcgacgacatcatactaaactaaacccgacgctcgataaaaccataacgataaccttatcatt

SEQ ID NO: 25089 - DNA, 621 bp, Artificial Sequence
  chemically treated genomic DNA (Homo sapiens) CpG-island No: 25089
aatttatgggcgaagtgaatcgtttggtagggaattattcgcggcggtgtagttttatgttggcgcgtatcggttggtcgttgggttatatatttgcgtattagggttcggtggatttttttttgcgtttttgggaagtggatattagtcgtcgtattagtttcgattcgtcgttgtcggtataggtattggaagttagttcgaaaggttattatatttaattagtggtgtagtcgttggggtggtataacgaatcgttgacggtcgtgatgtatggcgacgatgtttcgtagcgtggcgagcgtttattcgttggtttgttatatgcgcggttgtataacggcgacgagcgtatcgaaattcgcgatgaggaatttgttttcgtataagcgtttgataggttgagtgaatgttaaacgttcggaggcgtttttcgcgattcgggttttttaatggtaaggtttgtaatttgtaggtttgataagacgcgttagcgtcgtattaggtattgattgtcggatgcggcgcgaacgttttattcggtttataaaattagtaattttaatacgttgtaaaattgtaggtttgataagacgcggtaagcgtcgtattaggtattgt

SEQ ID NO: 25090 - DNA, 621 bp, Artificial Sequence
  chemically treated genomic DNA (Homo sapiens) CpG-island No: 25090
acaatacctaatacgacgcttaccgcgtcttatcaaacctacaattttacaacgtattaaaattactaattttataaaccgaataaaacgttcgcgccgcatccgacaatcaatacctaatacgacgctaacgcgtcttatcaaacctacaaattacaaaccttaccattaaaaaacccgaatcgcgaaaaacgcctccgaacgtttaacattcactcaacctatcaaacgcttatacgaaaacaaattcctcatcgcgaatttcgatacgctcgtcgccgttatacaaccgcgcatataacaaaccaacgaataaacgctcgccacgctacgaaacatcgtcgccatacatcacgaccgtcaacgattcgttataccaccccaacgactacaccactaattaaatataataacctttcgaactaacttccaatacctataccgacaacgacgaatcgaaactaatacgacgactaatatccacttcccaaaaacgcaaaaaaaaatccaccgaaccctaatacgcaaatatataacccaacgaccaaccgatacgcgccaacataaaactacaccgccgcgaataattccctaccaaacgattcacttcgcccataaatt

SEQ ID NO: 25091 - DNA, 621 bp, Artificial Sequence
  chemically treated genomic DNA (Homo sapiens) CpG-island No: 25091
ataatgtttgatgcgacgtttatcgcgttttattaggtttatagttttataacgtattgaaattgttggttttgtaggtcggataaggcgttcgcgtcgtattcggtaattaatgtttgatgcgacgttggcgcgttttattaggtttataggttataaattttgttattaaaaagttcggatcgcgggaagcgttttcgggcgtttaatatttatttaatttattaggcgtttgtgcgagagtaagttttttatcgcgggtttcgatacgttcgtcgtcgttatatagtcgcgtatgtagtagattaacgaataaacgttcgttacgttgcggggtatcgtcgttatgtattacgatcgttagcggttcgttgtattattttagcggttgtattattaattgggtgtagtgatttttcgggttggtttttagtatttgtatcggtagcggcgaatcgaggttggtacggcggttgatatttattttttaagggcgtaggaagagatttatcggattttgatacgtaggtgtgtagtttagcggttagtcgatgcgcgttaatatggaattgtatcgtcgcgaatggttttttgttaggcggtttatttcgtttataaatt

SEQ ID NO: 25092 - DNA, 621 bp, Artificial Sequence
  chemically treated genomic DNA (Homo sapiens) CpG-island No: 25092
aatttataaacgaaataaaccgcctaacaaaaaaccattcgcgacgatacaattccatattaacgcgcatcgactaaccgctaaactacacacctacgtatcaaaatccgataaatctcttcctacgcccttaaaaaataaatatcaaccgccgtaccaacctcgattcgccgctaccgatacaaatactaaaaaccaacccgaaaaatcactacacccaattaataatacaaccgctaaaataatacaacgaaccgctaacgatcgtaatacataacgacgataccccgcaacgtaacgaacgtttattcgttaatctactacatacgcgactatataacgacgacgaacgtatcgaaacccgcgataaaaaacttactctcgcacaaacgcctaataaattaaataaatattaaacgcccgaaaacgcttcccgcgatccgaactttttaataacaaaatttataacctataaacctaataaaacgcgccaacgtcgcatcaaacattaattaccgaatacgacgcgaacgccttatccgacctacaaaaccaacaatttcaatacgttataaaactataaacctaataaaacgcgataaacgtcgcatcaaacattat

SEQ ID NO: 25093 - DNA, 903 bp, Artificial Sequence
  chemically treated genomic DNA (Homo sapiens) CpG-island No: 25093
ttacgttgttgtttttttcgtgttgatgagcgttagcggtaggtcgcgatggtcgtagtggtataggtggatttttcgcgtcggcgtgtatatcgggtttatttggttttgtatttgttttacggttaggtcgtacgatgttagttagcggcggttttttttatttattcggttagttaggattttattttttagtcggtcgagtatttgtattagtatcggcgggaatattatattgttatcgttttcgtcgtcggattgttgaagggtattcgttaggttgcggcgttgcgttttcgttagtttatcggatgtagtttcgattttgatgagtggcgtgaagtttttcggttgataaatcgtttggatgcggtttttgtcgttttgtatcgtggttagtcggtcgtcgttttagtcgtattaggttatttgcggttttcgtgatagcgatatttagttcgttaggtttcgtttacgtcgttatattcgttttgttattttgcggtttagcgggtcgtaaagatagcgattttcgattagcggttttttatattgtgttcgcgtgtagtgtattagtcggtgttgattgtcgtaatggtatcggtgagttcgtttattattcgtgcggataatttttttcgggatgaggtcggttttttttgttagtttgtcgtgacggttatatcggtaagatgtgcgcgttacgggcgatacggttattcggttatatgttgagggtgttgttcgggtgtagtttcgggtcgggtaggcggttatttgtcgggtttgtggtatacgggattgcggattatttagattcgttgcggtggtgtgaacgtcggttagtttgtcggtgtgttgtagttgtaattttcggtttggcgcggtttgttgattcgatga

SEQ ID NO: 25094 - DNA, 903 bp, Artificial Sequence
  chemically treated genomic DNA (Homo sapiens) CpG-island No: 25094
tcatcgaatcaacaaaccgcgccaaaccgaaaattacaactacaacacaccgacaaactaaccgacgttcacaccaccgcaacgaatctaaataatccgcaatcccgtataccacaaacccgacaaataaccgcctacccgacccgaaactacacccgaacaacaccctcaacatataaccgaataaccgtatcgcccgtaacgcgcacatcttaccgatataaccgtcacgacaaactaacaaaaaaaaccgacctcatcccgaaaaaaattatccgcacgaataataaacgaactcaccgataccattacgacaatcaacaccgactaatacactacacgcgaacacaatataaaaaaccgctaatcgaaaatcgctatctttacgacccgctaaaccgcaaaataacaaaacgaatataacgacgtaaacgaaacctaacgaactaaatatcgctatcacgaaaaccgcaaataacctaatacgactaaaacgacgaccgactaaccacgatacaaaacgacaaaaaccgcatccaaacgatttatcaaccgaaaaacttcacgccactcatcaaaatcgaaactacatccgataaactaacgaaaacgcaacgccgcaacctaacgaatacccttcaacaatccgacgacgaaaacgataacaatataatattcccgccgatactaatacaaatactcgaccgactaaaaaataaaatcctaactaaccgaataaataaaaaaaaccgccgctaactaacatcgtacgacctaaccgtaaaacaaatacaaaaccaaataaacccgatatacacgccgacgcgaaaaatccacctataccactacgaccatcgcgacctaccgctaacgctcatcaacacgaaaaaaacaacaacgtaa

SEQ ID NO: 25095 - DNA, 903 bp, Artificial Sequence
  chemically treated genomic DNA (Homo sapiens) CpG-island No: 25095
ttatcgaattagtaagtcgcgttagatcgggaattatagttatagtatatcggtaggttgatcggcgtttatattatcgtagcgaatttggataattcgtaatttcgtatgttatagattcggtaggtaatcgtttgttcgattcggagttgtattcggatagtatttttagtatgtggtcggataatcgtatcgttcgtgacgcgtatattttatcggtatgatcgttacggtaggttgatagagaaaatcgattttatttcggaaggggttattcgtacggatgatgagcggatttatcggtattattacgatagttagtatcggttggtgtattatacgcggatataatatgaagagtcgttggtcgaaagtcgttatttttacgattcgttgggtcgtagggtggtaaaacgggtgtggcggcgtgaacgggatttgacgggttggatgtcgttgttacggaaatcgtaagtgatttggtacggttgggacggcgatcggttgattacgatatagaacgataggagtcgtatttagacgatttattagtcggggagttttacgttatttattagggtcgaaattgtattcggtgagttggcgaaaacgtagcgtcgtagtttggcggatgttttttagtagttcggcggcgaagacggtggtagtgtggtgttttcgtcggtgttggtgtagatgttcgatcggttggaaagtgaaattttggttgatcgggtgagtgaggaaagtcgtcgttggttggtatcgtgcggtttgatcgtggagtagatgtaaaattagatggattcggtgtatacgtcggcgcgaaaaatttatttgtattattgcgattatcgcggtttgtcgttggcgtttattagtacggaaggggtaatagcgtgg

SEQ ID NO: 25096 - DNA, 903 bp, Artificial Sequence
  chemically treated genomic DNA (Homo sapiens) CpG-island No: 25096
ccacgctattaccccttccgtactaataaacgccaacgacaaaccgcgataatcgcaataatacaaataaatttttcgcgccgacgtatacaccgaatccatctaattttacatctactccacgatcaaaccgcacgataccaaccaacgacgactttcctcactcacccgatcaaccaaaatttcactttccaaccgatcgaacatctacaccaacaccgacgaaaacaccacactaccaccgtcttcgccgccgaactactaaaaaacatccgccaaactacgacgctacgttttcgccaactcaccgaatacaatttcgaccctaataaataacgtaaaactccccgactaataaatcgtctaaatacgactcctatcgttctatatcgtaatcaaccgatcgccgtcccaaccgtaccaaatcacttacgatttccgtaacaacgacatccaacccgtcaaatcccgttcacgccgccacacccgttttaccaccctacgacccaacgaatcgtaaaaataacgactttcgaccaacgactcttcatattatatccgcgtataatacaccaaccgatactaactatcgtaataataccgataaatccgctcatcatccgtacgaataaccccttccgaaataaaatcgattttctctatcaacctaccgtaacgatcataccgataaaatatacgcgtcacgaacgatacgattatccgaccacatactaaaaatactatccgaatacaactccgaatcgaacaaacgattacctaccgaatctataacatacgaaattacgaattatccaaattcgctacgataatataaacgccgatcaacctaccgatatactataactataattcccgatctaacgcgacttactaattcgataa

SEQ ID NO: 25097 - DNA, 587 bp, Artificial Sequence
  chemically treated genomic DNA (Homo sapiens) CpG-island No: 25097
  misc_feature (49)..(49): n is either a, c, g or t
tattttgtttatcgatgttcgtatttataacggttggcgggagatattncgttagcgatgagacgttacgggagatttatgttttgatgaaatgggggtcgatattagttaattgtttttcggtacggatcgtgtttattcgtacggtagaaggaaaagaacgtttgcgttcggtattttttagcggtaatttgtaaaaaattttgatcgcgttcgttatcgttatcgtcgtttgggatagtgaattttatgaacggttattattattgtttttttacggtgatgttcgtagttggtttatttttagtttataatttgtcgaagaaatagcgtttcgtaatagttttatgtaggcggtttatttgatcgtcgtttgtcgggcgttgggattggatatcggttcgatgtcgggttttgatcgttaatacgtggacgacgttttttttacgggtagtacgttgaagagtaatttgttgattaatatcggttatggcgatagtagtaagttttatgcgcgtttgttacgtttgttttttgaagaagtttgcgggttgttgtaaggagtaaattatgaatattgtcgatta

SEQ ID NO: 25098 - DNA, 587 bp, Artificial Sequence
  chemically treated genomic DNA (Homo sapiens) CpG-island No: 25098
  misc_feature (539)..(539): n is either a, c, g or t
taatcgacaatattcataatttactccttacaacaacccgcaaacttcttcaaaaaacaaacgtaacaaacgcgcataaaacttactactatcgccataaccgatattaatcaacaaattactcttcaacgtactacccgtaaaaaaaacgtcgtccacgtattaacgatcaaaacccgacatcgaaccgatatccaatcccaacgcccgacaaacgacgatcaaataaaccgcctacataaaactattacgaaacgctatttcttcgacaaattataaactaaaaataaaccaactacgaacatcaccgtaaaaaaacaataataataaccgttcataaaattcactatcccaaacgacgataacgataacgaacgcgatcaaaattttttacaaattaccgctaaaaaataccgaacgcaaacgttcttttccttctaccgtacgaataaacacgatccgtaccgaaaaacaattaactaatatcgacccccatttcatcaaaacataaatctcccgtaacgtctcatcgctaacgnaatatctcccgccaaccgttataaatacgaacatcgataaacaaaata

SEQ ID NO: 25099 - DNA, 587 bp, Artificial Sequence
  chemically treated genomic DNA (Homo sapiens) CpG-island No: 25099
  misc_feature (539)..(539): n is either a, c, g or t
tgatcgataatgtttatagtttgttttttataatagttcgtaggtttttttaaaggatagacgtggtaggcgcgtataaagtttgttgttatcgttatagtcgatattaattagtagattgttttttagcgtgttgttcgtaaaaaaggcgtcgtttacgtgttgacggttaaagttcgatatcgggtcggtatttagttttagcgttcggtaggcgacgattagataggtcgtttgtatggaattgttgcgaaacgttgttttttcggtaagttgtgggttggaggtaaattaattgcgggtattatcgtggggaaatagtagtggtaatcgtttataaaatttattgttttaggcgacgatagcggtgacgggcgcggttagggttttttgtagattgtcgttggaaagtgtcgggcgtagacgtttttttttttttgtcgtgcgggtaaatacgattcgtgtcggagaatagttagttgatgtcggtttttattttattagggtataaatttttcgtaacgttttatcgttgacgnggtgtttttcgttagtcgttgtgagtgcgggtatcggtgaatagggtg

SEQ ID NO: 25100 - DNA, 587 bp, Artificial Sequence
  chemically treated genomic DNA (Homo sapiens) CpG-island No: 25100
  misc_feature (49)..(49): n is either a, c, g or t
caccctattcaccgatacccgcactcacaacgactaacgaaaaacaccncgtcaacgataaaacgttacgaaaaatttataccctaataaaataaaaaccgacatcaactaactattctccgacacgaatcgtatttacccgcacgacaaaaaaaaaaaaacgtctacgcccgacactttccaacgacaatctacaaaaaaccctaaccgcgcccgtcaccgctatcgtcgcctaaaacaataaattttataaacgattaccactactatttccccacgataatacccgcaattaatttacctccaacccacaacttaccgaaaaaacaacgtttcgcaacaattccatacaaacgacctatctaatcgtcgcctaccgaacgctaaaactaaataccgacccgatatcgaactttaaccgtcaacacgtaaacgacgccttttttacgaacaacacgctaaaaaacaatctactaattaatatcgactataacgataacaacaaactttatacgcgcctaccacgtctatcctttaaaaaaacctacgaactattataaaaaacaaactataaacattatcgatca

SEQ ID NO: 25101 - DNA, 548 bp, Artificial Sequence
  chemically treated genomic DNA (Homo sapiens) CpG-island No: 25101
cgtagacgttcgttattcggttcggtttgttttggttttggataatcgggatttattcggtttatcgggtaggcggtggtgtagacggtgtatttaatgtagttttcgaagttggtgttatttattgttggttttttgcgcgttgggtaatttgttgagcggtatgtaaagtattgacggtataaatatcgtcgtcgtatttttgggcgatgggattaaattcgtttagtatcgaatcgatggtaaataggtttttaatggtttgttttgtttgtgacgggcgtagcgttttattagtggttatatcgaattgttgttacggttgcggcgtaaaaaaattttttttatattatttatttcgcgtggcggtttgtagtatattaagggtcgagaatcggttttcgaatgtcgttacgtttcgttattagttcgatattaaagaaattgtcgttggcgagaatcgcgaaacgtggacgtagcggaatatcggcgtgattgcgggtttagatttcgtttattacgttatttttataggttattttttttat

SEQ ID NO: 25102 - DNA, 548 bp, Artificial Sequence
  chemically treated genomic DNA (Homo sapiens) CpG-island No: 25102
ataaaaaaaataacctataaaaataacgtaataaacgaaatctaaacccgcaatcacgccgatattccgctacgtccacgtttcgcgattctcgccaacgacaatttctttaatatcgaactaataacgaaacgtaacgacattcgaaaaccgattctcgacccttaatatactacaaaccgccacgcgaaataaataatataaaaaaaatttttttacgccgcaaccgtaacaacaattcgatataaccactaataaaacgctacgcccgtcacaaacaaaacaaaccattaaaaacctatttaccatcgattcgatactaaacgaatttaatcccatcgcccaaaaatacgacgacgatatttataccgtcaatactttacataccgctcaacaaattacccaacgcgcaaaaaaccaacaataaataacaccaacttcgaaaactacattaaatacaccgtctacaccaccgcctacccgataaaccgaataaatcccgattatccaaaaccaaaacaaaccgaaccgaataacgaacgtctacg

SEQ ID NO: 25103 - DNA, 548 bp, Artificial Sequence
  chemically treated genomic DNA (Homo sapiens) CpG-island No: 25103
gtgaaaaaagtgatttgtaaaaatggcgtagtgaacgaaatttggattcgtaattacgtcgatatttcgttacgtttacgtttcgcggttttcgttagcggtagtttttttagtgtcggattggtagcggaacgtaacggtattcgagagtcgattttcggtttttgatgtgttataaatcgttacgcggggtgaatggtataagggagatttttttgcgtcgtaatcgtggtagtagttcggtgtaattattgatgagacgttacgttcgttataggtagggtaaattattgaaaatttgtttgttatcggttcggtgttgggcggatttgattttatcgtttagggatgcggcggcggtgtttgtgtcgttagtgttttatatgtcgtttaatagattgtttaacgcgtaggaggttaataatgaatgatattagtttcgaaaattgtattaagtgtatcgtttgtattatcgtttgttcggtgagtcgggtgaatttcggttatttagggttaaaataagtcgggtcggatggcgagcgtttgcg

SEQ ID NO: 25104 - DNA, 548 bp, Artificial Sequence
  chemically treated genomic DNA (Homo sapiens) CpG-island No: 25104
cgcaaacgctcgccatccgacccgacttattttaaccctaaataaccgaaattcacccgactcaccgaacaaacgataatacaaacgatacacttaatacaattttcgaaactaatatcattcattattaacctcctacgcgttaaacaatctattaaacgacatataaaacactaacgacacaaacaccgccgccgcatccctaaacgataaaatcaaatccgcccaacaccgaaccgataacaaacaaattttcaataatttaccctacctataacgaacgtaacgtctcatcaataattacaccgaactactaccacgattacgacgcaaaaaaatctcccttataccattcaccccgcgtaacgatttataacacatcaaaaaccgaaaatcgactctcgaataccgttacgttccgctaccaatccgacactaaaaaaactaccgctaacgaaaaccgcgaaacgtaaacgtaacgaaatatcgacgtaattacgaatccaaatttcgttcactacgccatttttacaaatcacttttttcac

SEQ ID NO: 25105 - DNA, 621 bp, Artificial Sequence
  chemically treated genomic DNA (Homo sapiens) CpG-island No: 25105
  misc_feature (179)..(179): n is either a, c, g or t
tttagcgcgtcgatcgttagtcgataattgtgtcgttagatagtagattaaagtcggtgaaattttaatcgttgcgttacgtattacgtcgttttttgttgttgatttcgatggtgttcgtcgtttcggtgattatttttttgattttgcgtttcggtattcggcgatttcgtgcgttntcggattttattgtgcgatttgtttaatttgttcgtcgacgttcggagatgttggtttttattcgtattatgttgggattggattatgtcgttgtacgttcgtacgtattagttttgaggagttttattattacgtttcgcgaagaagaacggatcgtggttaagcgttgttttatgggtatgacgtcgaggttattatgataaagttaatcgtcgcgaggtcgaaggttagttatagtaaggtgcgatcgtatatgattaggttgtcggtatttttttttcgcgagtttattatttagttttttagcgtcgtggagatttagattaggatattgaattttggtaggcgcggtatttttaggcgagggagagataaacgtattaatttaattttttcgttagacgggtaaatttattgtttcgttgtttaaagtttttgaat

SEQ ID NO: 25106 - DNA, 621 bp, Artificial Sequence
  chemically treated genomic DNA (Homo sapiens) CpG-island No: 25106
  misc_feature (443)..(443): n is either a, c, g or t
attcaaaaactttaaacaacgaaacaataaatttacccgtctaacgaaaaaattaaattaatacgtttatctctccctcgcctaaaaataccgcgcctaccaaaattcaatatcctaatctaaatctccacgacgctaaaaaactaaataataaactcgcgaaaaaaaaataccgacaacctaatcatatacgatcgcaccttactataactaaccttcgacctcgcgacgattaactttatcataataacctcgacgtcatacccataaaacaacgcttaaccacgatccgttcttcttcgcgaaacgtaataataaaactcctcaaaactaatacgtacgaacgtacaacgacataatccaatcccaacataatacgaataaaaaccaacatctccgaacgtcgacgaacaaattaaacaaatcgcacaataaaatccganaacgcacgaaatcgccgaataccgaaacgcaaaatcaaaaaaataatcaccgaaacgacgaacaccatcgaaatcaacaacaaaaaacgacgtaatacgtaacgcaacgattaaaatttcaccgactttaatctactatctaacgacacaattatcgactaacgatcgacgcgctaaa

SEQ ID NO: 25107 - DNA, 621 bp, Artificial Sequence
  chemically treated genomic DNA (Homo sapiens) CpG-island No: 25107
  misc_feature (443)..(443): n is either a, c, g or t
gtttaagaattttgaataacgaggtaatgagtttgttcgtttggcgaaggagttaggttgatgcgtttatttttttttcgtttgaaaatgtcgcgtttgttaggatttagtattttggtttggatttttacggcgttaaagggttgggtgatgggttcgcgggaaaaagatatcgatagtttgattatgtacgatcgtattttattgtggttgattttcggtttcgcggcgattggttttattatggtgatttcggcgttatgtttatagggtaacgtttaattacgattcgttttttttcgcgaagcgtgatggtggggttttttaaagttggtgcgtacggacgtatagcggtatgatttagttttagtatggtgcgggtagaggttagtattttcggacgtcggcggataggttagatagatcgtataatagaattcgangacgtacggggtcgtcgggtatcgaggcgtaggattagaaaaatgattatcgaggcggcgagtattatcgggattagtagtagaaagcggcgtaatacgtaacgtaacgattaaggttttatcggttttaatttgttgtttaacggtatagttgtcggttggcgatcggcgcgttagg

SEQ ID NO: 25108 - DNA, 621 bp, Artificial Sequence
  chemically treated genomic DNA (Homo sapiens) CpG-island No: 25108
  misc_feature (179)..(179): n is either a, c, g or t
cctaacgcgccgatcgccaaccgacaactataccgttaaacaacaaattaaaaccgataaaaccttaatcgttacgttacgtattacgccgctttctactactaatcccgataatactcgccgcctcgataatcatttttctaatcctacgcctcgatacccgacgaccccgtacgtcntcgaattctattatacgatctatctaacctatccgccgacgtccgaaaatactaacctctacccgcaccatactaaaactaaatcataccgctatacgtccgtacgcaccaactttaaaaaaccccaccatcacgcttcgcgaaaaaaaacgaatcgtaattaaacgttaccctataaacataacgccgaaatcaccataataaaaccaatcgccgcgaaaccgaaaatcaaccacaataaaatacgatcgtacataatcaaactatcgatatctttttcccgcgaacccatcacccaaccctttaacgccgtaaaaatccaaaccaaaatactaaatcctaacaaacgcgacattttcaaacgaaaaaaaaataaacgcatcaacctaactccttcgccaaacgaacaaactcattacctcgttattcaaaattcttaaac

SEQ ID NO: 25109 - DNA, 706 bp, Artificial Sequence
  chemically treated genomic DNA (Homo sapiens) CpG-island No: 25109
  misc_feature (72)..(72): n is either a, c, g or t
cgttaattttcgtcgttttcgttattttatttattagcgtggtgatcgtgtttttgtcgttagagtcggtantcgattattattgcgtgggttcggtacgttcgaaggaacgattttcgggttagtttgatcgaagatggtattatttgtcgcgatagttaggtcgtatattatgtgtagaacgtgatcgtcgtcgatggagtagttagttattatcgcgataatcggtttcggataggtacggatttgacgttggaagtttagtatatttaggtgatgtacgtcggaattatttttatagtcgtcgtaattattacgtattttttggttattatcggagtagaacgttttatcgtttgtattagttagaatgattacgtcgatgttgtcgttataacgcgtatttgttagttttatgatgttgtaatattatttgacgtggtttttttgaagcggttgcggaatgtcgtcgattggtttggtatatttgtcgtataaatatttgttgtacgcgatcgtagttacggtttgtataagcggaaagagattgcgttttgtcgatggaatagtaattagtgcgtttcgggggcggtagcgttgaatggcgattatatatgggttgtgatttttatatttgttagtttattgatttttgagttaatcggataggagaggtttggtcgggatcgtacgttaggttagtatt

SEQ ID NO: 25110 - DNA, 706 bp, Artificial Sequence
  chemically treated genomic DNA (Homo sapiens) CpG-island No: 25110
  misc_feature (635)..(635): n is either a, c, g or t
aatactaacctaacgtacgatcccgaccaaacctctcctatccgattaactcaaaaatcaataaactaacaaatataaaaatcacaacccatatataatcgccattcaacgctaccgcccccgaaacgcactaattactattccatcgacaaaacgcaatctctttccgcttatacaaaccgtaactacgatcgcgtacaacaaatatttatacgacaaatataccaaaccaatcgacgacattccgcaaccgcttcaaaaaaaccacgtcaaataatattacaacatcataaaactaacaaatacgcgttataacgacaacatcgacgtaatcattctaactaatacaaacgataaaacgttctactccgataataaccaaaaaatacgtaataattacgacgactataaaaataattccgacgtacatcacctaaatatactaaacttccaacgtcaaatccgtacctatccgaaaccgattatcgcgataataactaactactccatcgacgacgatcacgttctacacataatatacgacctaactatcgcgacaaataataccatcttcgatcaaactaacccgaaaatcgttccttcgaacgtaccgaacccacgcaataataatcgantaccgactctaacgacaaaaacacgatcaccacgctaataaataaaataacgaaaacgacgaaaattaacg

SEQ ID NO: 25111 - DNA, 706 bp, Artificial Sequence
  chemically treated genomic DNA (Homo sapiens) CpG-island No: 25111
  misc_feature (635)..(635): n is either a, c, g or t
aatattgatttgacgtacggtttcggttagattttttttgttcggttagtttaaaagttagtgaattgataggtatgaggattatagtttatatgtagtcgttatttagcgttgtcgttttcggggcgtattgattgttgttttatcgataagacgtaattttttttcgtttgtataagtcgtaattgcggtcgcgtatagtaagtgtttgtgcggtaagtatgttaaattagtcggcggtatttcgtaatcgttttaggagagttacgttagataatgttgtaatattatggagttggtagatgcgcgttatgacgataatatcggcgtgattattttgattggtgtaggcgataaagcgttttgtttcggtggtgattagaaagtgcgtggtgattacggcggttataaagatgatttcggcgtatattatttgaatgtgttggatttttagcgttagattcgtatttgttcgaaatcggttgtcgcgatggtggttggttattttatcggcggcggttacgttttgtatatgatgtgcgatttgattatcgcggtagataatgttattttcggttagattggttcgaaagtcgttttttcgagcgtgtcggatttacgtagtggtggtcgantatcggttttaacggtaaaagtacggttattacgttagtgggtgaaatggcgaaagcggcgggggttaacg

SEQ ID NO: 25112 - DNA, 706 bp, Artificial Sequence
  chemically treated genomic DNA (Homo sapiens) CpG-island No: 25112
  misc_feature (72)..(72): n is either a, c, g or t
cgttaacccccgccgctttcgccatttcacccactaacgtaataaccgtacttttaccgttaaaaccgatantcgaccaccactacgtaaatccgacacgctcgaaaaaacgactttcgaaccaatctaaccgaaaataacattatctaccgcgataatcaaatcgcacatcatatacaaaacgtaaccgccgccgataaaataaccaaccaccatcgcgacaaccgatttcgaacaaatacgaatctaacgctaaaaatccaacacattcaaataatatacgccgaaatcatctttataaccgccgtaatcaccacgcactttctaatcaccaccgaaacaaaacgctttatcgcctacaccaatcaaaataatcacgccgatattatcgtcataacgcgcatctaccaactccataatattacaacattatctaacgtaactctcctaaaacgattacgaaataccgccgactaatttaacatacttaccgcacaaacacttactatacgcgaccgcaattacgacttatacaaacgaaaaaaaattacgtcttatcgataaaacaacaatcaatacgccccgaaaacgacaacgctaaataacgactacatataaactataatcctcatacctatcaattcactaacttttaaactaaccgaacaaaaaaaatctaaccgaaaccgtacgtcaaatcaatatt

SEQ ID NO: 25113 - DNA, 527 bp, Artificial Sequence
  chemically treated genomic DNA (Homo sapiens) CpG-island No: 25113
aagtcgatttcggtacgtcgcgcgttggtattggcgtattatttggcgaatcgtattatttggattaaatacgatgagttgattattggtaattaggtaagcgaagttcgcgtcgcgtcgattttttcggaatatattgtttcgtggatcgaaaaagagattgatgatttggtagatcgtttcgggtatcgaattcgacgtgtattcgtttatattatggtggagtattattcggttatcggtagaatcggcgcgcgataaaggaaaaggatttcgtttatgtttggtcgttggttttaaggggtttcgtagattgtatttcgtttatagcgtaggttaggcgttatgtataatttcggtattgacgtcgttgtgtaagtacgtggcgcgtgggtagatattcgtcgaagttagttattcgagtcgtcgttagtcgaggtttagttatgttttttttgattatttttttgtagttaggcgtaggtttttggattagtgagatcgataacgtcgtcgtaaaattcgtt

SEQ ID NO: 25114 - DNA, 527 bp, Artificial Sequence
  chemically treated genomic DNA (Homo sapiens) CpG-island No: 25114
aacgaattttacgacgacgttatcgatctcactaatccaaaaacctacgcctaactacaaaaaaataatcaaaaaaaacataactaaacctcgactaacgacgactcgaataactaacttcgacgaatatctacccacgcgccacgtacttacacaacgacgtcaataccgaaattatacataacgcctaacctacgctataaacgaaatacaatctacgaaaccccttaaaaccaacgaccaaacataaacgaaatccttttcctttatcgcgcgccgattctaccgataaccgaataatactccaccataatataaacgaatacacgtcgaattcgatacccgaaacgatctaccaaatcatcaatctctttttcgatccacgaaacaatatattccgaaaaaatcgacgcgacgcgaacttcgcttacctaattaccaataatcaactcatcgtatttaatccaaataatacgattcgccaaataatacgccaataccaacgcgcgacgtaccgaaatcgactt

SEQ ID NO: 25115 - DNA, 527 bp, Artificial Sequence
  chemically treated genomic DNA (Homo sapiens) CpG-island No: 25115
ggcgagttttacggcggcgttgtcgattttattaatttagaagtttacgtttggttataaggaagtgattaaaaagaatatgattgaatttcggttagcggcggttcggatggttgatttcggcgagtatttgtttacgcgttacgtatttgtataacggcgttagtgtcgaaattatgtataacgtttggtttgcgttgtgggcgaagtgtaatttacgaagttttttgaagttaacggttaagtataggcgagattttttttttttatcgcgcgtcggttttatcggtagtcgagtaatattttattatgatgtgggcgggtatacgtcgagttcggtattcgggacgatttgttagattattaatttttttttcgatttacgagatagtatatttcgggaagatcggcgcggcgcgaatttcgtttgtttggttgttaatgattaatttatcgtgtttgatttagatggtgcgattcgttaggtgatgcgttagtgttagcgcgcgacgtatcgggatcggttt

SEQ ID NO: 25116 - DNA, 527 bp, Artificial Sequence
  chemically treated genomic DNA (Homo sapiens) CpG-island No: 25116
aaaccgatcccgatacgtcgcgcgctaacactaacgcatcacctaacgaatcgcaccatctaaatcaaacacgataaattaatcattaacaaccaaacaaacgaaattcgcgccgcgccgatcttcccgaaatatactatctcgtaaatcgaaaaaaaaattaataatctaacaaatcgtcccgaataccgaactcgacgtatacccgcccacatcataataaaatattactcgactaccgataaaaccgacgcgcgataaaaaaaaaaaatctcgcctatacttaaccgttaacttcaaaaaacttcgtaaattacacttcgcccacaacgcaaaccaaacgttatacataatttcgacactaacgccgttatacaaatacgtaacgcgtaaacaaatactcgccgaaatcaaccatccgaaccgccgctaaccgaaattcaatcatattctttttaatcacttccttataaccaaacgtaaacttctaaattaataaaatcgacaacgccgccgtaaaactcgcc

SEQ ID NO: 25117 - DNA, 698 bp, Artificial Sequence
  chemically treated genomic DNA (Homo sapiens) CpG-island No: 25117
  misc_feature (440)..(440): n is either a, c, g or t
  misc_feature (443)..(443): n is either a, c, g or t
  misc_feature (504)..(504): n is either a, c, g or t
  misc_feature (600)..(600): n is either a, c, g or t
tgttgcgcgtaatttaatagtttatgcgcggtagatcgtagagtatataacgaggcgttagcgtaagcggtatgaagtaacgtttgaattggttgggcgaatagcgaatttttttataattgatcggtagtatgacgaatatgttcgaggttcgttagatcggtatgacgttagcgtttgttaagcgcggtatgggtaaaattttttatttagcgttgttgttttggcggtggtaatttatcgttgttggttaatttatagcgcgttcgattcgttaggtagttttatatcgacgatatcggaaatatttgttgtggcgtaatatagttttttattagcgtttcggaaattagtgttcgtatttggtcggcgtcgttattgttacgattttgttgatcgaatttattgattagtacgtatagcggtatcgatttgtttancgntaaaatcgttttacggatttttttatcggagatcgattttcgttgcgtataatatagtatncgtagtatcggcgagaggcgtggtagtttgttgttaaggtttttttggaaatgtcggtggtcggtttatattggttcgggggtatttataacgttnattggtcggggaaattttttagtttcgttatgtggaaatttttttaaaatcgcgaattttttcgggcggtataaattttaaggggattttcgtaatgt

SEQ ID NO: 25118 - DNA, 698 bp, Artificial Sequence
  chemically treated genomic DNA (Homo sapiens) CpG-island No: 25118
  misc_feature (99)..(99): n is either a, c, g or t
  misc_feature (195)..(195): n is either a, c, g or t
  misc_feature (256)..(256): n is either a, c, g or t
  misc_feature (259)..(259): n is either a, c, g or t
acattacgaaaatccccttaaaatttataccgcccgaaaaaattcgcgattttaaaaaaatttccacataacgaaactaaaaaatttccccgaccaatnaacgttataaatacccccgaaccaatataaaccgaccaccgacatttccaaaaaaaccttaacaacaaactaccacgcctctcgccgatactacgnatactatattatacgcaacgaaaatcgatctccgataaaaaaatccgtaaaacgattttancgntaaacaaatcgataccgctatacgtactaatcaataaattcgatcaacaaaatcgtaacaataacgacgccgaccaaatacgaacactaatttccgaaacgctaataaaaaactatattacgccacaacaaatatttccgatatcgtcgatataaaactacctaacgaatcgaacgcgctataaattaaccaacaacgataaattaccaccgccaaaacaacaacgctaaataaaaaattttacccataccgcgcttaacaaacgctaacgtcataccgatctaacgaacctcgaacatattcgtcatactaccgatcaattataaaaaaattcgctattcgcccaaccaattcaaacgttacttcataccgcttacgctaacgcctcgttatatactctacgatctaccgcgcataaactattaaattacgcgcaaca

SEQ ID NO: 25119 - DNA, 698 bp, Artificial Sequence
  chemically treated genomic DNA (Homo sapiens) CpG-island No: 25119
  misc_feature (99)..(99): n is either a, c, g or t
  misc_feature (195)..(195): n is either a, c, g or t
  misc_feature (256)..(256): n is either a, c, g or t
  misc_feature (259)..(259): n is either a, c, g or t
gtattgcgaaaatttttttaaaatttgtatcgttcgggggaattcgcggttttaaagggatttttatataacggggttgagagattttttcggttagtngacgttatggatattttcgggttaatgtaagtcggttatcggtatttttaaaaaagttttaatagtaagttgttacgtttttcgtcggtattgcgngtgttgtattatacgtaacggaaatcgattttcgatgaagaggttcgtgaggcgattttgncgntgggtaaatcggtgtcgttgtacgtgttggttaataagttcgattaataggatcgtaatagtgacgacgtcgattaggtgcgggtattgattttcgggacgttgatgaaaggttgtattacgttatagtagatattttcggtgtcgtcgatgtggggttatttggcgaatcgggcgcgttatgagttagttaataacggtaagttattatcgttagagtaataacgttgggtggaagattttgtttatgtcgcgtttggtaggcgttggcgttatgtcgatttggcggatttcgaatatattcgttatgttgtcgattagttgtgggaagattcgttgttcgtttagttaatttaggcgttgttttatgtcgtttacgttaacgtttcgttgtatgttttgcgatttgtcgcgtataaattgttgaattacgcgtagta

SEQ ID NO: 25120 - DNA, 698 bp, Artificial Sequence
  chemically treated genomic DNA (Homo sapiens) CpG-island No: 25120
  misc_feature (440)..(440): n is either a, c, g or t
  misc_feature (443)..(443): n is either a, c, g or t
  misc_feature (504)..(504): n is either a, c, g or t
  misc_feature (600)..(600): n is either a, c, g or t
tactacgcgtaattcaacaatttatacgcgacaaatcgcaaaacatacaacgaaacgttaacgtaaacgacataaaacaacgcctaaattaactaaacgaacaacgaatcttcccacaactaatcgacaacataacgaatatattcgaaatccgccaaatcgacataacgccaacgcctaccaaacgcgacataaacaaaatcttccacccaacgttattactctaacgataataacttaccgttattaactaactcataacgcgcccgattcgccaaataaccccacatcgacgacaccgaaaatatctactataacgtaatacaacctttcatcaacgtcccgaaaatcaatacccgcacctaatcgacgtcgtcactattacgatcctattaatcgaacttattaaccaacacgtacaacgacaccgatttacccancgncaaaatcgcctcacgaacctcttcatcgaaaatcgatttccgttacgtataatacaacacncgcaataccgacgaaaaacgtaacaacttactattaaaacttttttaaaaataccgataaccgacttacattaacccgaaaatatccataacgtcnactaaccgaaaaaatctctcaaccccgttatataaaaatccctttaaaaccgcgaattcccccgaacgatacaaattttaaaaaaattttcgcaatac

SEQ ID NO: 25121 - DNA, 878 bp, Artificial Sequence
  chemically treated genomic DNA (Homo sapiens) CpG-island No: 25121
gataattatcgttattagtcgggtagcggtattttggatttttacgcgttgtttgaatagttgcgcgcggataattattagggttatgtagtgtacgaagggcgtattcgggcggaagattttgtttaggcgtatcgtgattcgttggtttggttgcgtatttgttaagaggtttttgtgaaaagtgtaatgataagtttttcgttgcgggtcgcgataataggcgtaggttaggtggcggataaggtttatgtttcgtattattgtattcgtaacgatttggaattggtggttgtttgtgatagtcgttttttttaggcgtaggcgttggtagaaaaatacgggaatgtattcgtgtgggacgattcgtaggttatgttgttggcggtgaaatttgatgtggttagcgtttgtttatttaatcgtttttattacgaatatattttgatggtattggaagcggggttgttatgtgatgtgcgaaaaatcgttcgttatgacgttagaataggcgcgggaaatgtgcgatatcgcgcgtaaattgggtaaggtgttggtttacgatttttattatcgttttgcgttcgatacgtaatagttgcgtgaataggtgattaacggcgttttgggagagatttacgttattatcgttcgcgttttgcgtcgttgcggcgttttcggttggggtgtttttattaataaagaattgtagggtggtggttcgttgatcgatatcggtatttatatgttggatgttgcgatgtatgtgttgggtttttcggcggtgaaaagcgtgaatgcgtatagtttttaaaagatcggtacgtaaaagagttgtggttaatttggtgagtgggattcggtaatttatagcgtcg

SEQ ID NO: 25122 - DNA, 878 bp, Artificial Sequence
  chemically treated genomic DNA (Homo sapiens) CpG-island No: 25122
cgacgctataaattaccgaatcccactcaccaaattaaccacaactcttttacgtaccgatcttttaaaaactatacgcattcacgcttttcaccgccgaaaaacccaacacatacatcgcaacatccaacatataaataccgatatcgatcaacgaaccaccaccctacaattctttattaataaaaacaccccaaccgaaaacgccgcaacgacgcaaaacgcgaacgataataacgtaaatctctcccaaaacgccgttaatcacctattcacgcaactattacgtatcgaacgcaaaacgataataaaaatcgtaaaccaacaccttacccaatttacgcgcgatatcgcacatttcccgcgcctattctaacgtcataacgaacgatttttcgcacatcacataacaaccccgcttccaataccatcaaaatatattcgtaataaaaacgattaaataaacaaacgctaaccacatcaaatttcaccgccaacaacataacctacgaatcgtcccacacgaatacattcccgtatttttctaccaacgcctacgcctaaaaaaaacgactatcacaaacaaccaccaattccaaatcgttacgaatacaataatacgaaacataaaccttatccgccacctaacctacgcctattatcgcgacccgcaacgaaaaacttatcattacacttttcacaaaaacctcttaacaaatacgcaaccaaaccaacgaatcacgatacgcctaaacaaaatcttccgcccgaatacgcccttcgtacactacataaccctaataattatccgcgcgcaactattcaaacaacgcgtaaaaatccaaaataccgctacccgactaataacgataattatc

SEQ ID NO: 25123 - DNA, 878 bp, Artificial Sequence
  chemically treated genomic DNA (Homo sapiens) CpG-island No: 25123
cgacgttgtaagttgtcggattttatttattaaattgattatagtttttttgcgtgtcgattttttgaaagttatgcgtatttacgttttttatcgtcggaaagtttagtatatatatcgtagtatttagtatatgaatgtcgatgtcgattagcgggttattattttgtagttttttattggtaaagatattttagtcgggaacgtcgtagcgacgtagggcgcgggcggtggtaacgtaaattttttttaaaacgtcgttggttatttgtttacgtagttgttgcgtatcgagcgtaaaacgatggtgaaagtcgtaggttagtattttgtttagtttgcgcgcggtatcgtatatttttcgcgtttgttttggcgttatggcgggcggtttttcgtatattatatggtagtttcgtttttagtgttattagggtatgttcgtaatgaaaacggttaggtgagtagacgttaattatattaggttttatcgttagtagtatggtttgcggatcgttttatacggatgtattttcgtatttttttgttagcgtttgcgtttgggaaaggcggttgttatagatagttattagttttagatcgttgcgggtgtagtagtacgaagtatgaattttattcgttatttggtttgcgtttattatcgcgattcgtagcggagagtttgttattgtattttttataaagattttttagtaggtacgtaattaggttaacgaattacggtacgtttgggtaggatttttcgttcggatacgtttttcgtatattatatagttttgatagttattcgcgcgtagttgtttaaatagcgcgtggaaatttagggtgtcgttgttcggttggtagcgatggttatt

SEQ ID NO: 25124 - DNA, 878 bp, Artificial Sequence
  chemically treated genomic DNA (Homo sapiens) CpG-island No: 25124
aataaccatcgctaccaaccgaacaacgacaccctaaatttccacgcgctatttaaacaactacgcgcgaataactatcaaaactatataatatacgaaaaacgtatccgaacgaaaaatcctacccaaacgtaccgtaattcgttaacctaattacgtacctactaaaaaatctttataaaaaatacaataacaaactctccgctacgaatcgcgataataaacgcaaaccaaataacgaataaaattcatacttcgtactactacacccgcaacgatctaaaactaataactatctataacaaccgcctttcccaaacgcaaacgctaacaaaaaaatacgaaaatacatccgtataaaacgatccgcaaaccatactactaacgataaaacctaatataattaacgtctactcacctaaccgttttcattacgaacataccctaataacactaaaaacgaaactaccatataatatacgaaaaaccgcccgccataacgccaaaacaaacgcgaaaaatatacgataccgcgcgcaaactaaacaaaatactaacctacgactttcaccatcgttttacgctcgatacgcaacaactacgtaaacaaataaccaacgacgttttaaaaaaaatttacgttaccaccgcccgcgccctacgtcgctacgacgttcccgactaaaatatctttaccaataaaaaactacaaaataataacccgctaatcgacatcgacattcatatactaaatactacgatatatatactaaactttccgacgataaaaaacgtaaatacgcataactttcaaaaaatcgacacgcaaaaaaactataatcaatttaataaataaaatccgacaacttacaacgtcg

SEQ ID NO: 25125 - DNA, 622 bp, Artificial Sequence
  chemically treated genomic DNA (Homo sapiens) CpG-island No: 25125
tagatagcggggtttgcgtttcgttgtcgggtttttcgttataaattcgattgtagtaggcgttggcggaatgaacggaaagttttttttggtttatttttttatttacggatagggttggttgtttttagggacgtgtgttatcgtcgtttgttatcgttttttttgttattttatttaagtttacggtcgagaagttttttttgaagtaggttttaaatttcgttcggttttagcgtttttcgttattttttcgtcgttcgtcgtttgggaagggcgcgggttttatttgagggtttaggtcgcgaggcggaagtttagttttggttttgcgcggtcgaatttattttagtatgtcgggttcggcgaggtttaggcgcggggttaggcgttcgattagtttcgattttatggcgtcggtattaaagcgaataattttcgtgaacgtcgcgggttaacgaaattcgcgcgtaaaggttgtatcggttagtgagagtaggttttacgtcggcgtatttggatggttaggacggacgttgggacgttttaaaataatgagggttttttgggtagtgttaaaaagtaagataaagaatagggtaacgtttggggtatcgtttat

SEQ ID NO: 25126 - DNA, 622 bp, Artificial Sequence
  chemically treated genomic DNA (Homo sapiens) CpG-island No: 25126
ataaacgataccccaaacgttaccctattctttatcttactttttaacactacccaaaaaaccctcattattttaaaacgtcccaacgtccgtcctaaccatccaaatacgccgacgtaaaacctactctcactaaccgatacaacctttacgcgcgaatttcgttaacccgcgacgttcacgaaaattattcgctttaataccgacgccataaaatcgaaactaatcgaacgcctaaccccgcgcctaaacctcgccgaacccgacatactaaaataaattcgaccgcgcaaaaccaaaactaaacttccgcctcgcgacctaaaccctcaaataaaacccgcgcccttcccaaacgacgaacgacgaaaaaataacgaaaaacgctaaaaccgaacgaaatttaaaacctacttcaaaaaaaacttctcgaccgtaaacttaaataaaataacaaaaaaaacgataacaaacgacgataacacacgtccctaaaaacaaccaaccctatccgtaaataaaaaaataaaccaaaaaaaactttccgttcattccgccaacgcctactacaatcgaatttataacgaaaaacccgacaacgaaacgcaaaccccgctatcta

SEQ ID NO: 25127 - DNA, 622 bp, Artificial Sequence
  chemically treated genomic DNA (Homo sapiens) CpG-island No: 25127
atgagcggtattttaagcgttgttttattttttgttttgttttttagtattgtttaaggaatttttattgttttgggacgttttaacgttcgttttaattatttagatgcgtcggcgtgggatttgtttttattggtcggtgtagtttttgcgcgcgggtttcgttgattcgcggcgtttacgggaattgttcgttttagtgtcggcgttatggggtcggagttgatcgggcgtttagtttcgcgtttgggtttcgtcgagttcgatatgttgaggtgagttcggtcgcgtaagattagggttgggttttcgtttcgcggtttgggtttttaggtgaggttcgcgttttttttaggcgacgggcggcgggggagtgacggggagcgttggggtcgggcggggtttagggtttattttaagaaaaatttttcggtcgtgagtttgaatgagatggtaagaagggcgatagtaaacggcgatggtatacgtttttgggaatagttagttttgttcgtgggtagaaaaatgagttagggagaatttttcgtttatttcgttaacgtttattgtagtcgggtttatagcggggaattcgataacgaggcgtagatttcgttgtttg

SEQ ID NO: 25128 - DNA, 622 bp, Artificial Sequence
  chemically treated genomic DNA (Homo sapiens) CpG-island No: 25128
caaacaacgaaatctacgcctcgttatcgaattccccgctataaacccgactacaataaacgttaacgaaataaacgaaaaattctccctaactcatttttctacccacgaacaaaactaactattcccaaaaacgtataccatcgccgtttactatcgcccttcttaccatctcattcaaactcacgaccgaaaaatttttcttaaaataaaccctaaaccccgcccgaccccaacgctccccgtcactcccccgccgcccgtcgcctaaaaaaaacgcgaacctcacctaaaaacccaaaccgcgaaacgaaaacccaaccctaatcttacgcgaccgaactcacctcaacatatcgaactcgacgaaacccaaacgcgaaactaaacgcccgatcaactccgaccccataacgccgacactaaaacgaacaattcccgtaaacgccgcgaatcaacgaaacccgcgcgcaaaaactacaccgaccaataaaaacaaatcccacgccgacgcatctaaataattaaaacgaacgttaaaacgtcccaaaacaataaaaattccttaaacaatactaaaaaacaaaacaaaaaataaaacaacgcttaaaataccgctcat

SEQ ID NO: 25129 - DNA, 619 bp, Artificial Sequence
  chemically treated genomic DNA (Homo sapiens) CpG-island No: 25129
tcggaacgggtttttatagtgttaagacgttcgttatggagttttattttaatatcgaaacggttatgaatacggttggtaaatttacgcgttttggtagttaatggttgttcggtgtcgtttatatttagcggtaaatcgacgatgatttcgttcggttgttatttttttagtaaacgttcgataatgttttagttcggcgtatcgttttgtgttttaattgtaggtaaagggcgagcggtgtcggtaatgcgttggtcgatcgttacgttaatgtttttgttcgaagtcgaggcgagttaggtgtttttattatcgggggttttttttatattgatttgttgaaatattttttttatttcgggttttttttaggggttttcgttcgtatttcgttttcgtttagtatatgtataatcggcgtatcggcgttttgttagatatttagatttgtcgggttttatttacgcgtatcgagtattcgtgttgtagtgatttgttttaggaggtataatttagagttattaatacgttagacgtttgtttatcggtttcgacgttttagtatatcgcgggaagtgttattatcgtgttgtttgaaatgcgaatgttggaagta

SEQ ID NO: 25130 - DNA, 619 bp, Artificial Sequence
  chemically treated genomic DNA (Homo sapiens) CpG-island No: 25130
tacttccaacattcgcatttcaaacaacacgataataacacttcccgcgatatactaaaacgtcgaaaccgataaacaaacgtctaacgtattaataactctaaattatacctcctaaaacaaatcactacaacacgaatactcgatacgcgtaaataaaacccgacaaatctaaatatctaacaaaacgccgatacgccgattatacatatactaaacgaaaacgaaatacgaacgaaaacccctaaaaaaaacccgaaataaaaaaaatatttcaacaaatcaatataaaaaaaacccccgataataaaaacacctaactcgcctcgacttcgaacaaaaacattaacgtaacgatcgaccaacgcattaccgacaccgctcgccctttacctacaattaaaacacaaaacgatacgccgaactaaaacattatcgaacgtttactaaaaaaataacaaccgaacgaaatcatcgtcgatttaccgctaaatataaacgacaccgaacaaccattaactaccaaaacgcgtaaatttaccaaccgtattcataaccgtttcgatattaaaataaaactccataacgaacgtcttaacactataaaaacccgttccga

SEQ ID NO: 25131 - DNA, 619 bp, Artificial Sequence
  chemically treated genomic DNA (Homo sapiens) CpG-island No: 25131
tgtttttagtattcgtattttagataatacggtaatgatatttttcgcgatgtgttggaacgtcgggatcgataaataagcgtttgacgtattggtggttttgggttatgttttttggaataagttattgtaatacgaatattcgatacgcgtggataaggttcggtagatttgaatatttgataaaacgtcgatgcgtcgattgtgtatgtgttgaacgaaggcgggatgcgaacgggggtttttaaggggaattcgagatgggggagatattttaataaattagtgtgggagaaattttcgataatgggggtatttaattcgtttcgatttcggataaaagtattggcgtagcggtcggttaacgtattatcggtatcgttcgttttttgtttgtaattaaagtataggacggtacgtcggattggaatattatcgagcgtttattgaaagagtggtagtcggacgaaattatcgtcggtttgtcgttgaatatggacggtatcgagtaattattgattgttagagcgcgtaaatttgttaatcgtatttatggtcgtttcggtgttgaagtaaagttttatgacgagcgttttagtattgtggaagttcgtttcgg

SEQ ID NO: 25132 - DNA, 619 bp, Artificial Sequence
  chemically treated genomic DNA (Homo sapiens) CpG-island No: 25132
ccgaaacgaacttccacaatactaaaacgctcgtcataaaactttacttcaacaccgaaacgaccataaatacgattaacaaatttacgcgctctaacaatcaataattactcgataccgtccatattcaacgacaaaccgacgataatttcgtccgactaccactctttcaataaacgctcgataatattccaatccgacgtaccgtcctatactttaattacaaacaaaaaacgaacgataccgataatacgttaaccgaccgctacgccaatacttttatccgaaatcgaaacgaattaaatacccccattatcgaaaatttctcccacactaatttattaaaatatctcccccatctcgaattccccttaaaaacccccgttcgcatcccgccttcgttcaacacatacacaatcgacgcatcgacgttttatcaaatattcaaatctaccgaaccttatccacgcgtatcgaatattcgtattacaataacttattccaaaaaacataacccaaaaccaccaatacgtcaaacgcttatttatcgatcccgacgttccaacacatcgcgaaaaatatcattaccgtattatctaaaatacgaatactaaaaaca

SEQ ID NO: 25133 - DNA, 893 bp, Artificial Sequence
  chemically treated genomic DNA (Homo sapiens) CpG-island No: 25133
ttgttttcgcgtcggtggttttgagcgtacggcgttcggaattcggaggtgttagaggttcgggtaaagtaggtttggggagggcgcgaagtcgcgttgtttcgatttttagttatttgagttttagtttggaattttcggattttcgcgttcggttcgaacgttcgggttttttcggtgttaggcgtttcgagtgtcgcggcgcgtcgggcgcgggttgggagcggcggattgcgggcgggatagcgttttcgtttttttcgtgggagagcgcgcgtttttttaggaagttttcgtttcgttttttatttttttttttattttttttttcggtcggagggaggagttcgagtcgtcgtcgtcgtcgtcgttcgttcgttcggttcgggaggaggatcggatttcgagcggttgggagcgtacgcgagcgggtcgtggtcgcgcgggtagcgttttgagtttgtttcgcgttcgcgggttcggtcgagtaggagtagttttcggggatgttcgggcggttcggagcgcgggtagcggtagatcgtgcggtgagggcggtggcgttcgcgggatttgcggtgagtggggttcgggtaggcggggtagtttggcgtgagtgtttaatttcggttttggggttgggttttttgatttagttgcgggttcgaaggaattcgggtttcgtttcggggggttgcggcgttttagttttcgtcgttagcgcgaattcggatttcggcgtttcggtgatttagtttcgattcggttacgcgggggcgtttcgacggtatttcggattgcggggaagggcgggcggggtttttgcggaggggggcgttttcgggggttcgagtttagttgttttggggatttttttattcgtttcgaggggt

SEQ ID NO: 25134 - DNA, 893 bp, Artificial Sequence
  chemically treated genomic DNA (Homo sapiens) CpG-island No: 25134
acccctcgaaacgaataaaaaaatccccaaaacaactaaactcgaacccccgaaaacgcccccctccgcaaaaaccccgcccgcccttccccgcaatccgaaataccgtcgaaacgcccccgcgtaaccgaatcgaaactaaatcaccgaaacgccgaaatccgaattcgcgctaacgacgaaaactaaaacgccgcaaccccccgaaacgaaacccgaattccttcgaacccgcaactaaatcaaaaaacccaaccccaaaaccgaaattaaacactcacgccaaactaccccgcctacccgaaccccactcaccgcaaatcccgcgaacgccaccgccctcaccgcacgatctaccgctacccgcgctccgaaccgcccgaacatccccgaaaactactcctactcgaccgaacccgcgaacgcgaaacaaactcaaaacgctacccgcgcgaccacgacccgctcgcgtacgctcccaaccgctcgaaatccgatcctcctcccgaaccgaacgaacgaacgacgacgacgacgacgactcgaactcctccctccgaccgaaaaaaaaaataaaaaaaaaaataaaaaacgaaacgaaaacttcctaaaaaaacgcgcgctctcccacgaaaaaaacgaaaacgctatcccgcccgcaatccgccgctcccaacccgcgcccgacgcgccgcgacactcgaaacgcctaacaccgaaaaaacccgaacgttcgaaccgaacgcgaaaatccgaaaattccaaactaaaactcaaataactaaaaatcgaaacaacgcgacttcgcgccctccccaaacctactttacccgaacctctaacacctccgaattccgaacgccgtacgctcaaaaccaccgacgcgaaaacaa

SEQ ID NO: 25135 - DNA, 893 bp, Artificial Sequence
  chemically treated genomic DNA (Homo sapiens) CpG-island No: 25135
gtttttcggggcgggtggaagggtttttaaagtagttgggttcggattttcgagggcgttttttttcgtagggatttcgttcgttttttttcgtagttcgggatgtcgtcggggcgttttcgcgtggtcgggtcggagttgagttatcgaagcgtcggagttcgggttcgcgttggcggcgggggttagagcgtcgtagtttttcgaggcggaattcgggttttttcggattcgtagttggattaaagagtttagttttaaggtcgaagttgggtatttacgttaagttgtttcgtttgttcgggttttatttatcgtaggtttcgcgggcgttatcgtttttatcgtacggtttgtcgttgttcgcgtttcgagtcgttcgggtattttcgggagttgtttttgttcggtcgggttcgcgggcgcgggataggtttagggcgttgttcgcgcggttacggttcgttcgcgtgcgtttttagtcgttcggggttcggtttttttttcgggtcgggcgggcgggcggcggcggcggcggcggttcgggttttttttttcggtcgaggaggggagtggggagggaagtgggaggcgaggcgggagttttttggaggggcgcgcgtttttttacgggaggagcgggggcgttgtttcgttcgtagttcgtcgtttttagttcgcgttcggcgcgtcgcggtattcggggcgtttggtatcgagggggttcgaacgttcgggtcgaacgcgagggttcgaaggttttaggttgggatttaggtggttgaggatcggaataacgcggtttcgcgttttttttaggtttgttttgttcgagtttttggtattttcgagtttcgagcgtcgtgcgtttagggttatcgacgcgggaatag

SEQ ID NO: 25136 - DNA, 893 bp, Artificial Sequence
  chemically treated genomic DNA (Homo sapiens) CpG-island No: 25136
ctattcccgcgtcgataaccctaaacgcacgacgctcgaaactcgaaaataccaaaaactcgaacaaaacaaacctaaaaaaaacgcgaaaccgcgttattccgatcctcaaccacctaaatcccaacctaaaaccttcgaaccctcgcgttcgacccgaacgttcgaaccccctcgataccaaacgccccgaataccgcgacgcgccgaacgcgaactaaaaacgacgaactacgaacgaaacaacgcccccgctcctcccgtaaaaaaacgcgcgcccctccaaaaaactcccgcctcgcctcccacttccctccccactcccctcctcgaccgaaaaaaaaaacccgaaccgccgccgccgccgccgcccgcccgcccgacccgaaaaaaaaaccgaaccccgaacgactaaaaacgcacgcgaacgaaccgtaaccgcgcgaacaacgccctaaacctatcccgcgcccgcgaacccgaccgaacaaaaacaactcccgaaaatacccgaacgactcgaaacgcgaacaacgacaaaccgtacgataaaaacgataacgcccgcgaaacctacgataaataaaacccgaacaaacgaaacaacttaacgtaaatacccaacttcgaccttaaaactaaactctttaatccaactacgaatccgaaaaaacccgaattccgcctcgaaaaactacgacgctctaacccccgccgccaacgcgaacccgaactccgacgcttcgataactcaactccgacccgaccacgcgaaaacgccccgacgacatcccgaactacgaaaaaaaacgaacgaaatccctacgaaaaaaaacgccctcgaaaatccgaacccaactactttaaaaacccttccacccgccccgaaaaac

SEQ ID NO: 25137 - DNA, 591 bp, Artificial Sequence
  chemically treated genomic DNA (Homo sapiens) CpG-island No: 25137
ggacgttcggggtagacgcggtttaggtgggttttgaggtggtttatattttagtcgcggtcgttatttagttttaagtcgcggtggcgttggttggggttttttattaggagcgtgacgggttcgggttcggtttcggattttatggcggcggcggcggtgtcggggtttcgttgcgtttttaggtgttaggtaggcggcgttttagtcgttcgtaatttttgtaacgatcgtttacgtttttggggcgcgcgttttcgtttcgggcgttttttatagaagtttcgcgtttggttttgcggatagaacgttttgtggttgtcgtttattggttgaggcggaggtatttttttaacgtggtttaatcggcgttcggattcgggtggtagagggcggatcgagtacgtgggtacgggttgatgtaattcgtcgcgtttgcgttatttagaggcgcggttgtgtttcgggaattcgggttcggtggttatgtttgggtgcgttgtaggtcgcgcggggagtttggtttgagatttgcgaggtttttagttcgggtggttgagggcgttcgaggtagggggtggggagtggggt

SEQ ID NO: 25138 - DNA, 591 bp, Artificial Sequence
  chemically treated genomic DNA (Homo sapiens) CpG-island No: 25138
accccactccccaccccctacctcgaacgccctcaaccacccgaactaaaaacctcgcaaatctcaaaccaaactccccgcgcgacctacaacgcacccaaacataaccaccgaacccgaattcccgaaacacaaccgcgcctctaaataacgcaaacgcgacgaattacatcaacccgtacccacgtactcgatccgccctctaccacccgaatccgaacgccgattaaaccacgttaaaaaaatacctccgcctcaaccaataaacgacaaccacaaaacgttctatccgcaaaaccaaacgcgaaacttctataaaaaacgcccgaaacgaaaacgcgcgccccaaaaacgtaaacgatcgttacaaaaattacgaacgactaaaacgccgcctacctaacacctaaaaacgcaacgaaaccccgacaccgccgccgccgccataaaatccgaaaccgaacccgaacccgtcacgctcctaataaaaaaccccaaccaacgccaccgcgacttaaaactaaataacgaccgcgactaaaatataaaccacctcaaaacccacctaaaccgcgtctaccccgaacgtcc

SEQ ID NO: 25139 - DNA, 591 bp, Artificial Sequence
  chemically treated genomic DNA (Homo sapiens) CpG-island No: 25139
attttattttttattttttgtttcgggcgtttttagttattcgagttgggggtttcgtaggttttagattaagtttttcgcgcggtttgtagcgtatttaaatatggttatcgaattcgggttttcggggtatagtcgcgtttttgggtgacgtagacgcggcgggttgtattagttcgtgtttacgtgttcggttcgttttttgttattcggattcggacgtcgattgggttacgttgggagagtgttttcgttttagttaatgggcggtagttatagagcgttttgttcgtagagttaggcgcggggtttttataaaaggcgttcgaagcgggggcgcgcgttttagagacgtgaacggtcgttgtagagattgcgggcggttgagacgtcgtttgtttggtatttaggagcgtagcggagtttcgatatcgtcgtcgtcgttatggagttcgagatcgaattcgagttcgttacgtttttggtgaagagttttaattagcgttatcgcgatttggagttgagtggcgatcgcggttggagtgtgggttattttaaggtttatttgagtcgcgtttatttcgagcgttt

SEQ ID NO: 25140 - DNA, 591 bp, Artificial Sequence
  chemically treated genomic DNA (Homo sapiens) CpG-island No: 25140
aaacgctcgaaataaacgcgactcaaataaaccttaaaataacccacactccaaccgcgatcgccactcaactccaaatcgcgataacgctaattaaaactcttcaccaaaaacgtaacgaactcgaattcgatctcgaactccataacgacgacgacgatatcgaaactccgctacgctcctaaataccaaacaaacgacgtctcaaccgcccgcaatctctacaacgaccgttcacgtctctaaaacgcgcgcccccgcttcgaacgccttttataaaaaccccgcgcctaactctacgaacaaaacgctctataactaccgcccattaactaaaacgaaaacactctcccaacgtaacccaatcgacgtccgaatccgaataacaaaaaacgaaccgaacacgtaaacacgaactaatacaacccgccgcgtctacgtcacccaaaaacgcgactataccccgaaaacccgaattcgataaccatatttaaatacgctacaaaccgcgcgaaaaacttaatctaaaacctacgaaacccccaactcgaataactaaaaacgcccgaaacaaaaaataaaaaataaaat

SEQ ID NO: 25141 - DNA, 777 bp, Artificial Sequence
  chemically treated genomic DNA (Homo sapiens) CpG-island No: 25141
gaagcggcggcgttggtaacgttttcggcgttgatagatgagttggttagttacggcgagttgatgtcgattttgttgtttgttgagattttgcgcgaacgcgatgtttaggtatagtggtttgatgtacgtaaagtgatgcgtattaacgatcgatttggtcgtgtagagttagatatagtcgcgttggcggaattggtcgcgttgtagttgtttttacgttttaatgaaggtttagtgattatttagggatttatcggtagcgaaaataaaggtcgtataacgacgtttggtcgtggaggtagcgattatacggtagttttgttggcggaggttttatacgtatttcgtgttgatatttggatcgacgtttcgggtatttatattatcgatttacgcgtagttttcgtagtaaaacgtattgatgaaatcgcgtttgtcgaagcggtagagatggtaatttttggtgtaaaagtattgtattcggtaacgttgttattcgtagtacgtagcgatatttcggtttttgtcggttttagtaaagatttatgcgtaggtggtacgttggtgtgtatgaaaaggaagattcgtcgttgtatcgcgttttggcgtatcgtcgcgattagattttggttattttgtatagattgaatatgttgtattttcggggttttttcggggaagttacggtatttcggcggggtatattcggagatttaaataaatttttggtttgttattttgaaagtttattgttggtttgaagggaaggtaaat

SEQ ID NO: 25142 - DNA, 777 bp, Artificial Sequence
  chemically treated genomic DNA (Homo sapiens) CpG-island No: 25142
atttaccttcccttcaaaccaacaataaactttcaaaataacaaaccaaaaatttatttaaatctccgaatataccccgccgaaataccgtaacttccccgaaaaaaccccgaaaatacaacatattcaatctatacaaaataaccaaaatctaatcgcgacgatacgccaaaacgcgatacaacgacgaatcttccttttcatacacaccaacgtaccacctacgcataaatctttactaaaaccgacaaaaaccgaaatatcgctacgtactacgaataacaacgttaccgaatacaatacttttacaccaaaaattaccatctctaccgcttcgacaaacgcgatttcatcaatacgttttactacgaaaactacgcgtaaatcgataatataaatacccgaaacgtcgatccaaatatcaacacgaaatacgtataaaacctccgccaacaaaactaccgtataatcgctacctccacgaccaaacgtcgttatacgacctttattttcgctaccgataaatccctaaataatcactaaaccttcattaaaacgtaaaaacaactacaacgcgaccaattccgccaacgcgactatatctaactctacacgaccaaatcgatcgttaatacgcatcactttacgtacatcaaaccactatacctaaacatcgcgttcgcgcaaaatctcaacaaacaacaaaatcgacatcaactcgccgtaactaaccaactcatctatcaacgccgaaaacgttaccaacgccgccgcttc

SEQ ID NO: 25143 - DNA, 777 bp, Artificial Sequence
  chemically treated genomic DNA (Homo sapiens) CpG-island No: 25143
gtttattttttttttaagttagtagtgggtttttaggatgataggttaaagatttgtttaggttttcgaatatatttcgtcgaggtgtcgtaattttttcgaggaaatttcgagaatgtagtatatttagtttgtgtaaagtgattagagtttgatcgcgacgatgcgttagagcgcggtatagcgacggatttttttttttatgtatattagcgtattatttgcgtatgggtttttgttggagtcgataaagatcgggatatcgttgcgtattgcgggtagtaacgttgtcggatgtagtatttttgtattaaaagttgttatttttgtcgtttcggtaaacgcgattttattaatgcgttttgttgcggaaattacgcgtggatcggtggtgtagatgttcgggacgtcggtttagatattaatacgagatgcgtgtaaagttttcgttagtaaggttgtcgtataatcgttgtttttacggttaagcgtcgttgtacgatttttattttcgttatcgataaatttttgggtgattattaagtttttattgagacgtgggagtagttgtagcgcggttagtttcgttagcgcggttatatttggttttgtacgattaaatcggtcgttggtacgtattattttacgtatattaaattattgtgtttgaatatcgcgttcgcgtaggattttaataaatagtagggtcgatattagttcgtcgtggttgattagtttatttgttagcgtcggagacgttgttagcgtcgtcgtttt

SEQ ID NO: 25144 - DNA, 777 bp, Artificial Sequence
  chemically treated genomic DNA (Homo sapiens) CpG-island No: 25144
aaaacgacgacgctaacaacgtctccgacgctaacaaataaactaatcaaccacgacgaactaatatcgaccctactatttattaaaatcctacgcgaacgcgatattcaaacacaataatttaatatacgtaaaataatacgtaccaacgaccgatttaatcgtacaaaaccaaatataaccgcgctaacgaaactaaccgcgctacaactactcccacgtctcaataaaaacttaataatcacccaaaaatttatcgataacgaaaataaaaatcgtacaacgacgcttaaccgtaaaaacaacgattatacgacaaccttactaacgaaaactttacacgcatctcgtattaatatctaaaccgacgtcccgaacatctacaccaccgatccacgcgtaatttccgcaacaaaacgcattaataaaatcgcgtttaccgaaacgacaaaaataacaacttttaatacaaaaatactacatccgacaacgttactacccgcaatacgcaacgatatcccgatctttatcgactccaacaaaaacccatacgcaaataatacgctaatatacataaaaaaaaaaatccgtcgctataccgcgctctaacgcatcgtcgcgatcaaactctaatcactttacacaaactaaatatactacattctcgaaatttcctcgaaaaaattacgacacctcgacgaaatatattcgaaaacctaaacaaatctttaacctatcatcctaaaaacccactactaacttaaaaaaaaaataaac

SEQ ID NO: 25145 - DNA, 559 bp, Artificial Sequence
  chemically treated genomic DNA (Homo sapiens) CpG-island No: 25145
  misc_feature (505)..(505): n is either a, c, g or t
  misc_feature (509)..(510): n is either a, c, g or t
  misc_feature (538)..(538): n is either a, c, g or t
cgggacgtacgcgcggggttttatcgtcgtcggcggtatcgcgcggtattcggggcggtcgatcggttttcggcgattttcgcggttttttttattatcgtcgtcgtagtcgcggtcggtttttcggaatcgttttttttttcgtacgcgtcgtaggtcgattttcggaatttttcgggaagtttatcgggttttacgcggggcgttatcgattcggtttttaaggcgcgcgtcgggggacgcggacgtcgggtcgattagtggtcggcggcggcgttttacgaggcggtgtcgggttcggttttaggcggggttattaacgaacgtgaagtcggtgagtcgttcggggggaagaagaggatcggcgggcggcgggcggggaagagggtatagacgggcgggcgagggtcggggatcgcgagggtaagggtattcgggagttcgtagaggcggcggttcggggagaaattttaggtacggtcgggttttcggggatatttttagngtgnnttgttcgagtgtagattagagtatgggnttttaatttatttttggtttt

SEQ ID NO: 25146 - DNA, 559 bp, Artificial Sequence
  chemically treated genomic DNA (Homo sapiens) CpG-island No: 25146
  misc_feature (22)..(22): n is either a, c, g or t
  misc_feature (50)..(51): n is either a, c, g or t
  misc_feature (55)..(55): n is either a, c, g or t
aaaaccaaaaataaattaaaancccatactctaatctacactcgaacaanncacnctaaaaatatccccgaaaacccgaccgtacctaaaatttctccccgaaccgccgcctctacgaactcccgaatacccttaccctcgcgatccccgaccctcgcccgcccgtctataccctcttccccgcccgccgcccgccgatcctcttcttccccccgaacgactcaccgacttcacgttcgttaataaccccgcctaaaaccgaacccgacaccgcctcgtaaaacgccgccgccgaccactaatcgacccgacgtccgcgtcccccgacgcgcgccttaaaaaccgaatcgataacgccccgcgtaaaacccgataaacttcccgaaaaattccgaaaatcgacctacgacgcgtacgaaaaaaaaaacgattccgaaaaaccgaccgcgactacgacgacgataataaaaaaaaccgcgaaaatcgccgaaaaccgatcgaccgccccgaataccgcgcgataccgccgacgacgataaaaccccgcgcgtacgtcccg

SEQ ID NO: 25147 - DNA, 559 bp, Artificial Sequence
  chemically treated genomic DNA (Homo sapiens) CpG-island No: 25147
  misc_feature (22)..(22): n is either a, c, g or t
  misc_feature (50)..(51): n is either a, c, g or t
  misc_feature (55)..(55): n is either a, c, g or t
agaattaaaagtaaattggggntttatattttgatttatattcgaatagnntatnttagaggtattttcggaggttcggtcgtgtttgaggttttttttcgagtcgtcgtttttgcgggttttcgggtgtttttgttttcgcggttttcggttttcgttcgttcgtttgtgttttttttttcgttcgtcgttcgtcgatttttttttttttttcgagcggtttatcggttttacgttcgttggtggtttcgtttgggatcgaattcggtatcgtttcgtggggcgtcgtcgtcggttattgatcggttcggcgttcgcgtttttcggcgcgcgttttggggatcgggtcggtggcgtttcgcgtggggttcggtgggtttttcggagggtttcgggggtcggtttgcggcgcgtgcgggggaggagacggtttcgggggatcggtcgcgattgcggcggcggtggtggggggagtcgcggggatcgtcgagggtcggtcggtcgtttcgggtgtcgcgcggtgtcgtcggcggcggtgaggtttcgcgcgtgcgtttcg

SEQ ID NO: 25148 - DNA, 559 bp, Artificial Sequence
  chemically treated genomic DNA (Homo sapiens) CpG-island No: 25148
  misc_feature (505)..(505): n is either a, c, g or t
  misc_feature (509)..(510): n is either a, c, g or t
  misc_feature (538)..(538): n is either a, c, g or t
cgaaacgcacgcgcgaaacctcaccgccgccgacgacaccgcgcgacacccgaaacgaccgaccgaccctcgacgatccccgcgactccccccaccaccgccgccgcaatcgcgaccgatcccccgaaaccgtctcctcccccgcacgcgccgcaaaccgacccccgaaaccctccgaaaaacccaccgaaccccacgcgaaacgccaccgacccgatccccaaaacgcgcgccgaaaaacgcgaacgccgaaccgatcaataaccgacgacgacgccccacgaaacgataccgaattcgatcccaaacgaaaccaccaacgaacgtaaaaccgataaaccgctcgaaaaaaaaaaaaaaatcgacgaacgacgaacgaaaaaaaaaacacaaacgaacgaacgaaaaccgaaaaccgcgaaaacaaaaacacccgaaaacccgcaaaaacgacgactcgaaaaaaaacctcaaacacgaccgaacctccgaaaatacctctaanatannctattcgaatataaatcaaaatataaanccccaatttacttttaattct

SEQ ID NO: 25149 - DNA, 524 bp, Artificial Sequence
  chemically treated genomic DNA (Homo sapiens) CpG-island No: 25149
agggggtacgaaaagttataggggagcggaagttagtcggtcggttagagagataaacggattcggataaatttatatataggggaaggggcgggggataaattcgcggaaacgagaacgtttgatacgtacggaacggagttagcggggagggggtgacgcggacgtttcgggcgttcgtagcggagagcgtacgggggtacggtggttttcgtcgtttttttcgtcgttttcgggtgggttagagattcggattcgggtcggtatcgggagtcgggacgttcggacgcgcgagagaatagtaggttcgcgggtttcggtaggcggtttaagtaggagcgcggtcggttagtcgggttatcggtaggttagagtttcgcgcgtattcggaggtttaatttttttagcgataggtcgttagaggatagcgtgttagtaataattcggagggataaaaaagttaattcggagcgaagaatatattatatatagagtcgagagagatatagtaatagagatatata

SEQ ID NO: 25150 - DNA, 524 bp, Artificial Sequence
  chemically treated genomic DNA (Homo sapiens) CpG-island No: 25150
tatatatctctattactatatctctctcgactctatatataatatattcttcgctccgaattaacttttttatccctccgaattattactaacacgctatcctctaacgacctatcgctaaaaaaattaaacctccgaatacgcgcgaaactctaacctaccgataacccgactaaccgaccgcgctcctacttaaaccgcctaccgaaacccgcgaacctactattctctcgcgcgtccgaacgtcccgactcccgataccgacccgaatccgaatctctaacccacccgaaaacgacgaaaaaaacgacgaaaaccaccgtacccccgtacgctctccgctacgaacgcccgaaacgtccgcgtcaccccctccccgctaactccgttccgtacgtatcaaacgttctcgtttccgcgaatttatcccccgccccttcccctatatataaatttatccgaatccgtttatctctctaaccgaccgactaacttccgctcccctataacttttcgtaccccct

SEQ ID NO: 25151 - DNA, 524 bp, Artificial Sequence
  chemically treated genomic DNA (Homo sapiens) CpG-island No: 25151
tgtgtgtttttgttattgtgtttttttcggttttgtgtgtggtatatttttcgtttcgagttggtttttttgttttttcgggttattgttgatacgttgttttttggcgatttgtcgttggagaggttgggttttcggatgcgcgcggggttttggtttatcggtgattcggttagtcggtcgcgtttttgtttgagtcgtttgtcggggttcgcgggtttgttgttttttcgcgcgttcgagcgtttcgattttcggtgtcggttcgggttcgggtttttgatttattcgggggcggcggggaaggcggcgagggttatcgtgttttcgtgcgtttttcgttgcgggcgttcggggcgttcgcgttatttttttttcgttggtttcgtttcgtgcgtgttaggcgttttcgttttcgcgggtttgtttttcgtttttttttttgtgtgtgggtttgttcggattcgtttgtttttttggtcggtcggttggttttcgtttttttgtggtttttcgtgtttttt

SEQ ID NO: 25152 - DNA, 524 bp, Artificial Sequence
  chemically treated genomic DNA (Homo sapiens) CpG-island No: 25152
aaaaaacacgaaaaaccacaaaaaaacgaaaaccaaccgaccgaccaaaaaaacaaacgaatccgaacaaacccacacacaaaaaaaaaaacgaaaaacaaacccgcgaaaacgaaaacgcctaacacgcacgaaacgaaaccaacgaaaaaaaaataacgcgaacgccccgaacgcccgcaacgaaaaacgcacgaaaacacgataaccctcgccgccttccccgccgcccccgaataaatcaaaaacccgaacccgaaccgacaccgaaaatcgaaacgctcgaacgcgcgaaaaaacaacaaacccgcgaaccccgacaaacgactcaaacaaaaacgcgaccgactaaccgaatcaccgataaaccaaaaccccgcgcgcatccgaaaacccaacctctccaacgacaaatcgccaaaaaacaacgtatcaacaataacccgaaaaaacaaaaaaaccaactcgaaacgaaaaatataccacacacaaaaccgaaaaaaacacaataacaaaaacacaca

SEQ ID NO: 25153 - DNA, 981 bp, Artificial Sequence
  chemically treated genomic DNA (Homo sapiens) CpG-island No: 25153
ttatattacggggaggcgcgcgtcgtttattcgggggcgagcgcggatattattttataggcgttcgggggttttcgtttttacggcgcggggcgtacgttatacgcgcggtaggcgcgcgacggtcgtcgggtaaagtttttattcgacggtcgtttcggcggcggcggcggcgcggtttcggtcggggagcggaattttcgggggaggcgtaggagggttttttaagttcgcgtcggcgttttttcgtgggggggtcgggttattttttttacggcgcgatcgtttttttatttttttttttcgcgttttcgtttcggcgacggggggggtgtcgcgcgcgggtcggggggcggggcggattgtttttagtgcgtttcgggcgggtcgcgtcgtcgggttcgggggaggttttttcggggttacgcgcgcgtttttcgaagagggggacggcggagcgagcgtacggggtcggcggcgacgtcggttatttattcgattcgttttgaaatacggattaaggagtttaatacgtgcgcgagtcgggggttcgtacgaaagtcgtcgtggcgtaatgaaggtgaaggtcggcgcgttcgtcggtcgaggtgggatttcgaggtttttttagttcgttagggcgtattatcggttcgtttcgttcgtcgcgtcggggaggtggagtacgagcgtacgtgttaggattcgaaagatggtgaattatgtttgggtagggcgaagttagaggaaattttggtggaggttcgtagcggttttgacgtgtaaatcggtcgttcgatttgggtataggggcgaaagattaatcgaattatttagtagttggtttttttcgaagttttttttaggatagttggcgttttcgtagattcgacgtattttcgttacgtagttttattcggtaaagcgaatgattagaggttttggggtcgaaacgattttaatttatttttaaattttaaa

SEQ ID NO: 25154 - DNA, 981 bp, Artificial Sequence
  chemically treated genomic DNA (Homo sapiens) CpG-island No: 25154
tttaaaatttaaaaataaattaaaatcgtttcgaccccaaaacctctaatcattcgctttaccgaataaaactacgtaacgaaaatacgtcgaatctacgaaaacgccaactatcctaaaaaaaacttcgaaaaaaaccaactactaaataattcgattaatctttcgcccctatacccaaatcgaacgaccgatttacacgtcaaaaccgctacgaacctccaccaaaatttcctctaacttcgccctacccaaacataattcaccatctttcgaatcctaacacgtacgctcgtactccacctccccgacgcgacgaacgaaacgaaccgataatacgccctaacgaactaaaaaaacctcgaaatcccacctcgaccgacgaacgcgccgaccttcaccttcattacgccacgacgactttcgtacgaacccccgactcgcgcacgtattaaactccttaatccgtatttcaaaacgaatcgaataaataaccgacgtcgccgccgaccccgtacgctcgctccgccgtccccctcttcgaaaaacgcgcgcgtaaccccgaaaaaacctcccccgaacccgacgacgcgacccgcccgaaacgcactaaaaacaatccgccccgccccccgacccgcgcgcgacaccccccccgtcgccgaaacgaaaacgcgaaaaaaaaaaataaaaaaacgatcgcgccgtaaaaaaaataacccgacccccccacgaaaaaacgccgacgcgaacttaaaaaaccctcctacgcctcccccgaaaattccgctccccgaccgaaaccgcgccgccgccgccgccgaaacgaccgtcgaataaaaactttacccgacgaccgtcgcgcgcctaccgcgcgtataacgtacgccccgcgccgtaaaaacgaaaacccccgaacgcctataaaataatatccgcgctcgcccccgaataaacgacgcgcgcctccccgtaatataa

SEQ ID NO: 25155 - DNA, 981 bp, Artificial Sequence
  chemically treated genomic DNA (Homo sapiens) CpG-island No: 25155
tttaaagtttgagaataggttgagatcgtttcggttttaagatttttaattattcgttttatcggataaaattgcgtggcgggggtgcgtcgggtttgcgagagcgttagttattttgagggaaatttcggagggaattagttattagatggttcgattagtttttcgtttttatatttaggtcggacgatcgatttgtacgttaggatcgttacggatttttattagagttttttttggtttcgttttgtttaggtatagtttattatttttcgggttttaatacgtgcgttcgtgttttattttttcggcgcggcgggcgagacgggtcggtggtgcgttttggcggattggagaggtttcgggattttatttcggtcggcgagcgcgtcggtttttatttttattgcgttacggcggttttcgtgcgagttttcgattcgcgtacgtgttagattttttggttcgtgttttaagacgggtcgggtgggtagtcgacgtcgtcgtcgatttcgtgcgttcgtttcgtcgttttttttttcgggggacgcgcgcgtggtttcgagagaatttttttcgggttcgacggcgcgattcgttcggggcgtattggggatagttcgtttcgtttttcgattcgcgcgcggtatttttttcgtcgtcggggcgggggcgcggggaggaggggtgggagagcggtcgcgtcgtgggaggggtggttcggtttttttacgaggagacgtcggcgcgaatttgggggatttttttgcgtttttttcggggatttcgtttttcggtcggggtcgcgtcgtcgtcgtcgtcgaggcggtcgtcgggtgggggttttattcggcggtcgtcgcgcgtttgtcgcgcgtgtggcgtgcgtttcgcgtcgtgggggcgggaattttcgggcgtttgtggggtggtgttcgcgttcgttttcgagtgggcggcgcgcgttttttcgtggtgtga

SEQ ID NO: 25156 - DNA, 981 bp, Artificial Sequence
  chemically treated genomic DNA (Homo sapiens) CpG-island No: 25156
tcacaccacgaaaaaacgcgcgccgcccactcgaaaacgaacgcgaacaccaccccacaaacgcccgaaaattcccgcccccacgacgcgaaacgcacgccacacgcgcgacaaacgcgcgacgaccgccgaataaaacccccacccgacgaccgcctcgacgacgacgacgacgcgaccccgaccgaaaaacgaaatccccgaaaaaaacgcaaaaaaatcccccaaattcgcgccgacgtctcctcgtaaaaaaaccgaaccacccctcccacgacgcgaccgctctcccacccctcctccccgcgcccccgccccgacgacgaaaaaaataccgcgcgcgaatcgaaaaacgaaacgaactatccccaatacgccccgaacgaatcgcgccgtcgaacccgaaaaaaattctctcgaaaccacgcgcgcgtcccccgaaaaaaaaaacgacgaaacgaacgcacgaaatcgacgacgacgtcgactacccacccgacccgtcttaaaacacgaaccaaaaaatctaacacgtacgcgaatcgaaaactcgcacgaaaaccgccgtaacgcaataaaaataaaaaccgacgcgctcgccgaccgaaataaaatcccgaaacctctccaatccgccaaaacgcaccaccgacccgtctcgcccgccgcgccgaaaaaataaaacacgaacgcacgtattaaaacccgaaaaataataaactatacctaaacaaaacgaaaccaaaaaaaactctaataaaaatccgtaacgatcctaacgtacaaatcgatcgtccgacctaaatataaaaacgaaaaactaatcgaaccatctaataactaattccctccgaaatttccctcaaaataactaacgctctcgcaaacccgacgcacccccgccacgcaattttatccgataaaacgaataattaaaaatcttaaaaccgaaacgatctcaacctattctcaaactttaaa

SEQ ID NO: 25157 - DNA, 560 bp, Artificial Sequence
  chemically treated genomic DNA (Homo sapiens) CpG-island No: 25157
  misc_feature (547)..(547): n is either a, c, g or t
gcggcgggttttcgcgggtcgcggttcgggtttcgggagttacggcgcgttggtcgatcggttcgggtagttttacgttcgtcgcgggtttagaagcgtagcgatagttttttttttatataaatttgtacgttagagttgtgatttataagcgacgcgttatagttttggtttatcgggttagtcgggttgacgatcgcgggtttttcggagttttgtttagtttatagcggggacggttttttttttcggtagttgttatcgtagtttcggaagtcgagagtacgattttaaagcggtcgttagatggagttcgataatcgtcgcggacgttagcgagatagattcggttggtagggcgggtcgtggatcgcgaaagcgaaatcgggagtcgagaagtttttttcgaggtcgaaaacgtaggttttttgttttaattttatataaacggtgtttaaaacgcgtttatgttttgatttcgatagagttagaagataatttacggcgtgtgggtgtttggagatgtttttcggaagtagggatgganggaaggaaggagg

SEQ ID NO: 25158 - DNA, 560 bp, Artificial Sequence
  chemically treated genomic DNA (Homo sapiens) CpG-island No: 25158
  misc_feature (14)..(14): n is either a, c, g or t
cctccttccttccntccatccctacttccgaaaaacatctccaaacacccacacgccgtaaattatcttctaactctatcgaaatcaaaacataaacgcgttttaaacaccgtttatataaaattaaaacaaaaaacctacgttttcgacctcgaaaaaaacttctcgactcccgatttcgctttcgcgatccacgacccgccctaccaaccgaatctatctcgctaacgtccgcgacgattatcgaactccatctaacgaccgctttaaaatcgtactctcgacttccgaaactacgataacaactaccgaaaaaaaaaaccgtccccgctataaactaaacaaaactccgaaaaacccgcgatcgtcaacccgactaacccgataaaccaaaactataacgcgtcgcttataaatcacaactctaacgtacaaatttatataaaaaaaaaactatcgctacgcttctaaacccgcgacgaacgtaaaactacccgaaccgatcgaccaacgcgccgtaactcccgaaacccgaaccgcgacccgcgaaaacccgccgc

SEQ ID NO: 25159 - DNA, 560 bp, Artificial Sequence
  chemically treated genomic DNA (Homo sapiens) CpG-island No: 25159
  misc_feature (14)..(14): n is either a, c, g or t
tttttttttttttntttatttttgttttcgagaggtatttttaaatatttatacgtcgtgggttgttttttgattttgtcgggattaaggtatagacgcgttttgggtatcgtttgtgtggggttggggtagagggtttgcgttttcggtttcggaaagagtttttcgattttcggtttcgttttcgcggtttacggttcgttttgttagtcggatttgtttcgttgacgttcgcggcggttgtcgggttttatttggcggtcgttttgagatcgtgttttcggttttcggagttgcggtggtagttgtcgagggaggggatcgttttcgttgtgagttaggtagagtttcggaaagttcgcggtcgttagttcggttggttcggtgggttagagttgtggcgcgtcgtttgtgagttatagttttggcgtgtaggtttatgtgggggagaggttgtcgttgcgtttttgggttcgcggcgggcgtggggttgttcgggtcggtcgattagcgcgtcgtagttttcgaggttcgagtcgcgattcgcggggattcgtcgt

SEQ ID NO: 25160 - DNA, 560 bp, Artificial Sequence
  chemically treated genomic DNA (Homo sapiens) CpG-island No: 25160
  misc_feature (547)..(547): n is either a, c, g or t
acgacgaatccccgcgaatcgcgactcgaacctcgaaaactacgacgcgctaatcgaccgacccgaacaaccccacgcccgccgcgaacccaaaaacgcaacgacaacctctcccccacataaacctacacgccaaaactataactcacaaacgacgcgccacaactctaacccaccgaaccaaccgaactaacgaccgcgaactttccgaaactctacctaactcacaacgaaaacgatcccctccctcgacaactaccaccgcaactccgaaaaccgaaaacacgatctcaaaacgaccgccaaataaaacccgacaaccgccgcgaacgtcaacgaaacaaatccgactaacaaaacgaaccgtaaaccgcgaaaacgaaaccgaaaatcgaaaaactctttccgaaaccgaaaacgcaaaccctctaccccaaccccacacaaacgatacccaaaacgcgtctataccttaatcccgacaaaatcaaaaaacaacccacgacgtataaatatttaaaaatacctctcgaaaacaaaaataaanaaaaaaaaaaaaa

SEQ ID NO: 25161 - DNA, 546 bp, Artificial Sequence
  chemically treated genomic DNA (Homo sapiens) CpG-island No: 25161
  misc_feature (382)..(382): n is either a, c, g or t
tcgcggtggggttgaaaaaaatgtgggagagggagtttcgcgtggttttagttttatcgcgggtcgaggtcggtggaggtcgcgggcgcgcgaacgggaatcgacgttttcgcgtcggtgcgtcgtagcgttcggcggtcgtttgttggtcgattcgggatacgtgtaggcgtcggttaagttcggagttcgcgggcggtagttggtcgatttcggaggtgtcgatcgagacggggacgtttcggttgcggttcgtttcgacgggtatttttatacgtcgttcggtggagaaggttcgtcggtcgattcgggatacggcgagacgtcggttgagttttacgttcgcgggcggtaggcggtcgatttcggaggttcgatcgangagaggtcgcgagcggcggtcggtcggttgcggggatatatatttggggttttgtcgatcgtcggtcgttattcgtggggtgttggttaatttttgcggagggacgaggaggaaggacgtttatagatcgggtatttatgggttgaaaataggaatatgagtcg

SEQ ID NO: 25162 - DNA, 546 bp, Artificial Sequence
  chemically treated genomic DNA (Homo sapiens) CpG-island No: 25162
  misc_feature (165)..(165): n is either a, c, g or t
cgactcatattcctattttcaacccataaatacccgatctataaacgtccttcctcctcgtccctccgcaaaaattaaccaacaccccacgaataacgaccgacgatcgacaaaaccccaaatatatatccccgcaaccgaccgaccgccgctcgcgacctctcntcgatcgaacctccgaaatcgaccgcctaccgcccgcgaacgtaaaactcaaccgacgtctcgccgtatcccgaatcgaccgacgaaccttctccaccgaacgacgtataaaaatacccgtcgaaacgaaccgcaaccgaaacgtccccgtctcgatcgacacctccgaaatcgaccaactaccgcccgcgaactccgaacttaaccgacgcctacacgtatcccgaatcgaccaacaaacgaccgccgaacgctacgacgcaccgacgcgaaaacgtcgattcccgttcgcgcgcccgcgacctccaccgacctcgacccgcgataaaactaaaaccacgcgaaactccctctcccacatttttttcaaccccaccgcga

SEQ ID NO: 25163 - DNA, 546 bp, Artificial Sequence
  chemically treated genomic DNA (Homo sapiens) CpG-island No: 25163
  misc_feature (165)..(165): n is either a, c, g or t
cggtttatatttttatttttagtttatgggtattcggtttatgagcgtttttttttttcgttttttcgtaggggttgattagtattttacgggtggcggtcggcggtcggtaaggttttaaatgtgtgttttcgtaatcggtcgatcgtcgttcgcgattttttntcggtcgggttttcggggtcgatcgtttgtcgttcgcgggcgtgagatttagtcggcgtttcgtcgtgtttcgggtcgatcggcgggttttttttatcgagcggcgtgtaggagtgttcgtcgggacgaatcgtaatcggagcgttttcgtttcggtcggtattttcggggtcgattagttgtcgttcgcgagtttcggatttagtcggcgtttgtacgtgtttcgggtcgattagtaggcggtcgtcggacgttgcggcgtatcgacgcgagggcgtcgattttcgttcgcgcgttcgcgatttttatcggtttcggttcgcggtggagttgggattacgcggaatttttttttttatattttttttagttttatcgcga

SEQ ID NO: 25164 - DNA, 546 bp, Artificial Sequence
  chemically treated genomic DNA (Homo sapiens) CpG-island No: 25164
  misc_feature (382)..(382): n is either a, c, g or t
tcgcgataaaactaaaaaaaatataaaaaaaaaaattccgcgtaatcccaactccaccgcgaaccgaaaccgataaaaatcgcgaacgcgcgaacgaaaatcgacgccctcgcgtcgatacgccgcaacgtccgacgaccgcctactaatcgacccgaaacacgtacaaacgccgactaaatccgaaactcgcgaacgacaactaatcgaccccgaaaataccgaccgaaacgaaaacgctccgattacgattcgtcccgacgaacactcctacacgccgctcgataaaaaaaacccgccgatcgacccgaaacacgacgaaacgccgactaaatctcacgcccgcgaacgacaaacgatcgaccccgaaaacccgaccganaaaaaatcgcgaacgacgatcgaccgattacgaaaacacacatttaaaaccttaccgaccgccgaccgccacccgtaaaatactaatcaacccctacgaaaaaacgaaaaaaaaaaacgctcataaaccgaatacccataaactaaaaataaaaatataaaccg

SEQ ID NO: 25165 - DNA, 536 bp, Artificial Sequence
  chemically treated genomic DNA (Homo sapiens) CpG-island No: 25165
  misc_feature (132)..(132): n is either a, c, g or t
attcgagtcggttttttattcgattaagttttagttttgttttttttttttcgtagtttcggttttagtcgattttttcgattaaaaattttttcgtttagttcgtttattttttcgtttatttaacgtttngttttttttagttatttgatttcggtttgtttattcgttttatttaggcggcgtattagttagttagtacgttttttttttttaattttttaatttttttttcgtgtgttttgttcgtttattaggcgtagtttgtttaacgttttgtacgggttttatcggtttcgttagtcgttttcgcgttagttcgttttttttagttagttcgttcgcggttcgttcgtcgttcgttcgtcgtttttttcgtttgcggagcgttagattcgttttcgagaggtttttaggtcggtcgttcggtcgcgtcggggtttcgacgcgttttattttatttatttggttgattttgttagtagtatatgtttgttttaaagattaagttatgtatgtttaagtacgtacggacg

SEQ ID NO: 25166 - DNA, 536 bp, Artificial Sequence
  chemically treated genomic DNA (Homo sapiens) CpG-island No: 25166
  misc_feature (405)..(405): n is either a, c, g or t
cgtccgtacgtacttaaacatacataacttaatctttaaaacaaacatatactactaacaaaatcaaccaaataaataaaataaaacgcgtcgaaaccccgacgcgaccgaacgaccgacctaaaaacctctcgaaaacgaatctaacgctccgcaaacgaaaaaaacgacgaacgaacgacgaacgaaccgcgaacgaactaactaaaaaaaacgaactaacgcgaaaacgactaacgaaaccgataaaacccgtacaaaacgttaaacaaactacgcctaataaacgaacaaaacacacgaaaaaaaaattaaaaaattaaaaaaaaaaaacgtactaactaactaatacgccgcctaaataaaacgaataaacaaaccgaaatcaaataactaaaaaaaacnaaacgttaaataaacgaaaaaataaacgaactaaacgaaaaaatttttaatcgaaaaaatcgactaaaaccgaaactacgaaaaaaaaaaaacaaaactaaaacttaatcgaataaaaaaccgactcgaat

SEQ ID NO: 25167 - DNA, 536 bp, Artificial Sequence
  chemically treated genomic DNA (Homo sapiens) CpG-island No: 25167
  misc_feature (405)..(405): n is either a, c, g or t
cgttcgtgcgtatttagatatgtatggtttaatttttgagataagtatatgttattggtaggattaattaggtaggtaaggtagagcgcgtcgaggtttcgacgcggtcggacggtcggtttgggggtttttcgaggacgggtttggcgtttcgtaagcgaggaggacgacggacggacggcggacgggtcgcggacgggttgattggagggagcgagttggcgcgggggcggttgacgggatcggtggggttcgtgtagagcgttaagtaaattacgtttaatgaacgggtagggtatacgagaagagggttggggggttgaggagaggaggcgtattggttggttggtgcgtcgtttgggtaaagcgggtgggtagatcggggttaggtgattggaagggatngggcgttaaatggacgaaaggatgggcgagttggacgagggggtttttaatcgggaaggtcggttggaatcgggattacgggaagaaaagggtagggttggggtttgatcgggtaggggatcggttcgggt

SEQ ID NO: 25168 - DNA, 536 bp, Artificial Sequence
  chemically treated genomic DNA (Homo sapiens) CpG-island No: 25168
  misc_feature (132)..(132): n is either a, c, g or t
acccgaaccgatcccctacccgatcaaaccccaaccctacccttttcttcccgtaatcccgattccaaccgaccttcccgattaaaaaccccctcgtccaactcgcccatcctttcgtccatttaacgcccnatcccttccaatcacctaaccccgatctacccacccgctttacccaaacgacgcaccaaccaaccaatacgcctcctctcctcaaccccccaaccctcttctcgtataccctacccgttcattaaacgtaatttacttaacgctctacacgaaccccaccgatcccgtcaaccgcccccgcgccaactcgctccctccaatcaacccgtccgcgacccgtccgccgtccgtccgtcgtcctcctcgcttacgaaacgccaaacccgtcctcgaaaaacccccaaaccgaccgtccgaccgcgtcgaaacctcgacgcgctctaccttacctacctaattaatcctaccaataacatatacttatctcaaaaattaaaccatacatatctaaatacgcacgaacg

SEQ ID NO: 25169 - DNA, 878 bp, Artificial Sequence
  chemically treated genomic DNA (Homo sapiens) CpG-island No: 25169
atcgttttaaaaaaaaaaaaaaagttacgattttttaggggttcggggggcgttgttcgttttttatttcgcgttaaggagggaaattattatcggttatcgttttttgcgtcgtcgttgtcgttatcggttgtagttttagtcgttcggttcgttcgttttttttttttatatagcgagttaataagttgcgcgagttattatcgtcgtcgtcgtcgtcgtcgagagatagggtgaagggggagggaggggcggaaagggcgggggtagaggtgggcggggttgagcgcgagatatcgcgagagtcgcgtgcgtaggcgcgtcggggcggaggtcgtcggcgagtcgcgttgttacgcgtcgtggcgggtattggattggcggagttcggggagtgaagtagtgaaatcggatttacgtttttttaacgttcgcgtgattacgtggttggtatttaggcggaagtttgcggtagttttttgcggtgaagaatttgtaaagcgttgttggaaaagacgggagttttattgatattttagtttaaagttaggtgggatcgttttttgtcgtacgttttcgtttggtttcgcgttttaggagttaggaaatgtgatagaggcggtgtttattgtttcgttaggaatggtcgcggaggaggattggttacgtggcgtggttttcggtttttggcgcgtttttattcgggaaggttttaaatgcggagttattttttgatttgttagcgaggttttgattgtgagtttcgcggcgttcgcgttttatcgttttatcgagggtgggtttttcgcgcgtagaattgtgtaggattttttaaagggagtaaaagtcgatcggggtttatttttaatattttataa

SEQ ID NO: 25170 - DNA, 878 bp, Artificial Sequence
  chemically treated genomic DNA (Homo sapiens) CpG-island No: 25170
ttataaaatattaaaaataaaccccgatcgacttttactccctttaaaaaatcctacacaattctacgcgcgaaaaacccaccctcgataaaacgataaaacgcgaacgccgcgaaactcacaatcaaaacctcgctaacaaatcaaaaaataactccgcatttaaaaccttcccgaataaaaacgcgccaaaaaccgaaaaccacgccacgtaaccaatcctcctccgcgaccattcctaacgaaacaataaacaccgcctctatcacatttcctaactcctaaaacgcgaaaccaaacgaaaacgtacgacaaaaaacgatcccacctaactttaaactaaaatatcaataaaactcccgtcttttccaacaacgctttacaaattcttcaccgcaaaaaactaccgcaaacttccgcctaaataccaaccacgtaatcacgcgaacgttaaaaaaacgtaaatccgatttcactacttcactccccgaactccgccaatccaatacccgccacgacgcgtaacaacgcgactcgccgacgacctccgccccgacgcgcctacgcacgcgactctcgcgatatctcgcgctcaaccccgcccacctctacccccgccctttccgcccctccctcccccttcaccctatctctcgacgacgacgacgacgacgataataactcgcgcaacttattaactcgctatataaaaaaaaaaaacgaacgaaccgaacgactaaaactacaaccgataacgacaacgacgacgcaaaaaacgataaccgataataatttccctccttaacgcgaaataaaaaacgaacaacgccccccgaacccctaaaaaatcgtaactttttttttttttttaaaacgat

SEQ ID NO: 25171 - DNA, 878 bp, Artificial Sequence
  chemically treated genomic DNA (Homo sapiens) CpG-island No: 25171
ttgtggaatgttaaaagtaggtttcgatcggtttttattttttttggaaaattttatataattttgcgcgcgaaagatttattttcggtgaggcggtgaggcgcgaacgtcgcgaagtttatagttaaagtttcgttgataaattaagagatgatttcgtatttaaaattttttcgaataggaacgcgttagaggtcggaagttacgttacgtgattagttttttttcgcggttatttttagcgaggtagtaggtatcgtttttgttatattttttagtttttaaagcgcgggattaggcggaaacgtgcgataggaggcggttttatttagttttggattggagtgttagtagaattttcgttttttttagtaacgttttgtaagttttttatcgtaaagaattgtcgtagattttcgtttgggtgttaattacgtgattacgcgagcgttggagaggcgtaggttcgattttattattttatttttcgggtttcgttagtttagtattcgttacggcgcgtgataacgcggttcgtcggcggttttcgtttcggcgcgtttgcgtacgcggttttcgcggtgtttcgcgtttagtttcgtttatttttgttttcgtttttttcgtttttttttttttttttattttgtttttcggcggcggcggcggcggcggtggtggttcgcgtagtttgttggttcgttatataaaggagagaagcgggcggatcggacggttggagttgtagtcggtggcggtagcggcggcgtagggagcggtgatcggtggtggtttttttttttggcgcggggtggggagcgggtaacgtttttcggatttttgaagggtcgtggttttttttttttttttaaggcgat

SEQ ID NO: 25172 - DNA, 878 bp, Artificial Sequence
  chemically treated genomic DNA (Homo sapiens) CpG-island No: 25172
atcgccttaaaaaaaaaaaaaaaaccacgacccttcaaaaatccgaaaaacgttacccgctccccaccccgcgccaaaaaaaaaaaccaccaccgatcaccgctccctacgccgccgctaccgccaccgactacaactccaaccgtccgatccgcccgcttctctcctttatataacgaaccaacaaactacgcgaaccaccaccgccgccgccgccgccgccgaaaaacaaaataaaaaaaaaaaaaaaaacgaaaaaaacgaaaacaaaaataaacgaaactaaacgcgaaacaccgcgaaaaccgcgtacgcaaacgcgccgaaacgaaaaccgccgacgaaccgcgttatcacgcgccgtaacgaatactaaactaacgaaacccgaaaaataaaataataaaatcgaacctacgcctctccaacgctcgcgtaatcacgtaattaacacccaaacgaaaatctacgacaattctttacgataaaaaacttacaaaacgttactaaaaaaaacgaaaattctactaacactccaatccaaaactaaataaaaccgcctcctatcgcacgtttccgcctaatcccgcgctttaaaaactaaaaaatataacaaaaacgatacctactacctcgctaaaaataaccgcgaaaaaaaactaatcacgtaacgtaacttccgacctctaacgcgttcctattcgaaaaaattttaaatacgaaatcatctcttaatttatcaacgaaactttaactataaacttcgcgacgttcgcgcctcaccgcctcaccgaaaataaatctttcgcgcgcaaaattatataaaattttccaaaaaaaataaaaaccgatcgaaacctacttttaacattccacaa

SEQ ID NO: 25173 - DNA, 612 bp, Artificial Sequence
  chemically treated genomic DNA (Homo sapiens) CpG-island No: 25173
  misc_feature (325)..(325): n is either a, c, g or t
  misc_feature (330)..(330): n is either a, c, g or t
  misc_feature (338)..(338): n is either a, c, g or t
  misc_feature (526)..(527): n is either a, c, g or t
  misc_feature (574)..(574): n is either a, c, g or t
gtcgggatcgggaagggcggttaagggtggaaaggggttggcggttgttaggtttggcggaatggagcggggcggggcgtagcggggcggggcgggtttggagttgtatttgtttttgggcggacgtaattggcgcgcggcgcgggttgtagacggttgcgaggcgttgggtataggttagacgttcgtattcgtacggggttcgaatttggaggagggttcgaagggagagggggttcgttaaggagcggggatgtgatggagaggaggtttcgattcgtaggggatatgcgggggaagggacgcggatagggaagggttttgngatangcgtgaangatgcgttaagggaggacgggacgggatggaaggttatgatgtcgcggaagttagttagggcgtattcggttgcggatcggtgcgataataatttaacgtatcgaatgttttgtcggttagcgcggtttggaagaatatgttaatattcgtaataagtttgcgtttttcgatagggacgtgtaagtanngttcgtttttagtaattcgggacgcggttcgggaattaatggatttngttttaatatatagtatatagtttggtaggatcgatcg

SEQ ID NO: 25174 - DNA, 612 bp, Artificial Sequence
  chemically treated genomic DNA (Homo sapiens) CpG-island No: 25174
  misc_feature (39)..(39): n is either a, c, g or t
  misc_feature (86)..(87): n is either a, c, g or t
  misc_feature (275)..(275): n is either a, c, g or t
  misc_feature (283)..(283): n is either a, c, g or t
  misc_feature (288)..(288): n is either a, c, g or t
cgatcgatcctaccaaactatatactatatattaaaacnaaatccattaattcccgaaccgcgtcccgaattactaaaaacgaacnntacttacacgtccctatcgaaaaacgcaaacttattacgaatattaacatattcttccaaaccgcgctaaccgacaaaacattcgatacgttaaattattatcgcaccgatccgcaaccgaatacgccctaactaacttccgcgacatcataaccttccatcccgtcccgtcctcccttaacgcatcnttcacgcntatcncaaaacccttccctatccgcgtcccttcccccgcatatcccctacgaatcgaaacctcctctccatcacatccccgctccttaacgaaccccctctcccttcgaaccctcctccaaattcgaaccccgtacgaatacgaacgtctaacctatacccaacgcctcgcaaccgtctacaacccgcgccgcgcgccaattacgtccgcccaaaaacaaatacaactccaaacccgccccgccccgctacgccccgccccgctccattccgccaaacctaacaaccgccaacccctttccacccttaaccgcccttcccgatcccgac

SEQ ID NO: 25175 - DNA, 612 bp, Artificial Sequence
  chemically treated genomic DNA (Homo sapiens) CpG-island No: 25175
  misc_feature (39)..(39): n is either a, c, g or t
  misc_feature (86)..(87): n is either a, c, g or t
  misc_feature (275)..(275): n is either a, c, g or t
  misc_feature (283)..(283): n is either a, c, g or t
  misc_feature (288)..(288): n is either a, c, g or t
cgatcgattttgttaagttatgtattgtatgttaaagtnagatttattgattttcgggtcgcgtttcgagttattggagacgagtnntgtttatacgtttttatcgggaagcgtagatttattgcgggtattagtatatttttttaggtcgcgttagtcgatagagtattcggtgcgttggattattgtcgtatcggttcgtagtcggatgcgttttagttggttttcgcgatattatggttttttatttcgtttcgtttttttttagcgtattntttacgtntgttntagagtttttttttgttcgcgttttttttttcgtatgttttttgcgagtcggaattttttttttattatattttcgttttttggcgggtttttttttttttcgagtttttttttaggttcgagtttcgtgcgggtacggacgtttgatttgtgtttagcgtttcgtagtcgtttgtagttcgcgtcgcgcgttaattgcgttcgtttagaagtaggtgtagttttaggttcgtttcgtttcgttgcgtttcgtttcgttttatttcgttaggtttggtagtcgttagtttttttttatttttgatcgtttttttcggtttcggt

SEQ ID NO: 25176 - DNA, 612 bp, Artificial Sequence
  chemically treated genomic DNA (Homo sapiens) CpG-island No: 25176
  misc_feature (325)..(325): n is either a, c, g or t
  misc_feature (330)..(330): n is either a, c, g or t
  misc_feature (338)..(338): n is either a, c, g or t
  misc_feature (526)..(527): n is either a, c, g or t
  misc_feature (574)..(574): n is either a, c, g or t
accgaaaccgaaaaaaacgatcaaaaataaaaaaaaactaacgactaccaaacctaacgaaataaaacgaaacgaaacgcaacgaaacgaaacgaacctaaaactacacctacttctaaacgaacgcaattaacgcgcgacgcgaactacaaacgactacgaaacgctaaacacaaatcaaacgtccgtacccgcacgaaactcgaacctaaaaaaaaactcgaaaaaaaaaaaaacccgccaaaaaacgaaaatataataaaaaaaaaattccgactcgcaaaaaacatacgaaaaaaaaaacgcgaacaaaaaaaaactctanaacanacgtaaanaatacgctaaaaaaaaacgaaacgaaataaaaaaccataatatcgcgaaaaccaactaaaacgcatccgactacgaaccgatacgacaataatccaacgcaccgaatactctatcgactaacgcgacctaaaaaaatatactaatacccgcaataaatctacgcttcccgataaaaacgtataaacannactcgtctccaataactcgaaacgcgacccgaaaatcaataaatctnactttaacatacaatacataacttaacaaaatcgatcg

SEQ ID NO: 25177 - DNA, 742 bp, Artificial Sequence
  chemically treated genomic DNA (Homo sapiens) CpG-island No: 25177
  misc_feature (353)..(353): n is either a, c, g or t
  misc_feature (598)..(598): n is either a, c, g or t
ggttacggtaatattagattcggtaattatttgcggttgtttagttatcgcggtagcgattattttaggatgcgtcgttttaattattttcggttgcggttcggtaatttgaacgggggtttttacgatatcggttatttttttaataattggcgcgttaataatcggttcgatagcggcggcgatagggattttagttattatcggttgtatatgtatttttttttgttcgcgttgttttttaatttgtatattttgcggacgtataattggatagcggatttagattttgttagaggttagtttcggagacgcgtacgttacggttaacggtattggcgattgggttggantacgttcgttacgatagcgacgacgatattattatttacgcgtaggtacgaggcgagcggcgagaacgacgcggtatgtaacgttgttacggtatagtatgtttttttttgttgttttggtgtagttgcgttacgattggaagcgggatttttattagttttgtgcgtggagttggcgttttttgaataattggttcggtagcgatagtttttttaataatcggtgcgattatcgttttttggtnacgtttgttcgtaacgtattttttgattgagttgacgttgttacgacgcggttgaatcggacgtatacgttttttttgttcggttttttgaatagattgttttttaatatttagcgttttcgttttttgttgcgtttgacgtta

SEQ ID NO: 25178 - DNA, 742 bp, Artificial Sequence
  chemically treated genomic DNA (Homo sapiens) CpG-island No: 25178
  misc_feature (145)..(145): n is either a, c, g or t
  misc_feature (390)..(390): n is either a, c, g or t
taacgtcaaacgcaacaaaaaacgaaaacgctaaatattaaaaaacaatctattcaaaaaaccgaacaaaaaaaacgtatacgtccgattcaaccgcgtcgtaacaacgtcaactcaatcaaaaaatacgttacgaacaaacgtnaccaaaaaacgataatcgcaccgattattaaaaaaactatcgctaccgaaccaattattcaaaaaacgccaactccacgcacaaaactaataaaaatcccgcttccaatcgtaacgcaactacaccaaaacaacaaaaaaaaacatactataccgtaacaacgttacataccgcgtcgttctcgccgctcgcctcgtacctacgcgtaaataataatatcgtcgtcgctatcgtaacgaacgtantccaacccaatcgccaataccgttaaccgtaacgtacgcgtctccgaaactaacctctaacaaaatctaaatccgctatccaattatacgtccgcaaaatatacaaattaaaaaacaacgcgaacaaaaaaaaatacatatacaaccgataataactaaaatccctatcgccgccgctatcgaaccgattattaacgcgccaattattaaaaaaataaccgatatcgtaaaaacccccgttcaaattaccgaaccgcaaccgaaaataattaaaacgacgcatcctaaaataatcgctaccgcgataactaaacaaccgcaaataattaccgaatctaatattaccgtaacc

SEQ ID NO: 25179 - DNA, 742 bp, Artificial Sequence
  chemically treated genomic DNA (Homo sapiens) CpG-island No: 25179
  misc_feature (145)..(145): n is either a, c, g or t
  misc_feature (390)..(390): n is either a, c, g or t
taacgttaggcgtaataagaagcgaaggcgttgaatgttgaagagtaatttgtttaggaaatcgaataggaagaacgtgtacgttcggtttagtcgcgtcgtaatagcgttagtttaattagaaagtgcgttacgagtaagcgtnattaagaagcggtagtcgtatcggttgttgaagaaattgtcgttgtcgaattaattgtttaggaagcgttagttttacgtatagaattggtgaaagtttcgtttttagtcgtagcgtaattgtattagaatagtagaagagaatatgttatatcgtgataacgttgtatgtcgcgtcgttttcgtcgttcgtttcgtatttgcgcgtaagtggtagtgtcgtcgtcgttatcgtgacgagcgtantttaatttagtcgttaatgtcgttgatcgtagcgtgcgcgttttcggaattggtttttggtaaagtttggattcgttatttaattgtacgttcgtaagatgtataggttgaagagtagcgcgaataggaagaagtatatgtgtagtcgatggtgattgaggtttttgtcgtcgtcgttatcgaatcggttgttagcgcgttagttgttgaagaagtggtcggtgtcgtagaagttttcgtttaggttgtcgaatcgtaatcggaagtggttgaaacgacgtattttgaagtgatcgttgtcgcggtaattgaatagtcgtaggtgattatcgagtttgatgttgtcgtagtt

SEQ ID NO: 25180 - DNA, 742 bp, Artificial Sequence
  chemically treated genomic DNA (Homo sapiens) CpG-island No: 25180
  misc_feature (353)..(353): n is either a, c, g or t
  misc_feature (598)..(598): n is either a, c, g or t
aactacgacaacatcaaactcgataatcacctacgactattcaattaccgcgacaacgatcacttcaaaatacgtcgtttcaaccacttccgattacgattcgacaacctaaacgaaaacttctacgacaccgaccacttcttcaacaactaacgcgctaacaaccgattcgataacgacgacgacaaaaacctcaatcaccatcgactacacatatacttcttcctattcgcgctactcttcaacctatacatcttacgaacgtacaattaaataacgaatccaaactttaccaaaaaccaattccgaaaacgcgcacgctacgatcaacgacattaacgactaaattaaantacgctcgtcacgataacgacgacgacactaccacttacgcgcaaatacgaaacgaacgacgaaaacgacgcgacatacaacgttatcacgatataacatattctcttctactattctaatacaattacgctacgactaaaaacgaaactttcaccaattctatacgtaaaactaacgcttcctaaacaattaattcgacaacgacaatttcttcaacaaccgatacgactaccgcttcttaatnacgcttactcgtaacgcactttctaattaaactaacgctattacgacgcgactaaaccgaacgtacacgttcttcctattcgatttcctaaacaaattactcttcaacattcaacgccttcgcttcttattacgcctaacgtta

SEQ ID NO: 25181 - DNA, 505 bp, Artificial Sequence
  chemically treated genomic DNA (Homo sapiens) CpG-island No: 25181
tggtttttatttaatataatcgtttggtttttatcgttattattatatgcgtttattaattaggtacggtttgtaacgattttttttttatttttttattttgttatttttaattaatcgcgttaacgaattttttacgtagtttttttttttcgtatttaatttatttttttaatttattttattagttttttaatcgtttcgtttatagtcgttttttcgtaattaatttcgttaattgtttttcgtagttagtagttaattttcgttatcggtaatatttaatttcgtatacgatcggtttcgaatatatttttattaataagttattacgtagttagttattatataatttttcgttttaatcgagttatacgttttatattttgtataatttacgcgttacgtttgtcgcggtttttatttgtgttatatatacgttttatataattatattataatgttgatgttttttatttttatattattatatttatttttttat

SEQ ID NO: 25182 - DNA, 505 bp, Artificial Sequence
  chemically treated genomic DNA (Homo sapiens) CpG-island No: 25182
ataaaaaaataaatataataatataaaaataaaaaacatcaacattataatataattatataaaacgtatatataacacaaataaaaaccgcgacaaacgtaacgcgtaaattatacaaaatataaaacgtataactcgattaaaacgaaaaattatataataactaactacgtaataacttattaataaaaatatattcgaaaccgatcgtatacgaaattaaatattaccgataacgaaaattaactactaactacgaaaaacaattaacgaaattaattacgaaaaaacgactataaacgaaacgattaaaaaactaataaaataaattaaaaaaataaattaaatacgaaaaaaaaaaactacgtaaaaaattcgttaacgcgattaattaaaaataacaaaataaaaaaataaaaaaaaaatcgttacaaaccgtacctaattaataaacgcatataataataacgataaaaaccaaacgattatattaaataaaaacca

SEQ ID NO: 25183 - DNA, 505 bp, Artificial Sequence
  chemically treated genomic DNA (Homo sapiens) CpG-island No: 25183
gtggggaggtgagtgtggtggtgtgggggtgggggatattaatattatgatatagttgtatgaggcgtgtgtgtggtataggtgagggtcgcggtaagcgtgacgcgtgggttgtgtaggatgtggagcgtatggttcggttgaggcggagggttgtgtagtgattggttgcgtaatggtttgttggtgggggtgtgttcgggatcggtcgtgtgcgggattgggtattgtcggtggcgagggttggttgttggttgcgggaggtaattggcggagttagttgcggggaggcggttgtggacggagcggttggaaggttggtgaagtaagttggggagatgggttgggtgcgggggggagaagttgcgtagaggattcgttgacgcggttggttgagaatagtagggtggaagggtaaggggagggtcgttgtaggtcgtatttgattggtggacgtatgtggtggtagcggtggaggttaggcggttgtgttgggtggaagtta

SEQ ID NO: 25184 - DNA, 505 bp, Artificial Sequence
  chemically treated genomic DNA (Homo sapiens) CpG-island No: 25184
taacttccacccaacacaaccgcctaacctccaccgctaccaccacatacgtccaccaatcaaatacgacctacaacgaccctccccttacccttccaccctactattctcaaccaaccgcgtcaacgaatcctctacgcaacttctcccccccgcacccaacccatctccccaacttacttcaccaaccttccaaccgctccgtccacaaccgcctccccgcaactaactccgccaattacctcccgcaaccaacaaccaaccctcgccaccgacaatacccaatcccgcacacgaccgatcccgaacacacccccaccaacaaaccattacgcaaccaatcactacacaaccctccgcctcaaccgaaccatacgctccacatcctacacaacccacgcgtcacgcttaccgcgaccctcacctataccacacacacgcctcatacaactatatcataatattaatatcccccacccccacaccaccacactcacctccccac

SEQ ID NO: 25185 - DNA, 849 bp, Artificial Sequence
  chemically treated genomic DNA (Homo sapiens) CpG-island No: 25185
gaacgcgcgttagggtataaaaggttttttttttttttattagcgcggtcgttaattcgagggcggaggttcgcgaggtcggagggcggggtagttcggttttacggttcggggcgtttttttcggggggtcgtcgagaggggttagcgtgttttagtttttttgtttgttaaaaggcggggtcgcgtttttggtcgcgagtatatattttttttttcgtagcggtcgaagatttcgcgtttgcgcgggtcgttgagtacgtcgtaggttttagcgatttttttgaattttttttcggcgtcgggttttttgtttttgttcgggtggtagcgtagcgtttggcggcggtaggttcgtttgattttttcgttcgacgcgtcgcgggttaggtttaacgtttggtagtagtttttatttatgatttttttttgcggttcgtcgattcgttgtcgtcgtttttcggtttcgtcgtcgattagtttcggattttatatattcgttcggcggaagtttttagagttcgttagttttttttagaatttttcgtttcgttcgttttcgcggcgtcggttaatcgtcgtcgtttttttagcgatacgcgatattcggggcggggtttcgtcgttaacggtcgttcgcgcggggttacgttttttttcgtttcgttttcggtaatattttttcgcggcgcgcgcgtataggtcggaggaggtttcgtttatttttcgggacgagttaatcgcgattttttttttttttttacgcggttttagttattttgcgtttcgtttttcgtttgggttagtaggtcgggatttatagcgaatttgttgttttaggaaggggtgg

SEQ ID NO: 25186 - DNA, 849 bp, Artificial Sequence
  chemically treated genomic DNA (Homo sapiens) CpG-island No: 25186
ccaccccttcctaaaacaacaaattcgctataaatcccgacctactaacccaaacgaaaaacgaaacgcaaaataactaaaaccgcgtaaaaaaaaaaaaaaaatcgcgattaactcgtcccgaaaaataaacgaaacctcctccgacctatacgcgcgcgccgcgaaaaaatattaccgaaaacgaaacgaaaaaaaacgtaaccccgcgcgaacgaccgttaacgacgaaaccccgccccgaatatcgcgtatcgctaaaaaaacgacgacgattaaccgacgccgcgaaaacgaacgaaacgaaaaattctaaaaaaaactaacgaactctaaaaacttccgccgaacgaatatataaaatccgaaactaatcgacgacgaaaccgaaaaacgacgacaacgaatcgacgaaccgcaaaaaaaaatcataaataaaaactactaccaaacgttaaacctaacccgcgacgcgtcgaacgaaaaaatcaaacgaacctaccgccgccaaacgctacgctaccacccgaacaaaaacaaaaaacccgacgccgaaaaaaaattcaaaaaaatcgctaaaacctacgacgtactcaacgacccgcgcaaacgcgaaatcttcgaccgctacgaaaaaaaaaatatatactcgcgaccaaaaacgcgaccccgccttttaacaaacaaaaaaactaaaacacgctaacccctctcgacgaccccccgaaaaaaacgccccgaaccgtaaaaccgaactaccccgccctccgacctcgcgaacctccgccctcgaattaacgaccgcgctaataaaaaaaaaaaaaaccttttataccctaacgcgcgttc

SEQ ID NO: 25187 - DNA, 849 bp, Artificial Sequence
  chemically treated genomic DNA (Homo sapiens) CpG-island No: 25187
ttatttttttttggaatagtaagttcgttgtgggtttcgatttattgatttaggcggagggcgggacgtagggtagttggggtcgcgtagagagggaaagaaggtcgcgattggttcgtttcgaaaggtgggcggggtttttttcgatttgtgcgcgcgcgtcgcggggaggtgttgtcgagggcggagcgggagggggcgtggtttcgcgcgggcggtcgttgacggcgaggtttcgtttcggatgtcgcgtgtcgttgaaagggcggcggcgattggtcggcgtcgcgggggcgggcggggcggaaggttttggagggggttggcgggttttggaagttttcgtcggacgggtatatagagttcgggattggtcggcggcggagtcgggggacggcgatagcgggtcggcgggtcgtaggagggggttatgggtaaagattattattagacgttgggtttggttcgcggcgcgtcggacgaggagattaagcgggtttatcgtcgttaggcgttgcgttattattcggataagaataaggagttcggcgtcgaggagaagtttaaggagatcgttgaggtttacgacgtgtttagcgattcgcgtaagcgcgagattttcgatcgttacggggaggaaggtgtgtgttcgcggttaggggcgcggtttcgttttttgatagatagggaaattgaggtacgttggtttttttcggcggtttttcgggaaggacgtttcgggtcgtggggtcgagttgtttcgtttttcggtttcgcgggttttcgttttcggattggcggtcgcgttggtgggaaggaaggaagttttttgtgttttagcgcgcgttt

SEQ ID NO: 25188 - DNA, 849 bp, Artificial Sequence
  chemically treated genomic DNA (Homo sapiens) CpG-island No: 25188
aaacgcgcgctaaaacacaaaaaacttccttccttcccaccaacgcgaccgccaatccgaaaacgaaaacccgcgaaaccgaaaaacgaaacaactcgaccccacgacccgaaacgtccttcccgaaaaaccgccgaaaaaaaccaacgtacctcaatttccctatctatcaaaaaacgaaaccgcgcccctaaccgcgaacacacaccttcctccccgtaacgatcgaaaatctcgcgcttacgcgaatcgctaaacacgtcgtaaacctcaacgatctccttaaacttctcctcgacgccgaactccttattcttatccgaataataacgcaacgcctaacgacgataaacccgcttaatctcctcgtccgacgcgccgcgaaccaaacccaacgtctaataataatctttacccataaccccctcctacgacccgccgacccgctatcgccgtcccccgactccgccgccgaccaatcccgaactctatatacccgtccgacgaaaacttccaaaacccgccaaccccctccaaaaccttccgccccgcccgcccccgcgacgccgaccaatcgccgccgccctttcaacgacacgcgacatccgaaacgaaacctcgccgtcaacgaccgcccgcgcgaaaccacgccccctcccgctccgccctcgacaacacctccccgcgacgcgcgcgcacaaatcgaaaaaaaccccgcccacctttcgaaacgaaccaatcgcgaccttctttccctctctacgcgaccccaactaccctacgtcccgccctccgcctaaatcaataaatcgaaacccacaacgaacttactattccaaaaaaaaataa

SEQ ID NO: 25189 - DNA, 522 bp, Artificial Sequence
  chemically treated genomic DNA (Homo sapiens) CpG-island No: 25189
attgttaaatggattgattgacgatagggggaatggtaggcgcgggaatagatagttaagtgtaagattcggatagtagatcgagtagatcgaaatggtagatatgatttaattattcgagtaaaaacgtacgatcgagtatatggcgtgttttagtgtaacggtgttcggtgtagtgcgacgcgtaacgggacgtatttttgttatcgtatgtgttattaagcgttcgtagtagtatttggtgtgcgagaggtagttacgtaacgggatggagtgtcgtcgatagtgtgattggatcggcgtttatcgtacgtaatgtgtgtttatgacgcgggtatggattatttggtaggttgtttgataaagcgcgcgatacgtgagggtgagacgagatgcggtgagggttcgtgtaagtagtattggagtagtataagacgtggtttggcgtatagcgttggatattgtttcggatgtggtgtgtttcgggcggagtgatttattatagatataatttaatatgtt

SEQ ID NO: 25190 - DNA, 522 bp, Artificial Sequence
  chemically treated genomic DNA (Homo sapiens) CpG-island No: 25190
aacatattaaattatatctataataaatcactccgcccgaaacacaccacatccgaaacaatatccaacgctatacgccaaaccacgtcttatactactccaatactacttacacgaaccctcaccgcatctcgtctcaccctcacgtatcgcgcgctttatcaaacaacctaccaaataatccatacccgcgtcataaacacacattacgtacgataaacgccgatccaatcacactatcgacgacactccatcccgttacgtaactacctctcgcacaccaaatactactacgaacgcttaataacacatacgataacaaaaatacgtcccgttacgcgtcgcactacaccgaacaccgttacactaaaacacgccatatactcgatcgtacgtttttactcgaataattaaatcatatctaccatttcgatctactcgatctactatccgaatcttacacttaactatctattcccgcgcctaccattccccctatcgtcaatcaatccatttaacaat

SEQ ID NO: 25191 - DNA, 522 bp, Artificial Sequence
  chemically treated genomic DNA (Homo sapiens) CpG-island No: 25191
ggtatattaaattatatttatagtaggttatttcgttcgggatatattatattcgaggtagtgtttaacgttatacgttaggttacgttttgtgttgttttaatgttgtttgtacgagtttttatcgtatttcgttttatttttacgtatcgcgcgttttgttaggtaatttgttaagtaatttatgttcgcgttatgaatatatattgcgtacggtaaacgtcggtttagttatattatcggcggtattttatttcgttgcgtggttgtttttcgtatattaggtgttgttgcgaacgtttaatggtatatacggtaataaaggtacgtttcgttgcgcgtcgtattatatcgggtatcgttgtattggggtacgttatgtgttcggtcgtacgtttttgttcgggtagttgggttatgtttgttatttcggtttattcggtttattattcgggttttgtatttggttatttgttttcgcgtttgttattttttttgtcgttagttaatttatttggtagt

SEQ ID NO: 25192 - DNA, 522 bp, Artificial Sequence
  chemically treated genomic DNA (Homo sapiens) CpG-island No: 25192
actaccaaataaattaactaacgacaaaaaaaataacaaacgcgaaaacaaataaccaaatacaaaacccgaataataaaccgaataaaccgaaataacaaacataacccaactacccgaacaaaaacgtacgaccgaacacataacgtaccccaatacaacgatacccgatataatacgacgcgcaacgaaacgtacctttattaccgtatataccattaaacgttcgcaacaacacctaatatacgaaaaacaaccacgcaacgaaataaaataccgccgataatataactaaaccgacgtttaccgtacgcaatatatattcataacgcgaacataaattacttaacaaattacctaacaaaacgcgcgatacgtaaaaataaaacgaaatacgataaaaactcgtacaaacaacattaaaacaacacaaaacgtaacctaacgtataacgttaaacactacctcgaatataatatatcccgaacgaaataacctactataaatataatttaatatacc

SEQ ID NO: 25193 - DNA, 651 bp, Artificial Sequence
  chemically treated genomic DNA (Homo sapiens) CpG-island No: 25193
ttgtcgtaggcgttttacgatagttcggtttcgatgattatgattacgatgtcgaatatgtcgaagatgagcgcgtagtcgttgagtcgtttgcgtttttcgaatagggcgcgtcggtggtttagtttgtagtcgatgttttggtttttttttttgttggatttggtgttattgttgttgtcgtgttcgttttcgttatcgtcgtcgttttttttagtgttgttttcgtcgtcggttttatagagcgttaggttgttggagttgttgtgttcgggtttagatattacgatttcgggggttgaggacgaaatagcggcggcggcggtagcggttgtagacggggaggacgcgtcgttatttttttcgatagacgcggggggttgtaggggttgcgtttttgagtttatttcgtgtaggtttcggcgggacgcgtttaagttgttgagcggtcgtatgacgttttcgttgtatttgtagttgtttatggttatttcggtgaaggggttgttttcgcggcgcgtttggggttggtggtgttggtggtgcgtcgggtgcgggtggtggtggtggtgcgagagcgggggttcggagtttagattgtcgaggttgttcgtggggttggcggcgggttgtaggttgtggtattggtgg

SEQ ID NO: 25194 - DNA, 651 bp, Artificial Sequence
  chemically treated genomic DNA (Homo sapiens) CpG-island No: 25194
ccaccaataccacaacctacaacccgccgccaaccccacgaacaacctcgacaatctaaactccgaacccccgctctcgcaccaccaccaccacccgcacccgacgcaccaccaacaccaccaaccccaaacgcgccgcgaaaacaaccccttcaccgaaataaccataaacaactacaaatacaacgaaaacgtcatacgaccgctcaacaacttaaacgcgtcccgccgaaacctacacgaaataaactcaaaaacgcaacccctacaaccccccgcgtctatcgaaaaaaataacgacgcgtcctccccgtctacaaccgctaccgccgccgccgctatttcgtcctcaacccccgaaatcgtaatatctaaacccgaacacaacaactccaacaacctaacgctctataaaaccgacgacgaaaacaacactaaaaaaaacgacgacgataacgaaaacgaacacgacaacaacaataacaccaaatccaacaaaaaaaaaaaccaaaacatcgactacaaactaaaccaccgacgcgccctattcgaaaaacgcaaacgactcaacgactacgcgctcatcttcgacatattcgacatcgtaatcataatcatcgaaaccgaactatcgtaaaacgcctacgacaa

SEQ ID NO: 25195 - DNA, 651 bp, Artificial Sequence
  chemically treated genomic DNA (Homo sapiens) CpG-island No: 25195
ttattagtgttatagtttgtagttcgtcgttagttttacgggtagtttcggtagtttgggtttcgggttttcgttttcgtattattattattattcgtattcggcgtattattagtattattagttttaggcgcgtcgcgagagtaatttttttatcgaaatagttatgagtagttgtaggtataacgggggcgttatgcggtcgtttagtaatttgagcgcgtttcgtcggaatttgtacgagatggatttagaggcgtagtttttgtagtttttcgcgtttgtcggaggaggtggcggcgcgtttttttcgtttgtagtcgttgtcgtcgtcgtcgttgtttcgtttttagttttcgagatcgtggtgtttaagttcgagtataataattttaataatttggcgttttatggaatcggcggcggaggtagtattggaggaggcggcggcggtggcgggagcgggtacggtagtagtagtggtattaagtttagtaaaaagaaaaattagaatatcggttataagttgggttatcggcgcgttttgttcgaaaagcgtaagcggtttagcgattacgcgtttattttcggtatgttcggtatcgtggttatggttatcgagatcgagttgtcgtggggcgtttacgataa

SEQ ID NO: 25196 - DNA, 651 bp, Artificial Sequence
  chemically treated genomic DNA (Homo sapiens) CpG-island No: 25196
ttatcgtaaacgccccacgacaactcgatctcgataaccataaccacgataccgaacataccgaaaataaacgcgtaatcgctaaaccgcttacgcttttcgaacaaaacgcgccgataacccaacttataaccgatattctaatttttctttttactaaacttaataccactactactaccgtacccgctcccgccaccgccgccgcctcctccaatactacctccgccgccgattccataaaacgccaaattattaaaattattatactcgaacttaaacaccacgatctcgaaaactaaaaacgaaacaacgacgacgacgacaacgactacaaacgaaaaaaacgcgccgccacctcctccgacaaacgcgaaaaactacaaaaactacgcctctaaatccatctcgtacaaattccgacgaaacgcgctcaaattactaaacgaccgcataacgcccccgttatacctacaactactcataactatttcgataaaaaaattactctcgcgacgcgcctaaaactaataatactaataatacgccgaatacgaataataataataatacgaaaacgaaaacccgaaacccaaactaccgaaactacccgtaaaactaacgacgaactacaaactataacactaataa

SEQ ID NO: 25197 - DNA, 508 bp, Artificial Sequence
  chemically treated genomic DNA (Homo sapiens) CpG-island No: 25197
gaggcggacgtcgattgttgcgcggattgttgcgcgtattgttgtcggagcgtattggtatggttggacggcgttagttcgtttatattgagttggttgtttcggcgcgacgagtagtagtagtagtagtaggacgagttcgatagcggcgaggaggtgcgggttcggaaggcgtcgtcgggcgaggaggtgcggagtagtagggataggttatttttcgttttcgtcgtcggggtatcggaggaggcgtagttgttgtatcggaggtatgggttgttgtcgtcgttggtcggttgttggtgcgcgaggtgcgggtggtggtgagggtgcgggaggggcgcgaagggcgggtacggtttgttttggttttgttgttgttgttggtaatgtaggtgtgaggagcgcggcggcggcggcggttgttttgggaagaagtcgcgttggaattgtaatggggtttttatgttagggttgttaaagttgtagggagattaagcggtggtgtatt

SEQ ID NO: 25198 - DNA, 508 bp, Artificial Sequence
  chemically treated genomic DNA (Homo sapiens) CpG-island No: 25198
aatacaccaccgcttaatctccctacaactttaacaaccctaacataaaaaccccattacaattccaacgcgacttcttcccaaaacaaccgccgccgccgccgcgctcctcacacctacattaccaacaacaacaacaaaaccaaaacaaaccgtacccgcccttcgcgcccctcccgcaccctcaccaccacccgcacctcgcgcaccaacaaccgaccaacgacgacaacaacccatacctccgatacaacaactacgcctcctccgataccccgacgacgaaaacgaaaaataacctatccctactactccgcacctcctcgcccgacgacgccttccgaacccgcacctcctcgccgctatcgaactcgtcctactactactactactactcgtcgcgccgaaacaaccaactcaatataaacgaactaacgccgtccaaccataccaatacgctccgacaacaatacgcgcaacaatccgcgcaacaatcgacgtccgcctc

SEQ ID NO: 25199 - DNA, 508 bp, Artificial Sequence
  chemically treated genomic DNA (Homo sapiens) CpG-island No: 25199
ggtgtattatcgtttggtttttttgtagttttaatagttttgatatggaaattttattgtagttttagcgcggtttttttttagagtagtcgtcgtcgtcgtcgcgttttttatatttgtattgttagtagtagtaatagagttaggataagtcgtgttcgtttttcgcgtttttttcgtatttttattattattcgtatttcgcgtattagtagtcggttagcggcggtagtagtttatgttttcggtgtaatagttgcgtttttttcggtgtttcggcggcgggggcgggagataatttgtttttgttgtttcgtattttttcgttcggcggcgtttttcggattcgtattttttcgtcgttgtcgggttcgttttgttgttgttgttgttgttcgtcgcgtcggggtagttagtttaatgtgagcgagttgacgtcgtttagttatgttagtgcgtttcggtagtagtacgcgtagtagttcgcgtagtagtcggcgttcgtttt

SEQ ID NO: 25200 - DNA, 508 bp, Artificial Sequence
  chemically treated genomic DNA (Homo sapiens) CpG-island No: 25200
aaaacgaacgccgactactacgcgaactactacgcgtactactaccgaaacgcactaacataactaaacgacgtcaactcgctcacattaaactaactaccccgacgcgacgaacaacaacaacaacaacaaaacgaacccgacaacgacgaaaaaatacgaatccgaaaaacgccgccgaacgaaaaaatacgaaacaacaaaaacaaattatctcccgcccccgccgccgaaacaccgaaaaaaacgcaactattacaccgaaaacataaactactaccgccgctaaccgactactaatacgcgaaatacgaataataataaaaatacgaaaaaaacgcgaaaaacgaacacgacttatcctaactctattactactactaacaatacaaatataaaaaacgcgacgacgacgacgactactctaaaaaaaaaccgcgctaaaactacaataaaatttccatatcaaaactattaaaactacaaaaaaaccaaacgataatacacc

SEQ ID NO: 25201 - DNA, 890 bp, Artificial Sequence
  chemically treated genomic DNA (Homo sapiens) CpG-island No: 25201
ttcgttaggtttcgtttacgtcgttatattcgttttgttattttgcggtttagcgggtcgtaaaagatagcgattttcgattagcggttttttatattgtgttcgcgtgtagttggtaattttaaggttcgggtggttgattgtcgtaatggtatcggtgagttcgtttattattcgtgcggataatttttttcgggatgaggtcggttttttttgttagtttgtcgtgacggttatatcggtaaagatagtgcgcgttacgggcgatacggttattcggttatatgttgagggtgttgttcgggtgtagtttcgggtcgggtaggcggttatttgtcgggtttgtggtatacgggatgcggatatttagattcgttgcggtggtgtgaacgtcggttagtttgtcggtggtgttgtagttgtaatttcgggtttggcgcgggttgttgatgcggatgagttcgtcgttgtcgttttaggtgtaatcgcggttagatagtaggttgtttaggtgttggttttgtaattgttcggtaggggtataagcggtggtgagtttataacggtcgaagttgcgtagcgtttttcggtgtaggcggtcgcgggtgtattttattagcggtgtgtcgtcgagttttatgtttgttaggtaatcgttgtcgtaggttagttattttacggcgggtaggttgttcggtatatagcggttcgttagtttttgcgcgttgtacgtatgtttggttttatgttgttagagtagtgttttcgtttgcgggtgatgtatcgtttgacgtttatcggttagtcggttttacgtatcgtatcgtgaagggtgaaatcgtagagcggtggtagtatgacgaacgtggttggttgatagatattagtta

SEQ ID NO: 25202 - DNA, 890 bp, Artificial Sequence
  chemically treated genomic DNA (Homo sapiens) CpG-island No: 25202
taactaatatctatcaaccaaccacgttcgtcatactaccaccgctctacgatttcacccttcacgatacgatacgtaaaaccgactaaccgataaacgtcaaacgatacatcacccgcaaacgaaaacactactctaacaacataaaaccaaacatacgtacaacgcgcaaaaactaacgaaccgctatataccgaacaacctacccgccgtaaaataactaacctacgacaacgattacctaacaaacataaaactcgacgacacaccgctaataaaatacacccgcgaccgcctacaccgaaaaacgctacgcaacttcgaccgttataaactcaccaccgcttatacccctaccgaacaattacaaaaccaacacctaaacaacctactatctaaccgcgattacacctaaaacgacaacgacgaactcatccgcatcaacaacccgcgccaaacccgaaattacaactacaacaccaccgacaaactaaccgacgttcacaccaccgcaacgaatctaaatatccgcatcccgtataccacaaacccgacaaataaccgcctacccgacccgaaactacacccgaacaacaccctcaacatataaccgaataaccgtatcgcccgtaacgcgcactatctttaccgatataaccgtcacgacaaactaacaaaaaaaaccgacctcatcccgaaaaaaattatccgcacgaataataaacgaactcaccgataccattacgacaatcaaccacccgaaccttaaaattaccaactacacgcgaacacaatataaaaaaccgctaatcgaaaatcgctatcttttacgacccgctaaaccgcaaaataacaaaacgaatataacgacgtaaacgaaacctaacgaa

SEQ ID NO: 25203 - DNA, 890 bp, Artificial Sequence
  chemically treated genomic DNA (Homo sapiens) CpG-island No: 25203
tggttgatgtttgttagttagttacgttcgttatattgttatcgttttgcggttttattttttacggtgcggtgcgtgaggtcggttgatcggtgagcgttagacggtgtattattcgtagacggaagtattgttttggtagtatgagattagatatgcgtataacgcgtaggggttggcgaatcgttgtatatcggatagtttgttcgtcgtggaatggttgatttacggtagcggttatttggtaggtatgaaattcggcgatatatcgttggtggagtatattcgcgatcgtttgtatcgggaaacgttgcgtagtttcggtcgttatgaatttattatcgtttatatttttgtcgggtagttatagagttagtatttgaatagtttgttgtttgatcgcgattatatttggaacgataacggcgaatttattcgtattagtagttcgcgttagattcggagttatagttatagtattatcggtaggttgatcggcgtttatattatcgtagcgaatttggatattcgtatttcgtatgttatagattcggtaggtaatcgtttgttcgattcggagttgtattcggatagtatttttagtatgtggtcggataatcgtatcgttcgtgacgcgtattatttttatcggtatgatcgttacggtaggttgatagagaaaatcgattttatttcggaaggggttattcgtacggatgatgagcggatttatcggtattattacgatagttagttattcgggttttggggttgttaattatacgcggatataatatgaagagtcgttggtcgaaagtcgttattttttacgattcgttgggtcgtagggtggtaaaacgggtgtggcggcgtgaacgggatttgacggg

SEQ ID NO: 25204 - DNA, 890 bp, Artificial Sequence
  chemically treated genomic DNA (Homo sapiens) CpG-island No: 25204
cccgtcaaatcccgttcacgccgccacacccgttttaccaccctacgacccaacgaatcgtaaaaaataacgactttcgaccaacgactcttcatattatatccgcgtataattaacaaccccaaaacccgaataactaactatcgtaataataccgataaatccgctcatcatccgtacgaataaccccttccgaaataaaatcgattttctctatcaacctaccgtaacgatcataccgataaaaataatacgcgtcacgaacgatacgattatccgaccacatactaaaaatactatccgaatacaactccgaatcgaacaaacgattacctaccgaatctataacatacgaaatacgaatatccaaattcgctacgataatataaacgccgatcaacctaccgataatactataactataactccgaatctaacgcgaactactaatacgaataaattcgccgttatcgttccaaatataatcgcgatcaaacaacaaactattcaaatactaactctataactacccgacaaaaatataaacgataataaattcataacgaccgaaactacgcaacgtttcccgatacaaacgatcgcgaatatactccaccaacgatatatcgccgaatttcatacctaccaaataaccgctaccgtaaatcaaccattccacgacgaacaaactatccgatatacaacgattcgccaacccctacgcgttatacgcatatctaatctcatactaccaaaacaatacttccgtctacgaataatacaccgtctaacgctcaccgatcaaccgacctcacgcaccgcaccgtaaaaaataaaaccgcaaaacgataacaatataacgaacgtaactaactaacaaacatcaacca

SEQ ID NO: 25205 - DNA, 647 bp, Artificial Sequence
  chemically treated genomic DNA (Homo sapiens) CpG-island No: 25205
ggcgtagcgcgatagttttattagagatgtttgttttatatacgttttcgtgcgcgcgttatggtttcgttatacgtgtaagttttgtaaggtttttatagttttttaatttagattttaaattttgtggttcgcgttttggtcgtatcgtttttatttttggacgttattgtattttcgtgtttattaagcggtttcgcggcgttaatatacgtttttcgcggcgtttttcgtttcggtatataaaagcgttcgttggttttattttttcgaatattttcggtaataacgtttttcggcggtttttttaattaatattcggtatttcgagttcggcggtcggcggtttacgcgttaatttcgggttttggtcgggcgttttttttttgggttttcgcgcgtttaatcgtttttcgggcggacggattttggggtttttttgttttttttcgtttcgattcgcgcgttcgttcgttcgttttttttttttttcgcgtacgttcgtttttcgaaagtcgtcgtttgtagtagaatcgttcgttttttttaggtacgtttttcgttggggttttcgcgtatttttcgcgtattttcgggagcgggtattattatttacgtagttagcgtattttttcggggtcgcggtt

SEQ ID NO: 25206 - DNA, 647 bp, Artificial Sequence
  chemically treated genomic DNA (Homo sapiens) CpG-island No: 25206
aaccgcgaccccgaaaaaatacgctaactacgtaaataataatacccgctcccgaaaatacgcgaaaaatacgcgaaaaccccaacgaaaaacgtacctaaaaaaaacgaacgattctactacaaacgacgactttcgaaaaacgaacgtacgcgaaaaaaaaaaaaaacgaacgaacgaacgcgcgaatcgaaacgaaaaaaaacaaaaaaaccccaaaatccgtccgcccgaaaaacgattaaacgcgcgaaaacccaaaaaaaaaacgcccgaccaaaacccgaaattaacgcgtaaaccgccgaccgccgaactcgaaataccgaatattaattaaaaaaaccgccgaaaaacgttattaccgaaaatattcgaaaaaataaaaccaacgaacgcttttatataccgaaacgaaaaacgccgcgaaaaacgtatattaacgccgcgaaaccgcttaataaacacgaaaatacaataacgtccaaaaataaaaacgatacgaccaaaacgcgaaccacaaaatttaaaatctaaattaaaaaactataaaaaccttacaaaacttacacgtataacgaaaccataacgcgcgcacgaaaacgtatataaaacaaacatctctaataaaactatcgcgctacgcc

SEQ ID NO: 25207 - DNA, 647 bp, Artificial Sequence
  chemically treated genomic DNA (Homo sapiens) CpG-island No: 25207
ggtcgcggtttcgggggagtgcgttggttgcgtgggtgatggtgttcgttttcggggatacgcggggggtgcgcgggggttttaacggggggcgtgtttgggggaagcgggcgattttgttgtaagcggcggttttcgggaaacgggcgtgcgcgggaaggggggggggcgagcgagcgggcgcgcgggtcggaacggaagggggtaggaggattttagggttcgttcgttcgaggagcggttaagcgcgcgggggtttaggaaggaggcgttcgattagggttcgaggttggcgcgtgggtcgtcggtcgtcgggttcggggtgtcgggtgttggttgggagggtcgtcgggaagcgttgttgtcgagggtgttcgggagggtggggttagcgggcgtttttgtgtgtcggggcggggagcgtcgcggggggcgtgtgttggcgtcgcgggatcgtttggtgaatacgagggtgtagtggcgtttagggatgggaacggtgcggttagagcgcgggttatagggtttgaaatttgggttggagggttgtaagggttttgtaaggtttgtacgtgtgacggggttatgacgcgcgtacgggggcgtgtgtgagataggtatttttagtggggttgtcgcgttgcgtt

SEQ ID NO: 25208 - DNA, 647 bp, Artificial Sequence
  chemically treated genomic DNA (Homo sapiens) CpG-island No: 25208
aacgcaacgcgacaaccccactaaaaatacctatctcacacacgcccccgtacgcgcgtcataaccccgtcacacgtacaaaccttacaaaacccttacaaccctccaacccaaatttcaaaccctataacccgcgctctaaccgcaccgttcccatccctaaacgccactacaccctcgtattcaccaaacgatcccgcgacgccaacacacgccccccgcgacgctccccgccccgacacacaaaaacgcccgctaaccccaccctcccgaacaccctcgacaacaacgcttcccgacgaccctcccaaccaacacccgacaccccgaacccgacgaccgacgacccacgcgccaacctcgaaccctaatcgaacgcctccttcctaaacccccgcgcgcttaaccgctcctcgaacgaacgaaccctaaaatcctcctacccccttccgttccgacccgcgcgcccgctcgctcgccccccccccttcccgcgcacgcccgtttcccgaaaaccgccgcttacaacaaaatcgcccgcttcccccaaacacgccccccgttaaaacccccgcgcaccccccgcgtatccccgaaaacgaacaccatcacccacgcaaccaacgcactcccccgaaaccgcgacc

SEQ ID NO: 25209 - DNA, 744 bp, Artificial Sequence
  chemically treated genomic DNA (Homo sapiens) CpG-island No: 25209
ggttaggcgtcgtagtgcgtttcgtcggtttagatattttagcggatttcgatttcgttaagttgcgcgttttgagtgtttttattacgatagtcgttgttttgaacgtgagcgtaaggtttaatagtttgttcgttagttattttttgatgttagttgacgcgataatttgtcgtttacgtttgaatattttggcggatatattgcgtcgtatcgaggtataggttttgggtaaattagtttgaatcgttcgggtgttattcgtcgttgtatttgtcgttattaaagaatgaggcgttggcgcgtagtatggtatcggatgcgttattttggtcgtttagcggtaattgttgttcgacggcgatgaaaaagatttgatcgcgtagcggtttttagcgtagatcggtgtcggatatcggattttttatcggtattattatttcgtttttttcggtatcggtaaagacgcggttataaattgagagtaggtcgttttttagtagtatattgcgttcgatgcggtattcggtttttagttgttcgtagttacgatagtttttttttggcgttgcgtcgtcgatattattgttagcggtatttatggcgtcggaacgtaagtcgatggaagaatcgaaattgaacgtttagcggcgatcgatttttttatgtaaacggcggaaattgaagcgttgttgattttgttttggggttagtggggttattagcgtttgattattaatgtta

SEQ ID NO: 25210 - DNA, 744 bp, Artificial Sequence
  chemically treated genomic DNA (Homo sapiens) CpG-island No: 25210
taacattaataatcaaacgctaataaccccactaaccccaaaacaaaatcaacaacgcttcaatttccgccgtttacataaaaaaatcgatcgccgctaaacgttcaatttcgattcttccatcgacttacgttccgacgccataaataccgctaacaataatatcgacgacgcaacgccaaaaaaaaactatcgtaactacgaacaactaaaaaccgaataccgcatcgaacgcaatatactactaaaaaacgacctactctcaatttataaccgcgtctttaccgataccgaaaaaaacgaaataataataccgataaaaaatccgatatccgacaccgatctacgctaaaaaccgctacgcgatcaaatctttttcatcgccgtcgaacaacaattaccgctaaacgaccaaaataacgcatccgataccatactacgcgccaacgcctcattctttaataacgacaaatacaacgacgaataacacccgaacgattcaaactaatttacccaaaacctatacctcgatacgacgcaatatatccgccaaaatattcaaacgtaaacgacaaattatcgcgtcaactaacatcaaaaaataactaacgaacaaactattaaaccttacgctcacgttcaaaacaacgactatcgtaataaaaacactcaaaacgcgcaacttaacgaaatcgaaatccgctaaaatatctaaaccgacgaaacgcactacgacgcctaacc

SEQ ID NO: 25211 - DNA, 744 bp, Artificial Sequence
  chemically treated genomic DNA (Homo sapiens) CpG-island No: 25211
tgatattgataattaggcgttgataattttattgattttagaataaaattaataacgttttaattttcgtcgtttgtatgaggaggtcggtcgtcgttggacgtttagtttcgatttttttatcggtttgcgtttcggcgttatgagtatcgttaataataatgtcggcggcgtagcgttagggaaaagttatcgtagttacggataattggaagtcgagtatcgtatcggacgtaatatgttgttggaaggcgatttgtttttagtttatagtcgcgtttttgtcgatatcggagaaaacggggtgatgatgtcggtgaaaaattcgatgttcggtatcggtttgcgttggaagtcgttgcgcgattagattttttttatcgtcgtcgaatagtagttgtcgttgaacggttaaaatggcgtattcgatattatgttgcgcgttagcgttttattttttaatggcggtaaatatagcgacgaatggtattcgaacggtttaggttggtttgtttaaaatttgtatttcgatgcggcgtaatatattcgttaggatatttaggcgtggacggtagattatcgcgttagttggtattagaaggtagttaacggatagattattgagttttacgtttacgtttaggataacggttatcgtgataaaggtatttagggcgcgtagtttggcggagtcggggttcgttggaatatttggatcggcgagacgtattacgacgtttggtt

SEQ ID NO: 25212 - DNA, 744 bp, Artificial Sequence
  chemically treated genomic DNA (Homo sapiens) CpG-island No: 25212
aaccaaacgtcgtaatacgtctcgccgatccaaatattccaacgaaccccgactccgccaaactacgcgccctaaatacctttatcacgataaccgttatcctaaacgtaaacgtaaaactcaataatctatccgttaactaccttctaataccaactaacgcgataatctaccgtccacgcctaaatatcctaacgaatatattacgccgcatcgaaatacaaattttaaacaaaccaacctaaaccgttcgaataccattcgtcgctatatttaccgccattaaaaaataaaacgctaacgcgcaacataatatcgaatacgccattttaaccgttcaacgacaactactattcgacgacgataaaaaaaatctaatcgcgcaacgacttccaacgcaaaccgataccgaacatcgaatttttcaccgacatcatcaccccgttttctccgatatcgacaaaaacgcgactataaactaaaaacaaatcgccttccaacaacatattacgtccgatacgatactcgacttccaattatccgtaactacgataacttttccctaacgctacgccgccgacattattattaacgatactcataacgccgaaacgcaaaccgataaaaaaatcgaaactaaacgtccaacgacgaccgacctcctcatacaaacgacgaaaattaaaacgttattaattttattctaaaatcaataaaattatcaacgcctaattatcaatatca

SEQ ID NO: 25213 - DNA, 839 bp, Artificial Sequence
  chemically treated genomic DNA (Homo sapiens) CpG-island No: 25213
  misc_feature (535)..(535): n is either a, c, g or t
ttgtcgagtcgtgttatataagtcgatatacggagtaagcgacggttggggtagtagtgtagtgttgtgttgatagtatggcgttgttttttgttcgttttttcgtcgattatacgtgtatttagtttgttgtattaggatcggtttaggtatgtcggtcgtagtaggatatttatgttattacgttaagagcgtacggtaagtacggcgttagtttagtacgcgttttagggcgattaatcgatagtgataacgaagtattgttgacgttaaatacgggttatagtaaatagagtataagggaaattaggtagaatataggtacgtcgcgttgattcgagacgtagtgaagtcgataagagcgttttggattttttatgtattgacgcgatttacgaaatagattcgagcgattatagagatttagtacggtcgggcgataatattagaattagggatttatgaatagtagtattacggtagttgtatcgtttaagcggaagcgttttattcgatgtcgtttttattttgatanatcgatatttggatcgcgttaatcgggaaaatttggttcggtttagaatattttacggggatagatagagcgtcgattttattgagcgtcgagtcgaggagggatttttaatacggtaggaggtagatagcgttttagacgtgggcgtgtgtataaaagttcgcgataacgtcgatcgaggcgttatattcgtataaacgcgcgacgattacgtcgagagaatcgatacgttttagcgatatttattaggtcggtagtaagttacggggatagtagttatcgtatattttcgagggcgatacgt

SEQ ID NO: 25214 - DNA, 839 bp, Artificial Sequence
  chemically treated genomic DNA (Homo sapiens) CpG-island No: 25214
  misc_feature (305)..(305): n is either a, c, g or t
acgtatcgccctcgaaaatatacgataactactatccccgtaacttactaccgacctaataaatatcgctaaaacgtatcgattctctcgacgtaatcgtcgcgcgtttatacgaatataacgcctcgatcgacgttatcgcgaacttttatacacacgcccacgtctaaaacgctatctacctcctaccgtattaaaaatccctcctcgactcgacgctcaataaaatcgacgctctatctatccccgtaaaatattctaaaccgaaccaaattttcccgattaacgcgatccaaatatcgatntatcaaaataaaaacgacatcgaataaaacgcttccgcttaaacgatacaactaccgtaatactactattcataaatccctaattctaatattatcgcccgaccgtactaaatctctataatcgctcgaatctatttcgtaaatcgcgtcaatacataaaaaatccaaaacgctcttatcgacttcactacgtctcgaatcaacgcgacgtacctatattctacctaatttcccttatactctatttactataacccgtatttaacgtcaacaatacttcgttatcactatcgattaatcgccctaaaacgcgtactaaactaacgccgtacttaccgtacgctcttaacgtaataacataaatatcctactacgaccgacatacctaaaccgatcctaatacaacaaactaaatacacgtataatcgacgaaaaaacgaacaaaaaacaacgccatactatcaacacaacactacactactaccccaaccgtcgcttactccgtatatcgacttatataacacgactcgacaa

SEQ ID NO: 25215 - DNA, 839 bp, Artificial Sequence
  chemically treated genomic DNA (Homo sapiens) CpG-island No: 25215
  misc_feature (305)..(305): n is either a, c, g or t
gcgtgtcgttttcggaggtgtgcggtggttgttgttttcgtggtttgttgtcggtttggtgggtgtcgttggggcgtgtcggttttttcggcgtggtcgtcgcgcgtttgtgcgggtgtggcgtttcggtcggcgttatcgcgggtttttgtgtatacgtttacgtttgagacgttgtttgttttttgtcgtgttggaggttttttttcggttcggcgtttagtgagatcggcgttttgtttgttttcgtagggtattttaggtcggattaggttttttcggttaacgcggtttaggtgtcggtntattaggatggaggcggtatcgagtgggacgttttcgtttgggcggtatagttgtcgtggtattgttgtttataggtttttggttttggtgttgtcgttcgatcgtgttggatttttgtagtcgttcggatttgtttcgtagatcgcgttagtatatgggaggtttaggacgtttttatcggttttattacgtttcgagttaacgcgacgtgtttgtgttttatttggttttttttgtgttttgtttgttgtggttcgtgtttggcgttagtagtgtttcgttgttattgtcggttagtcgttttggagcgcgtgttggattaacgtcgtatttgtcgtgcgtttttgacgtgatagtatgagtattttgttgcggtcggtatgtttggatcgattttgatgtagtaagttgagtgtacgtgtagtcgacggaaggacggataagaggtagcgttatattattagtataatattgtattgttgttttagtcgtcgtttgtttcgtatgtcgatttatatagtacgattcggtag

SEQ ID NO: 25216 - DNA, 839 bp, Artificial Sequence
  chemically treated genomic DNA (Homo sapiens) CpG-island No: 25216
  misc_feature (535)..(535): n is either a, c, g or t
ctaccgaatcgtactatataaatcgacatacgaaacaaacgacgactaaaacaacaatacaatattatactaataatataacgctacctcttatccgtccttccgtcgactacacgtacactcaacttactacatcaaaatcgatccaaacataccgaccgcaacaaaatactcatactatcacgtcaaaaacgcacgacaaatacgacgttaatccaacacgcgctccaaaacgactaaccgacaataacaacgaaacactactaacgccaaacacgaaccacaacaaacaaaacacaaaaaaaaccaaataaaacacaaacacgtcgcgttaactcgaaacgtaataaaaccgataaaaacgtcctaaacctcccatatactaacgcgatctacgaaacaaatccgaacgactacaaaaatccaacacgatcgaacgacaacaccaaaaccaaaaacctataaacaacaataccacgacaactataccgcccaaacgaaaacgtcccactcgataccgcctccatcctaatanaccgacacctaaaccgcgttaaccgaaaaaacctaatccgacctaaaataccctacgaaaacaaacaaaacgccgatctcactaaacgccgaaccgaaaaaaaacctccaacacgacaaaaaacaaacaacgtctcaaacgtaaacgtatacacaaaaacccgcgataacgccgaccgaaacgccacacccgcacaaacgcgcgacgaccacgccgaaaaaaccgacacgccccaacgacacccaccaaaccgacaacaaaccacgaaaacaacaaccaccgcacacctccgaaaacgacacgc

SEQ ID NO: 25217 - DNA, 784 bp, Artificial Sequence
  chemically treated genomic DNA (Homo sapiens) CpG-island No: 25217
aatatgacggttaaaaaagtgatagtttacgtttttttattgttcggggatggggagtaagtttagttattcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcggagttcggagagtaacggaatagtagagagtttcgtgaaaacgataaagcgtgattatattagtattatgtttaaattagacgggttaacggt

SEQ ID NO: 25218 - DNA, 784 bp, Artificial Sequence
  chemically treated genomic DNA (Homo sapiens) CpG-island No: 25218
accgttaacccgtctaatttaaacataatactaatataatcacgctttatcgttttcacgaaactctctactattccgttactctccgaactccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgaataactaaacttactccccatccccgaacaataaaaaaacgtaaactatcacttttttaaccgtcatatt

SEQ ID NO: 25219 - DNA, 784 bp, Artificial Sequence
  chemically treated genomic DNA (Homo sapiens) CpG-island No: 25219
gtcgttaattcgtttggtttgggtatgatattgatgtagttacgttttatcgtttttacgaagttttttgttatttcgttatttttcggatttcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacgggtgattaagtttattttttattttcgggtaataagggggcgtgggttattatttttttggtcgttatatt

SEQ ID NO: 25220 - DNA, 784 bp, Artificial Sequence
  chemically treated genomic DNA (Homo sapiens) CpG-island No: 25220
aatataacgaccaaaaaaataataacccacgcccccttattacccgaaaataaaaaataaacttaatcacccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacgaaatccgaaaaataacgaaataacaaaaaacttcgtaaaaacgataaaacgtaactacatcaatatcatacccaaaccaaacgaattaacgac

SEQ ID NO: 25221 - DNA, 738 bp, Artificial Sequence
  chemically treated genomic DNA (Homo sapiens) CpG-island No: 25221
tttcggttttttttacgtagtttcggttatttttttcgttattcgttggatttcggtttttagtgttttgtttcggttcgttcgtttttaatttcgtatttgttttcggttttcgttttttttgtttagttcgattttttcgttcgtttttattttaggtgttatttttttttcgttttttttgtttcgcgatttttcgcgtttggcgttagtgttatcgtttttcggtttagttcggattttttcgttcggtttcggttttttcgtcgagtttcggtttttttcgtttagtttcggtttttttcgcgtttggtttcggtttttttcgtttagtttcggtttttttattcgttttcgtttggcgttttattatggcgttgtttgtttttttttgttttcgatttgaaatttttttttttttcgttttggttatggttcggttttttcgtcgtttttttcgttgtttttcggttttgttcggtttttttcgtttggtttcggttttttttattggttttggttttttcggtttttttcggtcgattcggtttttattattcgtttttggtttttttcgtttagttttggttttttcggcgtttttcggtttagttcgtttagttcggtttttttcgttcggttttagtttttttcgatttcgtcgttttagtgggaatgaagttatgttcgttgttaatatttttggatgttgtgaggttacgtggagtgtgtgagaga

SEQ ID NO: 25222 - DNA, 738 bp, Artificial Sequence
  chemically treated genomic DNA (Homo sapiens) CpG-island No: 25222
tctctcacacactccacgtaacctcacaacatccaaaaatattaacaacgaacataacttcattcccactaaaacgacgaaatcgaaaaaaactaaaaccgaacgaaaaaaaccgaactaaacgaactaaaccgaaaaacgccgaaaaaaccaaaactaaacgaaaaaaaccaaaaacgaataataaaaaccgaatcgaccgaaaaaaaccgaaaaaaccaaaaccaataaaaaaaaccgaaaccaaacgaaaaaaaccgaacaaaaccgaaaaacaacgaaaaaaacgacgaaaaaaccgaaccataaccaaaacgaaaaaaaaaaaaatttcaaatcgaaaacaaaaaaaaacaaacaacgccataataaaacgccaaacgaaaacgaataaaaaaaccgaaactaaacgaaaaaaaccgaaaccaaacgcgaaaaaaaccgaaactaaacgaaaaaaaccgaaactcgacgaaaaaaccgaaaccgaacgaaaaaatccgaactaaaccgaaaaacgataacactaacgccaaacgcgaaaaatcgcgaaacaaaaaaaacgaaaaaaaaataacacctaaaataaaaacgaacgaaaaaatcgaactaaacaaaaaaaacgaaaaccgaaaacaaatacgaaattaaaaacgaacgaaccgaaacaaaacactaaaaaccgaaatccaacgaataacgaaaaaaataaccgaaactacgtaaaaaaaaccgaaa

SEQ ID NO: 25223 - DNA, 738 bp, Artificial Sequence
  chemically treated genomic DNA (Homo sapiens) CpG-island No: 25223
ttttttatatattttacgtggttttataatatttaaaagtgttagtagcgaatatggttttatttttattgaagcggcgaaatcggagaaaattgaagtcgggcggagaaagtcgaattgaacgaattgagtcgaggagcgtcggagaagttaaggttgggcgaggggagttaaagacgggtggtgggagtcgagtcggtcgagaggaatcggaaaagttaaggttaatgggaggagtcgaggttaggcgggaggagtcgagtagggtcgaaaagtagcgggaagggcggcggagaagtcgagttatggttaggacggagggaggggaagttttaggtcggagatagagagggataggtagcgttatggtaggacgttaggcgaggacggatggggaagtcgaagttgggcggaaagagtcgaagttaggcgcgaaggaagtcgaagttgggcgggggaagtcgaggttcggcggaagagtcgaggtcgggcgggaggattcgagttggatcgaaaagcggtggtattggcgttaagcgcgggaggtcgcggggtagagagggcgaagggagggtagtatttggggtgagggcgggcgggagagtcgagttgggtagaaagagcggaagtcgagagtaagtgcggggttgagggcgggcgaatcgaggtagggtattggaagtcgaggtttagcgggtggcggagagggtaatcgaggttgcgtgggaggagtcgagg

SEQ ID NO: 25224 - DNA, 738 bp, Artificial Sequence
  chemically treated genomic DNA (Homo sapiens) CpG-island No: 25224
cctcgactcctcccacgcaacctcgattaccctctccgccacccgctaaacctcgacttccaataccctacctcgattcgcccgccctcaaccccgcacttactctcgacttccgctctttctacccaactcgactctcccgcccgccctcaccccaaatactaccctcccttcgccctctctaccccgcgacctcccgcgcttaacgccaataccaccgcttttcgatccaactcgaatcctcccgcccgacctcgactcttccgccgaacctcgacttcccccgcccaacttcgacttccttcgcgcctaacttcgactctttccgcccaacttcgacttccccatccgtcctcgcctaacgtcctaccataacgctacctatccctctctatctccgacctaaaacttcccctccctccgtcctaaccataactcgacttctccgccgcccttcccgctacttttcgaccctactcgactcctcccgcctaacctcgactcctcccattaaccttaacttttccgattcctctcgaccgactcgactcccaccacccgtctttaactcccctcgcccaaccttaacttctccgacgctcctcgactcaattcgttcaattcgactttctccgcccgacttcaattttctccgatttcgccgcttcaataaaaataaaaccatattcgctactaacacttttaaatattataaaaccacgtaaaatatataaaaaa

SEQ ID NO: 25225 - DNA, 874 bp, Artificial Sequence
  chemically treated genomic DNA (Homo sapiens) CpG-island No: 25225
gcgcgcggcgtggtgggtagacgtttttttttttgggtttcggaggttaggtcggattgggagcgtatttatttcggtgaagaagttatttattgttttagcgtagtttcggattcgtcgagtgtcgtttcgattcgcggaagttagcgtcgtcgcgggttcggggaaattatgcgtgttacggcgttattttcgaggacgcgcgttcgcggggtttttttgttgttatcgttcggtttttttttgttttttttattttttgttcgtttaaatttaagtttttaattcgttcgtttcgacggtagtttttgttttttttttttttaagttttttattattgggcgtagcgttcgtaagcggagaatagttggtggtatattttttttttaggcgggggaaggcggcggggtgttggcgagcgcggttttttttttttgcgtttcggtcgggggttttcggggcgggtaggaggatagcgggtcgtaaagtgagtaggagtcgcgattttcgcgcgagcgtttggaggtgagtagtttcgcgtcgcggtttagttagttttcgttcgcgggattatagtttagcgatttcgtttcgttttttcgtagtcggtttcgttttttcgtagtcggtttcgttttttcgttcgcggtttcgtttttaggagtttggtttttcgttaattatatcgtttggtttcgttcgggcggagcgtttcgtttttttttcgattaggtttcgtttattttaagttcgaagtagtcgtaggttcgttagcggattcgggagggggtcgcgtgtttttttaggtttttttacgtaggcgtggggaggggatttaatttttttttttgtagagagagattaaataattat

SEQ ID NO: 25226 - DNA, 874 bp, Artificial Sequence
  chemically treated genomic DNA (Homo sapiens) CpG-island No: 25226
ataattatttaatctctctctacaaaaaaaaaaattaaatcccctccccacgcctacgtaaaaaaacctaaaaaaacacgcgaccccctcccgaatccgctaacgaacctacgactacttcgaacttaaaataaacgaaacctaatcgaaaaaaaaacgaaacgctccgcccgaacgaaaccaaacgatataattaacgaaaaaccaaactcctaaaaacgaaaccgcgaacgaaaaaacgaaaccgactacgaaaaaacgaaaccgactacgaaaaaacgaaacgaaatcgctaaactataatcccgcgaacgaaaactaactaaaccgcgacgcgaaactactcacctccaaacgctcgcgcgaaaatcgcgactcctactcactttacgacccgctatcctcctacccgccccgaaaacccccgaccgaaacgcaaaaaaaaaaaaccgcgctcgccaacaccccgccgccttcccccgcctaaaaaaaaaatataccaccaactattctccgcttacgaacgctacgcccaataataaaaaacttaaaaaaaaaaaaaacaaaaactaccgtcgaaacgaacgaattaaaaacttaaatttaaacgaacaaaaaataaaaaaaacaaaaaaaaaccgaacgataacaacaaaaaaaccccgcgaacgcgcgtcctcgaaaataacgccgtaacacgcataatttccccgaacccgcgacgacgctaacttccgcgaatcgaaacgacactcgacgaatccgaaactacgctaaaacaataaataacttcttcaccgaaataaatacgctcccaatccgacctaacctccgaaacccaaaaaaaaaaacgtctacccaccacgccgcgcgc

SEQ ID NO: 25227 - DNA, 874 bp, Artificial Sequence
  chemically treated genomic DNA (Homo sapiens) CpG-island No: 25227
gtgattgtttagtttttttttgtagagggaagagttaaattttttttttacgtttacgtgggaagatttggggaaatacgcggttttttttcgggttcgttaacgagtttgcggttgtttcgggtttagagtgggcggggtttggtcgggaagggggcggggcgtttcgttcgggcggggttagacggtgtggttggcggagggttaagtttttgggggcggggtcgcgagcgggagggcggggtcggttgcgggagggcggggtcggttgcgggagggcggggcgaggtcgttgggttgtagtttcgcgggcgagagttggttgagtcgcggcgcgggattgtttatttttaagcgttcgcgcggggatcgcggtttttgtttattttgcggttcgttgtttttttgttcgtttcgagggttttcggtcggagcgtagagggagggggtcgcgttcgttagtatttcgtcgttttttttcgtttgggggaagaatgtgttattagttgtttttcgtttgcgagcgttgcgtttagtagtgaggaatttggaggaagaagagataaaggttgtcgtcgggacgggcgagttagggatttgggtttgggcgaataaaaggtgagaaggataagaagggatcgggcgatggtagtaggggagtttcgcgggcgcgcgttttcgggagtggcgtcgtgatacgtatggttttttcggattcgcggcggcgttgattttcgcgagtcggagcggtattcggcgagttcgggattgcgttggaataatggataatttttttatcgaggtaagtgcgtttttagttcgatttggttttcggagtttagggagagaggcgtttgtttattacgtcgcgcgt

SEQ ID NO: 25228 - DNA, 874 bp, Artificial Sequence
  chemically treated genomic DNA (Homo sapiens) CpG-island No: 25228
acgcgcgacgtaataaacaaacgcctctctccctaaactccgaaaaccaaatcgaactaaaaacgcacttacctcgataaaaaaattatccattattccaacgcaatcccgaactcgccgaataccgctccgactcgcgaaaatcaacgccgccgcgaatccgaaaaaaccatacgtatcacgacgccactcccgaaaacgcgcgcccgcgaaactcccctactaccatcgcccgatcccttcttatccttctcaccttttattcgcccaaacccaaatccctaactcgcccgtcccgacgacaacctttatctcttcttcctccaaattcctcactactaaacgcaacgctcgcaaacgaaaaacaactaataacacattcttcccccaaacgaaaaaaaacgacgaaatactaacgaacgcgaccccctccctctacgctccgaccgaaaaccctcgaaacgaacaaaaaaacaacgaaccgcaaaataaacaaaaaccgcgatccccgcgcgaacgcttaaaaataaacaatcccgcgccgcgactcaaccaactctcgcccgcgaaactacaacccaacgacctcgccccgccctcccgcaaccgaccccgccctcccgcaaccgaccccgccctcccgctcgcgaccccgcccccaaaaacttaaccctccgccaaccacaccgtctaaccccgcccgaacgaaacgccccgcccccttcccgaccaaaccccgcccactctaaacccgaaacaaccgcaaactcgttaacgaacccgaaaaaaaaccgcgtatttccccaaatcttcccacgtaaacgtaaaaaaaaaatttaactcttccctctacaaaaaaaaactaaacaatcac

SEQ ID NO: 25229 - DNA, 737 bp, Artificial Sequence
  chemically treated genomic DNA (Homo sapiens) CpG-island No: 25229
  misc_feature (706)..(707): n is either a, c, g or t
  misc_feature (715)..(716): n is either a, c, g or t
tggattcgtcgcgatttgcgttagttttgttgcgtttagtgttggttttatattttttttcgtacggtaatcgagttgttgatcgttgatattcgttagtatttgacgttagtatttattacgcgtttcgtttttaattaacgtaatattttgcggtttaatatcgtaggtatgtacgatatttatgttatttgttagcgtataatttacgttttttagtattgttcgcgttagtttattggggttatgttgatgagttaaattaaagaaaatttttttcgtttggggattattgtgtggcgtacgttcgtcggaaagataaggtagaaattaaattggttcggtatttttattagtttgttgagttgtagcgattaaagttgggatattgtttaggtcggttaatttcgcggtttaatttagatacgacgttgtatttagtattatagatattaaatgttaacgttgcggtagcgtatggtaaaagttatgtacggcgttttttgggttgtttaagaatttttcgttgatagtaaaatagattttcgacgtttttagcgataatatgtttgattagtattaattatttttatattaattgtattagttgtattgtcgttatcgtttgttaattggtatcgtcgttatattttacgttttcgtaattttaggtaataaagtattagtaattttcgcgtgttttcgnntataagtnngcgggtatttggttacgagat

SEQ ID NO: 25230 - DNA, 737 bp, Artificial Sequence
  chemically treated genomic DNA (Homo sapiens) CpG-island No: 25230
  misc_feature (22)..(23): n is either a, c, g or t
  misc_feature (31)..(32): n is either a, c, g or t
atctcgtaaccaaatacccgcnnacttatanncgaaaacacgcgaaaattactaatactttattacctaaaattacgaaaacgtaaaatataacgacgataccaattaacaaacgataacgacaatacaactaatacaattaatataaaaataattaatactaatcaaacatattatcgctaaaaacgtcgaaaatctattttactatcaacgaaaaattcttaaacaacccaaaaaacgccgtacataacttttaccatacgctaccgcaacgttaacatttaatatctataatactaaatacaacgtcgtatctaaattaaaccgcgaaattaaccgacctaaacaatatcccaactttaatcgctacaactcaacaaactaataaaaataccgaaccaatttaatttctaccttatctttccgacgaacgtacgccacacaataatccccaaacgaaaaaaattttctttaatttaactcatcaacataaccccaataaactaacgcgaacaatactaaaaaacgtaaattatacgctaacaaataacataaatatcgtacatacctacgatattaaaccgcaaaatattacgttaattaaaaacgaaacgcgtaataaatactaacgtcaaatactaacgaatatcaacgatcaacaactcgattaccgtacgaaaaaaaatataaaaccaacactaaacgcaacaaaactaacgcaaatcgcgacgaatcca

SEQ ID NO: 25231 - DNA, 737 bp, Artificial Sequence
  chemically treated genomic DNA (Homo sapiens) CpG-island No: 25231
  misc_feature (22)..(23): n is either a, c, g or t
  misc_feature (31)..(32): n is either a, c, g or t
atttcgtgattagatgttcgtnnatttatanncgaaggtacgcggaaattattggtgttttgttatttgaagttgcgaaagcgtggggtatggcgacggtgttagttggtaggcggtggcgataatgtagttggtgtagttggtgtgggaatggttgatgttaattaggtatgttatcgttggggacgtcgggggtttattttgttgttagcgaagggtttttaagtagtttagaaggcgtcgtatatagtttttgttatgcgttatcgtaacgttggtatttaatgtttgtgatgttgagtgtagcgtcgtgtttggattgggtcgcgaaattaatcggtttgagtaatgttttagttttaatcgttgtagtttaataggttgatgaaagtgtcgagttagtttggtttttgttttattttttcggcgagcgtacgttatataataatttttaggcgaagggggttttttttggtttgatttattaatatggttttaatgaattggcgcgagtagtgttggaaggcgtgggttatgcgttggtagatggtatggatgtcgtgtatgtttgcggtattaaatcgtaaagtgttacgttgattgggggcggggcgcgtagtgagtattggcgttagatgttggcggatattagcggttagtagttcgattatcgtacggggggggatgtggggttagtattgggcgtagtaaggttggcgtagatcgcggcgaattta

SEQ ID NO: 25232 - DNA, 737 bp, Artificial Sequence
  chemically treated genomic DNA (Homo sapiens) CpG-island No: 25232
  misc_feature (706)..(707): n is either a, c, g or t
  misc_feature (715)..(716): n is either a, c, g or t
taaattcgccgcgatctacgccaaccttactacgcccaatactaaccccacatccccccccgtacgataatcgaactactaaccgctaatatccgccaacatctaacgccaatactcactacgcgccccgcccccaatcaacgtaacactttacgatttaataccgcaaacatacacgacatccataccatctaccaacgcataacccacgccttccaacactactcgcgccaattcattaaaaccatattaataaatcaaaccaaaaaaaacccccttcgcctaaaaattattatataacgtacgctcgccgaaaaaataaaacaaaaaccaaactaactcgacactttcatcaacctattaaactacaacgattaaaactaaaacattactcaaaccgattaatttcgcgacccaatccaaacacgacgctacactcaacatcacaaacattaaataccaacgttacgataacgcataacaaaaactatatacgacgccttctaaactacttaaaaacccttcgctaacaacaaaataaacccccgacgtccccaacgataacatacctaattaacatcaaccattcccacaccaactacaccaactacattatcgccaccgcctaccaactaacaccgtcgccataccccacgctttcgcaacttcaaataacaaaacaccaataatttccgcgtaccttcgnntataaatnnacgaacatctaatcacgaaat

SEQ ID NO: 25233 - DNA, 525 bp, Artificial Sequence
  chemically treated genomic DNA (Homo sapiens) CpG-island No: 25233
ggtttttttagcgtatcggcgcgtataatgttgttaagacgcgaacggatattcgttagttacggttgttacggtttcgttagtttaatttgtagttatattgttagcgtaatggtgttgtcgagaatcgcgcgaaaatttagacgcggatcgtttttggcgattatttttttcgtcgataggtgagttagcgtattcggtttttttgttatcggttggcgatatagttcgtagtacgtttgcggatgtttatcgttattggttagtttatgaacgggttgcggttgttgttgtttatcgttaataaataggcggttttgttcgttaataaatttgatgcgtagatggcggttttttagtaattttcgggtagagggcgttaggcgattgttcgtagggagatggatttttgcgttttcgttgagcgtatggttcgtttttagttatgtttcggtgatgaaattttttatagggattgttagttagtcggttaggcgatatataggaattttacgttggatgtcg

SEQ ID NO: 25234 - DNA, 525 bp, Artificial Sequence
  chemically treated genomic DNA (Homo sapiens) CpG-island No: 25234
cgacatccaacgtaaaattcctatatatcgcctaaccgactaactaacaatccctataaaaaatttcatcaccgaaacataactaaaaacgaaccatacgctcaacgaaaacgcaaaaatccatctccctacgaacaatcgcctaacgccctctacccgaaaattactaaaaaaccgccatctacgcatcaaatttattaacgaacaaaaccgcctatttattaacgataaacaacaacaaccgcaacccgttcataaactaaccaataacgataaacatccgcaaacgtactacgaactatatcgccaaccgataacaaaaaaaccgaatacgctaactcacctatcgacgaaaaaaataatcgccaaaaacgatccgcgtctaaattttcgcgcgattctcgacaacaccattacgctaacaatataactacaaattaaactaacgaaaccgtaacaaccgtaactaacgaatatccgttcgcgtcttaacaacattatacgcgccgatacgctaaaaaaacc

SEQ ID NO: 25235 - DNA, 525 bp, Artificial Sequence
  chemically treated genomic DNA (Homo sapiens) CpG-island No: 25235
cgatatttagcgtgaaatttttgtatgtcgtttggtcggttaattggtaatttttatgaaagattttattatcgaagtatggttaagagcgaattatacgtttagcgaaggcgtagagatttatttttttgcggatagtcgtttgacgttttttgttcgggagttgttggaaagtcgttatttgcgtattaagtttattgacgagtagggtcgtttgtttgttgacgatgaatagtagtagtcgtagttcgtttatgggttgattagtagcgatgaatattcgtaggcgtgttgcgaattgtgtcgttagtcggtggtaaaaaagtcggatacgttgatttatttgtcggcggaaaaaatggtcgttaaaagcgattcgcgtttgggttttcgcgcggttttcgatagtattattgcgttggtagtgtggttgtaaattgaattggcggaatcgtggtagtcgtggttggcggatattcgttcgcgttttggtaatattatgcgcgtcgatgcgttgggggaatt

SEQ ID NO: 25236 - DNA, 525 bp, Artificial Sequence
  chemically treated genomic DNA (Homo sapiens) CpG-island No: 25236
aattcccccaacgcatcgacgcgcataatattaccaaaacgcgaacgaatatccgccaaccacgactaccacgattccgccaattcaatttacaaccacactaccaacgcaataatactatcgaaaaccgcgcgaaaacccaaacgcgaatcgcttttaacgaccattttttccgccgacaaataaatcaacgtatccgacttttttaccaccgactaacgacacaattcgcaacacgcctacgaatattcatcgctactaatcaacccataaacgaactacgactactactattcatcgtcaacaaacaaacgaccctactcgtcaataaacttaatacgcaaataacgactttccaacaactcccgaacaaaaaacgtcaaacgactatccgcaaaaaaataaatctctacgccttcgctaaacgtataattcgctcttaaccatacttcgataataaaatctttcataaaaattaccaattaaccgaccaaacgacatacaaaaatttcacgctaaatatcg

SEQ ID NO: 25237 - DNA, 865 bp, Artificial Sequence
  chemically treated genomic DNA (Homo sapiens) CpG-island No: 25237
ttcgcgtattcggcgaggcgttgttttgtaataataacggtgcgattaattattcgtggcggtttagcgcgtcgttggtatcgagtatcgtttttatgtcgtttgttagttgatagcgtttattttgtttacggcgacgagtaatgcgatcggtaaacgtttcggtaagtagcggcgcgataagcgaattgtttgttttatcgttacgtacgtttaagcgttttaatagttgttgattacgttgttgttaggttggttgattgcgcgaaaacgttacgtttaggttattattgtttattcgtggcggtttttcgagaatggcggtaatttttgtcgcggtagtagtttcgtcgtcgtttttcgcgttaattagtattgtcgttaaacgcggatcgttatttagcgttgttattttttgtttttggcgtattaagtcgtttattttttagtgtttttagtatttgtaatagacgtttcgcggttagtagatttattattggcggttgatttagttaggtttatttgcgtcggatcgttgtattttttattgtagtaattttattagtaaatcggaaagatcgcgttgtaagattttcggttattttgcgtcgcgggcgttttgggaggttttggggattaaagtaggggatatcggggtttaagtcgggcgttcgggatcgcgttaggagagtcgagaatcggggaaaatacgcgtaattttcgtaggaataataattttaatattaggatggtgataatatatagagcgtatatggtttacgaggttttcgacggagcgttgaggtattatcggttcgtcggagatataatattcgtataattaatcggtaattattagcggatt

SEQ ID NO: 25238 - DNA, 865 bp, Artificial Sequence
  chemically treated genomic DNA (Homo sapiens) CpG-island No: 25238
aatccgctaataattaccgattaattatacgaatattatatctccgacgaaccgataatacctcaacgctccgtcgaaaacctcgtaaaccatatacgctctatatattatcaccatcctaatattaaaattattattcctacgaaaattacgcgtattttccccgattctcgactctcctaacgcgatcccgaacgcccgacttaaaccccgatatcccctactttaatccccaaaacctcccaaaacgcccgcgacgcaaaataaccgaaaatcttacaacgcgatctttccgatttactaataaaattactacaataaaaaatacaacgatccgacgcaaataaacctaactaaatcaaccgccaataataaatctactaaccgcgaaacgtctattacaaatactaaaaacactaaaaaataaacgacttaatacgccaaaaacaaaaaataacaacgctaaataacgatccgcgtttaacgacaatactaattaacgcgaaaaacgacgacgaaactactaccgcgacaaaaattaccgccattctcgaaaaaccgccacgaataaacaataataacctaaacgtaacgttttcgcgcaatcaaccaacctaacaacaacgtaatcaacaactattaaaacgcttaaacgtacgtaacgataaaacaaacaattcgcttatcgcgccgctacttaccgaaacgtttaccgatcgcattactcgtcgccgtaaacaaaataaacgctatcaactaacaaacgacataaaaacgatactcgataccaacgacgcgctaaaccgccacgaataattaatcgcaccgttattattacaaaacaacgcctcgccgaatacgcgaa

SEQ ID NO: 25239 - DNA, 865 bp, Artificial Sequence
  chemically treated genomic DNA (Homo sapiens) CpG-island No: 25239
gattcgttaatgattatcggttggttatacgaatattgtgttttcggcgaatcggtagtgttttaacgtttcgtcggaagtttcgtaggttatatgcgttttgtgtgttgttattattttagtgttaggattattatttttgcgggggttacgcgtatttttttcggttttcggtttttttgacgcggtttcgggcgttcggtttggatttcggtattttttgttttaatttttaggattttttagagcgttcgcggcgtaaagtgatcggagattttataacgcgattttttcggtttgttgatggaattattgtaatgggggatgtagcgattcggcgtagatgagtttggttggattaatcgttagtagtgaatttattggtcgcgaaacgtttgttataaatgttgggggtattggagggtgaacggtttagtgcgttaagggtaaaaaatggtagcgttgggtaacgattcgcgtttagcggtaatgttggttagcgcgaagaacgacgacgaagttgttatcgcggtaaaaattgtcgttattttcgaagagtcgttacggatgggtaatagtgatttgggcgtggcgttttcgcgtaattaattagtttggtagtaacgtagttagtaattgttaaaacgtttaaacgtacgtggcggtgaggtagatagttcgtttatcgcgtcgttatttgtcggggcgtttgtcgatcgtattgttcgtcgtcgtgggtaagatggacgttattaattggtaaacggtatgggagcgatgttcgatgttaacgacgcgttaagtcgttacgaatggttgatcgtatcgttattattgtagggtagcgtttcgtcggatgcgcgga

SEQ ID NO: 25240 - DNA, 865 bp, Artificial Sequence
  chemically treated genomic DNA (Homo sapiens) CpG-island No: 25240
tccgcgcatccgacgaaacgctaccctacaataataacgatacgatcaaccattcgtaacgacttaacgcgtcgttaacatcgaacatcgctcccataccgtttaccaattaataacgtccatcttacccacgacgacgaacaatacgatcgacaaacgccccgacaaataacgacgcgataaacgaactatctacctcaccgccacgtacgtttaaacgttttaacaattactaactacgttactaccaaactaattaattacgcgaaaacgccacgcccaaatcactattacccatccgtaacgactcttcgaaaataacgacaatttttaccgcgataacaacttcgtcgtcgttcttcgcgctaaccaacattaccgctaaacgcgaatcgttacccaacgctaccattttttacccttaacgcactaaaccgttcaccctccaatacccccaacatttataacaaacgtttcgcgaccaataaattcactactaacgattaatccaaccaaactcatctacgccgaatcgctacatcccccattacaataattccatcaacaaaccgaaaaaatcgcgttataaaatctccgatcactttacgccgcgaacgctctaaaaaatcctaaaaattaaaacaaaaaataccgaaatccaaaccgaacgcccgaaaccgcgtcaaaaaaaccgaaaaccgaaaaaaatacgcgtaacccccgcaaaaataataatcctaacactaaaataataacaacacacaaaacgcatataacctacgaaacttccgacgaaacgttaaaacactaccgattcgccgaaaacacaatattcgtataaccaaccgataatcattaacgaatc

SEQ ID NO: 25241 - DNA, 729 bp, Artificial Sequence
  chemically treated genomic DNA (Homo sapiens) CpG-island No: 25241
gtttcgtttttattttttgtgagttacgtttttttcgagcggggttaatttggtaaaaggagtgatgcgtttcgtttggatcgtgtttttgttcgggtttttgtagttttgcgcgttagtgtattgcgtttttttcgtcgtcggttaatagtagttttcgcgcgagtcgtcggcggtttcgggcgtttggcgttagtagatttaatgggagaataacgggtaggtgtttagtttgttgagtttgggtttatagtattagttttagcgtcgtcgggattcgggcgtcgtcgtttttggtgtagttaacgttttcgtttagtagtttcgtatttcgattttgttgattcgcgataatcgtatcgtcgcggcgcgaacgcggacggtcggtttatttggagttatcgttggtcgttttaggtttatcgttcgttattggttttaagttggttattcgatatttagagttcgcgaagttggcgtttcgcgcgcggagaattagatagcgtcgggagaagtttttgcgtttagtaatttgcggtcgtttagtcgcgtggacggtatggtgggcgacgatttttataatttttataagtattttgacgataatttttattataattattacgatatttatgaaaggtttagatttgggggtaggtatcggttcggatacggtattggttatttttagtacggtaagtatttttaagttcgttggaagtattcgtg

SEQ ID NO: 25242 - DNA, 729 bp, Artificial Sequence
  chemically treated genomic DNA (Homo sapiens) CpG-island No: 25242
cacgaatacttccaacgaacttaaaaatacttaccgtactaaaaataaccaataccgtatccgaaccgatacctacccccaaatctaaacctttcataaatatcgtaataattataataaaaattatcgtcaaaatacttataaaaattataaaaatcgtcgcccaccataccgtccacgcgactaaacgaccgcaaattactaaacgcaaaaacttctcccgacgctatctaattctccgcgcgcgaaacgccaacttcgcgaactctaaatatcgaataaccaacttaaaaccaataacgaacgataaacctaaaacgaccaacgataactccaaataaaccgaccgtccgcgttcgcgccgcgacgatacgattatcgcgaatcaacaaaatcgaaatacgaaactactaaacgaaaacgttaactacaccaaaaacgacgacgcccgaatcccgacgacgctaaaactaatactataaacccaaactcaacaaactaaacacctacccgttattctcccattaaatctactaacgccaaacgcccgaaaccgccgacgactcgcgcgaaaactactattaaccgacgacgaaaaaaacgcaatacactaacgcgcaaaactacaaaaacccgaacaaaaacacgatccaaacgaaacgcatcactccttttaccaaattaaccccgctcgaaaaaaacgtaactcacaaaaaataaaaacgaaac

SEQ ID NO: 25243 - DNA, 729 bp, Artificial Sequence
  chemically treated genomic DNA (Homo sapiens) CpG-island No: 25243
tacgggtgtttttagcggatttgggggtatttatcgtattggaagtagttagtgtcgtattcgggtcggtatttgtttttaggtttgggttttttataagtatcgtagtagttgtaataagggttgtcgttagagtatttgtaggggttgtaagggtcgtcgtttattatgtcgtttacgcggttgggcggtcgtaggttattgagcgtaggaatttttttcggcgttgtttggtttttcgcgcgcgaggcgttagtttcgcgggttttagatgtcgagtagttagtttggaattagtgacgggcggtgggtttggggcggttagcggtgattttagatgagtcggtcgttcgcgttcgcgtcgcggcggtgcggttgtcgcggattagtaggatcggagtgcggggttgttgggcggaggcgttggttgtattagggacggcggcgttcgggtttcggcggcgttgaggttggtattgtgagtttaggtttagtaagttgaatatttgttcgttgtttttttattggatttgttggcgttaggcgttcggagtcgtcggcggttcgcgcgggggttgttgttggtcggcggcgggaggggcgtagtgtattagcgcgtagagttgtaaaggttcgagtaggagtacggtttaggcgaagcgtattattttttttgttagattgatttcgttcgaggaggacgtggtttatagaaaataaaaacggggt

SEQ ID NO: 25244 - DNA, 729 bp, Artificial Sequence
  chemically treated genomic DNA (Homo sapiens) CpG-island No: 25244
accccgtttttattttctataaaccacgtcctcctcgaacgaaatcaatctaacaaaaaaaataatacgcttcgcctaaaccgtactcctactcgaacctttacaactctacgcgctaatacactacgcccctcccgccgccgaccaacaacaacccccgcgcgaaccgccgacgactccgaacgcctaacgccaacaaatccaataaaaaaacaacgaacaaatattcaacttactaaacctaaactcacaataccaacctcaacgccgccgaaacccgaacgccgccgtccctaatacaaccaacgcctccgcccaacaaccccgcactccgatcctactaatccgcgacaaccgcaccgccgcgacgcgaacgcgaacgaccgactcatctaaaatcaccgctaaccgccccaaacccaccgcccgtcactaattccaaactaactactcgacatctaaaacccgcgaaactaacgcctcgcgcgcgaaaaaccaaacaacgccgaaaaaaattcctacgctcaataacctacgaccgcccaaccgcgtaaacgacataataaacgacgacccttacaacccctacaaatactctaacgacaacccttattacaactactacgatacttataaaaaacccaaacctaaaaacaaataccgacccgaatacgacactaactacttccaatacgataaatacccccaaatccgctaaaaacacccgta

SEQ ID NO: 25245 - DNA, 763 bp, Artificial Sequence
  chemically treated genomic DNA (Homo sapiens) CpG-island No: 25245
ataagattatttttatcgcgggagaggcggaggttcgcgcgggtgttgggatttagatcgggggattcgggtagcggatgtaggttttatttttttcgtcgttttggtttgcgttggattcggcgttcggttatttttgcgcgtcgttttcggttttcgtcgttttttttttttcggagttcgaattttggttgaagtttattcgttgggttagacgcgttagattttgcgatatggatagcgggggtaggtacgtttcggtgttatttaggtttattttatggatttgtttttcgtaggtcgattcgatgttgattcgtattgcgcgtatttcggatatgttggttgcgtcggttagcggtgggaggattttttacgagttaaaaaacgaggtacgaagaggaggtttttttgcggagagtcgggaatttagaagttcgtagtcgcggtgttttagaagattttcgggaaatcgaacgtaacgtttagattggaaataaaggagttggtttagtaatttttttagaacgtatcgtaagtttttttttcggtaagtttttcggagtaaaattgggtaggcgcggaagttttagggttttttagagcgttttcggtgaattacggtgtagggtggggtaaattttcgggtttataagaggcgtggtcggtagagggagggaaagagcggttcgggagtcgagagtgtggcgggtatattttttgttttttaagtttgcgtttgtttaaaaagtggatgaggaaa

SEQ ID NO: 25246 - DNA, 763 bp, Artificial Sequence
  chemically treated genomic DNA (Homo sapiens) CpG-island No: 25246
tttcctcatccactttttaaacaaacgcaaacttaaaaaacaaaaaatatacccgccacactctcgactcccgaaccgctctttccctccctctaccgaccacgcctcttataaacccgaaaatttaccccaccctacaccgtaattcaccgaaaacgctctaaaaaaccctaaaacttccgcgcctacccaattttactccgaaaaacttaccgaaaaaaaaacttacgatacgttctaaaaaaattactaaaccaactcctttatttccaatctaaacgttacgttcgatttcccgaaaatcttctaaaacaccgcgactacgaacttctaaattcccgactctccgcaaaaaaacctcctcttcgtacctcgttttttaactcgtaaaaaatcctcccaccgctaaccgacgcaaccaacatatccgaaatacgcgcaatacgaatcaacatcgaatcgacctacgaaaaacaaatccataaaataaacctaaataacaccgaaacgtacctacccccgctatccatatcgcaaaatctaacgcgtctaacccaacgaataaacttcaaccaaaattcgaactccgaaaaaaaaaaaacgacgaaaaccgaaaacgacgcgcaaaaataaccgaacgccgaatccaacgcaaaccaaaacgacgaaaaaaataaaacctacatccgctacccgaatcccccgatctaaatcccaacacccgcgcgaacctccgcctctcccgcgataaaaataatcttat

SEQ ID NO: 25247 - DNA, 763 bp, Artificial Sequence
  chemically treated genomic DNA (Homo sapiens) CpG-island No: 25247
tttttttatttattttttaaataaacgtaggtttaaaaagtaaggaatatattcgttatattttcggttttcgaatcgttttttttttttttttgtcggttacgttttttataggttcggaagtttattttattttgtatcgtgatttatcggaagcgttttagggaattttggagttttcgcgtttgtttagttttgtttcgaaagatttatcgaggagggagtttgcggtgcgttttgggaaagttgttgggttagtttttttgtttttagtttgagcgttgcgttcggtttttcgagggttttttgaggtatcgcggttgcgggtttttgagttttcggtttttcgtagggaagtttttttttcgtatttcgttttttggttcgtggggggtttttttatcgttggtcgacgtagttagtatgttcggggtgcgcgtagtgcggattagtatcgaatcggtttgcgagaagtaggtttatgaggtgggtttggatggtatcgagacgtatttgttttcgttgtttatgtcgtagaatttggcgcgtttggtttagcggatagattttagttagggttcgggtttcgaggaggaggaggcggcggggatcgagggcgacgcgtaggagtggtcgggcgtcgggtttagcgtagattaggacgacgaggaaggtaaggtttgtattcgttgttcgagtttttcggtttgggttttagtattcgcgcgggttttcgtttttttcgcgatgggggtgattttgt

SEQ ID NO: 25248 - DNA, 763 bp, Artificial Sequence
  chemically treated genomic DNA (Homo sapiens) CpG-island No: 25248
acaaaatcacccccatcgcgaaaaaaacgaaaacccgcgcgaatactaaaacccaaaccgaaaaactcgaacaacgaatacaaaccttaccttcctcgtcgtcctaatctacgctaaacccgacgcccgaccactcctacgcgtcgccctcgatccccgccgcctcctcctcctcgaaacccgaaccctaactaaaatctatccgctaaaccaaacgcgccaaattctacgacataaacaacgaaaacaaatacgtctcgataccatccaaacccacctcataaacctacttctcgcaaaccgattcgatactaatccgcactacgcgcaccccgaacatactaactacgtcgaccaacgataaaaaaaccccccacgaaccaaaaaacgaaatacgaaaaaaaaacttccctacgaaaaaccgaaaactcaaaaacccgcaaccgcgatacctcaaaaaaccctcgaaaaaccgaacgcaacgctcaaactaaaaacaaaaaaactaacccaacaactttcccaaaacgcaccgcaaactccctcctcgataaatctttcgaaacaaaactaaacaaacgcgaaaactccaaaattccctaaaacgcttccgataaatcacgatacaaaataaaataaacttccgaacctataaaaaacgtaaccgacaaaaaaaaaaaaaaaacgattcgaaaaccgaaaatataacgaatatattccttactttttaaacctacgtttatttaaaaaataaataaaaaaa

SEQ ID NO: 25249 - DNA, 712 bp, Artificial Sequence
  chemically treated genomic DNA (Homo sapiens) CpG-island No: 25249
gtcgaggagggcgcgtttttggttgtttgcgatttcgttcgttttgacggtttttgttcgcgtttttcgtttcgtttcgttcggttttaggtttatttgcggcgggagcgttagatcgttttcgtttttttgttcgcgtggggttttttgtcgtcgttatgtcggtcgcgttgcggacgggcgttgggtttcggttcgtggtttgtagtggtttgttagacgcgacggtcgttcgtcggcgttcgggttcgtttttttgaggcgggttggggagggcgggggaggcgtagggcggggatgggtatcgattgacgcgtcgggtagttaattagaggtcgggtaggggaggagcgggttttagaggggcggggttttcgcgcgttgtcggggtcgcgggttttagaattgcggagattttcgaggttcggtagcggggcgggaagttatttttggggtttaggcgcgtttttgaggttgtttttcgggaaatattttgggaattttatttgggcggattcggcgatttttttggtattttttatcgaaggttcgttgattgggaagtataatcgcggagggtcggttgatgagggcgaggaattagtgttgttttttttcgcgggtaggttgttgcgcgatgttgttttgttattgtcggggtgggcgagtttggagtttagatgtagttgtcggtttaggatttgtttatttg

SEQ ID NO: 25250 - DNA, 712 bp, Artificial Sequence
  chemically treated genomic DNA (Homo sapiens) CpG-island No: 25250
caaataaacaaatcctaaaccgacaactacatctaaactccaaactcgcccaccccgacaataacaaaacaacatcgcgcaacaacctacccgcgaaaaaaaacaacactaattcctcgccctcatcaaccgaccctccgcgattatacttcccaatcaacgaaccttcgataaaaaataccaaaaaaatcgccgaatccgcccaaataaaattcccaaaatatttcccgaaaaacaacctcaaaaacgcgcctaaaccccaaaaataacttcccgccccgctaccgaacctcgaaaatctccgcaattctaaaacccgcgaccccgacaacgcgcgaaaaccccgcccctctaaaacccgctcctcccctacccgacctctaattaactacccgacgcgtcaatcgatacccatccccgccctacgcctcccccgccctccccaacccgcctcaaaaaaacgaacccgaacgccgacgaacgaccgtcgcgtctaacaaaccactacaaaccacgaaccgaaacccaacgcccgtccgcaacgcgaccgacataacgacgacaaaaaaccccacgcgaacaaaaaaacgaaaacgatctaacgctcccgccgcaaataaacctaaaaccgaacgaaacgaaacgaaaaacgcgaacaaaaaccgtcaaaacgaacgaaatcgcaaacaaccaaaaacgcgccctcctcgac

SEQ ID NO: 25251 - DNA, 712 bp, Artificial Sequence
  chemically treated genomic DNA (Homo sapiens) CpG-island No: 25251
taagtgaataggttttgggtcgatagttgtatttggattttaggttcgtttatttcggtagtaatagagtagtatcgcgtagtaatttgttcgcggggggaaatagtattggtttttcgtttttattagtcggtttttcgcgattgtgttttttaattaacgggttttcgatgaaaagtgttaaggaggtcgtcggattcgtttaagtggaatttttaagatgtttttcggggagtagttttaggaacgcgtttggattttaggagtagtttttcgtttcgttgtcgagtttcggaggttttcgtagttttggggttcgcgatttcgatagcgcgcggaggtttcgtttttttagggttcgttttttttttgttcggtttttgattggttgttcggcgcgttagtcggtatttattttcgttttacgtttttttcgttttttttagttcgttttagggaagcgagttcgggcgtcggcgggcggtcgtcgcgtttgatagattattgtagattacgggtcgaggtttagcgttcgttcgtagcgcggtcggtatggcggcgataaggagttttacgcgggtaagggagcgggagcggtttggcgttttcgtcgtaggtgagtttggggtcgggcggggcggggcggggggcgcgagtagggatcgttaaggcgggcggggtcgtaggtagttagggacgcgtttttttcggt

SEQ ID NO: 25252 - DNA, 712 bp, Artificial Sequence
  chemically treated genomic DNA (Homo sapiens) CpG-island No: 25252
accgaaaaaaacgcgtccctaactacctacgaccccgcccgccttaacgatccctactcgcgccccccgccccgccccgcccgaccccaaactcacctacgacgaaaacgccaaaccgctcccgctcccttacccgcgtaaaactccttatcgccgccataccgaccgcgctacgaacgaacgctaaacctcgacccgtaatctacaataatctatcaaacgcgacgaccgcccgccgacgcccgaactcgcttccctaaaacgaactaaaaaaaacgaaaaaaacgtaaaacgaaaataaataccgactaacgcgccgaacaaccaatcaaaaaccgaacaaaaaaaaaacgaaccctaaaaaaacgaaacctccgcgcgctatcgaaatcgcgaaccccaaaactacgaaaacctccgaaactcgacaacgaaacgaaaaactactcctaaaatccaaacgcgttcctaaaactactccccgaaaaacatcttaaaaattccacttaaacgaatccgacgacctccttaacacttttcatcgaaaacccgttaattaaaaaacacaatcgcgaaaaaccgactaataaaaacgaaaaaccaatactatttccccccgcgaacaaattactacgcgatactactctattactaccgaaataaacgaacctaaaatccaaatacaactatcgacccaaaacctattcactta

SEQ ID NO: 25253 - DNA, 527 bp, Artificial Sequence
  chemically treated genomic DNA (Homo sapiens) CpG-island No: 25253
  misc_feature (53)..(53): n is either a, c, g or t
tggcgcggtatggaagagatcgtgaaaaatcgcgattcgcgcgatgtatggantattgtgtataatgtttgatgcgacgttggcgcgttttattaggtttataagtttgtgtcgaatcgtaggtcgtattcggtatgttataaatagagcgtcggaaatattaatcggtttatttcgcgtatttttaacgtattagttaacggtttaacgtttttcggcgtggcgttcgtttagttttgcgtttcgttatatacgtcgtgggtatgaaacgcgtttaggcgtatcggaatatcgtcgagttttttgataaacgtcgttagtttttcgatgtgttgtaaataatttatttggttagggattattagtaaacgtagtttcgttagtttgtcgcgttttgttagtaaatagatgttgcgtttaatttgttgattatcgcgttcggtgagttgttgatgatattcgtttttttacgttttgagatcgagtattgcgtcgtcgtatatcgggagtaatttttttttagtcgg

SEQ ID NO: 25254 - DNA, 527 bp, Artificial Sequence
  chemically treated genomic DNA (Homo sapiens) CpG-island No: 25254
  misc_feature (475)..(475): n is either a, c, g or t
ccgactaaaaaaaaattactcccgatatacgacgacgcaatactcgatctcaaaacgtaaaaaaacgaatatcatcaacaactcaccgaacgcgataatcaacaaattaaacgcaacatctatttactaacaaaacgcgacaaactaacgaaactacgtttactaataatccctaaccaaataaattatttacaacacatcgaaaaactaacgacgtttatcaaaaaactcgacgatattccgatacgcctaaacgcgtttcatacccacgacgtatataacgaaacgcaaaactaaacgaacgccacgccgaaaaacgttaaaccgttaactaatacgttaaaaatacgcgaaataaaccgattaatatttccgacgctctatttataacataccgaatacgacctacgattcgacacaaacttataaacctaataaaacgcgccaacgtcgcatcaaacattatacacaatantccatacatcgcgcgaatcgcgatttttcacgatctcttccataccgcgcca

SEQ ID NO: 25255 - DNA, 527 bp, Artificial Sequence
  chemically treated genomic DNA (Homo sapiens) CpG-island No: 25255
  misc_feature (475)..(475): n is either a, c, g or t
tcggttggggaaaaattgttttcggtgtgcgacggcgtaatgttcgattttaaagcgtgggggagcgaatgttattaataatttatcggacgcgataattagtagattaagcgtagtatttatttgttggtagagcgcggtaagttggcggaattgcgtttgttggtgatttttggttaggtggattatttgtaatatatcgaagaattggcggcgtttattaagggattcggcgatgtttcggtacgtttgaacgcgttttatgtttacggcgtgtatggcgaggcgtaaagttgggcgagcgttacgtcggaagacgttgagtcgttggttgatgcgttaaaggtgcgcggggtgagtcggttgatattttcggcgttttatttgtgatatgtcggatacggtttacggttcggtatagatttgtaggtttgataagacgcgttagcgtcgtattaggtattgtgtataatantttatgtatcgcgcggatcgcggttttttacgattttttttatgtcgcgtta

SEQ ID NO: 25256 - DNA, 527 bp, Artificial Sequence
  chemically treated genomic DNA (Homo sapiens) CpG-island No: 25256
  misc_feature (53)..(53): n is either a, c, g or t
taacgcgacataaaaaaaatcgtaaaaaaccgcgatccgcgcgatacataaantattatacacaatacctaatacgacgctaacgcgtcttatcaaacctacaaatctataccgaaccgtaaaccgtatccgacatatcacaaataaaacgccgaaaatatcaaccgactcaccccgcgcacctttaacgcatcaaccaacgactcaacgtcttccgacgtaacgctcgcccaactttacgcctcgccatacacgccgtaaacataaaacgcgttcaaacgtaccgaaacatcgccgaatcccttaataaacgccgccaattcttcgatatattacaaataatccacctaaccaaaaatcaccaacaaacgcaattccgccaacttaccgcgctctaccaacaaataaatactacgcttaatctactaattatcgcgtccgataaattattaataacattcgctcccccacgctttaaaatcgaacattacgccgtcgcacaccgaaaacaatttttccccaaccga

SEQ ID NO: 25257 - DNA, 678 bp, Artificial Sequence
  chemically treated genomic DNA (Homo sapiens) CpG-island No: 25257
cgtacgcgtatttttttagatagcgtcgatttgcgtatggaaatcgttagttatttgcgtcggatttgtcgcgtttgttagtgttcgttcggtaataaacgtttttacgcggatatttttaaatagcggtaggttagtaggggtaatttcgttagtaatggaaagtttaaggtcgatatttgaaagcgtttttatgcgtgttagatcggtttcgttttattgttgttcgttggtttgtgtattacgatcgcgatgataaatgggtttgtcgtacgttaatacgatgttagtcgcgggcgtcgtttagcgtttagttatcgaatagttttatttgaattttattttcgtagcgttgtgttattgcgtggtttttttttatcgtcgcgagcggcgcgggcgtagatgatggttatttagttagcgtttgcgttaaacgtttgttgcgcgagcgtttattagcgtcgggatttttagttagtaacgatgattggttcggggtacggtcggtaaggtttacgggtagtttcgtttaatagagaaatgggggtcggttcgaagaaatttaagcggcgtttaaaaagggtcgtagtcggggggataaggaggatgatgaaggacgacgttttaaaaaggggcgtcgtataagaggggttttaggggggggagattttaaagggg

SEQ ID NO: 25258 - DNA, 678 bp, Artificial Sequence
  chemically treated genomic DNA (Homo sapiens) CpG-island No: 25258
cccctttaaaatctcccccccctaaaacccctcttatacgacgcccctttttaaaacgtcgtccttcatcatcctccttatccccccgactacgaccctttttaaacgccgcttaaatttcttcgaaccgacccccatttctctattaaacgaaactacccgtaaaccttaccgaccgtaccccgaaccaatcatcgttactaactaaaaatcccgacgctaataaacgctcgcgcaacaaacgtttaacgcaaacgctaactaaataaccatcatctacgcccgcgccgctcgcgacgataaaaaaaaaccacgcaataacacaacgctacgaaaataaaattcaaataaaactattcgataactaaacgctaaacgacgcccgcgactaacatcgtattaacgtacgacaaacccatttatcatcgcgatcgtaatacacaaaccaacgaacaacaataaaacgaaaccgatctaacacgcataaaaacgctttcaaatatcgaccttaaactttccattactaacgaaattacccctactaacctaccgctatttaaaaatatccgcgtaaaaacgtttattaccgaacgaacactaacaaacgcgacaaatccgacgcaaataactaacgatttccatacgcaaatcgacgctatctaaaaaaatacgcgtacg

SEQ ID NO: 25259 - DNA, 678 bp, Artificial Sequence
  chemically treated genomic DNA (Homo sapiens) CpG-island No: 25259
tttttttggggttttttttttttggggttttttttgtgcggcgtttttttttgagacgtcgttttttattattttttttgttttttcggttacggttttttttaaacgtcgtttgaattttttcgaatcggtttttatttttttgttaagcgaggttgttcgtgaattttgtcgatcgtgtttcggattaattatcgttgttgattgaaggtttcgacgttggtgaacgttcgcgtaataggcgtttggcgtaggcgttaattggatgattattatttgcgttcgcgtcgttcgcgacggtagaaaaaggttacgtaatggtataacgttgcgggggtgaaatttagatagagttgttcggtaattggacgttggacgacgttcgcgattggtatcgtattggcgtgcggtaggtttatttattatcgcggtcgtgatgtataggttagcgggtaatagtggggcgaagtcgatttggtacgtatgaaggcgtttttagatatcggttttgagttttttattattggcgggattatttttgttgatttgtcgttgtttaaagatattcgcgtgaaagcgtttattgtcgggcgggtattggtaggcgcggtaaattcggcgtaagtggttggcgatttttatgcgtaaatcgacgttatttggggaggtgcgcgtgcg

SEQ ID NO: 25260 - DNA, 678 bp, Artificial Sequence
  chemically treated genomic DNA (Homo sapiens) CpG-island No: 25260
cgcacgcgcacctccccaaataacgtcgatttacgcataaaaatcgccaaccacttacgccgaatttaccgcgcctaccaatacccgcccgacaataaacgctttcacgcgaatatctttaaacaacgacaaatcaacaaaaataatcccgccaataataaaaaactcaaaaccgatatctaaaaacgccttcatacgtaccaaatcgacttcgccccactattacccgctaacctatacatcacgaccgcgataataaataaacctaccgcacgccaatacgataccaatcgcgaacgtcgtccaacgtccaattaccgaacaactctatctaaatttcacccccgcaacgttataccattacgtaacctttttctaccgtcgcgaacgacgcgaacgcaaataataatcatccaattaacgcctacgccaaacgcctattacgcgaacgttcaccaacgtcgaaaccttcaatcaacaacgataattaatccgaaacacgatcgacaaaattcacgaacaacctcgcttaacaaaaaaataaaaaccgattcgaaaaaattcaaacgacgtttaaaaaaaaccgtaaccgaaaaaacaaaaaaaataataaaaaacgacgtctcaaaaaaaaacgccgcacaaaaaaaaccccaaaaaaaaaaaaccccaaaaaaa

SEQ ID NO: 25261 - DNA, 523 bp, Artificial Sequence
  chemically treated genomic DNA (Homo sapiens) CpG-island No: 25261
ttcgcgcgtagcgcgttgagtcggtgtttaggttggggtttggagtcgtagtttcgaaaaggcgcgttgtttttttaaaaggtcgcgtattttcgggtcggttttttttttcggggttttagttgtgattgacgttgggcggcgagaggaggcgtttggcgttaataaaagttcggttcgcgggcgagttgcgtcgggtcgttagtttttattcgtttcggggattcgtaataagtggtcgtcgcgtttttttcggggaagtcgcgggcgcgtaggggtagtcgaaggaggcggtcgagtcgcggagtttaggggtttgttcggtttagcgtttatcggaggggatcggggcgggcggatggggattcggcggcggcggcgcggtgagtttttgggcggtttcggggcgcgggttgtgcgcggcgttgcgttcgtcggtttttagcgcggattgtaagtgttgtagttgtgttcggtttcgtttggagttatcgggggtgttaggaggggacgtagtattttt

SEQ ID NO: 25262 - DNA, 523 bp, Artificial Sequence
  chemically treated genomic DNA (Homo sapiens) CpG-island No: 25262
aaaaatactacgtcccctcctaacacccccgataactccaaacgaaaccgaacacaactacaacacttacaatccgcgctaaaaaccgacgaacgcaacgccgcgcacaacccgcgccccgaaaccgcccaaaaactcaccgcgccgccgccgccgaatccccatccgcccgccccgatcccctccgataaacgctaaaccgaacaaacccctaaactccgcgactcgaccgcctccttcgactacccctacgcgcccgcgacttccccgaaaaaaacgcgacgaccacttattacgaatccccgaaacgaataaaaactaacgacccgacgcaactcgcccgcgaaccgaacttttattaacgccaaacgcctcctctcgccgcccaacgtcaatcacaactaaaaccccgaaaaaaaaaaccgacccgaaaatacgcgaccttttaaaaaaacaacgcgccttttcgaaactacgactccaaaccccaacctaaacaccgactcaacgcgctacgcgcgaa

SEQ ID NO: 25263 - DNA, 523 bp, Artificial Sequence
  chemically treated genomic DNA (Homo sapiens) CpG-island No: 25263
gggggtgttgcgtttttttttggtattttcggtggttttaggcggggtcgggtatagttgtagtatttataattcgcgttgggggtcggcgggcgtagcgtcgcgtatagttcgcgtttcggggtcgtttagaggtttatcgcgtcgtcgtcgtcgggtttttattcgttcgtttcgatttttttcggtgggcgttgagtcgggtaggtttttgggtttcgcggttcgatcgtttttttcggttgtttttgcgcgttcgcggttttttcggggagggcgcggcggttatttgttgcgggttttcggagcgagtgaagattagcgattcggcgtagttcgttcgcgggtcggatttttgttagcgttaggcgttttttttcgtcgtttagcgttaattatagttggagtttcggggaggaaggtcggttcggagatgcgcggttttttaaaggggtagcgcgttttttcggggttgcggttttaggttttagtttgggtatcggtttagcgcgttacgcgcgaa

SEQ ID NO: 25264 - DNA, 523 bp, Artificial Sequence
  chemically treated genomic DNA (Homo sapiens) CpG-island No: 25264
ttcgcgcgtaacgcgctaaaccgatacccaaactaaaacctaaaaccgcaaccccgaaaaaacgcgctacccctttaaaaaaccgcgcatctccgaaccgaccttcctccccgaaactccaactataattaacgctaaacgacgaaaaaaaacgcctaacgctaacaaaaatccgacccgcgaacgaactacgccgaatcgctaatcttcactcgctccgaaaacccgcaacaaataaccgccgcgccctccccgaaaaaaccgcgaacgcgcaaaaacaaccgaaaaaaacgatcgaaccgcgaaacccaaaaacctacccgactcaacgcccaccgaaaaaaatcgaaacgaacgaataaaaacccgacgacgacgacgcgataaacctctaaacgaccccgaaacgcgaactatacgcgacgctacgcccgccgacccccaacgcgaattataaatactacaactatacccgaccccgcctaaaaccaccgaaaataccaaaaaaaaacgcaacaccccc

SEQ ID NO: 25265 - DNA, 520 bp, Artificial Sequence
  chemically treated genomic DNA (Homo sapiens) CpG-island No: 25265
  misc_feature (331)..(331): n is either a, c, g or t
tttgtttgggtcgtcgggtttcggaaaatttatttttttacgttatttaagcggtttgattatcggcgataaatttgtcggtagttatatcgagttgttgggtcgtatagtttagcgcgaaggtcgtttggttcgcgatattcgtaaaagtcgcgtttatatcggttatatattttaataatttaatttggtgaatcgtttgagcgtattggagaacgtgttgattggcgcgttcggtagtacgtcgttttggcgtatttgttttagttggtttatcggcgagtagaaatagcgcgcgttataggcgttgattcgcgttggtatggtgtanttttgttattagcgcgtttttattttttcggcgggtagtagtaacgtgtggcgattgttcgtgcgttgatttagtaggggaaagtgatttttggcgatgaaatttcgtttttttggggtttaattatgcgttttttgtggggattttcgggggtttttcggaggagggggttcggggggttagtcgttt

SEQ ID NO: 25266 - DNA, 520 bp, Artificial Sequence
  chemically treated genomic DNA (Homo sapiens) CpG-island No: 25266
  misc_feature (190)..(190): n is either a, c, g or t
aaacgactaaccccccgaaccccctcctccgaaaaacccccgaaaatccccacaaaaaacgcataattaaaccccaaaaaaacgaaatttcatcgccaaaaatcactttcccctactaaatcaacgcacgaacaatcgccacacgttactactacccgccgaaaaaataaaaacgcgctaataacaaaantacaccataccaacgcgaatcaacgcctataacgcgcgctatttctactcgccgataaaccaactaaaacaaatacgccaaaacgacgtactaccgaacgcgccaatcaacacgttctccaatacgctcaaacgattcaccaaattaaattattaaaatatataaccgatataaacgcgacttttacgaatatcgcgaaccaaacgaccttcgcgctaaactatacgacccaacaactcgatataactaccgacaaatttatcgccgataatcaaaccgcttaaataacgtaaaaaaataaattttccgaaacccgacgacccaaacaaa

SEQ ID NO: 25267 - DNA, 520 bp, Artificial Sequence
  chemically treated genomic DNA (Homo sapiens) CpG-island No: 25267
  misc_feature (190)..(190): n is either a, c, g or t
gagcggttgatttttcggattttttttttcggaaaattttcgagagtttttataagaagcgtataattgggttttagggagacggggttttatcgttaagaattatttttttttgttgaattagcgtacggataatcgttatacgttgttgttgttcgtcgaagaggtggaaacgcgttgatggtaaaantgtattatgttaacgcgggttagcgtttgtaacgcgcgttgtttttgttcgtcggtgaattagttaaaataggtgcgttagaacggcgtgttgtcgagcgcgttaattagtacgttttttagtacgtttaggcggtttattaggttgaattgttggaatatgtagtcggtatgggcgcggtttttgcggatatcgcgggttaggcggttttcgcgttggattgtgcggtttagtagttcgatatggttatcgatagatttatcgtcggtaattaaatcgtttaagtgacgtaaaagggtggatttttcggaattcgacggtttaagtaga

SEQ ID NO: 25268 - DNA, 520 bp, Artificial Sequence
  chemically treated genomic DNA (Homo sapiens) CpG-island No: 25268
  misc_feature (331)..(331): n is either a, c, g or t
tctacttaaaccgtcgaattccgaaaaatccacccttttacgtcacttaaacgatttaattaccgacgataaatctatcgataaccatatcgaactactaaaccgcacaatccaacgcgaaaaccgcctaacccgcgatatccgcaaaaaccgcgcccataccgactacatattccaacaattcaacctaataaaccgcctaaacgtactaaaaaacgtactaattaacgcgctcgacaacacgccgttctaacgcacctattttaactaattcaccgacgaacaaaaacaacgcgcgttacaaacgctaacccgcgttaacataatacanttttaccatcaacgcgtttccacctcttcgacgaacaacaacaacgtataacgattatccgtacgctaattcaacaaaaaaaaataattcttaacgataaaaccccgtctccctaaaacccaattatacgcttcttataaaaactctcgaaaattttccgaaaaaaaaaatccgaaaaatcaaccgctc

SEQ ID NO: 25269 - DNA, 1109 bp, Artificial Sequence
  chemically treated genomic DNA (Homo sapiens) CpG-island No: 25269
cgggtgagtcgtcgtattttacgcgcggttacgggttggtgttcggtatgagcgagcgtaaagcgatggcgatggcgttggtcgatcgcgttttgtaagtttcggagtacggcgagtacgcgataggttcggcgtaggatgaagagttcgtgttggtatatgtcgataacgtcgaagtcgtaggttttgttttatattttaaatttttttattacgtcgatttttaggtcgaattggagtttatttaaacgtttgtaataggagtagaattatggttaatttgagcggttataattttgtttatttcgacgagtagattaaacgtatgattcgtcgcgttattttaaaagcggtggcgattttcggttattaggtgtcgtttggcgggcgcgagatgtcgatgtcgtacggttggggaatcggcggtatttagtttatcgatagcgtgattggcgaaagcgacgtgttgaaggtgatgagtagggttcgaagatattattaacgcggttcgattcgtaatttttttaagcgcgtgatcggggaaatattacggaacgtacggacgatgcgacggtaatttagacgcgttatcgtattttcgaaacgtcgttgatcgaagattagataattattttttaggtgttaattttcgagtcgttgcgttttatcgagtcgcgcgaaacggaaattcgtattatgtacgcgttggaagagtacggcgtgatgtaggtgaaattgtatgaagatatcgttcgtttcggttatatcgttattatttacgtttattcggtgaaggtaaatgggcgttacgtgatggattcgtcgtcgatttcgaaattcgataatttaaaaatggatatgatgttcgttttgtaattgttcggcgcggggcgcgagaagcgtatttatgcggtgtcgtcgtttattcgcgtggaaagtttcgatttcgacgattattcgtttatcgtttagtagtgggatgagttatgcgttatttgcggatcgatttatagttattttgatgaagtggtgttggatgacgtcggaaatcgtatgtttgtttgtttcgatatcgattattgtcgttaatagagcgaggtaaaaaatta

SEQ ID NO: 25270 - DNA, 1109 bp, Artificial Sequence
  chemically treated genomic DNA (Homo sapiens) CpG-island No: 25270
taattttttacctcgctctattaacgacaataatcgatatcgaaacaaacaaacatacgatttccgacgtcatccaacaccacttcatcaaaataactataaatcgatccgcaaataacgcataactcatcccactactaaacgataaacgaataatcgtcgaaatcgaaactttccacgcgaataaacgacgacaccgcataaatacgcttctcgcgccccgcgccgaacaattacaaaacgaacatcatatccatttttaaattatcgaatttcgaaatcgacgacgaatccatcacgtaacgcccatttaccttcaccgaataaacgtaaataataacgatataaccgaaacgaacgatatcttcatacaatttcacctacatcacgccgtactcttccaacgcgtacataatacgaatttccgtttcgcgcgactcgataaaacgcaacgactcgaaaattaacacctaaaaaataattatctaatcttcgatcaacgacgtttcgaaaatacgataacgcgtctaaattaccgtcgcatcgtccgtacgttccgtaatatttccccgatcacgcgcttaaaaaaattacgaatcgaaccgcgttaataatatcttcgaaccctactcatcaccttcaacacgtcgctttcgccaatcacgctatcgataaactaaataccgccgattccccaaccgtacgacatcgacatctcgcgcccgccaaacgacacctaataaccgaaaatcgccaccgcttttaaaataacgcgacgaatcatacgtttaatctactcgtcgaaataaacaaaattataaccgctcaaattaaccataattctactcctattacaaacgtttaaataaactccaattcgacctaaaaatcgacgtaataaaaaaatttaaaatataaaacaaaacctacgacttcgacgttatcgacatataccaacacgaactcttcatcctacgccgaacctatcgcgtactcgccgtactccgaaacttacaaaacgcgatcgaccaacgccatcgccatcgctttacgctcgctcataccgaacaccaacccgtaaccgcgcgtaaaatacgacgactcacccg

SEQ ID NO: 25271 - DNA, 1109 bp, Artificial Sequence
  chemically treated genomic DNA (Homo sapiens) CpG-island No: 25271
tggttttttgtttcgttttgttggcggtaataatcggtatcggagtagataaatatgcggttttcggcgttatttagtattattttattaagatagttgtgggtcgattcgtagatggcgtatggtttattttattgttgaacggtgaacgggtgatcgtcgaaatcgagattttttacgcgggtaaacggcggtatcgtatagatgcgtttttcgcgtttcgcgtcgaatagttgtagggcgggtattatgtttatttttgggttatcgaatttcgggatcggcgacgggtttattacgtagcgtttatttatttttatcggataggcgtaggtggtggcgatatgatcgaagcgggcgatatttttatatagttttatttgtattacgtcgtatttttttagcgcgtgtatggtgcgggttttcgtttcgcgcggttcgataaagcgtagcggttcggggattggtatttggaagataattatttgattttcggttagcggcgtttcggggatgcggtgacgcgtttggattatcgtcgtatcgttcgtacgtttcgtggtgttttttcggttacgcgtttgaagaagttgcgaatcgaatcgcgttggtggtgttttcgggttttgtttattatttttagtacgtcgttttcgttaattacgttgtcggtaagttgaatgtcgtcggttttttagtcgtacggtatcggtatttcgcgttcgttaaacggtatttgataatcggggatcgttatcgtttttaagatggcgcggcggattatgcgtttggtttgttcgtcgaggtaggtaaagttgtagtcgtttagattagttatggttttgtttttgttgtagacgtttgagtagattttagttcggtttggaaatcgacgtagtgggggagtttgaggtgtgagataaagtttgcggtttcgacgttgtcggtatgtgttagtacgaattttttattttgcgtcgggtttgtcgcgtgttcgtcgtatttcggggtttgtagagcgcggtcgattagcgttatcgttatcgttttgcgttcgtttatgtcgaatattagttcgtagtcgcgcgtgaagtgcggcggtttattcg

SEQ ID NO: 25272 - DNA, 1109 bp, Artificial Sequence
  chemically treated genomic DNA (Homo sapiens) CpG-island No: 25272
cgaataaaccgccgcacttcacgcgcgactacgaactaatattcgacataaacgaacgcaaaacgataacgataacgctaatcgaccgcgctctacaaaccccgaaatacgacgaacacgcgacaaacccgacgcaaaataaaaaattcgtactaacacataccgacaacgtcgaaaccgcaaactttatctcacacctcaaactcccccactacgtcgatttccaaaccgaactaaaatctactcaaacgtctacaacaaaaacaaaaccataactaatctaaacgactacaactttacctacctcgacgaacaaaccaaacgcataatccgccgcgccatcttaaaaacgataacgatccccgattatcaaataccgtttaacgaacgcgaaataccgataccgtacgactaaaaaaccgacgacattcaacttaccgacaacgtaattaacgaaaacgacgtactaaaaataataaacaaaacccgaaaacaccaccaacgcgattcgattcgcaacttcttcaaacgcgtaaccgaaaaaacaccacgaaacgtacgaacgatacgacgataatccaaacgcgtcaccgcatccccgaaacgccgctaaccgaaaatcaaataattatcttccaaataccaatccccgaaccgctacgctttatcgaaccgcgcgaaacgaaaacccgcaccatacacgcgctaaaaaaatacgacgtaatacaaataaaactatataaaaatatcgcccgcttcgatcatatcgccaccacctacgcctatccgataaaaataaataaacgctacgtaataaacccgtcgccgatcccgaaattcgataacccaaaaataaacataatacccgccctacaactattcgacgcgaaacgcgaaaaacgcatctatacgataccgccgtttacccgcgtaaaaaatctcgatttcgacgatcacccgttcaccgttcaacaataaaataaaccatacgccatctacgaatcgacccacaactatcttaataaaataatactaaataacgccgaaaaccgcatatttatctactccgataccgattattaccgccaacaaaacgaaacaaaaaacca

SEQ ID NO: 25273 - DNA, 520 bp, Artificial Sequence
  chemically treated genomic DNA (Homo sapiens) CpG-island No: 25273
cggacgcgcggcgacgatgattaaattcgacggttgtaagttagcggtttttttgttgagatcgttataatcggtgtttatttcggtaacgttatcgtgtggttgttgaaataattgtttaatacgcgttacggttgcgtcgagtatatcggcgatgtttttcggtttttcgtttttgttcgtacgattttcggtaattttaaagacgcgggatttagttagatttagtagattttcgttggtacgtttttgcggattaaaattagtttcggtaattttattcgtaatcgagattattttacggataacggtacgtttacgtacgatgttcgtataggtattgatgttagtcgtatttggcgtattttttgatagttttgttagataagtaaaattatcgacgttatcgagttgtttttggcgttttagcgatttcgtaagagtaattagatcgatagggttatcgtttttttgtaaacgcgttattttagtaaagatatgacggtgtgggcgggtgtaa

SEQ ID NO: 25274 - DNA, 520 bp, Artificial Sequence
  chemically treated genomic DNA (Homo sapiens) CpG-island No: 25274
ttacacccgcccacaccgtcatatctttactaaaataacgcgtttacaaaaaaacgataaccctatcgatctaattactcttacgaaatcgctaaaacgccaaaaacaactcgataacgtcgataattttacttatctaacaaaactatcaaaaaatacgccaaatacgactaacatcaatacctatacgaacatcgtacgtaaacgtaccgttatccgtaaaataatctcgattacgaataaaattaccgaaactaattttaatccgcaaaaacgtaccaacgaaaatctactaaatctaactaaatcccgcgtctttaaaattaccgaaaatcgtacgaacaaaaacgaaaaaccgaaaaacatcgccgatatactcgacgcaaccgtaacgcgtattaaacaattatttcaacaaccacacgataacgttaccgaaataaacaccgattataacgatctcaacaaaaaaaccgctaacttacaaccgtcgaatttaatcatcgtcgccgcgcgtccg

SEQ ID NO: 25275 - DNA, 520 bp, Artificial Sequence
  chemically treated genomic DNA (Homo sapiens) CpG-island No: 25275
ttatattcgtttatatcgttatatttttattgaaatggcgcgtttgtaggaaagcggtagttttatcgatttgattatttttgcggaatcgttggaacgttaggggtaattcgatagcgtcggtggttttgtttatttggtagagttgttaaaaaatacgttaagtgcggttaatattagtgtttatgcggatatcgtgcgtgaacgtgtcgttgttcgtgagatgatttcggttgcgaatgagattgtcgaagttggttttgattcgtaggggcgtattagcgaagatttgttggatttggttgaatttcgcgtttttaaaattgtcgaaagtcgtgcgaataaagacgaagggtcgaagaatatcgtcgatgtgttcgacgtaatcgtggcgcgtattgagtagttgttttagtagttatacgatggcgttatcggggtaaatatcggttatgacgattttaataaaaaaatcgttggtttgtagtcgtcggatttgattatcgtcgtcgcgcgttcg

SEQ ID NO: 25276 - DNA, 520 bp, Artificial Sequence
  chemically treated genomic DNA (Homo sapiens) CpG-island No: 25276
cgaacgcgcgacgacgataatcaaatccgacgactacaaaccaacgatttttttattaaaatcgtcataaccgatatttaccccgataacgccatcgtataactactaaaacaactactcaatacgcgccacgattacgtcgaacacatcgacgatattcttcgacccttcgtctttattcgcacgactttcgacaattttaaaaacgcgaaattcaaccaaatccaacaaatcttcgctaatacgcccctacgaatcaaaaccaacttcgacaatctcattcgcaaccgaaatcatctcacgaacaacgacacgttcacgcacgatatccgcataaacactaatattaaccgcacttaacgtattttttaacaactctaccaaataaacaaaaccaccgacgctatcgaattacccctaacgttccaacgattccgcaaaaataatcaaatcgataaaactaccgctttcctacaaacgcgccatttcaataaaaatataacgatataaacgaatataa

SEQ ID NO: 25277 - DNA, 584 bp, Artificial Sequence
  chemically treated genomic DNA (Homo sapiens) CpG-island No: 25277
cgggattttattgacgaattttaggattttagttagcgtcgttttggaaagtatcgttagcggagatttttgttcgttttttgttatatacgtttgttgggtaaatattatattatcgtgcgtttcgatatgtataatgttggtatgttcgtcgacgatggtgatatacgtttattttttatcgttttagattttggcgcgtgagaagaggattttatcgtaaggtttttggattttaacggagatttttttcgtcgttagtagtgttttggtatcggtaattgtttgcgttgttgcgttttttagtatttttagttcggcgttggtatttttatttaacgtttttagcgtcgtcgtaatcggtagttttattattttcgtgtcgggaacggtgacgtttagatcgttttttattagatttggcgaaatttaggtttttatacgtttaatcggattttttagttttgtcgtagtaatcgtcgtcgttagcgttagtgaaatcggtttagtatattttagcgtcggttttatttttttttgaacggcgaggatgtaacgttgttataacggatttaaagtcgaat

SEQ ID NO: 25278 - DNA, 584 bp, Artificial Sequence
  chemically treated genomic DNA (Homo sapiens) CpG-island No: 25278
attcgactttaaatccgttataacaacgttacatcctcgccgttcaaaaaaaaataaaaccgacgctaaaatatactaaaccgatttcactaacgctaacgacgacgattactacgacaaaactaaaaaatccgattaaacgtataaaaacctaaatttcgccaaatctaataaaaaacgatctaaacgtcaccgttcccgacacgaaaataataaaactaccgattacgacgacgctaaaaacgttaaataaaaataccaacgccgaactaaaaatactaaaaaacgcaacaacgcaaacaattaccgataccaaaacactactaacgacgaaaaaaatctccgttaaaatccaaaaaccttacgataaaatcctcttctcacgcgccaaaatctaaaacgataaaaaataaacgtatatcaccatcgtcgacgaacataccaacattatacatatcgaaacgcacgataatataatatttacccaacaaacgtatataacaaaaaacgaacaaaaatctccgctaacgatactttccaaaacgacgctaactaaaatcctaaaattcgtcaataaaatcccg

SEQ ID NO: 25279 - DNA, 584 bp, Artificial Sequence
  chemically treated genomic DNA (Homo sapiens) CpG-island No: 25279
attcgattttaaattcgttatggtagcgttatattttcgtcgtttaggaggaagtaaaatcggcgttgggatgtattgaatcgattttattggcgttggcggcggcggttgttgcggtagaattggaaggttcggttgaacgtgtagaagtttgggtttcgttaaatttgatgaagaacggtttgggcgttatcgttttcggtacgggaatggtggggttgtcgattgcggcggcgttgggggcgttaggtggaaatgttaacgtcgggttggaagtgttgaaagacgtaatagcgtaggtaattgtcgatgttaaagtattgttggcggcggggaaagttttcgttaagatttaggaattttgcgatgaaattttttttttacgcgttaaagtttggaacggtgagaagtgggcgtgtgttattatcgtcggcgggtatattaatattgtgtatatcgagacgtacgatggtgtggtgtttatttagtaggcgtgtgtggtagagggcgagtaagagttttcgttgacggtgttttttagaacgacgttggttgagattttgaagttcgttaatgaagtttcg

SEQ ID NO: 25280 - DNA, 584 bp, Artificial Sequence
  chemically treated genomic DNA (Homo sapiens) CpG-island No: 25280
cgaaacttcattaacgaacttcaaaatctcaaccaacgtcgttctaaaaaacaccgtcaacgaaaactcttactcgccctctaccacacacgcctactaaataaacaccacaccatcgtacgtctcgatatacacaatattaatatacccgccgacgataataacacacgcccacttctcaccgttccaaactttaacgcgtaaaaaaaaaatttcatcgcaaaattcctaaatcttaacgaaaactttccccgccgccaacaatactttaacatcgacaattacctacgctattacgtctttcaacacttccaacccgacgttaacatttccacctaacgcccccaacgccgccgcaatcgacaaccccaccattcccgtaccgaaaacgataacgcccaaaccgttcttcatcaaatttaacgaaacccaaacttctacacgttcaaccgaaccttccaattctaccgcaacaaccgccgccgccaacgccaataaaatcgattcaatacatcccaacgccgattttacttcctcctaaacgacgaaaatataacgctaccataacgaatttaaaatcgaat

SEQ ID NO: 25281 - DNA, 607 bp, Artificial Sequence
  chemically treated genomic DNA (Homo sapiens) CpG-island No: 25281
ttgtcggtggataaagataaatttttcgttatgtttagtgaatttcgtatttcggcgattattgttacgattatcgcggtggttattattatcgttttgttgggtatgttgattcgtatttttttgtagttattgtatattatgattcgcgttatggaagatatcgtcgacggcgagggcgatttgattcgtcgtttgattatttagaattacgacgaattcggcgtgttcggtatcgcgtttaatcgtttcgtggagcggatttatatttcgattcgcgaggtattttcggttatcgagtacgttaatgaagtggttttgcgggtggttagcgtttttaatttttcgatggttaatttcgacgagtaggttaatcgtattaatagcgtagcggtcgttattaacgaattgggggtcgtcgtttaggaaatcgttcgtaacgtcgtataggtttttaattaggttagcgatgttcgataattggtcgaagacgggtagtaggtggtggagcgtaatattaaggcgatgaattagttgtcgtagatgattagcgtttttagtattaatatcgaagcgtttaataatagacggtgaatatcgggtagat

SEQ ID NO: 25282 - DNA, 607 bp, Artificial Sequence
  chemically treated genomic DNA (Homo sapiens) CpG-island No: 25282
atctacccgatattcaccgtctattattaaacgcttcgatattaatactaaaaacgctaatcatctacgacaactaattcatcgccttaatattacgctccaccacctactacccgtcttcgaccaattatcgaacatcgctaacctaattaaaaacctatacgacgttacgaacgatttcctaaacgacgacccccaattcgttaataacgaccgctacgctattaatacgattaacctactcgtcgaaattaaccatcgaaaaattaaaaacgctaaccacccgcaaaaccacttcattaacgtactcgataaccgaaaatacctcgcgaatcgaaatataaatccgctccacgaaacgattaaacgcgataccgaacacgccgaattcgtcgtaattctaaataatcaaacgacgaatcaaatcgccctcgccgtcgacgatatcttccataacgcgaatcataatatacaataactacaaaaaaatacgaatcaacatacccaacaaaacgataataataaccaccgcgataatcgtaacaataatcgccgaaatacgaaattcactaaacataacgaaaaatttatctttatccaccgacaa

SEQ ID NO: 25283 - DNA, 607 bp, Artificial Sequence
  chemically treated genomic DNA (Homo sapiens) CpG-island No: 25283
atttgttcgatgtttatcgtttgttgttaagcgtttcgatattggtattggaggcgttgattatttgcgataattggtttatcgttttgatattgcgttttattatttgttgttcgttttcggttagttgtcgggtatcgttggtttggttggaggtttgtgcggcgttgcgggcgattttttgggcggcggtttttagttcgttgatggcggtcgttacgttgttggtgcggttggtttgttcgtcggaattaattatcgaggagttggaggcgttgattattcgtagggttattttattgacgtgttcggtggtcgaggatatttcgcgaatcgaggtgtgaattcgttttacgaagcgattgaacgcggtatcgagtacgtcgaattcgtcgtggttttggatggttaggcggcgggttaggtcgttttcgtcgtcggcgatgttttttatggcgcgggttatgatgtgtaatggttgtaggaggatgcggattagtatgtttagtagggcgatgatgatgattatcgcgatgatcgtggtaatgatcgtcgaggtgcggaatttattgagtatggcgaaggatttgtttttatttatcgatag

SEQ ID NO: 25284 - DNA, 607 bp, Artificial Sequence
  chemically treated genomic DNA (Homo sapiens) CpG-island No: 25284
ctatcgataaataaaaacaaatccttcgccatactcaataaattccgcacctcgacgatcattaccacgatcatcgcgataatcatcatcatcgccctactaaacatactaatccgcatcctcctacaaccattacacatcataacccgcgccataaaaaacatcgccgacgacgaaaacgacctaacccgccgcctaaccatccaaaaccacgacgaattcgacgtactcgataccgcgttcaatcgcttcgtaaaacgaattcacacctcgattcgcgaaatatcctcgaccaccgaacacgtcaataaaataaccctacgaataatcaacgcctccaactcctcgataattaattccgacgaacaaaccaaccgcaccaacaacgtaacgaccgccatcaacgaactaaaaaccgccgcccaaaaaatcgcccgcaacgccgcacaaacctccaaccaaaccaacgatacccgacaactaaccgaaaacgaacaacaaataataaaacgcaatatcaaaacgataaaccaattatcgcaaataatcaacgcctccaataccaatatcgaaacgcttaacaacaaacgataaacatcgaacaaat

SEQ ID NO: 25285 - DNA, 617 bp, Artificial Sequence
  chemically treated genomic DNA (Homo sapiens) CpG-island No: 25285
ttggattcggggcgcggtgtaggcggggtggagtgagggtgggtcggggattttagcgtcgtaggagggattgcgttatacggggtcgatttgtagtagtaggaggtcgtggtcgatggtgtcgggttggttgttcgggtggggtattgcgcggagtacgtcgtataggcgtttggagggtttcggttgcgatagggagtgcgcgtttaggagaatttgtattttttcgtcggttttggggatcggacggagttcgcggtcggtgttagtcgattttttttatcgtattcgggtttttttttcgcgcggcgcgggtatttacgcgttttttaggtagtgcgtcgcgtttagtatttattgtttcgttattaggacgtcgtcgtataggtgcgcgtcgtttagttgtatcgacgttatgtagggtcgcgcgtgcgtttcggtttttttgtcgtttaggattcgattacggggcggcgtcgttgtgggtgggcgggcgcgtgagggtcgcggggtggatttttttttcgggcgaggttgtttgacgggattttagtttttattttttaggtcgtttttcgtaagaattttatttttgggcgcggtggtttacgtttgta

SEQ ID NO: 25286 - DNA, 617 bp, Artificial Sequence
  chemically treated genomic DNA (Homo sapiens) CpG-island No: 25286
tacaaacgtaaaccaccgcgcccaaaaataaaattcttacgaaaaacgacctaaaaaataaaaactaaaatcccgtcaaacaacctcgcccgaaaaaaaaatccaccccgcgaccctcacgcgcccgcccacccacaacgacgccgccccgtaatcgaatcctaaacgacaaaaaaaccgaaacgcacgcgcgaccctacataacgtcgatacaactaaacgacgcgcacctatacgacgacgtcctaataacgaaacaataaatactaaacgcgacgcactacctaaaaaacgcgtaaatacccgcgccgcgcgaaaaaaaaacccgaatacgataaaaaaaatcgactaacaccgaccgcgaactccgtccgatccccaaaaccgacgaaaaaatacaaattctcctaaacgcgcactccctatcgcaaccgaaaccctccaaacgcctatacgacgtactccgcgcaataccccacccgaacaaccaacccgacaccatcgaccacgacctcctactactacaaatcgaccccgtataacgcaatccctcctacgacgctaaaatccccgacccaccctcactccaccccgcctacaccgcgccccgaatccaa

SEQ ID NO: 25287 - DNA, 617 bp, Artificial Sequence
  chemically treated genomic DNA (Homo sapiens) CpG-island No: 25287
tataggcgtgagttatcgcgtttagagatgggatttttgcggggagcggtttggggggtgagagttgggatttcgttaggtagtttcgttcgggggaggagtttatttcgcggtttttacgcgttcgtttatttatagcggcgtcgtttcgtggtcggattttgggcggtagagaggtcgaggcgtacgcgcggttttatatggcgtcggtgtagttgaacggcgcgtatttgtgcggcggcgttttggtggcggagtagtgggtgttgagcgcggcgtattgtttggaggacgcgtgagtgttcgcgtcgcgcgggggaagagttcgggtgcggtggggggagtcggttggtatcgatcgcggatttcgttcggtttttagggtcgacgggaaggtgtaggtttttttgggcgcgtattttttgtcgtagtcggagttttttaagcgtttgtacgacgtgtttcgcgtagtgttttattcggatagttagttcgatattatcgattacgattttttgttgttataggtcggtttcgtgtagcgtagttttttttgcggcgttgggattttcggtttatttttattttatttcgtttatatcgcgtttcgggtttag

SEQ ID NO: 25288 - DNA, 617 bp, Artificial Sequence
  chemically treated genomic DNA (Homo sapiens) CpG-island No: 25288
ctaaacccgaaacgcgatataaacgaaataaaataaaaataaaccgaaaatcccaacgccgcaaaaaaaactacgctacacgaaaccgacctataacaacaaaaaatcgtaatcgataatatcgaactaactatccgaataaaacactacgcgaaacacgtcgtacaaacgcttaaaaaactccgactacgacaaaaaatacgcgcccaaaaaaacctacaccttcccgtcgaccctaaaaaccgaacgaaatccgcgatcgataccaaccgactccccccaccgcacccgaactcttcccccgcgcgacgcgaacactcacgcgtcctccaaacaatacgccgcgctcaacacccactactccgccaccaaaacgccgccgcacaaatacgcgccgttcaactacaccgacgccatataaaaccgcgcgtacgcctcgacctctctaccgcccaaaatccgaccacgaaacgacgccgctataaataaacgaacgcgtaaaaaccgcgaaataaactcctcccccgaacgaaactacctaacgaaatcccaactctcaccccccaaaccgctccccgcaaaaatcccatctctaaacgcgataactcacgcctata

SEQ ID NO: 25289 - DNA, 1123 bp, Artificial Sequence
  chemically treated genomic DNA (Homo sapiens) CpG-island No: 25289
gtaggacgggttcgtcggttttatacgtcgtataagtgggtggagaatattttatacgtttagattaataggcggggtgaacgaggatcgtgtttattaatttagttcggttcgcggaatgttttttgttcgttttcgggtttgtagtggtttttcgtcgtaggttaggtcgcgttttattttcgtcggtagtttagatacgttttttcgggtttaattttcgttttttatatatttggtttcgtttcgtcgggagttcggcggttttttttgcgttaggtttttttagcgttcgacggggttacgtttattttcgacgttttgaggttatttatagggtcgattttcggtgggcggagggacggagggaagatggttgtagagatcggatattggcgttgttttttcgaatttcggatttgcgttgaggaggcggtttatttgtggttagcggtgtttcgggattcgcgttgggggaattttggcgacggggtttggttttgttatatgcgggggtttcggttggagtgagcggcgtggacgtttttttttttcggttttttttttgttgttgcgagagcgagagggtcgcgggcggcggaggtagcggggtcgggatggaggacgttaattttaacgtgaacgcggattaggaggtgcggaagttgtaggtgtcggtgaagaagttggggaagtagtacgaatagtcgaggagtcgttcgcgttgtgttgggtttcggttttatcgcggttcgtcggtttttttatttttttttacggcgcggggttttttcggggtttttttttgggttttagcgtaaagtcgggcggcggggtcggatggattcgaggcggacgaataacgaggagttgcgagacgttatttttttgttggcggcgggggagggcggtttgttagacgatttggagcgtttgttaggttaggaggagggggaggagagttggtgagcgtcgggcgtcgggcggggttgggcggggacgtttcggtggcggaggacgtttcggaggatttttttggtcgggcgtttggttttgtgtagttagttaggttcgttttcggcgggtattcgtggttttgttttggtagaggggaggttagttg

SEQ ID NO: 25290 - DNA, 1123 bp, Artificial Sequence
  chemically treated genomic DNA (Homo sapiens) CpG-island No: 25290
caactaacctcccctctaccaaaacaaaaccacgaatacccgccgaaaacgaacctaactaactacacaaaaccaaacgcccgaccaaaaaaatcctccgaaacgtcctccgccaccgaaacgtccccgcccaaccccgcccgacgcccgacgctcaccaactctcctccccctcctcctaacctaacaaacgctccaaatcgtctaacaaaccgccctcccccgccgccaacaaaaaaataacgtctcgcaactcctcgttattcgtccgcctcgaatccatccgaccccgccgcccgactttacgctaaaacccaaaaaaaaaccccgaaaaaaccccgcgccgtaaaaaaaaataaaaaaaccgacgaaccgcgataaaaccgaaacccaacacaacgcgaacgactcctcgactattcgtactacttccccaacttcttcaccgacacctacaacttccgcacctcctaatccgcgttcacgttaaaattaacgtcctccatcccgaccccgctacctccgccgcccgcgaccctctcgctctcgcaacaacaaaaaaaaaaccgaaaaaaaaaaacgtccacgccgctcactccaaccgaaacccccgcatataacaaaaccaaaccccgtcgccaaaattcccccaacgcgaatcccgaaacaccgctaaccacaaataaaccgcctcctcaacgcaaatccgaaattcgaaaaaacaacgccaatatccgatctctacaaccatcttccctccgtccctccgcccaccgaaaatcgaccctataaataacctcaaaacgtcgaaaataaacgtaaccccgtcgaacgctaaaaaaacctaacgcaaaaaaaaccgccgaactcccgacgaaacgaaaccaaatatataaaaaacgaaaattaaacccgaaaaaacgtatctaaactaccgacgaaaataaaacgcgacctaacctacgacgaaaaaccactacaaacccgaaaacgaacaaaaaacattccgcgaaccgaactaaattaataaacacgatcctcgttcaccccgcctattaatctaaacgtataaaatattctccacccacttatacgacgtataaaaccgacgaacccgtcctac

SEQ ID NO: 25291 - DNA, 1123 bp, Artificial Sequence
  chemically treated genomic DNA (Homo sapiens) CpG-island No: 25291
taattgattttttttttgttagagtaagattacgagtattcgtcgagagcggatttggttggttatataaagttaggcgttcgattagagggatttttcgggacgtttttcgttatcggggcgttttcgtttagtttcgttcggcgttcggcgtttattagtttttttttttttttttttagtttgatagacgttttaggtcgtttagtaagtcgttttttttcgtcgttagtaagaaggtggcgtttcgtagtttttcgttattcgttcgtttcgggtttattcggtttcgtcgttcgattttgcgttgagatttaaggggaagtttcgaggggatttcgcgtcgtaggagggagtggaggagtcggcgaatcgcgatggagtcggggtttagtatagcgcgagcggtttttcggttgttcgtgttgtttttttagtttttttatcggtatttgtagttttcgtattttttggttcgcgtttacgttagagttaacgttttttatttcggtttcgttgttttcgtcgttcgcggttttttcgttttcgtagtaataagggaagagtcggaggaaagaggcgtttacgtcgtttattttagtcgaggttttcgtatatagtagggttaggtttcgtcgttagggtttttttagcgcgggtttcgaagtatcgttggttatagatgaatcgtttttttagcgtaggttcgggattcggggaggtagcgttaatattcggtttttgtagttatttttttttcgttttttcgtttatcgagggtcggttttgtaggtgattttagagcgtcggggatgggcgtggtttcgtcgggcgttaagaagatttagcgtagagaggatcgtcgagttttcgacggggcggggttaggtgtgtgaggggcggggattggattcggaggggcgtgtttggattgtcggcggaagtggaacgcggtttgatttgcgacggaaagttattgtaagttcggaggcgaatagaaggtatttcgcgagtcgggttgagttggtgaatacggttttcgtttatttcgtttattggtttgggcgtgtggggtattttttatttatttatacggcgtgtgggatcgacgggttcgttttgt

SEQ ID NO: 25292 - DNA, 1123 bp, Artificial Sequence
  chemically treated genomic DNA (Homo sapiens) CpG-island No: 25292
acaaaacgaacccgtcgatcccacacgccgtataaataaataaaaaataccccacacgcccaaaccaataaacgaaataaacgaaaaccgtattcaccaactcaacccgactcgcgaaataccttctattcgcctccgaacttacaataactttccgtcgcaaatcaaaccgcgttccacttccgccgacaatccaaacacgcccctccgaatccaatccccgcccctcacacacctaaccccgccccgtcgaaaactcgacgatcctctctacgctaaatcttcttaacgcccgacgaaaccacgcccatccccgacgctctaaaatcacctacaaaaccgaccctcgataaacgaaaaaacgaaaaaaaaataactacaaaaaccgaatattaacgctacctccccgaatcccgaacctacgctaaaaaaacgattcatctataaccaacgatacttcgaaacccgcgctaaaaaaaccctaacgacgaaacctaaccctactatatacgaaaacctcgactaaaataaacgacgtaaacgcctctttcctccgactcttcccttattactacgaaaacgaaaaaaccgcgaacgacgaaaacaacgaaaccgaaataaaaaacgttaactctaacgtaaacgcgaaccaaaaaatacgaaaactacaaataccgataaaaaaactaaaaaaacaacacgaacaaccgaaaaaccgctcgcgctatactaaaccccgactccatcgcgattcgccgactcctccactccctcctacgacgcgaaatcccctcgaaacttccccttaaatctcaacgcaaaatcgaacgacgaaaccgaataaacccgaaacgaacgaataacgaaaaactacgaaacgccaccttcttactaacgacgaaaaaaaacgacttactaaacgacctaaaacgtctatcaaactaaaaaaaaaaaaaaaaaaactaataaacgccgaacgccgaacgaaactaaacgaaaacgccccgataacgaaaaacgtcccgaaaaatccctctaatcgaacgcctaactttatataaccaaccaaatccgctctcgacgaatactcgtaatcttactctaacaaaaaaaaaatcaatta

SEQ ID NO: 25293 - DNA, 726 bp, Artificial Sequence
  chemically treated genomic DNA (Homo sapiens) CpG-island No: 25293
ttttttcgttatagtgttaagagcgtttagattacgattaggggggcgtgcgcgcgtcgggaggggaaacgtgcgcgcgtcggggggtgggggggcgtttagtttagcgttagtacggattatgtatagattagtaatcgttggtcgttaggttttcggagggtttgttcgtcgcggttttcgttacgggcggtttcgtattttttggtttagtacgcgggattggcgtagtcgtttttcggtatttatcgttcgtagacgttgttttagtttttttcgtaggtttcgtttggcgttgtttatcgttgtcgtcgttattttacgtttaagtcgagtttagtttcgttttcggcgttttgggcgttttcgggttcggttttcgtttttggtcgtttttaggtggattcgcggtttaggggcgggtcggggttcggggaagcgtttttatttcgttttcgggacgcgggttcgcggcgcgtcgcgcgtttatttcgtttttggtttttgggatttagttttcgtgcggttttcgtggttcggttcgtttttttcggttaggggagcggtggcgaggcgtcgtcgttgttttgtcgtttgatttttttgagtttgggtttttatcgggatcgcggaggcggtagcgttattggcggggatggtaaagatggtcggtagtatttacggtgtttggtattttttgtattgtttagtagtgggattttaggg

SEQ ID NO: 25294 - DNA, 726 bp, Artificial Sequence
  chemically treated genomic DNA (Homo sapiens) CpG-island No: 25294
ccctaaaatcccactactaaacaatacaaaaaataccaaacaccgtaaatactaccgaccatctttaccatccccgccaataacgctaccgcctccgcgatcccgataaaaacccaaactcaaaaaaatcaaacgacaaaacaacgacgacgcctcgccaccgctcccctaaccgaaaaaaacgaaccgaaccacgaaaaccgcacgaaaactaaatcccaaaaaccaaaaacgaaataaacgcgcgacgcgccgcgaacccgcgtcccgaaaacgaaataaaaacgcttccccgaaccccgacccgcccctaaaccgcgaatccacctaaaaacgaccaaaaacgaaaaccgaacccgaaaacgcccaaaacgccgaaaacgaaactaaactcgacttaaacgtaaaataacgacgacaacgataaacaacgccaaacgaaacctacgaaaaaaactaaaacaacgtctacgaacgataaataccgaaaaacgactacgccaatcccgcgtactaaaccaaaaaatacgaaaccgcccgtaacgaaaaccgcgacgaacaaaccctccgaaaacctaacgaccaacgattactaatctatacataatccgtactaacgctaaactaaacgcccccccaccccccgacgcgcgcacgtttcccctcccgacgcgcgcacgcccccctaatcgtaatctaaacgctcttaacactataacgaaaaaa

SEQ ID NO: 25295 - DNA, 726 bp, Artificial Sequence
  chemically treated genomic DNA (Homo sapiens) CpG-island No: 25295
ttttgaagttttattattgaatagtataagagatgttaggtatcgtgggtattgtcggttatttttattattttcgttagtggcgttgtcgttttcgcggtttcggtgagggtttaggtttagggaggttaggcggtagggtagcgacggcgtttcgttatcgtttttttaatcggggagggcgagtcggattacggggatcgtacgagggttgggttttaagggttagaggcgaggtaagcgcgcggcgcgtcgcgggttcgcgtttcggaagcggggtgggggcgttttttcgagtttcgattcgtttttaggtcgcggatttatttgggagcggttaggggcggagatcgaattcgagggcgtttagggcgtcgagggcgggattggattcggtttgggcgtgagatggcggcggtagcggtgagtagcgttaagcggagtttgcggggagagttgaagtagcgtttgcgggcgatgagtgtcgaggagcggttacgttagtttcgcgtattgagttagaaggtgcgaggtcgttcgtagcggaagtcgcggcggatagatttttcgaaggtttggcggttagcgattgttgatttgtgtatggttcgtgttggcgttgggttaggcgtttttttatttttcggcgcgcgtacgttttttttttcggcgcgcgtacgtttttttagtcgtggtttggacgtttttggtattatggcggggaga

SEQ ID NO: 25296 - DNA, 726 bp, Artificial Sequence
  chemically treated genomic DNA (Homo sapiens) CpG-island No: 25296
tctccccgccataataccaaaaacgtccaaaccacgactaaaaaaacgtacgcgcgccgaaaaaaaaaacgtacgcgcgccgaaaaataaaaaaacgcctaacccaacgccaacacgaaccatacacaaatcaacaatcgctaaccgccaaaccttcgaaaaatctatccgccgcgacttccgctacgaacgacctcgcaccttctaactcaatacgcgaaactaacgtaaccgctcctcgacactcatcgcccgcaaacgctacttcaactctccccgcaaactccgcttaacgctactcaccgctaccgccgccatctcacgcccaaaccgaatccaatcccgccctcgacgccctaaacgccctcgaattcgatctccgcccctaaccgctcccaaataaatccgcgacctaaaaacgaatcgaaactcgaaaaaacgcccccaccccgcttccgaaacgcgaacccgcgacgcgccgcgcgcttacctcgcctctaacccttaaaacccaaccctcgtacgatccccgtaatccgactcgccctccccgattaaaaaaacgataacgaaacgccgtcgctaccctaccgcctaacctccctaaacctaaaccctcaccgaaaccgcgaaaacgacaacgccactaacgaaaataataaaaataaccgacaatacccacgatacctaacatctcttatactattcaataataaaacttcaaaa

SEQ ID NO: 25297 - DNA, 525 bp, Artificial Sequence
  chemically treated genomic DNA (Homo sapiens) CpG-island No: 25297
  misc_feature (36)..(36): n is either a, c, g or t
  misc_feature (194)..(194): n is either a, c, g or t
  misc_feature (212)..(212): n is either a, c, g or t
  misc_feature (287)..(287): n is either a, c, g or t
  misc_feature (340)..(340): n is either a, c, g or t
  misc_feature (368)..(368): n is either a, c, g or t
tgcgtcgtagaagtatttgggacgtgtagtttcggngtcgcgcgggttcggcgcgcgttggggagaagttggtagaagtcgttcgttaatatttcgtgcggaattcggtattaggatttttttcgacgtcggtttttagttcgcggcgtcgtagtcgtcgtcgtcgtcgcgaagttaaatggggttgggacggnggttgtttcgtttttttngtttttttcgggcgcgtagagcgttgcgttggttttcgtttaaaggcggaggtcgcgcgtcgttatttgtatcgntcggtaagtgtacggcgcgtttaggcgttcgtaaggttgcgcgcgggaatcgngtttttggtttgagttggaggcgtcggnggcgttaaaagattttttgtgggggtagtttcgggtcgttcggattcgcgggggttcgggaatcgcgggatttggttggaacggtttttcgtttcgttttttggaattattttttgtttttgggcgggtttttaggcgtttttgtaaaaaaatcgga

SEQ ID NO: 25298 - DNA, 525 bp, Artificial Sequence
  chemically treated genomic DNA (Homo sapiens) CpG-island No: 25298
  misc_feature (158)..(158): n is either a, c, g or t
  misc_feature (186)..(186): n is either a, c, g or t
  misc_feature (239)..(239): n is either a, c, g or t
  misc_feature (314)..(314): n is either a, c, g or t
  misc_feature (332)..(332): n is either a, c, g or t
  misc_feature (490)..(490): n is either a, c, g or t
tccgatttttttacaaaaacgcctaaaaacccgcccaaaaacaaaaaataattccaaaaaacgaaacgaaaaaccgttccaaccaaatcccgcgattcccgaacccccgcgaatccgaacgacccgaaactacccccacaaaaaatcttttaacgccnccgacgcctccaactcaaaccaaaaacncgattcccgcgcgcaaccttacgaacgcctaaacgcgccgtacacttaccgancgatacaaataacgacgcgcgacctccgcctttaaacgaaaaccaacgcaacgctctacgcgcccgaaaaaaacnaaaaaaacgaaacaaccnccgtcccaaccccatttaacttcgcgacgacgacgacgactacgacgccgcgaactaaaaaccgacgtcgaaaaaaatcctaataccgaattccgcacgaaatattaacgaacgacttctaccaacttctccccaacgcgcgccgaacccgcgcgacnccgaaactacacgtcccaaatacttctacgacgca

SEQ ID NO: 25299 - DNA, 525 bp, Artificial Sequence
  chemically treated genomic DNA (Homo sapiens) CpG-island No: 25299
  misc_feature (158)..(158): n is either a, c, g or t
  misc_feature (186)..(186): n is either a, c, g or t
  misc_feature (239)..(239): n is either a, c, g or t
  misc_feature (314)..(314): n is either a, c, g or t
  misc_feature (332)..(332): n is either a, c, g or t
  misc_feature (490)..(490): n is either a, c, g or t
ttcggtttttttgtaaaaacgtttgggggttcgtttaagggtaagaaatggttttaagaaacggggcgaaggatcgttttaattaagtttcgcggttttcgggttttcgcgggttcgaacggttcggggttgtttttatagggggttttttggcgttntcggcgtttttagtttaaattaagggtncggttttcgcgcgtagttttacgggcgtttgggcgcgtcgtgtatttgtcggncggtgtaggtggcggcgcgcggttttcgtttttgggcgggggttagcgtagcgttttgcgcgttcgaagggggtnggaaaggcggggtagttntcgttttagttttatttaatttcgcggcggcggcggcgattgcggcgtcgcgggttggaggtcggcgtcggggaaggttttggtgtcggatttcgtacgaggtgttgacgggcggtttttgttaatttttttttagcgcgcgtcgagttcgcgcggtntcggggttgtacgttttagatatttttgcggcgta

SEQ ID NO: 25300 - DNA, 525 bp, Artificial Sequence
  chemically treated genomic DNA (Homo sapiens) CpG-island No: 25300
  misc_feature (36)..(36): n is either a, c, g or t
  misc_feature (194)..(194): n is either a, c, g or t
  misc_feature (212)..(212): n is either a, c, g or t
  misc_feature (287)..(287): n is either a, c, g or t
  misc_feature (340)..(340): n is either a, c, g or t
  misc_feature (368)..(368): n is either a, c, g or t
tacgccgcaaaaatatctaaaacgtacaaccccganaccgcgcgaactcgacgcgcgctaaaaaaaaattaacaaaaaccgcccgtcaacacctcgtacgaaatccgacaccaaaaccttccccgacgccgacctccaacccgcgacgccgcaatcgccgccgccgccgcgaaattaaataaaactaaaacganaactaccccgcctttccnacccccttcgaacgcgcaaaacgctacgctaacccccgcccaaaaacgaaaaccgcgcgccgccacctacaccgnccgacaaatacacgacgcgcccaaacgcccgtaaaactacgcgcgaaaaccgnacccttaatttaaactaaaaacgccganaacgccaaaaaaccccctataaaaacaaccccgaaccgttcgaacccgcgaaaacccgaaaaccgcgaaacttaattaaaacgatccttcgccccgtttcttaaaaccatttcttacccttaaacgaacccccaaacgtttttacaaaaaaaccgaa

SEQ ID NO: 25301 - DNA, 758 bp, Artificial Sequence
  chemically treated genomic DNA (Homo sapiens) CpG-island No: 25301
gcgcgcgtttaggtgcggggttttggggtttaggcgtagtagtcgggttcgtagttgttggcgttatcgcggagggcggggtcgcggggcggtgttcggggtcggggacggttgttggagcggcgttcgtcgcggtttagcgtattttcgtttttcgttttttttttcgttgcgttttcgcgcgaagatggtaatcgaggggttgtacgagaacgagacgttggcgtcgttgaagagcgaggtcgagagttttaagggtaagttggaggaggagcgagttaagttgtacgatgtggagcgtgagtgcgggtcgggaggcgggcggggtaagtcggatcggttcgttatttttcgggcggggacggcgggggcggtgggggcggtcgtggtagcgacgggagttaggttcgcgttatcgttcgggagtagggttttggggttcgggcgcgtaggtgaggcgcgggtagcggtttcgattttcggaacgcgcggcggtggggttttcggagggttcgggtatttggtcgattttcgtcgttagttagcggaggatcgcgggattagttatttttattatttgtttggaagttgcgaacggatcgcgtttttgttttttttatgcggagggtagggggtggggtgtcggtggtgacgagcgagcgcggcgagttcgtgtaggcgcggtttaggagagatttttgttttgttttttaatgttcgtttggttttttttattattgttgtatttttttttagtt

SEQ ID NO: 25302 - DNA, 758 bp, Artificial Sequence
  chemically treated genomic DNA (Homo sapiens) CpG-island No: 25302
aactaaaaaaaaatacaacaataataaaaaaaaccaaacgaacattaaaaaacaaaacaaaaatctctcctaaaccgcgcctacacgaactcgccgcgctcgctcgtcaccaccgacaccccaccccctaccctccgcataaaaaaaacaaaaacgcgatccgttcgcaacttccaaacaaataataaaaataactaatcccgcgatcctccgctaactaacgacgaaaatcgaccaaatacccgaaccctccgaaaaccccaccgccgcgcgttccgaaaatcgaaaccgctacccgcgcctcacctacgcgcccgaaccccaaaaccctactcccgaacgataacgcgaacctaactcccgtcgctaccacgaccgcccccaccgcccccgccgtccccgcccgaaaaataacgaaccgatccgacttaccccgcccgcctcccgacccgcactcacgctccacatcgtacaacttaactcgctcctcctccaacttacccttaaaactctcgacctcgctcttcaacgacgccaacgtctcgttctcgtacaacccctcgattaccatcttcgcgcgaaaacgcaacgaaaaaaaaaacgaaaaacgaaaatacgctaaaccgcgacgaacgccgctccaacaaccgtccccgaccccgaacaccgccccgcgaccccgccctccgcgataacgccaacaactacgaacccgactactacgcctaaaccccaaaaccccgcacctaaacgcgcgc

SEQ ID NO: 25303 - DNA, 758 bp, Artificial Sequence
  chemically treated genomic DNA (Homo sapiens) CpG-island No: 25303
aattgagaaaagatataatagtgatggagaaagttagacgggtattaaaaaataaaataggagttttttttaggtcgcgtttatacgggttcgtcgcgttcgttcgttattatcgatattttattttttgtttttcgtatgggaggggtaagaacgcgattcgttcgtagtttttaggtaggtgatgaggatagttagtttcgcggtttttcgttagttggcggcgggggtcggttaggtgttcggatttttcgagggttttatcgtcgcgcgtttcggggatcgggatcgttattcgcgttttatttgcgcgttcgggttttagggttttgttttcgggcggtggcgcgggtttggttttcgtcgttgttacgatcgtttttatcgttttcgtcgttttcgttcgggaagtggcgagtcggttcggtttgtttcgttcgtttttcggttcgtatttacgttttatatcgtgtagtttggttcgttttttttttagtttgtttttgaggttttcggtttcgttttttagcgacgttagcgtttcgttttcgtgtagtttttcggttgttattttcgcgcggggacgtagcggagagggaagcggagagcgggaatgcgttgagtcgcggcgggcgtcgttttagtagtcgttttcggtttcgagtatcgtttcgcggtttcgtttttcgcgatgacgttagtagttgcgggttcggttgttgcgtttgagttttaagatttcgtatttgggcgcgcgt

SEQ ID NO: 25304 - DNA, 758 bp, Artificial Sequence
  chemically treated genomic DNA (Homo sapiens) CpG-island No: 25304
acgcgcgcccaaatacgaaatcttaaaactcaaacgcaacaaccgaacccgcaactactaacgtcatcgcgaaaaacgaaaccgcgaaacgatactcgaaaccgaaaacgactactaaaacgacgcccgccgcgactcaacgcattcccgctctccgcttccctctccgctacgtccccgcgcgaaaataacaaccgaaaaactacacgaaaacgaaacgctaacgtcgctaaaaaacgaaaccgaaaacctcaaaaacaaactaaaaaaaaaacgaaccaaactacacgatataaaacgtaaatacgaaccgaaaaacgaacgaaacaaaccgaaccgactcgccacttcccgaacgaaaacgacgaaaacgataaaaacgatcgtaacaacgacgaaaaccaaacccgcgccaccgcccgaaaacaaaaccctaaaacccgaacgcgcaaataaaacgcgaataacgatcccgatccccgaaacgcgcgacgataaaaccctcgaaaaatccgaacacctaaccgacccccgccgccaactaacgaaaaaccgcgaaactaactatcctcatcacctacctaaaaactacgaacgaatcgcgttcttacccctcccatacgaaaaacaaaaaataaaatatcgataataacgaacgaacgcgacgaacccgtataaacgcgacctaaaaaaaactcctattttattttttaatacccgtctaactttctccatcactattatatcttttctcaatt

SEQ ID NO: 25305 - DNA, 559 bp, Artificial Sequence
  chemically treated genomic DNA (Homo sapiens) CpG-island No: 25305
atcggcgttggtcgcgcgttaggttagtcgcgaggttatcgttcgattttttattttttttcgtagttttcggcgcggggttcggcgagaaggggaggggaggggagcggagaatcgggttttcgggacgcgtgtggtatttgaagtattattagcgagcgagagttagagagaaggaaagttatcgattttatcgttttcgagttgtttcgggtcgcgggtttgtagcgttttcggtttttcgcgtttatagtttaagttatattcgaaggggagggagtcgggagttgcgcgcggggtcgtcggggggaggggtggtatttttacgtcgggcggttacgaagggcggggtagcgggcgcgcgttcggcggggggaggggtcgcgcgtcgcgttcgttgggaattggggttttagggggagggcggaggcgtcgacgatcgcggtatttatcgttcgcggcgtggcgttcggtggtttttaaggggagggaagggggaggcggggcgaggatagtgatcggagtttttttagcggtggtttttttgtttggtagtttt

SEQ ID NO: 25306 - DNA, 559 bp, Artificial Sequence
  chemically treated genomic DNA (Homo sapiens) CpG-island No: 25306
aaaactaccaaacaaaaaaaccaccgctaaaaaaactccgatcactatcctcgccccgcctcccccttccctccccttaaaaaccaccgaacgccacgccgcgaacgataaataccgcgatcgtcgacgcctccgccctccccctaaaaccccaattcccaacgaacgcgacgcgcgacccctccccccgccgaacgcgcgcccgctaccccgcccttcgtaaccgcccgacgtaaaaataccacccctccccccgacgaccccgcgcgcaactcccgactccctccccttcgaatataacttaaactataaacgcgaaaaaccgaaaacgctacaaacccgcgacccgaaacaactcgaaaacgataaaatcgataactttccttctctctaactctcgctcgctaataatacttcaaataccacacgcgtcccgaaaacccgattctccgctcccctcccctccccttctcgccgaaccccgcgccgaaaactacgaaaaaaaataaaaaatcgaacgataacctcgcgactaacctaacgcgcgaccaacgccgat

SEQ ID NO: 25307 - DNA, 559 bp, Artificial Sequence
  chemically treated genomic DNA (Homo sapiens) CpG-island No: 25307
gaggttgttaagtagaaaagttatcgttgaggagatttcggttattgttttcgtttcgttttttttttttttttttttggggattatcgggcgttacgtcgcgaacggtaagtgtcgcggtcgtcggcgttttcgttttttttttagggttttaatttttagcgggcgcggcgcgcggttttttttttcgtcgggcgcgcgttcgttgtttcgtttttcgtggtcgttcggcgtgggggtgttattttttttttcggcggtttcgcgcgtagttttcggttttttttttttcggatgtggtttgagttgtaggcgcggagggtcggagacgttgtagattcgcgattcggagtagttcggaggcggtgaagtcggtggttttttttttttttagttttcgttcgttggtggtgttttagatgttatacgcgtttcgggggttcggtttttcgttttttttttttttttttttcgtcggatttcgcgtcgggagttgcgggaaggagtggagggtcgggcggtggtttcgcggttggtttggcgcgcggttagcgtcggt

SEQ ID NO: 25308 - DNA, 559 bp, Artificial Sequence
  chemically treated genomic DNA (Homo sapiens) CpG-island No: 25308
accgacgctaaccgcgcgccaaaccaaccgcgaaaccaccgcccgaccctccactccttcccgcaactcccgacgcgaaatccgacgaaaaaaaaaaaaaaaaaaaacgaaaaaccgaacccccgaaacgcgtataacatctaaaacaccaccaacgaacgaaaactaaaaaaaaaaaaaaccaccgacttcaccgcctccgaactactccgaatcgcgaatctacaacgtctccgaccctccgcgcctacaactcaaaccacatccgaaaaaaaaaaaaccgaaaactacgcgcgaaaccgccgaaaaaaaaaataacacccccacgccgaacgaccacgaaaaacgaaacaacgaacgcgcgcccgacgaaaaaaaaaaccgcgcgccgcgcccgctaaaaattaaaaccctaaaaaaaaaacgaaaacgccgacgaccgcgacacttaccgttcgcgacgtaacgcccgataatccccaaaaaaaaaaaaaaaaaaaacgaaacgaaaacaataaccgaaatctcctcaacgataacttttctacttaacaacctc

SEQ ID NO: 25309 - DNA, 673 bp, Artificial Sequence
  chemically treated genomic DNA (Homo sapiens) CpG-island No: 25309
tcgtcggcgttaattttaaattgcgcgatcgttttttatttgttttgcgttaaggtagggggcgggattttattttaagaggtagtaattagtaggattttagtttttcgtaatttattgagcgtatttacggaagtaacgtcgggtattgtttttggtcgtaagggtgggaggagtacgtatttggcgtaaggtggggcgtagagttttttcgttattggcggcggatagggcgtttacgcgacggtttgacgtagcggaagacgcgttagtgggggggaaggttttagaaaagcggcggtagcggttttagcggtagtagtagtagcgtcgggtttcgtgcggaggtgtttttcgtagagttgtttttcgagtagcggtagtttttattatagcgttaggacgagttcggttcgtgttcgttcgcggagattttttttatttcgttcggttgcgggaaatcgggttgaagcgattgagttcgcgatggaggtaacgggtttgaaattaatgagttattgaaaagggtatggcgaggtcgttggcgttttagtggaagtcggttagtcgttttcgtgggagagaggtaggaaatcggattaatttagtagtagtggggtttaaggtttatgaacggggttttgagcggaggtttgagcgtataaatagtttt

SEQ ID NO: 25310 - DNA, 673 bp, Artificial Sequence
  chemically treated genomic DNA (Homo sapiens) CpG-island No: 25310
aaaactatttatacgctcaaacctccgctcaaaaccccgttcataaaccttaaaccccactactactaaattaatccgatttcctacctctctcccacgaaaacgactaaccgacttccactaaaacgccaacgacctcgccatacccttttcaataactcattaatttcaaacccgttacctccatcgcgaactcaatcgcttcaacccgatttcccgcaaccgaacgaaataaaaaaaatctccgcgaacgaacacgaaccgaactcgtcctaacgctataataaaaactaccgctactcgaaaaacaactctacgaaaaacacctccgcacgaaacccgacgctactactactaccgctaaaaccgctaccgccgcttttctaaaaccttcccccccactaacgcgtcttccgctacgtcaaaccgtcgcgtaaacgccctatccgccgccaataacgaaaaaactctacgccccaccttacgccaaatacgtactcctcccacccttacgaccaaaaacaatacccgacgttacttccgtaaatacgctcaataaattacgaaaaactaaaatcctactaattactacctcttaaaataaaatcccgccccctaccttaacgcaaaacaaataaaaaacgatcgcgcaatttaaaattaacgccgacga

SEQ ID NO: 25311 - DNA, 673 bp, Artificial Sequence
  chemically treated genomic DNA (Homo sapiens) CpG-island No: 25311
gaagttgtttgtacgtttaggttttcgtttaagatttcgtttataaattttaagttttattgttattgaattggttcgattttttgttttttttttacggaggcggttggtcgatttttattgaggcgttaacggtttcgttatgttttttttaataatttattgattttaaattcgttatttttatcgcggatttagtcgttttagttcgatttttcgtagtcgagcgagatgagagagattttcgcggacgaatacgaatcggattcgttttggcgttgtagtgagaattgtcgttgttcgagaaataattttgcgaggagtattttcgtacgggattcggcgttgttgttattgtcgttagagtcgttgtcgtcgtttttttagaatttttttttttattaacgcgtttttcgttacgttaggtcgtcgcgtaaacgttttattcgtcgttaatggcgggaaggttttacgttttattttacgttaaatgcgtattttttttatttttgcggttagagatagtattcgacgttattttcgtaaatgcgtttaatgaattgcggaaggttagagttttgttagttattattttttggaatagggtttcgttttttgttttggcgtaaggtaggtgagaaacggtcgcgtagtttgaaattaacgtcgacgg

SEQ ID NO: 25312 - DNA, 673 bp, Artificial Sequence
  chemically treated genomic DNA (Homo sapiens) CpG-island No: 25312
ccgtcgacgttaatttcaaactacgcgaccgtttctcacctaccttacgccaaaacaaaaaacgaaaccctattccaaaaaataataactaacaaaactctaaccttccgcaattcattaaacgcatttacgaaaataacgtcgaatactatctctaaccgcaaaaataaaaaaaatacgcatttaacgtaaaataaaacgtaaaaccttcccgccattaacgacgaataaaacgtttacgcgacgacctaacgtaacgaaaaacgcgttaataaaaaaaaaaattctaaaaaaacgacgacaacgactctaacgacaataacaacaacgccgaatcccgtacgaaaatactcctcgcaaaattatttctcgaacaacgacaattctcactacaacgccaaaacgaatccgattcgtattcgtccgcgaaaatctctctcatctcgctcgactacgaaaaatcgaactaaaacgactaaatccgcgataaaaataacgaatttaaaatcaataaattattaaaaaaaacataacgaaaccgttaacgcctcaataaaaatcgaccaaccgcctccgtaaaaaaaaaacaaaaaatcgaaccaattcaataacaataaaacttaaaatttataaacgaaatcttaaacgaaaacctaaacgtacaaacaacttc

SEQ ID NO: 25313 - DNA, 514 bp, Artificial Sequence
  chemically treated genomic DNA (Homo sapiens) CpG-island No: 25313
gattttttcgatgtttcgttggtttttgtttttattgatttttgcgggtttgttttcgttgcggcgtcggtagttgtttggtagttgcggggggcgtgagggcggtggtttagattaatcggttggtagtttagtttcgtttcgttcgtttttgtttcggattttgcgtttgaggaagtatcgaggtaattttttgttattcgaagttcgtgggtcgtttttagagggcgcgttttggagtcgagcgtttttgggcggttatttggaggttaggtgcgggtcgcgaattcgcgaggagcgcgcggcgggcgcggcggcgacggtaggaggaggggtcgggagttcgggcgtcgtcgaaggacgtttcgttttttatatgttgttatttggttgagtcgggcgtcggcgagaaggcggcgtcgttgttttggtagttggattgtattttgttttcgttcggttttagttgtcgttcgtttagacgttagtaagttttttttttacgatagggttg

SEQ ID NO: 25314 - DNA, 514 bp, Artificial Sequence
  chemically treated genomic DNA (Homo sapiens) CpG-island No: 25314
caaccctatcgtaaaaaaaaaacttactaacgtctaaacgaacgacaactaaaaccgaacgaaaacaaaatacaatccaactaccaaaacaacgacgccgccttctcgccgacgcccgactcaaccaaataacaacatataaaaaacgaaacgtccttcgacgacgcccgaactcccgacccctcctcctaccgtcgccgccgcgcccgccgcgcgctcctcgcgaattcgcgacccgcacctaacctccaaataaccgcccaaaaacgctcgactccaaaacgcgccctctaaaaacgacccacgaacttcgaataacaaaaaattacctcgatacttcctcaaacgcaaaatccgaaacaaaaacgaacgaaacgaaactaaactaccaaccgattaatctaaaccaccgccctcacgccccccgcaactaccaaacaactaccgacgccgcaacgaaaacaaacccgcaaaaatcaataaaaacaaaaaccaacgaaacatcgaaaaaatc

SEQ ID NO: 25315 - DNA, 514 bp, Artificial Sequence
  chemically treated genomic DNA (Homo sapiens) CpG-island No: 25315
tagttttgtcgtgggaggggggtttgttggcgtttgggcgggcggtagttgaggtcgggcgggggtaaagtgtagtttagttgttagggtagcggcgtcgttttttcgtcggcgttcggtttagttaagtggtagtatgtggaggacggggcgtttttcggcggcgttcgggttttcggtttttttttttgtcgtcgtcgtcgcgttcgtcgcgcgtttttcgcgggttcgcggttcgtatttggtttttagatggtcgtttaagggcgttcggttttagggcgcgttttttgggagcgatttacgaatttcgggtggtagagggttgtttcgatatttttttaggcgtagggttcgaggtaggggcgggcggagcggagttgggttgttagtcggttggtttgggttatcgtttttacgtttttcgtaattattaagtagttgtcggcgtcgtagcgggaatagattcgtaaaggttaatgaaagtagaagttagcgaggtatcgagagggtt

SEQ ID NO: 25316 - DNA, 514 bp, Artificial Sequence
  chemically treated genomic DNA (Homo sapiens) CpG-island No: 25316
aaccctctcgatacctcgctaacttctactttcattaacctttacgaatctattcccgctacgacgccgacaactacttaataattacgaaaaacgtaaaaacgataacccaaaccaaccgactaacaacccaactccgctccgcccgcccctacctcgaaccctacgcctaaaaaaatatcgaaacaaccctctaccacccgaaattcgtaaatcgctcccaaaaaacgcgccctaaaaccgaacgcccttaaacgaccatctaaaaaccaaatacgaaccgcgaacccgcgaaaaacgcgcgacgaacgcgacgacgacgacaaaaaaaaaaaccgaaaacccgaacgccgccgaaaaacgccccgtcctccacatactaccacttaactaaaccgaacgccgacgaaaaaacgacgccgctaccctaacaactaaactacactttacccccgcccgacctcaactaccgcccgcccaaacgccaacaaacccccctcccacgacaaaacta

SEQ ID NO: 25317 - DNA, 579 bp, Artificial Sequence
  chemically treated genomic DNA (Homo sapiens) CpG-island No: 25317
atttgcgtacgtttagtgagttcgagttgtgatttacgttcgggatggttaattttaatcgtcgtcgcgggcgattcgttgtttttcgtcgagttaggtttgtttgggataggggtcgttattatcgggagcgttcggtcgcgttatttggattatatagttcgattgtagtagatacgcgtttaggtttttttttaggttcgcgtacgcgtcgttttgcggtttgtttttataatatttaggtatgacggcgtttttttttcgatgcggacgcgatttttttttatcgtaatatttgtaatcgggtcgggagcgagcgaggttttagttttaggggatcggaagttagcggtaataattttcggcgggtcgcggcggtagggtcgaggattacgggggtcgagaggtggcgcgttcgcggcggaagtcggttttcgtgacgcggcggttttaagggtcggtttcgttgagggaagggaagttcgttcggtggcggttggggtcggttgttgggaggaggtggtgggttggttcggacgtgggtcgaggttgtagtaggattttaggtgaggtttgagg

SEQ ID NO: 25318 - DNA, 579 bp, Artificial Sequence
  chemically treated genomic DNA (Homo sapiens) CpG-island No: 25318
cctcaaacctcacctaaaatcctactacaacctcgacccacgtccgaaccaacccaccacctcctcccaacaaccgaccccaaccgccaccgaacgaacttcccttccctcaacgaaaccgacccttaaaaccgccgcgtcacgaaaaccgacttccgccgcgaacgcgccacctctcgacccccgtaatcctcgaccctaccgccgcgacccgccgaaaattattaccgctaacttccgatcccctaaaactaaaacctcgctcgctcccgacccgattacaaatattacgataaaaaaaaatcgcgtccgcatcgaaaaaaaaacgccgtcatacctaaatattataaaaacaaaccgcaaaacgacgcgtacgcgaacctaaaaaaaaacctaaacgcgtatctactacaatcgaactatataatccaaataacgcgaccgaacgctcccgataataacgacccctatcccaaacaaacctaactcgacgaaaaacaacgaatcgcccgcgacgacgattaaaattaaccatcccgaacgtaaatcacaactcgaactcactaaacgtacgcaaat

SEQ ID NO: 25319 - DNA, 579 bp, Artificial Sequence
  chemically treated genomic DNA (Homo sapiens) CpG-island No: 25319
ttttaggttttatttggagttttgttatagtttcgatttacgttcgaattagtttattatttttttttagtagtcgattttagtcgttatcgggcgggtttttttttttttaacggagtcggtttttggggtcgtcgcgttacgggaatcgattttcgtcgcggacgcgttatttttcggttttcgtagttttcggttttatcgtcgcggttcgtcggaagttgttgtcgttggttttcggttttttgagattggggtttcgttcgttttcgattcggttgtaagtgttgcggtgggagaaagtcgcgttcgtatcggaggggaagcgtcgttatgtttaagtattatgaggataagtcgtagggcggcgcgtgcgcgggtttgaaggaggatttgggcgcgtgtttgttgtagtcggattgtgtggtttaggtagcgcggtcgggcgttttcggtggtgacgatttttgttttaggtaggtttggttcggcggagggtagcgggtcgttcgcggcggcggttggagttaattatttcgggcgtaggttatagttcgggtttattgaacgtgcgtagat

SEQ ID NO: 25320 - DNA, 579 bp, Artificial Sequence
  chemically treated genomic DNA (Homo sapiens) CpG-island No: 25320
atctacgcacgttcaataaacccgaactataacctacgcccgaaataattaactccaaccgccgccgcgaacgacccgctaccctccgccgaaccaaacctacctaaaacaaaaatcgtcaccaccgaaaacgcccgaccgcgctacctaaaccacacaatccgactacaacaaacacgcgcccaaatcctccttcaaacccgcgcacgcgccgccctacgacttatcctcataatacttaaacataacgacgcttcccctccgatacgaacgcgactttctcccaccgcaacacttacaaccgaatcgaaaacgaacgaaaccccaatctcaaaaaaccgaaaaccaacgacaacaacttccgacgaaccgcgacgataaaaccgaaaactacgaaaaccgaaaaataacgcgtccgcgacgaaaatcgattcccgtaacgcgacgaccccaaaaaccgactccgttaaaaaaaaaaaaacccgcccgataacgactaaaatcgactactaaaaaaaaataataaactaattcgaacgtaaatcgaaactataacaaaactccaaataaaacctaaaa

SEQ ID NO: 25321 - DNA, 708 bp, Artificial Sequence
  chemically treated genomic DNA (Homo sapiens) CpG-island No: 25321
gttcgggttggtagtggggcgggggtcgtagggcgcgggtcgggtttttagcgcgtatgcgcgataagggggcggggttagggcggggttgcgttcggcgtttagagcggcggcggttggttagggttgcggcgcgcgtggagggttcgttgttggtttgtcgtcgggtcgggtttcgtgggtcggggtaggaggattagtatttgaggtcgggttcgtagttcgcgattttatagttaggcggcggcgttgttgttgttgcggggttttggcgcgtagttcggcgggatagcggggcggttggcgtcgggggtcggggagcgttaggtaggtgggtcgggtcgggtaggaggcgacgcggtcgtcgcgggggtcggggtcggggacggatagcgggcgcgggggcgcgtttaggttttcgttggggcggatgtggacggcgttcgcggtttttatggaaattgtattgtttaacggtgttagtggtttatttgcggtggcgttttttgagaataattcgagttcggtcgatttttagtttcgtgaagacgcggtcgttttagtagggagtcgggtgtcgagcgggcgcgtggtcgcgggacgtagacgcggtgtttgttcgatgcggttttagggttgggtttacgggtttttgaagttggaggttttgtcgtgtttggggtggaaatataatcgggtgaaagtaaa

SEQ ID NO: 25322 - DNA, 708 bp, Artificial Sequence
  chemically treated genomic DNA (Homo sapiens) CpG-island No: 25322
tttactttcacccgattatatttccaccccaaacacgacaaaacctccaacttcaaaaacccgtaaacccaaccctaaaaccgcatcgaacaaacaccgcgtctacgtcccgcgaccacgcgcccgctcgacacccgactccctactaaaacgaccgcgtcttcacgaaactaaaaatcgaccgaactcgaattattctcaaaaaacgccaccgcaaataaaccactaacaccgttaaacaatacaatttccataaaaaccgcgaacgccgtccacatccgccccaacgaaaacctaaacgcgcccccgcgcccgctatccgtccccgaccccgacccccgcgacgaccgcgtcgcctcctacccgacccgacccacctacctaacgctccccgacccccgacgccaaccgccccgctatcccgccgaactacgcgccaaaaccccgcaacaacaacaacgccgccgcctaactataaaatcgcgaactacgaacccgacctcaaatactaatcctcctaccccgacccacgaaacccgacccgacgacaaaccaacaacgaaccctccacgcgcgccgcaaccctaaccaaccgccgccgctctaaacgccgaacgcaaccccgccctaaccccgcccccttatcgcgcatacgcgctaaaaacccgacccgcgccctacgacccccgccccactaccaacccgaac

SEQ ID NO: 25323 - DNA, 708 bp, Artificial Sequence
  chemically treated genomic DNA (Homo sapiens) CpG-island No: 25323
tttatttttattcggttatgtttttattttaaatacggtaaggtttttagttttaggagttcgtagatttagttttggagtcgtatcgggtaggtatcgcgtttgcgtttcgcggttacgcgttcgttcggtattcggttttttgttggggcggtcgcgtttttacggggttgggggtcggtcgggttcggattgtttttaaaagacgttatcgtaggtggattattggtatcgttaggtagtgtaatttttatgaaaatcgcgggcgtcgtttatattcgttttagcggggatttggacgcgttttcgcgttcgttgttcgttttcggtttcggttttcgcggcggtcgcgtcgttttttgttcggttcggtttatttatttggcgtttttcggttttcggcgttagtcgtttcgttgtttcgtcgggttgcgcgttagagtttcgtagtagtagtagcgtcgtcgtttggttgtgaagtcgcgggttgcgggttcggttttaggtgttggtttttttgtttcggtttacggagttcgattcggcggtaaattagtagcgaattttttacgcgcgtcgtagttttagttagtcgtcgtcgttttagacgtcgggcgtagtttcgttttggtttcgtttttttgtcgcgtatgcgcgttgagggttcggttcgcgttttgcgattttcgttttattattagttcgagt

SEQ ID NO: 25324 - DNA, 708 bp, Artificial Sequence
  chemically treated genomic DNA (Homo sapiens) CpG-island No: 25324
actcgaactaataataaaacgaaaatcgcaaaacgcgaaccgaaccctcaacgcgcatacgcgacaaaaaaacgaaaccaaaacgaaactacgcccgacgtctaaaacgacgacgactaactaaaactacgacgcgcgtaaaaaattcgctactaatttaccgccgaatcgaactccgtaaaccgaaacaaaaaaaccaacacctaaaaccgaacccgcaacccgcgacttcacaaccaaacgacgacgctactactactacgaaactctaacgcgcaacccgacgaaacaacgaaacgactaacgccgaaaaccgaaaaacgccaaataaataaaccgaaccgaacaaaaaacgacgcgaccgccgcgaaaaccgaaaccgaaaacgaacaacgaacgcgaaaacgcgtccaaatccccgctaaaacgaatataaacgacgcccgcgattttcataaaaattacactacctaacgataccaataatccacctacgataacgtcttttaaaaacaatccgaacccgaccgacccccaaccccgtaaaaacgcgaccgccccaacaaaaaaccgaataccgaacgaacgcgtaaccgcgaaacgcaaacgcgatacctacccgatacgactccaaaactaaatctacgaactcctaaaactaaaaaccttaccgtatttaaaataaaaacataaccgaataaaaataaa

SEQ ID NO: 25325 - DNA, 690 bp, Artificial Sequence
  chemically treated genomic DNA (Homo sapiens) CpG-island No: 25325
tttagcgcgatttttggagttattgcgtttgtaagtttagtttttttgcgtcgtacgtgcggggttagttggcgtcgataaatacggggcgggatacggggcgggatacgggtcggttcgggggagggtttgagtcgtatagttcgtttagggtggtgcgtgtaaacgggcgtttggattttcgaatggttgcgtgttttcgtgtgtgggttcgggggaggtttacgaacgttagcgaaatcgttgatattatcgtttaattatgaatttattaggcgtttgaagatcgatacgtcgaatatgcgtcgcgtagcgtcgcgacgagtgagattatcgcgtttcggtcgtgagtgcgtttatacgtagtttgagattcgacgggagggggttacgtggaagtatttgagagaggcgtatttggttattaggaaagtatttttttttttttaaaaatgtttcggaagtgttttcgtttttcgtaaagatggtcggggtagtcggtacgagggaggcggggatgcgttgcgtaataagttcggcggggaagatggcggatgataaggtgagtggtcgtgggggtgatttgtagtcgggcgtggtttttattttttttgatttttttagtttcggggagaagcgattttggagcggtttaggagtgaggatgttttttgttttttttgcggtttt

SEQ ID NO: 25326 - DNA, 690 bp, Artificial Sequence
  chemically treated genomic DNA (Homo sapiens) CpG-island No: 25326
aaaaccgcaaaaaaaacaaaaaacatcctcactcctaaaccgctccaaaatcgcttctccccgaaactaaaaaaatcaaaaaaaataaaaaccacgcccgactacaaatcacccccacgaccactcaccttatcatccgccatcttccccgccgaacttattacgcaacgcatccccgcctccctcgtaccgactaccccgaccatctttacgaaaaacgaaaacacttccgaaacatttttaaaaaaaaaaaaatactttcctaataaccaaatacgcctctctcaaatacttccacgtaaccccctcccgtcgaatctcaaactacgtataaacgcactcacgaccgaaacgcgataatctcactcgtcgcgacgctacgcgacgcatattcgacgtatcgatcttcaaacgcctaataaattcataattaaacgataatatcaacgatttcgctaacgttcgtaaacctcccccgaacccacacacgaaaacacgcaaccattcgaaaatccaaacgcccgtttacacgcaccaccctaaacgaactatacgactcaaaccctcccccgaaccgacccgtatcccgccccgtatcccgccccgtatttatcgacgccaactaaccccgcacgtacgacgcaaaaaaactaaacttacaaacgcaataactccaaaaatcgcgctaaa

SEQ ID NO: 25327 - DNA, 690 bp, Artificial Sequence
  chemically treated genomic DNA (Homo sapiens) CpG-island No: 25327
ggagtcgtagaagaaataagggatatttttatttttgagtcgttttagagtcgttttttttcggaattaaaaaggttaaggagagtgaagattacgttcggttgtagattatttttacggttatttattttgttattcgttatttttttcgtcgaatttgttgcgtagcgtattttcgtttttttcgtgtcgattgtttcggttatttttacggagggcgaaggtattttcggagtatttttggaaagggggaggtgtttttttagtggttaagtacgttttttttagatatttttacgtgattttttttcgtcgagttttaggttgcgtgtgagcgtatttacgatcggggcgcgatgattttattcgtcgcgacgttgcgcggcgtatgttcggcgtgtcggtttttaggcgtttgatgagtttatagttgggcggtggtgttagcggtttcgttggcgttcgtgggtttttttcggatttatatacggaaatacgtaattattcggggatttagacgttcgtttatacgtattattttgggcgggttgtgcggtttaggttttttttcggatcggttcgtgtttcgtttcgtgtttcgtttcgtatttgtcggcgttagttggtttcgtacgtgcggcgtagagaggttgggtttgtaggcgtagtagttttagaggtcgcgttggg

SEQ ID NO: 25328 - DNA, 690 bp, Artificial Sequence
  chemically treated genomic DNA (Homo sapiens) CpG-island No: 25328
cccaacgcgacctctaaaactactacgcctacaaacccaacctctctacgccgcacgtacgaaaccaactaacgccgacaaatacgaaacgaaacacgaaacgaaacacgaaccgatccgaaaaaaaacctaaaccgcacaacccgcccaaaataatacgtataaacgaacgtctaaatccccgaataattacgtatttccgtatataaatccgaaaaaaacccacgaacgccaacgaaaccgctaacaccaccgcccaactataaactcatcaaacgcctaaaaaccgacacgccgaacatacgccgcgcaacgtcgcgacgaataaaatcatcgcgccccgatcgtaaatacgctcacacgcaacctaaaactcgacgaaaaaaaatcacgtaaaaatatctaaaaaaaacgtacttaaccactaaaaaaacacctccccctttccaaaaatactccgaaaataccttcgccctccgtaaaaataaccgaaacaatcgacacgaaaaaaacgaaaatacgctacgcaacaaattcgacgaaaaaaataacgaataacaaaataaataaccgtaaaaataatctacaaccgaacgtaatcttcactctccttaacctttttaattccgaaaaaaaacgactctaaaacgactcaaaaataaaaatatcccttatttcttctacgactcc

SEQ ID NO: 25329 - DNA, 534 bp, Artificial Sequence
  chemically treated genomic DNA (Homo sapiens) CpG-island No: 25329
gttttagttcgtttttatacgaatacgttatcgtttacgttttttgtagttagtaggttacgcgtcggatagaacgttagcgtattagtcggagttttagtacgatgtttttcgagtgttcggattcgagttgggtttttatggagtttgcgtttttttcgtcgtttttattttagcggttttttttttataagtgcggtttatgttgagaaggattgcgagtcgcgtcgtcgtagggtagttagtttcgaattatttatattgcgggaggagtagtttggtatttcgtttcgtttcgggggcggggtcggaagtgttttcgggacgtttttttttttataggagaggtgggtgggtcgttgttggtgcgggtggagcggagcgaagagatcgtatttgggagatcggttatttttttgttttgttgtgatttcgtttgggttaggtagacggtgcgatcgttaattttttttttagttacgttacgtaaagttgagaattgcgtgtaaatttttttttttttattttatttag

SEQ ID NO: 25330 - DNA, 534 bp, Artificial Sequence
  chemically treated genomic DNA (Homo sapiens) CpG-island No: 25330
ctaaataaaataaaaaaaaaaaaatttacacgcaattctcaactttacgtaacgtaactaaaaaaaaaattaacgatcgcaccgtctacctaacccaaacgaaatcacaacaaaacaaaaaaataaccgatctcccaaatacgatctcttcgctccgctccacccgcaccaacaacgacccacccacctctcctataaaaaaaaaaacgtcccgaaaacacttccgaccccgcccccgaaacgaaacgaaataccaaactactcctcccgcaatataaataattcgaaactaactaccctacgacgacgcgactcgcaatccttctcaacataaaccgcacttataaaaaaaaaaccgctaaaataaaaacgacgaaaaaaacgcaaactccataaaaacccaactcgaatccgaacactcgaaaaacatcgtactaaaactccgactaatacgctaacgttctatccgacgcgtaacctactaactacaaaaaacgtaaacgataacgtattcgtataaaaacgaactaaaac

SEQ ID NO: 25331 - DNA, 534 bp, Artificial Sequence
  chemically treated genomic DNA (Homo sapiens) CpG-island No: 25331
ttggatgaagtaggagaggaaagatttatacgtagtttttaattttacgtgacgtgattagggagggaattgacggtcgtatcgtttatttagtttaaacggggttatagtaggataaggaagtagtcgattttttagatgcggttttttcgtttcgttttattcgtattagtagcggtttatttattttttttgtaagaggaagaacgtttcggagatattttcggtttcgttttcgaggcgaagcggagtgttaggttatttttttcgtagtgtgggtggttcgaggttgattattttgcggcggcgcggttcgtagttttttttagtatggatcgtatttgtgaggagaggatcgttgagatgggagcgacgaggaggacgtagattttatggaagtttaattcggattcggatattcggaagatatcgtgttggagtttcggttagtgcgttgacgttttattcggcgcgtgatttattagttgtaggagacgtggacggtgacgtgttcgtgtgagagcgggttagggt

SEQ ID NO: 25332 - DNA, 534 bp, Artificial Sequence
  chemically treated genomic DNA (Homo sapiens) CpG-island No: 25332
accctaacccgctctcacacgaacacgtcaccgtccacgtctcctacaactaataaatcacgcgccgaataaaacgtcaacgcactaaccgaaactccaacacgatatcttccgaatatccgaatccgaattaaacttccataaaatctacgtcctcctcgtcgctcccatctcaacgatcctctcctcacaaatacgatccatactaaaaaaaactacgaaccgcgccgccgcaaaataatcaacctcgaaccacccacactacgaaaaaaataacctaacactccgcttcgcctcgaaaacgaaaccgaaaatatctccgaaacgttcttcctcttacaaaaaaaataaataaaccgctactaatacgaataaaacgaaacgaaaaaaccgcatctaaaaaatcgactacttccttatcctactataaccccgtttaaactaaataaacgatacgaccgtcaattccctccctaatcacgtcacgtaaaattaaaaactacgtataaatctttcctctcctacttcatccaa

SEQ ID NO: 25333 - DNA, 682 bp, Artificial Sequence
  chemically treated genomic DNA (Homo sapiens) CpG-island No: 25333
cgtgttgtcggggttcgtcgggtcgaggaggagtcgacgcggttcggggaattttagtttttatacggttaacgtttttttaaggagagtggaggagggagggttttcgtttacgagaacgaagagaattttagggtcgaagtttcgttttagtcggttcggttttttttcgttagttcgttatttaattcgggtcgtattaggggtcgtatttgttcgcgcgtatacgtttttcgcgcgttaggtttcgtcgtcgtcgtcgttttcggtacgcgttcgttgcggttgttttttatcgttttgtttcggcgcgggttatagcgtacgagtcgtcgtcgtcgtcgtcgcgttttttttcgtcgcggacgtcgttttcgcgtaatcgtcgaggaagtcgaggcgagttcgggtcgggcgcgagggcgcgcgggtcgttgttgttatcgcgggtgttttttgcgttttcgttttagttaggattttttttgtcgttttttttttttttttcgattttagtttttattatttttttttcgttttttaaaagtattttcgagtttttatttttttacgtcgtattcgcgggaacgaggttttgggaatttaggggagtggttgtgggggcgcgtcgcggtttttagttcggttagttttttttttaagatatggtttgatttttatt

SEQ ID NO: 25334 - DNA, 682 bp, Artificial Sequence
  chemically treated genomic DNA (Homo sapiens) CpG-island No: 25334
aataaaaatcaaaccatatcttaaaaaaaaaactaaccgaactaaaaaccgcgacgcgcccccacaaccactcccctaaattcccaaaacctcgttcccgcgaatacgacgtaaaaaaataaaaactcgaaaatacttttaaaaaacgaaaaaaaaataataaaaactaaaatcgaaaaaaaaaaaaaaaacgacaaaaaaaatcctaactaaaacgaaaacgcaaaaaacacccgcgataacaacaacgacccgcgcgccctcgcgcccgacccgaactcgcctcgacttcctcgacgattacgcgaaaacgacgtccgcgacgaaaaaaaacgcgacgacgacgacgacgactcgtacgctataacccgcgccgaaacaaaacgataaaaaacaaccgcaacgaacgcgtaccgaaaacgacgacgacgacgaaacctaacgcgcgaaaaacgtatacgcgcgaacaaatacgacccctaatacgacccgaattaaataacgaactaacgaaaaaaaaccgaaccgactaaaacgaaacttcgaccctaaaattctcttcgttctcgtaaacgaaaaccctccctcctccactctccttaaaaaaacgttaaccgtataaaaactaaaattccccgaaccgcgtcgactcctcctcgacccgacgaaccccgacaacacg

SEQ ID NO: 25335 - DNA, 682 bp, Artificial Sequence
  chemically treated genomic DNA (Homo sapiens) CpG-island No: 25335
aatggggattagattatgttttgaaagaggggttggtcgagttgggagtcgcgacgcgtttttatagttatttttttgaatttttaaggtttcgttttcgcgggtgcggcgtgagggggtggggattcgggggtgtttttgaggagcgggaggagggtggtgaggattgaggtcggaggaggaggaggaggcggtagagagagttttagttggagcgggagcgtagggaatattcgcggtggtagtagcggttcgcgcgttttcgcgttcgattcgggttcgtttcggttttttcggcggttacgcgggggcggcgttcgcggcggggaggagcgcggcggcggcggcggcggttcgtgcgttgtggttcgcgtcgaggtagggcggtggggggtagtcgtagcgggcgcgtgtcgagggcggcggcggcggcgaggtttggcgcgcggggggcgtgtgcgcgcgggtaggtgcggtttttggtgcggttcgagttgggtggcgggttggcggggaggggtcgggtcggttgaggcggggtttcggttttgagatttttttcgttttcgtgggcggggatttttttttttttattttttttggaagagcgttaatcgtgtgaggattggagtttttcgggtcgcgtcggttttttttcggttcggcgggtttcggtaatacg

SEQ ID NO: 25336 - DNA, 682 bp, Artificial Sequence
  chemically treated genomic DNA (Homo sapiens) CpG-island No: 25336
cgtattaccgaaacccgccgaaccgaaaaaaaaccgacgcgacccgaaaaactccaatcctcacacgattaacgctcttccaaaaaaaataaaaaaaaaaaaatccccgcccacgaaaacgaaaaaaatctcaaaaccgaaaccccgcctcaaccgacccgacccctccccgccaacccgccacccaactcgaaccgcaccaaaaaccgcacctacccgcgcgcacacgccccccgcgcgccaaacctcgccgccgccgccgccctcgacacgcgcccgctacgactaccccccaccgccctacctcgacgcgaaccacaacgcacgaaccgccgccgccgccgccgcgctcctccccgccgcgaacgccgcccccgcgtaaccgccgaaaaaaccgaaacgaacccgaatcgaacgcgaaaacgcgcgaaccgctactaccaccgcgaatattccctacgctcccgctccaactaaaactctctctaccgcctcctcctcctcctccgacctcaatcctcaccaccctcctcccgctcctcaaaaacacccccgaatccccaccccctcacgccgcacccgcgaaaacgaaaccttaaaaattcaaaaaaataactataaaaacgcgtcgcgactcccaactcgaccaacccctctttcaaaacataatctaatccccatt

SEQ ID NO: 25337 - DNA, 700 bp, Artificial Sequence
  chemically treated genomic DNA (Homo sapiens) CpG-island No: 25337
atagcgttcggttcgagtgtcgcgggaagcggaataggtagtttggtagaggttggtgggtagaagggcggggcgggacgtcgagttaggtggttatttggagcgtttcgtttttttagcgtcgggtcgcgttttcgttttcgtttttacgcgttatcgtttatttcgttttcgtttttagtttcgcgcggtcgttttatttgtataaggaggcgtttttcgggttcgttcggggcgtacgtgatttcgggggaggcggagggaatttgttgatttgatacgagtcgttgtgcggttttttttggcgcggaatagcgagagtagtcgtgattttcgatttcgttcgtcggtagttaataagagcgtaggtcgtttttaaatttaaaatttttacgtcggtaaaagttaagatggaagggagcggagcggagcgcgaggggggagtcggttcgggaatgtttggcggtcggcgttggaggggtaggttggggagtttgcggcgggcgtacgaggggttattcgcgaaggtgtttcggtttagcgcgattatcgtttttaatttcgggagtttttgggcgtttcgtatttcgttagtcgttcgtgtatttcggttcgggggacgtaatttattgttttttcggttttgttttttaggggtggcgggggatggaacgggtggcgaggggttttggggggaaga

SEQ ID NO: 25338 - DNA, 700 bp, Artificial Sequence
  chemically treated genomic DNA (Homo sapiens) CpG-island No: 25338
tcttccccccaaaacccctcgccacccgttccatcccccgccacccctaaaaaacaaaaccgaaaaaacaataaattacgtcccccgaaccgaaatacacgaacgactaacgaaatacgaaacgcccaaaaactcccgaaattaaaaacgataatcgcgctaaaccgaaacaccttcgcgaataacccctcgtacgcccgccgcaaactccccaacctacccctccaacgccgaccgccaaacattcccgaaccgactcccccctcgcgctccgctccgctcccttccatcttaacttttaccgacgtaaaaattttaaatttaaaaacgacctacgctcttattaactaccgacgaacgaaatcgaaaatcacgactactctcgctattccgcgccaaaaaaaaccgcacaacgactcgtatcaaatcaacaaattccctccgcctcccccgaaatcacgtacgccccgaacgaacccgaaaaacgcctccttatacaaataaaacgaccgcgcgaaactaaaaacgaaaacgaaataaacgataacgcgtaaaaacgaaaacgaaaacgcgacccgacgctaaaaaaacgaaacgctccaaataaccacctaactcgacgtcccgccccgcccttctacccaccaacctctaccaaactacctattccgcttcccgcgacactcgaaccgaacgctat

SEQ ID NO: 25339 - DNA, 700 bp, Artificial Sequence
  chemically treated genomic DNA (Homo sapiens) CpG-island No: 25339
ttttttttttaaaatttttcgttattcgttttatttttcgttatttttaagagataaggtcggaggggtagtgggttgcgtttttcgggtcggggtgtacgggcggttggcggagtgcggggcgtttagaggttttcggggttgggggcggtggtcgcgttgggtcgggatattttcgcgagtggtttttcgtgcgttcgtcgtaggttttttagtttgtttttttagcgtcggtcgttaggtattttcgggtcggtttttttttcgcgtttcgtttcgtttttttttattttgatttttgtcgacgtggaaattttgggtttggagacgatttgcgtttttattggttgtcggcgggcggggtcggaggttacggttgttttcgttatttcgcgttaaggggagtcgtatagcggttcgtgttaagttagtaggtttttttcgtttttttcggggttacgtgcgtttcgggcgggttcgggagacgtttttttatgtaaatagagcggtcgcgcggggttgggggcgggggcggggtgggcggtggcgcgtgggggcgggggcgggggcgcggttcggcgttgggagggcggggcgttttaggtggttatttggttcgacgtttcgtttcgtttttttgtttattagtttttgttaggttgtttgtttcgtttttcgcgatattcgggtcgggcgttgt

SEQ ID NO: 25340 - DNA, 700 bp, Artificial Sequence
  chemically treated genomic DNA (Homo sapiens) CpG-island No: 25340
acaacgcccgacccgaatatcgcgaaaaacgaaacaaacaacctaacaaaaactaataaacaaaaaaacgaaacgaaacgtcgaaccaaataaccacctaaaacgccccgccctcccaacgccgaaccgcgcccccgcccccgcccccacgcgccaccgcccaccccgcccccgcccccaaccccgcgcgaccgctctatttacataaaaaaacgtctcccgaacccgcccgaaacgcacgtaaccccgaaaaaaacgaaaaaaacctactaacttaacacgaaccgctatacgactccccttaacgcgaaataacgaaaacaaccgtaacctccgaccccgcccgccgacaaccaataaaaacgcaaatcgtctccaaacccaaaatttccacgtcgacaaaaatcaaaataaaaaaaaacgaaacgaaacgcgaaaaaaaaaccgacccgaaaatacctaacgaccgacgctaaaaaaacaaactaaaaaacctacgacgaacgcacgaaaaaccactcgcgaaaatatcccgacccaacgcgaccaccgcccccaaccccgaaaacctctaaacgccccgcactccgccaaccgcccgtacaccccgacccgaaaaacgcaacccactacccctccgaccttatctcttaaaaataacgaaaaataaaacgaataacgaaaaattttaaaaaaaaaa

SEQ ID NO: 25341 - DNA, 706 bp, Artificial Sequence
  chemically treated genomic DNA (Homo sapiens) CpG-island No: 25341
tatttagcgtcgtcgtttatcgtacgggagttaggggtagggggcggagcggggagagtcgagtgttggtttagtcgagagaagtagttggcgggaggggaatttttcgcggttgacgtaggttcgacgtagtaatttttattcggaggcgtgggcggggcgatttcgcggtcgtcggcgcgcgatcgtttttagcgtttcgtttttgtttgttttcgcgtacgtttttcgtcggtttttacgtatacgttttcggtttgttgcggcggttggtttgggagggggtcgagggagcgggagtttggggtgggtttcgggagcgtagggaacggcgggagtcgggaggtgacggttagtagcgtgagaaggtcgttggtttttgagaaattttttttttttaggttgttttttcgagtgtggtttaaagtttaggagcgggcgggagggtgcggatgacgtagagagggtcggtcgttggggagtttttgggggcgcgcggggtcgattttttcggtttgggagggcgacggtcggggttttcgagaggtggtttttttttttttcgatttcgtatatgtaaatttttattttcgcgttagcggcgggacgttgcgttttgtagggggaagtggtgttgcggcgggggttttgtttttttttgtaatttttgtatttgtatacggggatttttttttcgattgatttt

SEQ ID NO: 25342 - DNA, 706 bp, Artificial Sequence
  chemically treated genomic DNA (Homo sapiens) CpG-island No: 25342
aaaatcaatcgaaaaaaaaatccccgtatacaaatacaaaaattacaaaaaaaaacaaaacccccgccgcaacaccacttccccctacaaaacgcaacgtcccgccgctaacgcgaaaataaaaatttacatatacgaaatcgaaaaaaaaaaaaaccacctctcgaaaaccccgaccgtcgccctcccaaaccgaaaaaatcgaccccgcgcgcccccaaaaactccccaacgaccgaccctctctacgtcatccgcaccctcccgcccgctcctaaactttaaaccacactcgaaaaaacaacctaaaaaaaaaaaatttctcaaaaaccaacgaccttctcacgctactaaccgtcacctcccgactcccgccgttccctacgctcccgaaacccaccccaaactcccgctccctcgaccccctcccaaaccaaccgccgcaacaaaccgaaaacgtatacgtaaaaaccgacgaaaaacgtacgcgaaaacaaacaaaaacgaaacgctaaaaacgatcgcgcgccgacgaccgcgaaatcgccccgcccacgcctccgaataaaaattactacgtcgaacctacgtcaaccgcgaaaaattcccctcccgccaactacttctctcgactaaaccaacactcgactctccccgctccgccccctacccctaactcccgtacgataaacgacgacgctaaata

SEQ ID NO: 25343 - DNA, 706 bp, Artificial Sequence
  chemically treated genomic DNA (Homo sapiens) CpG-island No: 25343
aaaattagtcggggggggggttttcgtatgtaaatataggaattatagaagaagataggattttcgtcgtagtattatttttttttatagggcgtaacgtttcgtcgttggcgcgggggtggagatttgtatgtgcgaagtcgggaagagggggaattatttttcgaaaatttcggtcgtcgtttttttaggtcgggagagtcggtttcgcgcgtttttaaaagttttttagcggtcggttttttttacgttattcgtattttttcgttcgtttttgaattttaaattatattcggaagaataatttggaggagggggattttttaggagttagcggtttttttacgttgttagtcgttatttttcggttttcgtcgttttttgcgttttcgaagtttattttaagttttcgttttttcgatttttttttaagttagtcgtcgtagtaagtcgggggcgtatgcgtgggggtcggcggggagcgtgcgcggggataggtaggggcggggcgttgggggcggtcgcgcgtcggcggtcgcgaggtcgtttcgtttacgttttcgggtgagggttgttgcgtcgggtttacgttagtcgcgggaaatttttttttcgttagttgtttttttcggttgggttagtattcggtttttttcgtttcgttttttgtttttggttttcgtacggtggacggcgacgttgggtg

SEQ ID NO: 25344 - DNA, 706 bp, Artificial Sequence
  chemically treated genomic DNA (Homo sapiens) CpG-island No: 25344
cacccaacgtcgccgtccaccgtacgaaaaccaaaaacaaaaaacgaaacgaaaaaaaccgaatactaacccaaccgaaaaaaacaactaacgaaaaaaaaatttcccgcgactaacgtaaacccgacgcaacaaccctcacccgaaaacgtaaacgaaacgacctcgcgaccgccgacgcgcgaccgcccccaacgccccgcccctacctatccccgcgcacgctccccgccgacccccacgcatacgcccccgacttactacgacgactaacttaaaaaaaaatcgaaaaaacgaaaacttaaaataaacttcgaaaacgcaaaaaacgacgaaaaccgaaaaataacgactaacaacgtaaaaaaaccgctaactcctaaaaaatccccctcctccaaattattcttccgaatataatttaaaattcaaaaacgaacgaaaaaatacgaataacgtaaaaaaaaccgaccgctaaaaaacttttaaaaacgcgcgaaaccgactctcccgacctaaaaaaacgacgaccgaaattttcgaaaaataattccccctcttcccgacttcgcacatacaaatctccacccccgcgccaacgacgaaacgttacgccctataaaaaaaaataatactacgacgaaaatcctatcttcttctataattcctatatttacatacgaaaaccccccccccgactaatttt

SEQ ID NO: 25345 - DNA, 712 bp, Artificial Sequence
  chemically treated genomic DNA (Homo sapiens) CpG-island No: 25345
attacgtaaattgcgcgagcgtacgggaaaagcgattggtcggttaggagagagaggtgtgttttggcgggttcgtagtttcgattggtcgataggttgacgggaacgtttacggttagcgtgtgttagcgacgtgtaattcggaagggaagaaggggcgtgttaggttgcgtaggcggttagtttattggttggaagagatcggagtcgggtttcgggttcgattagaggagggcggtgttgtagggttggttcgggaggtgacgatcggtttcggagagtttattatggtagttcggattggttatacggttttgagaagggtagtttcgggatgtcgttcgaagtcggcgatagcggtcggggcgtaggcgttcgtgcggaatggtaggtaattaatagcgggggcgttgagacgagagtagttttcgattttggttgtcgagttgggggatcggaaggatttgggggtgaggtagagtcggattcggtgtattttcgtgtttttagaggagaaggtttttttttgcgtttggtatttgagggatttaagagcggcgcgtattattttgggtttaaggttgtgttcgtggttcgtttgtttcgtgagaggcggtgaattatcggcgaagcgattttggaagtaatttggttattggtgtttttgggttttttcggtttttttttttatggtttgttgttattgttgttg

SEQ ID NO: 25346 - DNA, 712 bp, Artificial Sequence
  chemically treated genomic DNA (Homo sapiens) CpG-island No: 25346
caacaacaataacaacaaaccataaaaaaaaaaaccgaaaaaacccaaaaacaccaataaccaaattacttccaaaatcgcttcgccgataattcaccgcctctcacgaaacaaacgaaccacgaacacaaccttaaacccaaaataatacgcgccgctcttaaatccctcaaataccaaacgcaaaaaaaaaccttctcctctaaaaacacgaaaatacaccgaatccgactctacctcacccccaaatccttccgatcccccaactcgacaaccaaaatcgaaaactactctcgtctcaacgcccccgctattaattacctaccattccgcacgaacgcctacgccccgaccgctatcgccgacttcgaacgacatcccgaaactacccttctcaaaaccgtataaccaatccgaactaccataataaactctccgaaaccgatcgtcacctcccgaaccaaccctacaacaccgccctcctctaatcgaacccgaaacccgactccgatctcttccaaccaataaactaaccgcctacgcaacctaacacgccccttcttcccttccgaattacacgtcgctaacacacgctaaccgtaaacgttcccgtcaacctatcgaccaatcgaaactacgaacccgccaaaacacacctctctctcctaaccgaccaatcgcttttcccgtacgctcgcgcaatttacgtaat

SEQ ID NO: 25347 - DNA, 712 bp, Artificial Sequence
  chemically treated genomic DNA (Homo sapiens) CpG-island No: 25347
taatagtagtagtaataagttataggggaggagatcggaagagtttaaaggtattaatggttaaattgtttttaaagtcgtttcgtcgatgatttatcgttttttacgaggtaaacgagttacgaatatagttttgggtttaaggtgatgcgcgtcgtttttgagttttttagatgttaaacgtaaaaaaaagtttttttttttaaagatacggaaatgtatcgagttcggttttgttttatttttaaattttttcggttttttaattcggtagttaaaatcgaaaattattttcgttttagcgttttcgttgttgattatttgttatttcgtacgggcgtttgcgtttcggtcgttgtcgtcgatttcggacggtatttcgagattattttttttaaggtcgtatgattagttcgagttgttatgatagatttttcgaagtcggtcgttatttttcggattagttttgtagtatcgtttttttttggtcgggttcggagttcggtttcggttttttttagttaatggattggtcgtttgcgtagtttgatacgtttttttttttttttcgggttgtacgtcgttgatatacgttgatcgtaaacgttttcgttagtttgtcggttaatcggagttgcgggttcgttaggatatattttttttttttgatcgattaatcgtttttttcgtgcgttcgcgtaatttgcgtaat

SEQ ID NO: 25348 - DNA, 712 bp, Artificial Sequence
  chemically treated genomic DNA (Homo sapiens) CpG-island No: 25348
attacgcaaattacgcgaacgcacgaaaaaaacgattaatcgatcaaaaaaaaaaaatatatcctaacgaacccgcaactccgattaaccgacaaactaacgaaaacgtttacgatcaacgtatatcaacgacgtacaacccgaaaaaaaaaaaaaaacgtatcaaactacgcaaacgaccaatccattaactaaaaaaaaccgaaaccgaactccgaacccgaccaaaaaaaaacgatactacaaaactaatccgaaaaataacgaccgacttcgaaaaatctatcataacaactcgaactaatcatacgaccttaaaaaaaataatctcgaaataccgtccgaaatcgacgacaacgaccgaaacgcaaacgcccgtacgaaataacaaataatcaacaacgaaaacgctaaaacgaaaataattttcgattttaactaccgaattaaaaaaccgaaaaaatttaaaaataaaacaaaaccgaactcgatacatttccgtatctttaaaaaaaaaaacttttttttacgtttaacatctaaaaaactcaaaaacgacgcgcatcaccttaaacccaaaactatattcgtaactcgtttacctcgtaaaaaacgataaatcatcgacgaaacgactttaaaaacaatttaaccattaatacctttaaactcttccgatctcctcccctataacttattactactactatta

SEQ ID NO: 25349 - DNA, 904 bp, Artificial Sequence
  chemically treated genomic DNA (Homo sapiens) CpG-island No: 25349
cgcgattcgtttagggttcggggtcggttcggtcgggcgtcgcgtgtaggtgcggaaggtaggcggcggttcggtgcgggcgcgggggtagcgtcgggggtcgggttgcgcggttcggttgcgggcggtaggaggtagcgtcggtttaggcggcgggcggcgagcgagttagcgcgcggtgatgttagtggcggttcggttggtagtagtcggtattttttgtggaaaggcgggcgggttcggttgtaaattttattagttagtgttagtttttcggcgggaggaggcggcggcggaggaggagtagggggagggttgttaaattcgggagttagattttttttttttttttggtaatttttttcgttttttcggttttcggcgtgatatttgcgggtcggggatttgtatgtgtgtgcgcgcgaaggagcggaagaatggtagtgtttaaatttatcgattaggtagcgggcggcggttcggcgggcgggatcgggtcggggcggcgcggagttcggcggggggatgggggcgcggttggagcgcgtcgagattgtttattcgcggcgaaggggaggattgtgtgcggtcgtcggtgttttcgagagttcgcggcggtagttttttttcgtcgcgtcgttttcgttttgggtcgtcggaattgcgcgttcgagtttggggtagggattcgtgggcgttgggtagtcggcgtgcgggagtggggcggtcgcgggttcggcggggttggggagggggtcgggggttcgaggtgttttcgggattcgtatcgcgtcgcgttgcgtgggcgtcgtcggttcgggtttcggggaggaggacgttgtacgaagagggagaaaggatcgtagattgggatttttttttaaatttagtaggagttttgttt

SEQ ID NO: 25350 - DNA, 904 bp, Artificial Sequence
  chemically treated genomic DNA (Homo sapiens) CpG-island No: 25350
aaacaaaactcctactaaatttaaaaaaaaatcccaatctacgatcctttctccctcttcgtacaacgtcctcctccccgaaacccgaaccgacgacgcccacgcaacgcgacgcgatacgaatcccgaaaacacctcgaacccccgaccccctccccaaccccgccgaacccgcgaccgccccactcccgcacgccgactacccaacgcccacgaatccctaccccaaactcgaacgcgcaattccgacgacccaaaacgaaaacgacgcgacgaaaaaaaactaccgccgcgaactctcgaaaacaccgacgaccgcacacaatcctccccttcgccgcgaataaacaatctcgacgcgctccaaccgcgcccccatccccccgccgaactccgcgccgccccgacccgatcccgcccgccgaaccgccgcccgctacctaatcgataaatttaaacactaccattcttccgctccttcgcgcgcacacacatacaaatccccgacccgcaaatatcacgccgaaaaccgaaaaaacgaaaaaaattaccaaaaaaaaaaaaaaaatctaactcccgaatttaacaaccctccccctactcctcctccgccgccgcctcctcccgccgaaaaactaacactaactaataaaatttacaaccgaacccgcccgcctttccacaaaaaataccgactactaccaaccgaaccgccactaacatcaccgcgcgctaactcgctcgccgcccgccgcctaaaccgacgctacctcctaccgcccgcaaccgaaccgcgcaacccgacccccgacgctacccccgcgcccgcaccgaaccgccgcctaccttccgcacctacacgcgacgcccgaccgaaccgaccccgaaccctaaacgaatcgcg

SEQ ID NO: 25351 - DNA, 904 bp, Artificial Sequence
  chemically treated genomic DNA (Homo sapiens) CpG-island No: 25351
gggtaggatttttgttaggtttggggaggggttttagtttgcgatttttttttttttttcgtgtagcgttttttttttcggggttcgggtcggcggcgtttacgtaacgcggcgcggtgcgagtttcgagagtatttcgagttttcggttttttttttagtttcgtcgggttcgcggtcgttttattttcgtacgtcggttgtttagcgtttacgggtttttgttttagattcgggcgcgtagtttcgacggtttagggcggggacggcgcggcggaggggagttgtcgtcgcgggttttcggaggtatcggcggtcgtatatagttttttttttcgtcgcgagtaaatagtttcgacgcgttttagtcgcgtttttattttttcgtcgggtttcgcgtcgtttcggttcggtttcgttcgtcgggtcgtcgttcgttatttggtcggtgagtttgagtattgttattttttcgttttttcgcgcgtatatatatgtaggttttcggttcgtagatgttacgtcgggagtcggggaagcggaagggattgttaggagaagggaaaaaatttggttttcgaatttgatagttttttttttgtttttttttcgtcgtcgttttttttcgtcgagaggttgatattggttagtggggtttgtagtcgagttcgttcgtttttttataggaagtatcggttgttgttagtcgggtcgttattgatattatcgcgcgttggttcgttcgtcgttcgtcgtttgggtcgacgttgttttttgtcgttcgtagtcgagtcgcgtagttcggttttcggcgttgttttcgcgttcgtatcgggtcgtcgtttgtttttcgtatttgtacgcggcgttcggtcgggtcggtttcgggttttgggcggatcgcg

SEQ ID NO: 25352 - DNA, 904 bp, Artificial Sequence
  chemically treated genomic DNA (Homo sapiens) CpG-island No: 25352
cgcgatccgcccaaaacccgaaaccgacccgaccgaacgccgcgtacaaatacgaaaaacaaacgacgacccgatacgaacgcgaaaacaacgccgaaaaccgaactacgcgactcgactacgaacgacaaaaaacaacgtcgacccaaacgacgaacgacgaacgaaccaacgcgcgataatatcaataacgacccgactaacaacaaccgatacttcctataaaaaaacgaacgaactcgactacaaaccccactaaccaatatcaacctctcgacgaaaaaaaacgacgacgaaaaaaaaacaaaaaaaaaactatcaaattcgaaaaccaaattttttcccttctcctaacaatcccttccgcttccccgactcccgacgtaacatctacgaaccgaaaacctacatatatatacgcgcgaaaaaacgaaaaaataacaatactcaaactcaccgaccaaataacgaacgacgacccgacgaacgaaaccgaaccgaaacgacgcgaaacccgacgaaaaaataaaaacgcgactaaaacgcgtcgaaactatttactcgcgacgaaaaaaaaaactatatacgaccgccgatacctccgaaaacccgcgacgacaactcccctccgccgcgccgtccccgccctaaaccgtcgaaactacgcgcccgaatctaaaacaaaaacccgtaaacgctaaacaaccgacgtacgaaaataaaacgaccgcgaacccgacgaaactaaaaaaaaaaccgaaaactcgaaatactctcgaaactcgcaccgcgccgcgttacgtaaacgccgccgacccgaaccccgaaaaaaaaaacgctacacgaaaaaaaaaaaaaaatcgcaaactaaaacccctccccaaacctaacaaaaatcctaccc

SEQ ID NO: 25353 - DNA, 618 bp, Artificial Sequence
  chemically treated genomic DNA (Homo sapiens) CpG-island No: 25353
agaacgggggtaggcgtggcgtttttgggattgtcggaaaacgacgtgagggaaaaatttagaggttacgaaaaggcgaatagacggagggtttgttttaggggagttaagtagttcgtttgaagttttttatttggaaatgacgtgtttaattcggcgtttttgtagtttcggtcgtttttttttgtttaatttcgcgtttttttagtttcggtcgtttttttcgtcgtttttttttcgcggtcgtttatttttgagatttttggttttattgagacgtttagttttattcggtaattcgcggatattaagcgttataaatttaaatacgagatttagagacgttgggttttaaacgttttttagagtgaaagatagaggaattaatcgaggttcggttgattttagacgtttaaggcgataggcgttgttaagaaaagggggtgggacgatatttagttgttaagacgacggttttcgggtgggcggtttgaggtggttttcggtcgttaggcgagatttcgcgggaaaattttttgttagagagattaggagatttggggttgcggtcgtttttttcggagtatttacgggattgtgtgttggggtttttttatt

SEQ ID NO: 25354 - DNA, 618 bp, Artificial Sequence
  chemically treated genomic DNA (Homo sapiens) CpG-island No: 25354
aataaaaaaaccccaacacacaatcccgtaaatactccgaaaaaaacgaccgcaaccccaaatctcctaatctctctaacaaaaaattttcccgcgaaatctcgcctaacgaccgaaaaccacctcaaaccgcccacccgaaaaccgtcgtcttaacaactaaatatcgtcccacccccttttcttaacaacgcctatcgccttaaacgtctaaaatcaaccgaacctcgattaattcctctatctttcactctaaaaaacgtttaaaacccaacgtctctaaatctcgtatttaaatttataacgcttaatatccgcgaattaccgaataaaactaaacgtctcaataaaaccaaaaatctcaaaaataaacgaccgcgaaaaaaaaacgacgaaaaaaacgaccgaaactaaaaaaacgcgaaattaaacaaaaaaaaacgaccgaaactacaaaaacgccgaattaaacacgtcatttccaaataaaaaacttcaaacgaactacttaactcccctaaaacaaaccctccgtctattcgccttttcgtaacctctaaatttttccctcacgtcgttttccgacaatcccaaaaacgccacgcctacccccgttct

SEQ ID NO: 25355 - DNA, 618 bp, Artificial Sequence
  chemically treated genomic DNA (Homo sapiens) CpG-island No: 25355
ggtggagggattttagtatatagtttcgtgggtgtttcggaggaaacggtcgtagttttaaattttttagtttttttagtagggagttttttcgcggagtttcgtttggcggtcggaagttattttaagtcgtttattcggaagtcgtcgttttggtaattgggtatcgttttattttttttttttagtaacgtttatcgttttagacgtttgaggttagtcgagtttcgattggtttttttgttttttattttgggagacgtttgagatttagcgtttttagatttcgtatttgaatttgtggcgtttggtgttcgcgagttgtcgaatgaagttgagcgttttagtggaattagggattttaggggtgagcgatcgcgaggggagagcgacgaaaagggcggtcggagttggaggggcgcggagttaaataaaaaagggcggtcggagttgtaggggcgtcgagttaaatacgttatttttagatggggggttttaggcgagttgtttagtttttttgaggtaggtttttcgtttgttcgttttttcgtagtttttgagttttttttttacgtcgtttttcggtagttttagagacgttacgtttgttttcgtttt

SEQ ID NO: 25356 - DNA, 618 bp, Artificial Sequence
  chemically treated genomic DNA (Homo sapiens) CpG-island No: 25356
aaaacgaaaacaaacgtaacgtctctaaaactaccgaaaaacgacgtaaaaaaaaaactcaaaaactacgaaaaaacgaacaaacgaaaaacctacctcaaaaaaactaaacaactcgcctaaaaccccccatctaaaaataacgtatttaactcgacgcccctacaactccgaccgcccttttttatttaactccgcgcccctccaactccgaccgcccttttcgtcgctctcccctcgcgatcgctcacccctaaaatccctaattccactaaaacgctcaacttcattcgacaactcgcgaacaccaaacgccacaaattcaaatacgaaatctaaaaacgctaaatctcaaacgtctcccaaaataaaaaacaaaaaaaccaatcgaaactcgactaacctcaaacgtctaaaacgataaacgttactaaaaaaaaaaaataaaacgatacccaattaccaaaacgacgacttccgaataaacgacttaaaataacttccgaccgccaaacgaaactccgcgaaaaaactccctactaaaaaaactaaaaaatttaaaactacgaccgtttcctccgaaacacccacgaaactatatactaaaatccctccacc

SEQ ID NO: 25357 - DNA, 1000 bp, Artificial Sequence
  chemically treated genomic DNA (Homo sapiens) CpG-island No: 25357
  misc_feature (33)..(33): n is either a, c, g or t
  misc_feature (200)..(200): n is either a, c, g or t
  misc_feature (226)..(226): n is either a, c, g or t
  misc_feature (445)..(445): n is either a, c, g or t
  misc_feature (458)..(458): n is either a, c, g or t
  misc_feature (463)..(463): n is either a, c, g or t
  misc_feature (523)..(523): n is either a, c, g or t
  misc_feature (528)..(528): n is either a, c, g or t
  misc_feature (550)..(550): n is either a, c, g or t
  misc_feature (939)..(939): n is either a, c, g or t
gcgggcgcgggttgcgtggggttttagttattncgtggagttttagttattcgtggataaagcgtcgcgcgttagtatagcggttcgggcggagttttttttttttttttttttttttttatattcgtacgttcgtttttttttcgcgttttgtttttttttcgatttttgggttcggttttttcgggggagggtggggncgttcgggttttcgggtttcgcgtgncgtgtgttcgagtagttttgggcggtgggcgaaggcgcggtttggggattcgggaggggtcggggcgcgggggttgtaggaagtggaggcggtcgtcgttcggggatcggtttggcggggtgagagatattcggaaacggatttcgtttcggggttcgcgcgagttgggtgtttcggagggcgcgagaggagcgggcgggtgttgttgagtaatttttngcggcggcggttnggatngtttattttttacgtcgcgtcgtagtcgggtcgcggttttttttttcgcggttttttttnttttntttttttttcgttttttttttnttttttttttttttttttcggtttcgtttggtttcgggtaggtagagtcgggtttcgggcgcgcgcggggtcgtagtagttgttttcgatttcgtttcggtttagcgtagggtttcgtacgtttatggtcggttcggagtagtagcggtcgcggcggcgggacgacggagattcggacgcggtagcggcggcggcggcgtttttgtaggacgcggagttggttttggtcggtattaatatgttgtttaataacggttttagggagtcggattagttttttaaataatataggtgatttacgcgttttcgattttttaattttgtagcgcgtatttcgtgttcggtttacgcgtttcgatttgcggttttcgggagtttttttttttttnttgtcggttatcgatttcggtttttaggttttttttttggtaagattagttagagggaatg

SEQ ID NO: 25358 - DNA, 1000 bp, Artificial Sequence
  chemically treated genomic DNA (Homo sapiens) CpG-island No: 25358
  misc_feature (62)..(62): n is either a, c, g or t
  misc_feature (451)..(451): n is either a, c, g or t
  misc_feature (473)..(473): n is either a, c, g or t
  misc_feature (478)..(478): n is either a, c, g or t
  misc_feature (538)..(538): n is either a, c, g or t
  misc_feature (543)..(543): n is either a, c, g or t
  misc_feature (556)..(556): n is either a, c, g or t
  misc_feature (775)..(775): n is either a, c, g or t
  misc_feature (801)..(801): n is either a, c, g or t
  misc_feature (968)..(968): n is either a, c, g or t
cattccctctaactaatcttaccaaaaaaaaaacctaaaaaccgaaatcgataaccgacaanaaaaaaaaaaaaactcccgaaaaccgcaaatcgaaacgcgtaaaccgaacacgaaatacgcgctacaaaattaaaaaatcgaaaacgcgtaaatcacctatattatttaaaaaactaatccgactccctaaaaccgttattaaacaacatattaataccgaccaaaaccaactccgcgtcctacaaaaacgccgccgccgccgctaccgcgtccgaatctccgtcgtcccgccgccgcgaccgctactactccgaaccgaccataaacgtacgaaaccctacgctaaaccgaaacgaaatcgaaaacaactactacgaccccgcgcgcgcccgaaacccgactctacctacccgaaaccaaacgaaaccgaaaaaaaaaaaaaaaaaanaaaaaaaaaacgaaaaaaaaanaaaanaaaaaaaaccgcgaaaaaaaaaaccgcgacccgactacgacgcgacgtaaaaaataaacnatccnaaccgccgccgcnaaaaattactcaacaacacccgcccgctcctctcgcgccctccgaaacacccaactcgcgcgaaccccgaaacgaaatccgtttccgaatatctctcaccccgccaaaccgatccccgaacgacgaccgcctccacttcctacaacccccgcgccccgacccctcccgaatccccaaaccgcgccttcgcccaccgcccaaaactactcgaacacacgncacgcgaaacccgaaaacccgaacgnccccaccctcccccgaaaaaaccgaacccaaaaatcgaaaaaaaaacaaaacgcgaaaaaaaaacgaacgtacgaatataaaaaaaaaaaaaaaaaaaaaaaaaactccgcccgaaccgctatactaacgcgcgacgctttatccacgaataactaaaactccacgnaataactaaaaccccacgcaacccgcgcccgc

SEQ ID NO: 25359 - DNA, 1000 bp, Artificial Sequence
  chemically treated genomic DNA (Homo sapiens) CpG-island No: 25359
  misc_feature (62)..(62): n is either a, c, g or t
  misc_feature (451)..(451): n is either a, c, g or t
  misc_feature (473)..(473): n is either a, c, g or t
  misc_feature (478)..(478): n is either a, c, g or t
  misc_feature (538)..(538): n is either a, c, g or t
  misc_feature (543)..(543): n is either a, c, g or t
  misc_feature (556)..(556): n is either a, c, g or t
  misc_feature (775)..(775): n is either a, c, g or t
  misc_feature (801)..(801): n is either a, c, g or t
  misc_feature (968)..(968): n is either a, c, g or t
tattttttttggttgattttgttagggaggagatttgaggatcggaatcggtgatcgatagngagggggagggggttttcgggggtcgtaggtcgaggcgcgtgagtcggatacgaggtgcgcgttgtagggttggggaatcggggacgcgtgggttatttgtattgtttgaaaagttggttcgattttttgaagtcgttgttgagtagtatgttgatgtcggttagggttagtttcgcgttttgtaggggcgtcgtcgtcgtcgttgtcgcgttcgagttttcgtcgtttcgtcgtcgcggtcgttgttgtttcgagtcggttatgggcgtgcgaggttttgcgttgggtcgaggcgagatcgggagtagttgttgcggtttcgcgcgcgttcggagttcggttttatttgttcggagttaagcggagtcgggaggggaggggagggganggggagaagacgggagggaagnaggangggaaggatcgcggagggaggagtcgcggttcggttgcggcgcggcgtgggaggtgggtngtttnggtcgtcgtcgtnggggattatttagtagtattcgttcgtttttttcgcgtttttcgaagtatttaattcgcgcgggtttcgaagcggaattcgttttcgggtgttttttatttcgttaagtcggttttcgagcggcggtcgtttttattttttgtagttttcgcgtttcggtttttttcgggtttttaagtcgcgttttcgtttatcgtttaggattgttcggatatacgntacgcgagattcggagattcgagcgnttttattttttttcgaaggggtcggatttaggagtcgggaggagggtaaggcgcggagggagaacgagcgtgcggatgtggaaggaaagggaaagggaaggggaatttcgttcgggtcgttatgttagcgcgcggcgttttgtttacgagtaattgaaattttacgnagtaattgaaattttacgtagttcgcgttcgt

SEQ ID NO: 25360 - DNA, 1000 bp, Artificial Sequence
  chemically treated genomic DNA (Homo sapiens) CpG-island No: 25360
  misc_feature (33)..(33): n is either a, c, g or t
  misc_feature (200)..(200): n is either a, c, g or t
  misc_feature (226)..(226): n is either a, c, g or t
  misc_feature (445)..(445): n is either a, c, g or t
  misc_feature (458)..(458): n is either a, c, g or t
  misc_feature (463)..(463): n is either a, c, g or t
  misc_feature (523)..(523): n is either a, c, g or t
  misc_feature (528)..(528): n is either a, c, g or t
  misc_feature (550)..(550): n is either a, c, g or t
  misc_feature (939)..(939): n is either a, c, g or t
acgaacgcgaactacgtaaaatttcaattactncgtaaaatttcaattactcgtaaacaaaacgccgcgcgctaacataacgacccgaacgaaattccccttccctttccctttccttccacatccgcacgctcgttctccctccgcgccttaccctcctcccgactcctaaatccgaccccttcgaaaaaaaataaaancgctcgaatctccgaatctcgcgtancgtatatccgaacaatcctaaacgataaacgaaaacgcgacttaaaaacccgaaaaaaaccgaaacgcgaaaactacaaaaaataaaaacgaccgccgctcgaaaaccgacttaacgaaataaaaaacacccgaaaacgaattccgcttcgaaacccgcgcgaattaaatacttcgaaaaacgcgaaaaaaacgaacgaatactactaaataatccccnacgacgacgaccnaaacnacccacctcccacgccgcgccgcaaccgaaccgcgactcctccctccgcgatccttcccntcctncttccctcccgtcttctccccntcccctcccctcccctcccgactccgcttaactccgaacaaataaaaccgaactccgaacgcgcgcgaaaccgcaacaactactcccgatctcgcctcgacccaacgcaaaacctcgcacgcccataaccgactcgaaacaacaacgaccgcgacgacgaaacgacgaaaactcgaacgcgacaacgacgacgacgacgcccctacaaaacgcgaaactaaccctaaccgacatcaacatactactcaacaacgacttcaaaaaatcgaaccaacttttcaaacaatacaaataacccacgcgtccccgattccccaaccctacaacgcgcacctcgtatccgactcacgcgcctcgacctacgacccccgaaaaccccctccccctcnctatcgatcaccgattccgatcctcaaatctcctccctaacaaaatcaaccaaaaaaaata

SEQ ID NO: 25361 - DNA, 511 bp, Artificial Sequence
  chemically treated genomic DNA (Homo sapiens) CpG-island No: 25361
  misc_feature (427)..(427): n is either a, c, g or t
ttagggttcgggtttggggcggcgttggtcggggcgggcgggcggcgggtaagacgttatttgcgcgcgtgtcgggtattttagtcgtcgtcgcgtcgtcgcgattaggcgcgttatgggtttgatgtcggtcgcgcgggtttatttcgggtgtagcgtttgttcgcggtcgttttgtcgtttgttcgtatgttgcgcgttcgtcgttttaggtaggggcgggacggggtgcgggcgttttcgggttcgttagagaagttgcgttttcgggttatagaggcgttcgaagttgggataagaatagcgggcgagagcgtcgcgtatgcgtttcgcgggggtcggcggggagtttgggggagtttgggtgttatcgcggatttggtgttgcgggacggtttttagggggcgagggtcgtgcgtgtttaangggaagaaatagggatcggaggcgttttttaattttttgttggttgtgggcgtttcgtaggaagagataaggatttagagtttg

SEQ ID NO: 25362 - DNA, 511 bp, Artificial Sequence
  chemically treated genomic DNA (Homo sapiens) CpG-island No: 25362
  misc_feature (85)..(85): n is either a, c, g or t
caaactctaaatccttatctcttcctacgaaacgcccacaaccaacaaaaaattaaaaaacgcctccgatccctatttcttcccnttaaacacgcacgaccctcgccccctaaaaaccgtcccgcaacaccaaatccgcgataacacccaaactcccccaaactccccgccgacccccgcgaaacgcatacgcgacgctctcgcccgctattcttatcccaacttcgaacgcctctataacccgaaaacgcaacttctctaacgaacccgaaaacgcccgcaccccgtcccgcccctacctaaaacgacgaacgcgcaacatacgaacaaacgacaaaacgaccgcgaacaaacgctacacccgaaataaacccgcgcgaccgacatcaaacccataacgcgcctaatcgcgacgacgcgacgacgactaaaatacccgacacgcgcgcaaataacgtcttacccgccgcccgcccgccccgaccaacgccgccccaaacccgaaccctaa

SEQ ID NO: 25363 - DNA, 511 bp, Artificial Sequence
  chemically treated genomic DNA (Homo sapiens) CpG-island No: 25363
  misc_feature (85)..(85): n is either a, c, g or t
tagattttaagtttttgtttttttttgcgggacgtttatagttagtaggagattgaaggacgttttcggtttttgtttttttttnttggatacgtacgattttcgttttttgggaatcgtttcgtagtattagattcgcggtgatatttaaatttttttaggtttttcgtcgattttcgcgagacgtatgcgcggcgttttcgttcgttgtttttgttttagtttcgagcgtttttatggttcggagacgtagtttttttggcgggttcgggggcgttcgtatttcgtttcgtttttatttggggcggcgggcgcgtagtatgcgggtaggcggtagggcggtcgcgggtaggcgttgtattcggagtaggttcgcgcggtcggtattaggtttatggcgcgtttagtcgcggcggcgcggcggcggttggaatgttcggtacgcgcgtaggtagcgttttgttcgtcgttcgttcgtttcggttagcgtcgttttaggttcggattttga

SEQ ID NO: 25364 - DNA, 511 bp, Artificial Sequence
  chemically treated genomic DNA (Homo sapiens) CpG-island No: 25364
  misc_feature (427)..(427): n is either a, c, g or t
tcaaaatccgaacctaaaacgacgctaaccgaaacgaacgaacgacgaacaaaacgctacctacgcgcgtaccgaacattccaaccgccgccgcgccgccgcgactaaacgcgccataaacctaataccgaccgcgcgaacctactccgaatacaacgcctacccgcgaccgccctaccgcctacccgcatactacgcgcccgccgccccaaataaaaacgaaacgaaatacgaacgcccccgaacccgccaaaaaaactacgtctccgaaccataaaaacgctcgaaactaaaacaaaaacaacgaacgaaaacgccgcgcatacgtctcgcgaaaatcgacgaaaaacctaaaaaaatttaaatatcaccgcgaatctaatactacgaaacgattcccaaaaaacgaaaatcgtacgtatccaanaaaaaaaaacaaaaaccgaaaacgtccttcaatctcctactaactataaacgtcccgcaaaaaaaaacaaaaacttaaaatcta

SEQ ID NO: 25365 - DNA, 626 bp, Artificial Sequence
  chemically treated genomic DNA (Homo sapiens) CpG-island No: 25365
  misc_feature (28)..(28): n is either a, c, g or t
  misc_feature (82)..(82): n is either a, c, g or t
  misc_feature (414)..(414): n is either a, c, g or t
  misc_feature (489)..(489): n is either a, c, g or t
  misc_feature (503)..(503): n is either a, c, g or t
  misc_feature (507)..(507): n is either a, c, g or t
  misc_feature (521)..(521): n is either a, c, g or t
  misc_feature (528)..(528): n is either a, c, g or t
  misc_feature (536)..(536): n is either a, c, g or t
  misc_feature (544)..(544): n is either a, c, g or t
  misc_feature (557)..(557): n is either a, c, g or t
  misc_feature (565)..(565): n is either a, c, g or t
tttcgggcggcggggacggtcgggttgnataggtcgttttagagggagaaagtggtatcgttattcgtgttcgggttggggngtcgtcggttatcgtcgagggcggtcgtacgtttcgtttagcgcggaggatagtagcgtgttcggtttgttaaggagcggcggtcgtagcggcggtcgtagcggcggaaggggtcggcgttcgacggtcgggggcggggtggggtggcggtttcggttcgttaggcggcggtcgggggaagtggttgtcgtttttggcggcggttagggttcgttaggttgtagggtcgggtttcggttcgggttcggattcggtttcggttgcgattttttcgggtttaggttggggttgtttcggttcgtaggtttcgttcggttcggttcgcggggggncgtttatttggcggcggcggcggcgattgtaggttaaagtttcggtcgcgcgcgtttttagcgtcggttgcgggnagttataatatggncgancggcgatggcgggncggggtntgcggttntcgggggncggagcgggggtngggagttnggtttggtcggcgggattttggttgggggttgttcgcggcggggggattgggggggggggg

SEQ ID NO: 25366 - DNA, 626 bp, Artificial Sequence
  chemically treated genomic DNA (Homo sapiens) CpG-island No: 25366
  misc_feature (62)..(62): n is either a, c, g or t
  misc_feature (70)..(70): n is either a, c, g or t
  misc_feature (83)..(83): n is either a, c, g or t
  misc_feature (91)..(91): n is either a, c, g or t
  misc_feature (99)..(99): n is either a, c, g or t
  misc_feature (106)..(106): n is either a, c, g or t
  misc_feature (120)..(120): n is either a, c, g or t
  misc_feature (124)..(124): n is either a, c, g or t
  misc_feature (138)..(138): n is either a, c, g or t
  misc_feature (213)..(213): n is either a, c, g or t
  misc_feature (545)..(545): n is either a, c, g or t
  misc_feature (599)..(599): n is either a, c, g or t
ccccccccccccaatccccccgccgcgaacaacccccaaccaaaatcccgccgaccaaaccnaactcccnacccccgctccgncccccganaaccgcanaccccgncccgccatcgccgntcgnccatattataactncccgcaaccgacgctaaaaacgcgcgcgaccgaaactttaacctacaatcgccgccgccgccgccaaataaacgnccccccgcgaaccgaaccgaacgaaacctacgaaccgaaacaaccccaacctaaacccgaaaaaatcgcaaccgaaaccgaatccgaacccgaaccgaaacccgaccctacaacctaacgaaccctaaccgccgccaaaaacgacaaccacttcccccgaccgccgcctaacgaaccgaaaccgccaccccaccccgcccccgaccgtcgaacgccgaccccttccgccgctacgaccgccgctacgaccgccgctccttaacaaaccgaacacgctactatcctccgcgctaaacgaaacgtacgaccgccctcgacgataaccgacgacnccccaacccgaacacgaataacgataccactttctccctctaaaacgacctatncaacccgaccgtccccgccgcccgaaa

SEQ ID NO: 25367 - DNA, 626 bp, Artificial Sequence
  chemically treated genomic DNA (Homo sapiens) CpG-island No: 25367
  misc_feature (62)..(62): n is either a, c, g or t
  misc_feature (70)..(70): n is either a, c, g or t
  misc_feature (83)..(83): n is either a, c, g or t
  misc_feature (91)..(91): n is either a, c, g or t
  misc_feature (99)..(99): n is either a, c, g or t
  misc_feature (106)..(106): n is either a, c, g or t
  misc_feature (120)..(120): n is either a, c, g or t
  misc_feature (124)..(124): n is either a, c, g or t
  misc_feature (138)..(138): n is either a, c, g or t
  misc_feature (213)..(213): n is either a, c, g or t
  misc_feature (545)..(545): n is either a, c, g or t
  misc_feature (599)..(599): n is either a, c, g or t
ttttttttttttaattttttcgtcgcgggtagtttttagttagggtttcgtcggttaggttnggtttttngttttcgtttcgnttttcggnagtcgtangtttcgnttcgttatcgtcgntcgnttatgttgtggttnttcgtagtcggcgttggggacgcgcgcggtcgagattttggtttgtagtcgtcgtcgtcgtcgttaggtaagcgntttttcgcgggtcgggtcgagcggggtttgcgggtcggggtagttttagtttgggttcgggaggatcgtagtcgggatcgagttcgagttcgagtcggggttcggttttgtagtttggcggattttggtcgtcgttagaggcggtagttatttttttcgatcgtcgtttggcgggtcggggtcgttattttatttcgttttcggtcgtcgggcgtcggtttttttcgtcgttgcgatcgtcgttgcgatcgtcgttttttggtaggtcgggtacgttgttgtttttcgcgttgggcgggacgtgcggtcgttttcggcgatagtcggcggtnttttagttcgggtacggataacggtgttattttttttttttgggacggtttgtntagttcgatcgttttcgtcgttcgaag

SEQ ID NO: 25368 - DNA, 626 bp, Artificial Sequence
  chemically treated genomic DNA (Homo sapiens) CpG-island No: 25368
  misc_feature (28)..(28): n is either a, c, g or t
  misc_feature (82)..(82): n is either a, c, g or t
  misc_feature (414)..(414): n is either a, c, g or t
  misc_feature (489)..(489): n is either a, c, g or t
  misc_feature (503)..(503): n is either a, c, g or t
  misc_feature (507)..(507): n is either a, c, g or t
  misc_feature (521)..(521): n is either a, c, g or t
  misc_feature (528)..(528): n is either a, c, g or t
  misc_feature (536)..(536): n is either a, c, g or t
  misc_feature (544)..(544): n is either a, c, g or t
  misc_feature (557)..(557): n is either a, c, g or t
  misc_feature (565)..(565): n is either a, c, g or t
cttcgaacgacgaaaacgatcgaactanacaaaccgtcccaaaaaaaaaaaataacaccgttatccgtacccgaactaaaanaccgccgactatcgccgaaaacgaccgcacgtcccgcccaacgcgaaaaacaacaacgtacccgacctaccaaaaaacgacgatcgcaacgacgatcgcaacgacgaaaaaaaccgacgcccgacgaccgaaaacgaaataaaataacgaccccgacccgccaaacgacgatcgaaaaaaataactaccgcctctaacgacgaccaaaatccgccaaactacaaaaccgaaccccgactcgaactcgaactcgatcccgactacgatcctcccgaacccaaactaaaactaccccgacccgcaaaccccgctcgacccgacccgcgaaaaancgcttacctaacgacgacgacgacgactacaaaccaaaatctcgaccgcgcgcgtccccaacgccgactacgaanaaccacaacataancgancgacgataacgaancgaaacntacgactnccgaaaancgaaacgaaaacnaaaaaccnaacctaaccgacgaaaccctaactaaaaactacccgcgacgaaaaaattaaaaaaaaaaaa

SEQ ID NO: 25369 - DNA, 591 bp, Artificial Sequence
  chemically treated genomic DNA (Homo sapiens) CpG-island No: 25369
  misc_feature (351)..(351): n is either a, c, g or t
tttgtttattcgtcgtatatcgtttaaaaagtttagagatagtatggcggggacggcgagtaggatatcggtaggggaaagggcgcgatgattagcgggcggaattattggagttcgggtcgggtttatattggataggatttcgtagtgtttgtattttcgttttcggggcgggagttggtacggtcgggtacggttttcgtttttcgcgttttttcgttgcggagagttgatagagagatttacgattttgttagtttagttttagggtttggtttcgtcgtgggagggtttttacgttttggttttcgtttgttaaaaatcgattggacgttatttttcgcgttcggntttcgcggttttttatcgaggcggcgatttaagtttagttggggaggttgttttgttattttcggaaggcgggtttttgtgttcgttcggttaatcgcgagtaattttttcggtgtgggcgggtagaagcggtttcgcgtttcggtttgggtatgggtgtgttagtggatgtgtcgtttgatcgtaggttttttggtcgagtaagttttttgcgttatgggaagttgaggaggtgttttt

SEQ ID NO: 25370 - DNA, 591 bp, Artificial Sequence
  chemically treated genomic DNA (Homo sapiens) CpG-island No: 25370
  misc_feature (241)..(241): n is either a, c, g or t
aaaaacacctcctcaacttcccataacgcaaaaaacttactcgaccaaaaaacctacgatcaaacgacacatccactaacacacccatacccaaaccgaaacgcgaaaccgcttctacccgcccacaccgaaaaaattactcgcgattaaccgaacgaacacaaaaacccgccttccgaaaataacaaaacaacctccccaactaaacttaaatcgccgcctcgataaaaaaccgcgaaanccgaacgcgaaaaataacgtccaatcgatttttaacaaacgaaaaccaaaacgtaaaaaccctcccacgacgaaaccaaaccctaaaactaaactaacaaaatcgtaaatctctctatcaactctccgcaacgaaaaaacgcgaaaaacgaaaaccgtacccgaccgtaccaactcccgccccgaaaacgaaaatacaaacactacgaaatcctatccaatataaacccgacccgaactccaataattccgcccgctaatcatcgcgccctttcccctaccgatatcctactcgccgtccccgccatactatctctaaactttttaaacgatatacgacgaataaacaaa

SEQ ID NO: 25371 - DNA, 591 bp, Artificial Sequence
  chemically treated genomic DNA (Homo sapiens) CpG-island No: 25371
  misc_feature (241)..(241): n is either a, c, g or t
gaaagtatttttttagttttttatagcgtaggagatttgttcgattagagaatttacggttagacgatatatttattggtatatttatatttaagtcgggacgcggaatcgtttttattcgtttatatcggagaggttgttcgcgattggtcgggcgggtatagaggttcgtttttcgaaggtggtagaatagtttttttaattaagtttgggtcgtcgtttcggtgaagggtcgcggggntcgagcgcgggaagtggcgtttagtcggtttttggtaggcgagagttagagcgtgagaatttttttacggcgaggttaagttttgagattggattagtaaggtcgtgagtttttttgttagtttttcgtagcgaaggggcgcggggggcggggatcgtgttcgatcgtgttagttttcgtttcggaagcggaagtgtaagtattgcggggttttgtttagtgtgagttcgattcgagttttagtagtttcgttcgttggttatcgcgtttttttttttgtcggtgttttgttcgtcgttttcgttatgttgtttttagattttttggacgatgtgcggcggatgaataag

SEQ ID NO: 25372 - DNA, 591 bp, Artificial Sequence
  chemically treated genomic DNA (Homo sapiens) CpG-island No: 25372
  misc_feature (351)..(351): n is either a, c, g or t
cttattcatccgccgcacatcgtccaaaaaatctaaaaacaacataacgaaaacgacgaacaaaacaccgacaaaaaaaaaaacgcgataaccaacgaacgaaactactaaaactcgaatcgaactcacactaaacaaaaccccgcaatacttacacttccgcttccgaaacgaaaactaacacgatcgaacacgatccccgccccccgcgccccttcgctacgaaaaactaacaaaaaaactcacgaccttactaatccaatctcaaaacttaacctcgccgtaaaaaaattctcacgctctaactctcgcctaccaaaaaccgactaaacgccacttcccgcgctcganccccgcgacccttcaccgaaacgacgacccaaacttaattaaaaaaactattctaccaccttcgaaaaacgaacctctatacccgcccgaccaatcgcgaacaacctctccgatataaacgaataaaaacgattccgcgtcccgacttaaatataaatataccaataaatatatcgtctaaccgtaaattctctaatcgaacaaatctcctacgctataaaaaactaaaaaaatactttc

SEQ ID NO: 25373 - DNA, 876 bp, Artificial Sequence
  chemically treated genomic DNA (Homo sapiens) CpG-island No: 25373
  misc_feature (34)..(34): n is either a, c, g or t
  misc_feature (103)..(103): n is either a, c, g or t
  misc_feature (112)..(112): n is either a, c, g or t
  misc_feature (215)..(215): n is either a, c, g or t
  misc_feature (275)..(275): n is either a, c, g or t
  misc_feature (446)..(446): n is either a, c, g or t
  misc_feature (616)..(616): n is either a, c, g or t
  misc_feature (650)..(650): n is either a, c, g or t
  misc_feature (677)..(677): n is either a, c, g or t
gtcgtcgcggaggtaattgtgatgttacgggtgngaatttttagtttttttggtttatttttagggtcgatggaatcgttcgttttcgtttcggcgttcgggntgggcgttnggtttacgggttttagttaaggtcggcgttttaagggtagcggtttgcgttcggtgttatttagttcgatagtcgagcgttttagttttggttggaattagantttttcgtttatttcgcgggcgatttagtagggttttaggattttagtttttaattattnggttcgcggttcgacgcgagttcgttttcggttttagtttcgtttcggttttagtttcgtttcggtttagtattgggtttcgtttttttcgttggtttgttcgtttttttcgtcggtttgtcggtttttcgcgtgcgtcgttcggggtttgcgagtcgggtcgcgtttttntgtttagtttttgtttcgttttttttatcgcggtatttgtttttattttacgagcgggttttgggttcggttttttttttagtttattttttaattgtgagcgtcgttttgatttatatcgtttttcgtttaggttttcgtttttataggatttttgcgtgaagtttaanttttgagttttagttcggtcgagttttcggtttnagtcgtgaattttagtttcggtttcgnttttcgtttagtttttaatttcgttttatgttggcgtagttttcgtcggtttttttagttcggttttaggttgcgtagtttttttagttgggttttagcgttagtcgcgttttttattcggggttttcggcgttttttaggtttttttttattttagattttaattttataggtttagtttttattatttatttttggt

SEQ ID NO: 25374 - DNA, 876 bp, Artificial Sequence
  chemically treated genomic DNA (Homo sapiens) CpG-island No: 25374
  misc_feature (200)..(200): n is either a, c, g or t
  misc_feature (227)..(227): n is either a, c, g or t
  misc_feature (261)..(261): n is either a, c, g or t
  misc_feature (431)..(431): n is either a, c, g or t
  misc_feature (602)..(602): n is either a, c, g or t
  misc_feature (662)..(662): n is either a, c, g or t
  misc_feature (765)..(765): n is either a, c, g or t
  misc_feature (774)..(774): n is either a, c, g or t
  misc_feature (843)..(843): n is either a, c, g or t
accaaaaataaataataaaaactaaacctataaaattaaaatctaaaataaaaaaaaacctaaaaaacgccgaaaaccccgaataaaaaacgcgactaacgctaaaacccaactaaaaaaactacgcaacctaaaaccgaactaaaaaaaccgacgaaaactacgccaacataaaacgaaattaaaaactaaacgaaaancgaaaccgaaactaaaattcacgactnaaaccgaaaactcgaccgaactaaaactcaaaanttaaacttcacgcaaaaatcctataaaaacgaaaacctaaacgaaaaacgatataaatcaaaacgacgctcacaattaaaaaataaactaaaaaaaaaaccgaacccaaaacccgctcgtaaaataaaaacaaataccgcgataaaaaaaacgaaacaaaaactaaacanaaaaacgcgacccgactcgcaaaccccgaacgacgcacgcgaaaaaccgacaaaccgacgaaaaaaacgaacaaaccaacgaaaaaaacgaaacccaatactaaaccgaaacgaaactaaaaccgaaacgaaactaaaaccgaaaacgaactcgcgtcgaaccgcgaaccnaataattaaaaactaaaatcctaaaaccctactaaatcgcccgcgaaataaacgaaaaantctaattccaaccaaaactaaaacgctcgactatcgaactaaataacaccgaacgcaaaccgctacccttaaaacgccgaccttaactaaaacccgtaaaccnaacgcccancccgaacgccgaaacgaaaacgaacgattccatcgaccctaaaaataaaccaaaaaaactaaaaattcncacccgtaacatcacaattacctccgcgacgac

SEQ ID NO: 25375 - DNA, 876 bp, Artificial Sequence
  chemically treated genomic DNA (Homo sapiens) CpG-island No: 25375
  misc_feature (200)..(200): n is either a, c, g or t
  misc_feature (227)..(227): n is either a, c, g or t
  misc_feature (261)..(261): n is either a, c, g or t
  misc_feature (431)..(431): n is either a, c, g or t
  misc_feature (602)..(602): n is either a, c, g or t
  misc_feature (662)..(662): n is either a, c, g or t
  misc_feature (765)..(765): n is either a, c, g or t
  misc_feature (774)..(774): n is either a, c, g or t
  misc_feature (843)..(843): n is either a, c, g or t
attagagatgggtggtgagagttgggtttgtaaggttaaggtttgagataaagaggggtttgggaggcgtcggaggtttcggatgaagaacgcggttgacgttgagatttagttgggaagattacgtagtttggagtcgggttggggaggtcggcgggggttgcgttagtatgaggcggggttaggggttaggcgggggncgaagtcgagattggagtttacggttngggtcgagggttcggtcgggttgaggtttagggnttggattttacgtaagagttttgtagagacgaagatttgggcggagagcgatgtgggttaggacgacgtttataattgaaagatggattaaggaaaagatcgagtttaaggttcgttcgtgggatgagagtagatgtcgcggtaagaggggcggggtaggggttgggtangagggcgcggttcggttcgtagatttcgagcggcgtacgcgggaagtcggtaaatcgacgagggagacgggtaaattaacgagagaggcggggtttagtgttgggtcggggcggagttagggtcggggcggagttagggtcgggggcgggttcgcgtcgagtcgcgggttnaatgattgaggattggggttttgaggttttgttgggtcgttcgcgggatgggcgggaagntttggttttagttagagttggaacgttcggttatcggattgggtggtatcgggcgtaggtcgttgtttttgaagcgtcggttttggttggagttcgtggattnagcgtttanttcggacgtcggggcgggagcgggcggttttatcgattttgagggtggattaaggagattgagggtttntattcgtggtattataattattttcgcggcggt

SEQ ID NO: 25376 - DNA, 876 bp, Artificial Sequence
  chemically treated genomic DNA (Homo sapiens) CpG-island No: 25376
  misc_feature (34)..(34): n is either a, c, g or t
  misc_feature (103)..(103): n is either a, c, g or t
  misc_feature (112)..(112): n is either a, c, g or t
  misc_feature (215)..(215): n is either a, c, g or t
  misc_feature (275)..(275): n is either a, c, g or t
  misc_feature (446)..(446): n is either a, c, g or t
  misc_feature (616)..(616): n is either a, c, g or t
  misc_feature (650)..(650): n is either a, c, g or t
  misc_feature (677)..(677): n is either a, c, g or t
accgccgcgaaaataattataataccacgaatanaaaccctcaatctccttaatccaccctcaaaatcgataaaaccgcccgctcccgccccgacgtccgaantaaacgctnaatccacgaactccaaccaaaaccgacgcttcaaaaacaacgacctacgcccgataccacccaatccgataaccgaacgttccaactctaactaaaaccaaancttcccgcccatcccgcgaacgacccaacaaaacctcaaaaccccaatcctcaatcattnaacccgcgactcgacgcgaacccgcccccgaccctaactccgccccgaccctaactccgccccgacccaacactaaaccccgcctctctcgttaatttacccgtctccctcgtcgatttaccgacttcccgcgtacgccgctcgaaatctacgaaccgaaccgcgccctcntacccaacccctaccccgcccctcttaccgcgacatctactctcatcccacgaacgaaccttaaactcgatcttttccttaatccatctttcaattataaacgtcgtcctaacccacatcgctctccgcccaaatcttcgtctctacaaaactcttacgtaaaatccaanccctaaacctcaacccgaccgaaccctcgacccnaaccgtaaactccaatctcgacttcgncccccgcctaacccctaaccccgcctcatactaacgcaacccccgccgacctccccaacccgactccaaactacgtaatcttcccaactaaatctcaacgtcaaccgcgttcttcatccgaaacctccgacgcctcccaaacccctctttatctcaaaccttaaccttacaaacccaactctcaccacccatctctaat

SEQ ID NO: 25377 - DNA, 599 bp, Artificial Sequence
  chemically treated genomic DNA (Homo sapiens) CpG-island No: 25377
  misc_feature (138)..(138): n is either a, c, g or t
  misc_feature (428)..(428): n is either a, c, g or t
  misc_feature (517)..(517): n is either a, c, g or t
  misc_feature (538)..(538): n is either a, c, g or t
  misc_feature (540)..(540): n is either a, c, g or t
  misc_feature (561)..(561): n is either a, c, g or t
  misc_feature (569)..(569): n is either a, c, g or t
  misc_feature (588)..(588): n is either a, c, g or t
gttaggacgcgattttttcgtacgggtgttagaatgtttattttgtttgcggttttgtagggcgttttgagaaggcgtcgaggtcggattcgcgttagcgattcgggcgcgtggagattcgacgattattcgcggttnggggtgtttcgattataattcggggttacggggattttacgggagttcgcggtttcggagacgttacgattatcgcgggttacggagatgaaataattattcggggtcgcggcgagtttaaaattattcgggttttgggcgtttcgaagatgattttggggcgaggagatttttcggtcgttaattgggggcggggagtttcgtttggtgggggtcgggttcgcgtagattttacgattacgcggggtcggatagtttttacgattacgcggggtcggatggtttttatnaataattcggggtcgcggagattcgacgttatttcggggttgaggttgttttattattatagagcggttcgggggcgcggagcggtttngttatacggggttagtgtggngntaggggcggcgttgttaaggnttcgtagngtcgttgaaggagggggtngaggggtttag

SEQ ID NO: 25378 - DNA, 599 bp, Artificial Sequence
  chemically treated genomic DNA (Homo sapiens) CpG-island No: 25378
  misc_feature (12)..(12): n is either a, c, g or t
  misc_feature (31)..(31): n is either a, c, g or t
  misc_feature (39)..(39): n is either a, c, g or t
  misc_feature (60)..(60): n is either a, c, g or t
  misc_feature (62)..(62): n is either a, c, g or t
  misc_feature (83)..(83): n is either a, c, g or t
  misc_feature (172)..(172): n is either a, c, g or t
  misc_feature (462)..(462): n is either a, c, g or t
ctaaacccctcnaccccctccttcaacgacnctacgaanccttaacaacgccgcccctancnccacactaaccccgtataacnaaaccgctccgcgcccccgaaccgctctataataataaaacaacctcaaccccgaaataacgtcgaatctccgcgaccccgaattattnataaaaaccatccgaccccgcgtaatcgtaaaaactatccgaccccgcgtaatcgtaaaatctacgcgaacccgacccccaccaaacgaaactccccgcccccaattaacgaccgaaaaatctcctcgccccaaaatcatcttcgaaacgcccaaaacccgaataattttaaactcgccgcgaccccgaataattatttcatctccgtaacccgcgataatcgtaacgtctccgaaaccgcgaactcccgtaaaatccccgtaaccccgaattataatcgaaacaccccnaaccgcgaataatcgtcgaatctccacgcgcccgaatcgctaacgcgaatccgacctcgacgccttctcaaaacgccctacaaaaccgcaaacaaaataaacattctaacacccgtacgaaaaaatcgcgtcctaac

SEQ ID NO: 25379 - DNA, 599 bp, Artificial Sequence
  chemically treated genomic DNA (Homo sapiens) CpG-island No: 25379
  misc_feature (12)..(12): n is either a, c, g or t
  misc_feature (31)..(31): n is either a, c, g or t
  misc_feature (39)..(39): n is either a, c, g or t
  misc_feature (60)..(60): n is either a, c, g or t
  misc_feature (62)..(62): n is either a, c, g or t
  misc_feature (83)..(83): n is either a, c, g or t
  misc_feature (172)..(172): n is either a, c, g or t
  misc_feature (462)..(462): n is either a, c, g or t
ttgggttttttngtttttttttttagcggtnttgcgggnttttggtagcgtcgtttttgntnttatattgatttcgtgtggtngggtcgtttcgcgttttcgggtcgttttgtaatggtagggtagttttagtttcgagatgacgtcgggttttcgcggtttcgggttattngtaggaattattcggtttcgcgtaatcgtaggaattattcggtttcgcgtaatcgtagggtttgcgcgggttcggtttttattagacgggatttttcgtttttaattggcggtcgaagagttttttcgttttagagttattttcgggacgtttagggttcgggtgattttgggttcgtcgcggtttcgggtgattgttttattttcgtggttcgcggtggtcgtagcgttttcgagatcgcggattttcgtagggttttcgtggtttcgagttgtagtcgggatattttnggtcgcgggtgatcgtcgggtttttacgcgttcgggtcgttgacgcggattcggtttcggcgtttttttagggcgttttgtaaggtcgtaggtaggatgaatattttggtattcgtgcggagggatcgcgttttggt

SEQ ID NO: 25380 - DNA, 599 bp, Artificial Sequence
  chemically treated genomic DNA (Homo sapiens) CpG-island No: 25380
  misc_feature (138)..(138): n is either a, c, g or t
  misc_feature (428)..(428): n is either a, c, g or t
  misc_feature (517)..(517): n is either a, c, g or t
  misc_feature (538)..(538): n is either a, c, g or t
  misc_feature (540)..(540): n is either a, c, g or t
  misc_feature (561)..(561): n is either a, c, g or t
  misc_feature (569)..(569): n is either a, c, g or t
  misc_feature (588)..(588): n is either a, c, g or t
accaaaacgcgatccctccgcacgaataccaaaatattcatcctacctacgaccttacaaaacgccctaaaaaaacgccgaaaccgaatccgcgtcaacgacccgaacgcgtaaaaacccgacgatcacccgcgaccnaaaatatcccgactacaactcgaaaccacgaaaaccctacgaaaatccgcgatctcgaaaacgctacgaccaccgcgaaccacgaaaataaaacaatcacccgaaaccgcgacgaacccaaaatcacccgaaccctaaacgtcccgaaaataactctaaaacgaaaaaactcttcgaccgccaattaaaaacgaaaaatcccgtctaataaaaaccgaacccgcgcaaaccctacgattacgcgaaaccgaataattcctacgattacgcgaaaccgaataattcctacnaataacccgaaaccgcgaaaacccgacgtcatctcgaaactaaaactaccctaccattacaaaacgacccgaaaacgcgaaacgacccnaccacacgaaatcaatataanancaaaaacgacgctaccaaaancccgcaanaccgctaaaaaaaaaaacnaaaaaacccaa

SEQ ID NO: 25381 - DNA, 695 bp, Artificial Sequence
  chemically treated genomic DNA (Homo sapiens) CpG-island No: 25381
  misc_feature (381)..(381): n is either a, c, g or t
  misc_feature (395)..(395): n is either a, c, g or t
  misc_feature (540)..(540): n is either a, c, g or t
  misc_feature (654)..(654): n is either a, c, g or t
ttcgcgggcgcgggagggataggtaaatacgggatttcggttagaagattgcgagtggtgcggtaggggtattgggtttgtacggagattattgtcggacgcggggtttcggagtttattttaggattaggatttagggggcgtgggcgtgtcgggtttcgtttagttttgcgtagaaagtagagggcggagagagttttcgcggtattcgtttagggcggggtagtcggtggttcggggaaaagtggggacgcgggttaatgaggttaggcgagcgagggtagcggggatttcgtcggtagtcgggaggcgttagcgaggggtgtttcggcgacgacgtttttagtatagtttttagttattcgaagttcgcgggagttnggtcggtggtcgangaggttacggggatattcggttcgcgcggtagtagcgtttgaggggcgggggtaggcggacggggcgggggtaggcgggcggggcgggggcgcgggcggttgggggcgggggtagaggtttcgtagggagggcgaggaggagttnaaggggtttagagggtttcgttaattgtgtggggttggcggtcggcgggagaggcggtcggtttggattggttcgagagggatttcggtttttagaatagatttaggaggcggntttcgagggcggacggtagggagggttagtatgtttcgatt

SEQ ID NO: 25382 - DNA, 695 bp, Artificial Sequence
  chemically treated genomic DNA (Homo sapiens) CpG-island No: 25382
  misc_feature (42)..(42): n is either a, c, g or t
  misc_feature (156)..(156): n is either a, c, g or t
  misc_feature (301)..(301): n is either a, c, g or t
  misc_feature (315)..(315): n is either a, c, g or t
aatcgaaacatactaaccctccctaccgtccgccctcgaaanccgcctcctaaatctattctaaaaaccgaaatccctctcgaaccaatccaaaccgaccgcctctcccgccgaccgccaaccccacacaattaacgaaaccctctaaaccccttnaactcctcctcgccctccctacgaaacctctacccccgcccccaaccgcccgcgcccccgccccgcccgcctacccccgccccgtccgcctacccccgcccctcaaacgctactaccgcgcgaaccgaatatccccgtaacctcntcgaccaccgaccnaactcccgcgaacttcgaataactaaaaactatactaaaaacgtcgtcgccgaaacacccctcgctaacgcctcccgactaccgacgaaatccccgctaccctcgctcgcctaacctcattaacccgcgtccccacttttccccgaaccaccgactaccccgccctaaacgaataccgcgaaaactctctccgccctctactttctacgcaaaactaaacgaaacccgacacgcccacgccccctaaatcctaatcctaaaataaactccgaaaccccgcgtccgacaataatctccgtacaaacccaatacccctaccgcaccactcgcaatcttctaaccgaaatcccgtatttacctatccctcccgcgcccgcgaa

SEQ ID NO: 25383 - DNA, 695 bp, Artificial Sequence
  chemically treated genomic DNA (Homo sapiens) CpG-island No: 25383
  misc_feature (42)..(42): n is either a, c, g or t
  misc_feature (156)..(156): n is either a, c, g or t
  misc_feature (301)..(301): n is either a, c, g or t
  misc_feature (315)..(315): n is either a, c, g or t
agtcggggtatgttggttttttttgtcgttcgttttcgaggntcgttttttaggtttgttttgggaatcgggatttttttcgggttagtttaggtcggtcgtttttttcgtcggtcgttagttttatatagttggcgaagttttttaggttttttnggttttttttcgttttttttgcgaggtttttgttttcgtttttagtcgttcgcgttttcgtttcgttcgtttgttttcgtttcgttcgtttgttttcgttttttaggcgttgttgtcgcgcgagtcgggtgttttcgtggttttntcggttatcggttnggttttcgcggatttcgggtaattaggagttgtgttgggggcgtcgtcgtcgagatatttttcgttggcgtttttcgattgtcgacggagttttcgttgttttcgttcgtttggttttattaattcgcgtttttattttttttcgggttatcggttatttcgttttgggcgggtatcgcgagagtttttttcgttttttattttttgcgtagagttggacgggattcgatacgtttacgttttttaagttttggttttggggtgggtttcggagtttcgcgttcgatagtggttttcgtgtagatttagtgtttttatcgtattattcgtagttttttggtcggagtttcgtgtttatttgtttttttcgcgttcgcgag

SEQ ID NO: 25384 - DNA, 695 bp, Artificial Sequence
  chemically treated genomic DNA (Homo sapiens) CpG-island No: 25384
  misc_feature (381)..(381): n is either a, c, g or t
  misc_feature (395)..(395): n is either a, c, g or t
  misc_feature (540)..(540): n is either a, c, g or t
  misc_feature (654)..(654): n is either a, c, g or t
ctcgcgaacgcgaaaaaaacaaataaacacgaaactccgaccaaaaaactacgaataatacgataaaaacactaaatctacacgaaaaccactatcgaacgcgaaactccgaaacccaccccaaaaccaaaacttaaaaaacgtaaacgtatcgaatcccgtccaactctacgcaaaaaataaaaaacgaaaaaaactctcgcgatacccgcccaaaacgaaataaccgataacccgaaaaaaaataaaaacgcgaattaataaaaccaaacgaacgaaaacaacgaaaactccgtcgacaatcgaaaaacgccaacgaaaaatatctcgacgacgacgcccccaacacaactcctaattacccgaaatccgcgaaaaccnaaccgataaccganaaaaccacgaaaacacccgactcgcgcgacaacaacgcctaaaaaacgaaaacaaacgaacgaaacgaaaacaaacgaacgaaacgaaaacgcgaacgactaaaaacgaaaacaaaaacctcgcaaaaaaaacgaaaaaaaaccnaaaaaacctaaaaaacttcgccaactatataaaactaacgaccgacgaaaaaaacgaccgacctaaactaacccgaaaaaaatcccgattcccaaaacaaacctaaaaaacgancctcgaaaacgaacgacaaaaaaaaccaacataccccgact

SEQ ID NO: 25385 - DNA, 651 bp, Artificial Sequence
  chemically treated genomic DNA (Homo sapiens) CpG-island No: 25385
  misc_feature (457)..(457): n is either a, c, g or t
  misc_feature (465)..(465): n is either a, c, g or t
  misc_feature (478)..(478): n is either a, c, g or t
  misc_feature (491)..(491): n is either a, c, g or t
  misc_feature (505)..(505): n is either a, c, g or t
  misc_feature (512)..(512): n is either a, c, g or t
  misc_feature (524)..(524): n is either a, c, g or t
  misc_feature (590)..(590): n is either a, c, g or t
  misc_feature (621)..(621): n is either a, c, g or t
ggcgcgggggtttcggaaaagggttcgcgtattttggttttgttgagtaggagttttacgaaggtggagagtagtagggacggggagagaggggagcgcggtcgtagttttttggcgagggcgggaaagggggcggcgggggggttttcgggtagggttacggtgtacgaggtgcgtatgttggggggcgggcggcgggttttggttttcgtttaacgttggtagcgggggcgcggggggagttttcgcgcggtgttatagttcggacgtcgaggtcggcgagatcgttataggatagcgttcgcggcgttcgaacgcgcgttttttcgttttaattttttcggcgtgcgtcgttaatagttcgggtttcggttttcgcgtttcggtcgattggcggtttcgtcggcgtttcgggtttcgcgacgttagcgttggggcggggttaggttttaagttntcgttttnatttcgtttttantttcgttttcggncgtcggtacgcggnattcganacgaggcgatanagggcggttttttttcgtcgggtttttttcgcgtttttcggcgtttttagttcgttgattttcggnttaggtaggttcgcgggggaggtaggatcgngagttttgaggttttggtcggtttcggggt

SEQ ID NO: 25386 - DNA, 651 bp, Artificial Sequence
  chemically treated genomic DNA (Homo sapiens) CpG-island No: 25386
  misc_feature (31)..(31): n is either a, c, g or t
  misc_feature (62)..(62): n is either a, c, g or t
  misc_feature (128)..(128): n is either a, c, g or t
  misc_feature (140)..(140): n is either a, c, g or t
  misc_feature (147)..(147): n is either a, c, g or t
  misc_feature (161)..(161): n is either a, c, g or t
  misc_feature (174)..(174): n is either a, c, g or t
  misc_feature (187)..(187): n is either a, c, g or t
  misc_feature (195)..(195): n is either a, c, g or t
accccgaaaccgaccaaaacctcaaaactcncgatcctacctcccccgcgaacctacctaanccgaaaatcaacgaactaaaaacgccgaaaaacgcgaaaaaaacccgacgaaaaaaaaccgccctntatcgcctcgtntcgaatnccgcgtaccgacgnccgaaaacgaaantaaaaacgaaatnaaaacganaacttaaaacctaaccccgccccaacgctaacgtcgcgaaacccgaaacgccgacgaaaccgccaatcgaccgaaacgcgaaaaccgaaacccgaactattaacgacgcacgccgaaaaaattaaaacgaaaaaacgcgcgttcgaacgccgcgaacgctatcctataacgatctcgccgacctcgacgtccgaactataacaccgcgcgaaaactccccccgcgcccccgctaccaacgttaaacgaaaaccaaaacccgccgcccgccccccaacatacgcacctcgtacaccgtaaccctacccgaaaacccccccgccgccccctttcccgccctcgccaaaaaactacgaccgcgctcccctctctccccgtccctactactctccaccttcgtaaaactcctactcaacaaaaccaaaatacgcgaacccttttccgaaacccccgcgcc

SEQ ID NO: 25387 - DNA, 651 bp, Artificial Sequence
  chemically treated genomic DNA (Homo sapiens) CpG-island No: 25387
  misc_feature (31)..(31): n is either a, c, g or t
  misc_feature (62)..(62): n is either a, c, g or t
  misc_feature (128)..(128): n is either a, c, g or t
  misc_feature (140)..(140): n is either a, c, g or t
  misc_feature (147)..(147): n is either a, c, g or t
  misc_feature (161)..(161): n is either a, c, g or t
  misc_feature (174)..(174): n is either a, c, g or t
  misc_feature (187)..(187): n is either a, c, g or t
  misc_feature (195)..(195): n is either a, c, g or t
atttcgaggtcggttagggttttagggtttncggttttgtttttttcgcgggtttgtttggntcgggggttagcgggttgggggcgtcggggagcgcggggaaggttcggcgggggaggatcgttttntgtcgtttcgtntcgggtntcgcgtgtcggcgntcgggggcggggntagaggcgaggtnggggcggnggtttagggtttggtttcgttttagcgttgacgtcgcggggttcgaggcgtcggcggggtcgttagtcggtcggagcgcgagagtcgggattcgggttgttggcggcgtacgtcggggaggttgaggcggaggagcgcgcgttcgggcgtcgcggacgttgttttgtagcggtttcgtcggtttcggcgttcggattgtggtatcgcgcggggatttttttcgcgttttcgttgttaacgttaagcgagggttaaagttcgtcgttcgttttttagtatgcgtatttcgtatatcgtgattttgttcgaggattttttcgtcgttttttttttcgttttcgttaaggagttgcggtcgcgttttttttttttttcgtttttgttgttttttattttcgtggggtttttgtttaataaagttaaggtacgcgggttttttttcgggattttcgcgtt

SEQ ID NO: 25388 - DNA, 651 bp, Artificial Sequence
  chemically treated genomic DNA (Homo sapiens) CpG-island No: 25388
  misc_feature (457)..(457): n is either a, c, g or t
  misc_feature (465)..(465): n is either a, c, g or t
  misc_feature (478)..(478): n is either a, c, g or t
  misc_feature (491)..(491): n is either a, c, g or t
  misc_feature (505)..(505): n is either a, c, g or t
  misc_feature (512)..(512): n is either a, c, g or t
  misc_feature (524)..(524): n is either a, c, g or t
  misc_feature (590)..(590): n is either a, c, g or t
  misc_feature (621)..(621): n is either a, c, g or t
aacgcgaaaatcccgaaaaaaaacccgcgtaccttaactttattaaacaaaaaccccacgaaaataaaaaacaacaaaaacgaaaaaaaaaaaaaacgcgaccgcaactccttaacgaaaacgaaaaaaaaaacgacgaaaaaatcctcgaacaaaatcacgatatacgaaatacgcatactaaaaaacgaacgacgaactttaaccctcgcttaacgttaacaacgaaaacgcgaaaaaaatccccgcgcgataccacaatccgaacgccgaaaccgacgaaaccgctacaaaacaacgtccgcgacgcccgaacgcgcgctcctccgcctcaacctccccgacgtacgccgccaacaacccgaatcccgactctcgcgctccgaccgactaacgaccccgccgacgcctcgaaccccgcgacgtcaacgctaaaacgaaaccaaaccctaaaccnccgccccnacctcgcctctanccccgcccccgancgccgacacgcganacccganacgaaacgacanaaaacgatcctcccccgccgaaccttccccgcgctccccgacgcccccaacccgctaacccccganccaaacaaacccgcgaaaaaaacaaaaccgnaaaccctaaaaccctaaccgacctcgaaat

SEQ ID NO: 25389 - DNA, 811 bp, Artificial Sequence
  chemically treated genomic DNA (Homo sapiens) CpG-island No: 25389
ttggcgggcggcggcggttatcggcgttttcgttgttttttttcgttagtcgggtcgagagcgtttcggtataaagtttttagttcgcgttatcgtcggcggttcgggattttttaggcgttttttttttagttatattttttcggttttttttttggcgtcgtttcgttggggttgttaggggtacggtcggcggcggttttttttgcggttagggagatttttgcgcgggtgtttttcgtcgagtttaagtcgttttcggttcgttttttcggtttttgttttgcgtatcgtagtcgtcgtcgtcgcggaaatttgcgatttatgaagcgcgggcggcggggagaattcgggtggttagggcgcgtcggggtcgtgtttcgtttttttggttttcggttcgttggttttcggttggcggcgtcgcgttagtggtcgcggtttcgtagagagcgtaatttttcgtagtttagcgggttcggtttttttttgcgttttcgttttttttttcgtcgtcgtcgtttgattatttgtgttaattttttaattcgtttttttttttttgtttcgcgcgttttcggatcggtttttaggcgtttcgtagtttgttttttattaggagggaggagttttgaaatcgacgtagaattggaggtttagggatcgtcgtttaatcgcggtttcggtttttcggcgtaaagggagtcggtcgttttttcgttagagcgaaagttagcggtaggagggcggggtaggaggaggcgggaggaggaggaagtagtggtggtggtattatttaggtataaagagt

SEQ ID NO: 25390 - DNA, 811 bp, Artificial Sequence
  chemically treated genomic DNA (Homo sapiens) CpG-island No: 25390
actctttatacctaaataataccaccaccactacttcctcctcctcccgcctcctcctaccccgccctcctaccgctaactttcgctctaacgaaaaaacgaccgactccctttacgccgaaaaaccgaaaccgcgattaaacgacgatccctaaacctccaattctacgtcgatttcaaaactcctccctcctaataaaaaacaaactacgaaacgcctaaaaaccgatccgaaaacgcgcgaaacaaaaaaaaaaaaacgaattaaaaaattaacacaaataatcaaacgacgacgacgaaaaaaaaaacgaaaacgcaaaaaaaaaccgaacccgctaaactacgaaaaattacgctctctacgaaaccgcgaccactaacgcgacgccgccaaccgaaaaccaacgaaccgaaaaccaaaaaaacgaaacacgaccccgacgcgccctaaccacccgaattctccccgccgcccgcgcttcataaatcgcaaatttccgcgacgacgacgactacgatacgcaaaacaaaaaccgaaaaaacgaaccgaaaacgacttaaactcgacgaaaaacacccgcgcaaaaatctccctaaccgcaaaaaaaaccgccgccgaccgtacccctaacaaccccaacgaaacgacgccaaaaaaaaaaccgaaaaaatataactaaaaaaaaaacgcctaaaaaatcccgaaccgccgacgataacgcgaactaaaaactttataccgaaacgctctcgacccgactaacgaaaaaaaacaacgaaaacgccgataaccgccgccgcccgccaa

SEQ ID NO: 25391 - DNA, 811 bp, Artificial Sequence
  chemically treated genomic DNA (Homo sapiens) CpG-island No: 25391
attttttgtgtttgagtagtgttattattattattttttttttttttcgtttttttttatttcgtttttttgtcgttggttttcgttttggcgaggaggcggtcggttttttttgcgtcgggaagtcggagtcgcgattgggcgacggtttttgagtttttagttttgcgtcggttttaaggttttttttttttggtgaaagatagattacggggcgtttggaaatcggttcgagggcgcgcgaggtagaggagagggagcgagttgagggattgatataaatggttaggcggcggcggcggagaaggaggcggaggcgtaggggggagtcgagttcgttgggttgcggagagttgcgttttttacggggtcgcggttattagcgcggcgtcgttagtcgggagttagcgagtcgagggttaggaaggcgggatacgatttcggcgcgttttagttattcgggtttttttcgtcgttcgcgttttatgaatcgtaagttttcgcggcggcggcggttgcggtacgtagaataggagtcgggggagcgggtcgaaagcggtttgggttcgacggagggtattcgcgtagaggtttttttggtcgtagggggagtcgtcgtcggtcgtgtttttggtagttttagcggagcggcgttaagagaggagtcgagaaagtatggttgaggaggaggcgtttaagaagtttcgggtcgtcggcggtggcgcgagttgggaattttgtgtcggggcgttttcggttcggttggcggaggagggtagcggggacgtcggtggtcgtcgtcgttcgttag

SEQ ID NO: 25392 - DNA, 811 bp, Artificial Sequence
  chemically treated genomic DNA (Homo sapiens) CpG-island No: 25392
ctaacgaacgacgacgaccaccgacgtccccgctaccctcctccgccaaccgaaccgaaaacgccccgacacaaaattcccaactcgcgccaccgccgacgacccgaaacttcttaaacgcctcctcctcaaccatactttctcgactcctctcttaacgccgctccgctaaaactaccaaaaacacgaccgacgacgactccccctacgaccaaaaaaacctctacgcgaataccctccgtcgaacccaaaccgctttcgacccgctcccccgactcctattctacgtaccgcaaccgccgccgccgcgaaaacttacgattcataaaacgcgaacgacgaaaaaaacccgaataactaaaacgcgccgaaatcgtatcccgccttcctaaccctcgactcgctaactcccgactaacgacgccgcgctaataaccgcgaccccgtaaaaaacgcaactctccgcaacccaacgaactcgactcccccctacgcctccgcctccttctccgccgccgccgcctaaccatttatatcaatccctcaactcgctccctctcctctacctcgcgcgccctcgaaccgatttccaaacgccccgtaatctatctttcaccaaaaaaaaaaaaccttaaaaccgacgcaaaactaaaaactcaaaaaccgtcgcccaatcgcgactccgacttcccgacgcaaaaaaaaccgaccgcctcctcgccaaaacgaaaaccaacgacaaaaaaacgaaataaaaaaaaacgaaaaaaaaaaaaaataataataataacactactcaaacacaaaaaat

SEQ ID NO: 25393 - DNA, 539 bp, Artificial Sequence
  chemically treated genomic DNA (Homo sapiens) CpG-island No: 25393
gggtagcgcgcgttggggaatttttggcgcgtggggatcgttaggtttttcgtttcggcgttttgggtaggggttggtttttaaacgcgtacgcggggtagatttcggttatagggacgagttacgcgagggttacgacgaagcgaattagttttaggagaaaggaagcggggtttacgagttgtgttagttagtgtggtattcggggggaggtaggaacgcggggcgaagggtatttttgacgcgatttacggatggtagggcgtaaaggttgatattcgggagcggagggaagtgtcgtttaggatagttgagtattttttttattttcggagaagtgagggcgtgcggatcgttgtgggagtgggcgtcggggaggatcgttcgtatttcgcgagtcgggcgcgtattaagtaggagttcgtttttcgttggggtttgtagcgtttatttgtcgtcgtttttcggtttttttttgtaggtttacgtgtgttttaacgttaggagtagtagtagcggatttaggtttttgtttagtt

SEQ ID NO: 25394 - DNA, 539 bp, Artificial Sequence
  chemically treated genomic DNA (Homo sapiens) CpG-island No: 25394
aactaaacaaaaacctaaatccgctactactactcctaacgttaaaacacacgtaaacctacaaaaaaaaaccgaaaaacgacgacaaataaacgctacaaaccccaacgaaaaacgaactcctacttaatacgcgcccgactcgcgaaatacgaacgatcctccccgacgcccactcccacaacgatccgcacgccctcacttctccgaaaataaaaaaaatactcaactatcctaaacgacacttccctccgctcccgaatatcaacctttacgccctaccatccgtaaatcgcgtcaaaaatacccttcgccccgcgttcctacctccccccgaataccacactaactaacacaactcgtaaaccccgcttcctttctcctaaaactaattcgcttcgtcgtaaccctcgcgtaactcgtccctataaccgaaatctaccccgcgtacgcgtttaaaaaccaacccctacccaaaacgccgaaacgaaaaacctaacgatccccacgcgccaaaaattccccaacgcgcgctaccc

SEQ ID NO: 25395 - DNA, 539 bp, Artificial Sequence
  chemically treated genomic DNA (Homo sapiens) CpG-island No: 25395
agttgggtaggagtttgggttcgttgttgttgtttttggcgttgggatatacgtggatttatagagaggagtcggaggacggcgataggtaagcgttgtaagttttagcggagggcgagtttttgtttgatgcgcgttcggttcgcggggtgcgggcggtttttttcggcgtttatttttatagcgattcgtacgtttttattttttcggggataaggagagtgtttagttgttttgggcgatattttttttcgttttcgggtattagtttttgcgttttgttattcgtgggtcgcgttagggatatttttcgtttcgcgtttttgttttttttcgggtgttatattggttggtatagttcgtgaatttcgtttttttttttttggagttggttcgtttcgtcgtgattttcgcgtggttcgtttttgtggtcggagtttgtttcgcgtacgcgtttggggattagtttttgtttagagcgtcgggacggggagtttggcgatttttacgcgttagggattttttagcgcgcgttgttt

SEQ ID NO: 25396 - DNA, 539 bp, Artificial Sequence
  chemically treated genomic DNA (Homo sapiens) CpG-island No: 25396
aaacaacgcgcgctaaaaaatccctaacgcgtaaaaatcgccaaactccccgtcccgacgctctaaacaaaaactaatccccaaacgcgtacgcgaaacaaactccgaccacaaaaacgaaccacgcgaaaatcacgacgaaacgaaccaactccaaaaaaaaaaaaacgaaattcacgaactataccaaccaatataacacccgaaaaaaaacaaaaacgcgaaacgaaaaatatccctaacgcgacccacgaataacaaaacgcaaaaactaatacccgaaaacgaaaaaaaatatcgcccaaaacaactaaacactctccttatccccgaaaaaataaaaacgtacgaatcgctataaaaataaacgccgaaaaaaaccgcccgcaccccgcgaaccgaacgcgcatcaaacaaaaactcgccctccgctaaaacttacaacgcttacctatcgccgtcctccgactcctctctataaatccacgtatatcccaacgccaaaaacaacaacaacgaacccaaactcctacccaact

SEQ ID NO: 25397 - DNA, 745 bp, Artificial Sequence
  chemically treated genomic DNA (Homo sapiens) CpG-island No: 25397
  misc_feature (116)..(116): n is either a, c, g or t
  misc_feature (569)..(569): n is either a, c, g or t
  misc_feature (586)..(586): n is either a, c, g or t
  misc_feature (610)..(610): n is either a, c, g or t
  misc_feature (641)..(641): n is either a, c, g or t
ttcggttcgcgtcgttttatgtgattcggttcgatatggtgtcgttttttttcggggcggcggcggtggcggttcgggttgggtttcgcgtcgggtcggtttcgcggtcgtttatngggtagttagggtcgttcggggtttttcgggaacggcgggttcggcgagggcgagggcggagaggcgaggaagttgtaggaagggagggtggcgagggggaagcgaaggaaggggaaggggaagggaaaagcgagagcggggtaaggcggaagaggaagcggggcggaagggaagttcgggtcgtagacggcgaaggaggtagtcgggtcgggggttgacgcgggagcgagggtatgtttaagggaggaagtagagggaggtagaagcgtggaggaaggggcgagaggtatcgttaagggagtcgaggggagcgtaggggtcgggaaggaggtataaggaagagagtatgggaagaaggaggaatggagggttagggttaggcggcgggagggcgttaggtcgggaagagtatagggacgagggggttaggtttgggtcgatatcgcggggantaggggtggttatggtngtcgtcggtcggggaggaggaggnagaagaagaaggcggttcgggagtcgattgnttcgttcggtcgcggggtttgcgttttggcgtttgtcggaggagttgttgttgtttatttgtttttatttggatatgcgggttttcggtcgtttggtttaagtg

SEQ ID NO: 25398 - DNA, 745 bp, Artificial Sequence
  chemically treated genomic DNA (Homo sapiens) CpG-island No: 25398
  misc_feature (105)..(105): n is either a, c, g or t
  misc_feature (136)..(136): n is either a, c, g or t
  misc_feature (160)..(160): n is either a, c, g or t
  misc_feature (177)..(177): n is either a, c, g or t
  misc_feature (630)..(630): n is either a, c, g or t
cacttaaaccaaacgaccgaaaacccgcatatccaaataaaaacaaataaacaacaacaactcctccgacaaacgccaaaacgcaaaccccgcgaccgaacgaancaatcgactcccgaaccgccttcttcttctncctcctcctccccgaccgacgacnaccataaccacccctantccccgcgatatcgacccaaacctaaccccctcgtccctatactcttcccgacctaacgccctcccgccgcctaaccctaaccctccattcctccttcttcccatactctcttccttatacctccttcccgacccctacgctcccctcgactcccttaacgatacctctcgccccttcctccacgcttctacctccctctacttcctcccttaaacataccctcgctcccgcgtcaacccccgacccgactacctccttcgccgtctacgacccgaacttcccttccgccccgcttcctcttccgccttaccccgctctcgcttttcccttccccttccccttccttcgcttccccctcgccaccctcccttcctacaacttcctcgcctctccgccctcgccctcgccgaacccgccgttcccgaaaaaccccgaacgaccctaactacccnataaacgaccgcgaaaccgacccgacgcgaaacccaacccgaaccgccaccgccgccgccccgaaaaaaaacgacaccatatcgaaccgaatcacataaaacgacgcgaaccgaa

SEQ ID NO: 25399 - DNA, 745 bp, Artificial Sequence
  chemically treated genomic DNA (Homo sapiens) CpG-island No: 25399
  misc_feature (105)..(105): n is either a, c, g or t
  misc_feature (136)..(136): n is either a, c, g or t
  misc_feature (160)..(160): n is either a, c, g or t
  misc_feature (177)..(177): n is either a, c, g or t
  misc_feature (630)..(630): n is either a, c, g or t
tatttgggttaggcggtcgagggttcgtatgtttaggtaggagtagatgagtagtagtagttttttcggtaggcgttagagcgtaggtttcgcggtcgggcgggntagtcgattttcgagtcgttttttttttttnttttttttttttcggtcggcggtngttatggttatttttgnttttcgcgatgtcggtttaagtttgattttttcgtttttgtgtttttttcggtttggcgttttttcgtcgtttagttttgattttttatttttttttttttttatatttttttttttgtgtttttttttcggtttttgcgtttttttcgatttttttgacgatgtttttcgtttttttttttacgtttttgtttttttttgtttttttttttgggtatgttttcgttttcgcgttagttttcggttcggttgtttttttcgtcgtttgcggttcgggtttttttttcgtttcgttttttttttcgttttgtttcgttttcgttttttttttttttttttttttttttcgtttttttttcgttattttttttttttgtagttttttcgttttttcgttttcgttttcgtcgggttcgtcgttttcggggggtttcgagcggttttggttgtttnatgagcggtcgcggggtcggttcgacgcggagtttagttcgagtcgttatcgtcgtcgtttcgggaggaggcgatattatgtcggatcgggttatatggggcggcgcgggtcgag

SEQ ID NO: 25400 - DNA, 745 bp, Artificial Sequence
  chemically treated genomic DNA (Homo sapiens) CpG-island No: 25400
  misc_feature (116)..(116): n is either a, c, g or t
  misc_feature (569)..(569): n is either a, c, g or t
  misc_feature (586)..(586): n is either a, c, g or t
  misc_feature (610)..(610): n is either a, c, g or t
  misc_feature (641)..(641): n is either a, c, g or t
ctcgacccgcgccgccccatataacccgatccgacataatatcgcctcctcccgaaacgacgacgataacgactcgaactaaactccgcgtcgaaccgaccccgcgaccgctcatnaaacaaccaaaaccgctcgaaaccccccgaaaacgacgaacccgacgaaaacgaaaacgaaaaaacgaaaaaactacaaaaaaaaaaaataacgaaaaaaaaacgaaaaaaaaaaaaaaaaaaaaaaaaaacgaaaacgaaacaaaacgaaaaaaaaaacgaaacgaaaaaaaaacccgaaccgcaaacgacgaaaaaaacaaccgaaccgaaaactaacgcgaaaacgaaaacatacccaaaaaaaaaaacaaaaaaaaacaaaaacgtaaaaaaaaaaacgaaaaacatcgtcaaaaaaatcgaaaaaaacgcaaaaaccgaaaaaaaaacacaaaaaaaaaaatataaaaaaaaaaaaaaataaaaaatcaaaactaaacgacgaaaaaacgccaaaccgaaaaaaacacaaaaacgaaaaaatcaaacttaaaccgacatcgcgaaaancaaaaataaccataacnaccgccgaccgaaaaaaaaaaaanaaaaaaaaaaaacgactcgaaaatcgactancccgcccgaccgcgaaacctacgctctaacgcctaccgaaaaaactactactactcatctactcctacctaaacatacgaaccctcgaccgcctaacccaaata

SEQ ID NO: 25401 - DNA, 924 bp, Artificial Sequence
  chemically treated genomic DNA (Homo sapiens) CpG-island No: 25401
  misc_feature (193)..(193): n is either a, c, g or t
  misc_feature (348)..(348): n is either a, c, g or t
  misc_feature (750)..(750): n is either a, c, g or t
cgcgtcgtcgcggttttttgttttttcgtcgtcgcggttttttgttcgattcggttttttgtttatttattttcgcggtttttttatttttattgtcgtggttttatgtcgtcgcggttttttgttcgttgcggttgtttgtttttttcgatcgtcgcggtttttttattttcgtcgcggtggttttttgttngcggcggttttttgttttttaatttcgtggtttttttttcgtcgtttcgggtttatgttcgtcgcggttttttgtttttttgtcgtcgcggtttttcgttttttaatcgttttcgcggttttttgttcgtttcggtttttcgttttttcgtcgancgcggttttttgatttttgttttcggtgtcgcggttatttgttcgtcgcggttttttgttttttttcgtcgacgcggttttttgtttttcgcgattttttggcgttttcggtgtcgcggttatttgtttatcgcggttttttgtattttcgtcgtcgcggttttttttttttgtcgtcgcggttttttgtcggtttcggttttttgtttcgtcgtcgcgtttttttgttcgttgcggtttttatttttcgttgttgcggttttttgttcgatttggttttttgttttcgttttttttttcgttgtcgcggttttttttttttcgtcgcggttttttgtcgttgcggttttttgtttttttatttatcgtcgcggttttattaaattcgtcgttttggtaggntggtatatcgttttcgcggttttttgtttgtcgcggttttttatttttcgtcgtcgtcgcggttttttgttcgattcggttttttgtttttttatcgtcgcggttttttgttttatggttatttttagaagtgtgagtggaatagagtgaagggaaagttgtttttttcgaaag

SEQ ID NO: 25402 - DNA, 924 bp, Artificial Sequence
  chemically treated genomic DNA (Homo sapiens) CpG-island No: 25402
  misc_feature (175)..(175): n is either a, c, g or t
  misc_feature (577)..(577): n is either a, c, g or t
  misc_feature (732)..(732): n is either a, c, g or t
ctttcgaaaaaaacaactttcccttcactctattccactcacacttctaaaaataaccataaaacaaaaaaccgcgacgataaaaaaacaaaaaaccgaatcgaacaaaaaaccgcgacgacgacgaaaaataaaaaaccgcgacaaacaaaaaaccgcgaaaacgatataccancctaccaaaacgacgaatttaataaaaccgcgacgataaataaaaaaacaaaaaaccgcaacgacaaaaaaccgcgacgaaaaaaaaaaaaccgcgacaacgaaaaaaaaaacgaaaacaaaaaaccaaatcgaacaaaaaaccgcaacaacgaaaaataaaaaccgcaacgaacaaaaaaacgcgacgacgaaacaaaaaaccgaaaccgacaaaaaaccgcgacgacaaaaaaaaaaaaccgcgacgacgaaaatacaaaaaaccgcgataaacaaataaccgcgacaccgaaaacgccaaaaaatcgcgaaaaacaaaaaaccgcgtcgacgaaaaaaaacaaaaaaccgcgacgaacaaataaccgcgacaccgaaaacaaaaatcaaaaaaccgcgntcgacgaaaaaacgaaaaaccgaaacgaacaaaaaaccgcgaaaacgattaaaaaacgaaaaaccgcgacgacaaaaaaacaaaaaaccgcgacgaacataaacccgaaacgacgaaaaaaaaaccacgaaattaaaaaacaaaaaaccgccgcnaacaaaaaaccaccgcgacgaaaataaaaaaaccgcgacgatcgaaaaaaacaaacaaccgcaacgaacaaaaaaccgcgacgacataaaaccacgacaataaaaataaaaaaaccgcgaaaataaataaacaaaaaaccgaatcgaacaaaaaaccgcgacgacgaaaaaacaaaaaaccgcgacgacgcg

SEQ ID NO: 25403 - DNA, 924 bp, Artificial Sequence
  chemically treated genomic DNA (Homo sapiens) CpG-island No: 25403
  misc_feature (175)..(175): n is either a, c, g or t
  misc_feature (577)..(577): n is either a, c, g or t
  misc_feature (732)..(732): n is either a, c, g or t
ttttcgaagaaaatagttttttttttattttgttttatttatatttttgaggatggttatggggtaaaaagtcgcggcggtggggggataaaaagtcgggtcgagtaaaaagtcgcggcggcggcggggggtaaaaagtcgcggtaggtagaaagtcgcggaggcggtgtgttantttgttagggcggcgggtttgataaagtcgcggcggtgggtgggggggtaaaaagtcgtagcgataaaaagtcgcggcgggggggaaaaagtcgcggtagcgggggggggggcggggataaaaagttaggtcgggtaaaaagtcgtagtagcggggggtaaaagtcgtagcgggtagaaaggcgcggcggcggggtaaaaagtcgaggtcggtaaaaagtcgcggcggtagggggaaaaagtcgcggcggcgggggtgtaaaaagtcgcggtgggtaaataatcgcggtatcgggggcgttaaaaagtcgcggagggtaaaaagtcgcgtcggcgggggggggtaaaaagtcgcggcgggtaaataatcgcggtatcggaggtaggggttaaaaagtcgcgntcggcggaggagcgaaaagtcggggcgggtaaaaagtcgcgagggcggttgaggggcggggaatcgcggcggtaggggggtaaaaagtcgcggcgggtataaattcgaggcggcggggaaaaggttacggggttagggggtaaaaagtcgtcgtnggtaaaaagttatcgcggcgggggtaaaaaagtcgcggcggtcggggggggtaaatagtcgtagcgggtaaaaagtcgcggcggtataaagttacggtagtgggggtgaaaaagtcgcgggggtgggtgggtaaaaagtcgggtcgagtaaaaagtcgcggcggcgagggggtaaaaagtcgcggcgacgcg

SEQ ID NO: 25404 - DNA, 924 bp, Artificial Sequence
  chemically treated genomic DNA (Homo sapiens) CpG-island No: 25404
  misc_feature (193)..(193): n is either a, c, g or t
  misc_feature (348)..(348): n is either a, c, g or t
  misc_feature (750)..(750): n is either a, c, g or t
cgcgtcgccgcgactttttaccccctcgccgccgcgactttttactcgacccgactttttacccacccacccccgcgactttttcacccccactaccgtaactttataccgccgcgactttttacccgctacgactatttaccccccccgaccgccgcgacttttttacccccgccgcgataactttttaccnacgacgactttttaccccctaaccccgtaaccttttccccgccgcctcgaatttatacccgccgcgactttttacccccctaccgccgcgattccccgcccctcaaccgccctcgcgactttttacccgccccgacttttcgctcctccgccgancgcgactttttaacccctacctccgataccgcgattatttacccgccgcgactttttacccccccccgccgacgcgactttttaccctccgcgactttttaacgcccccgataccgcgattatttacccaccgcgactttttacacccccgccgccgcgactttttccccctaccgccgcgactttttaccgacctcgactttttaccccgccgccgcgcctttctacccgctacgacttttaccccccgctactacgactttttacccgacctaactttttatccccgcccccccccccgctaccgcgactttttcccccccgccgcgactttttatcgctacgactttttacccccccacccaccgccgcgactttatcaaacccgccgccctaacaaantaacacaccgcctccgcgactttctacctaccgcgactttttaccccccgccgccgccgcgactttttactcgacccgactttttatccccccaccgccgcgactttttaccccataaccatcctcaaaaatataaataaaacaaaataaaaaaaaaactattttcttcgaaaa

SEQ ID NO: 25405 - DNA, 1399 bp, Artificial Sequence
  chemically treated genomic DNA (Homo sapiens) CpG-island No: 25405
  misc_feature (240)..(240): n is either a, c, g or t
  misc_feature (618)..(618): n is either a, c, g or t
  misc_feature (693)..(693): n is either a, c, g or t
  misc_feature (701)..(701): n is either a, c, g or t
  misc_feature (743)..(743): n is either a, c, g or t
  misc_feature (819)..(819): n is either a, c, g or t
  misc_feature (843)..(843): n is either a, c, g or t
  misc_feature (855)..(855): n is either a, c, g or t
  misc_feature (883)..(883): n is either a, c, g or t
  misc_feature (1325)..(1325): n is either a, c, g or t
gtcgttatggatttttgttttcgttattgcgggtttttgcgattttttgttttcgtcgtcgttgttttttgttttcgttatcgcggttttttgtttttgttatcgcggttttttgttttcggtttcgcggaatttagtttttgtcgtcgtggttttttggggttttttgttttcgtcgtcgcggttttttgttgtcgcggttttttgcgttttttttttttcgtcgcggcggtttttttnttttttgttgtcgtagttttttgttttcgttatcgcgatttttttcgtcgcggttttttatggtttttggttttcggcgtcgcggttttttgcggttttttgtcgtcgcgggttttttttgtcgcggttttttgtttttatcgttcgggttttttgcgtcgcggttttttgttgttatttgtttttgttatcgcggcgttttgttttcgtagtcgcggttttttgttttttacgcggttttttgttttcgttatcgtggttttttattattttagtcgttttttgaatttttcgtcgcgggtttttgtcgtcgcggttttttgtttttttcgtcgcggttttttatttttatagcggcggttttttgtttttgttttntgagggtttttgcggttttatgttttcgttgtcgtggttttttgtcgtcgcggtttttggtttttttcgtcgcgngttttttngcggtttttggtatttaacgtcgcggttttttggggtttttnggttttcgttatcggggttttttttttttatcgtcgtaggtttttttcgtttttgttttttgttttcgttatcgtnggttttttattttcgttatcgcgnattttttgtttntcgtcgtcgcggttttttgttttcgatngttgcggttttttacggttttttgttttcgtcgtcgcggtttgttgttttcgttatcgcggtttgttgtttttattatcgcggttttttgtttttatcgtcgcgggtttgagggcgggatcggtagattcggttgttagttttatcggcgttttggttaaggtagcgtcgaggggcgttttttgtttagtttttttggttcgggcgttttttgtttagacgttggcgtttcgggttttgtttttgggtcgttgtagtttgtatagagtagcgttgcgttcggtcgcgttgggagagaagaagaagggcggtggcgggggtgacgcggttatcgcggagggaggtgtaggggtcgcggttagtcggatattgtagtagtgcgggtagttttagaagtttatcggtattttcgttggtagtttgcgcgggttgcgtattaagtngcgttgtgtttaaggattttatttagtaggagatacggatcgtggaggtaagggggtcggggattagggttggg

SEQ ID NO: 25406 - DNA, 1399 bp, Artificial Sequence
  chemically treated genomic DNA (Homo sapiens) CpG-island No: 25406
  misc_feature (75)..(75): n is either a, c, g or t
  misc_feature (517)..(517): n is either a, c, g or t
  misc_feature (545)..(545): n is either a, c, g or t
  misc_feature (557)..(557): n is either a, c, g or t
  misc_feature (581)..(581): n is either a, c, g or t
  misc_feature (657)..(657): n is either a, c, g or t
  misc_feature (699)..(699): n is either a, c, g or t
  misc_feature (707)..(707): n is either a, c, g or t
  misc_feature (782)..(782): n is either a, c, g or t
  misc_feature (1160)..(1160): n is either a, c, g or t
cccaaccctaatccccgacccccttacctccacgatccgtatctcctactaaataaaatccttaaacacaacgcnacttaatacgcaacccgcgcaaactaccaacgaaaataccgataaacttctaaaactacccgcactactacaatatccgactaaccgcgacccctacacctccctccgcgataaccgcgtcacccccgccaccgcccttcttcttctctcccaacgcgaccgaacgcaacgctactctatacaaactacaacgacccaaaaacaaaacccgaaacgccaacgtctaaacaaaaaacgcccgaaccaaaaaaactaaacaaaaaacgcccctcgacgctaccttaaccaaaacgccgataaaactaacaaccgaatctaccgatcccgccctcaaacccgcgacgataaaaacaaaaaaccgcgataataaaaacaacaaaccgcgataacgaaaacaacaaaccgcgacgacgaaaacaaaaaaccgtaaaaaaccgcaacnatcgaaaacaaaaaaccgcgacgacganaaacaaaaaatncgcgataacgaaaataaaaaaccnacgataacgaaaacaaaaaacaaaaacgaaaaaaacctacgacgataaaaaaaaaaaaccccgataacgaaaaccnaaaaaccccaaaaaaccgcgacgttaaataccaaaaaccgcnaaaaaacncgcgacgaaaaaaaccaaaaaccgcgacgacaaaaaaccacgacaacgaaaacataaaaccgcaaaaaccctcanaaaacaaaaacaaaaaaccgccgctataaaaataaaaaaccgcgacgaaaaaaacaaaaaaccgcgacgacaaaaacccgcgacgaaaaattcaaaaaacgactaaaataataaaaaaccacgataacgaaaacaaaaaaccgcgtaaaaaacaaaaaaccgcgactacgaaaacaaaacgccgcgataacaaaaacaaataacaacaaaaaaccgcgacgcaaaaaacccgaacgataaaaacaaaaaaccgcgacaaaaaaaacccgcgacgacaaaaaaccgcaaaaaaccgcgacgccgaaaaccaaaaaccataaaaaaccgcgacgaaaaaaatcgcgataacgaaaacaaaaaactacgacaacaaaaaanaaaaaaaccgccgcgacgaaaaaaaaaaaacgcaaaaaaccgcgacaacaaaaaaccgcgacgacgaaaacaaaaaaccccaaaaaaccacgacgacaaaaactaaattccgcgaaaccgaaaacaaaaaaccgcgataacaaaaacaaaaaaccgcgataacgaaaacaaaaaacaacgacgacgaaaacaaaaaatcgcaaaaacccgcaataacgaaaacaaaaatccataacgac

SEQ ID NO: 25407 - DNA, 1399 bp, Artificial Sequence
  chemically treated genomic DNA (Homo sapiens) CpG-island No: 25407
  misc_feature (75)..(75): n is either a, c, g or t
  misc_feature (517)..(517): n is either a, c, g or t
  misc_feature (545)..(545): n is either a, c, g or t
  misc_feature (557)..(557): n is either a, c, g or t
  misc_feature (581)..(581): n is either a, c, g or t
  misc_feature (657)..(657): n is either a, c, g or t
  misc_feature (699)..(699): n is either a, c, g or t
  misc_feature (707)..(707): n is either a, c, g or t
  misc_feature (782)..(782): n is either a, c, g or t
  misc_feature (1160)..(1160): n is either a, c, g or t
tttagttttggttttcgatttttttatttttacggttcgtattttttgttgggtgaggtttttggatatagcgtnatttggtgcgtagttcgcgtaggttgttaacggagatgtcgatgagtttttggagttgttcgtattgttgtagtgttcggttggtcgcggtttttgtattttttttcgcgatagtcgcgttattttcgttatcgttttttttttttttttttaacgcggtcgagcgtagcgttgttttatgtaggttgtagcggtttaggagtagagttcggggcgttagcgtttaggtaaggaacgttcgaattaggagagttggataaggagcgtttttcggcgttgttttagttaggacgtcggtagagttggtagtcgagtttgtcgatttcgtttttagattcgcggcggtgggggtaaaaagtcgcggtgatgggggtaataagtcgcggtggcgggggtaataagtcgcggcggcggaggtaaaaagtcgtaaaaagtcgtagtngtcgggggtaaaaagtcgcgacggcggngggtaaaaagtncgcggtggcgggggtaagaagttngcggtggcgggggtaaaaagtaggggcgggaaaaatttgcggcggtgggggaaaaaagtttcggtggcggggattnaaaagttttaaaaagtcgcggcgttgggtgttaaaagtcgtnaaaaagtncgcggcggagggggttaaaagtcgcggcggtaaaaagttacgatagcggggatataaagtcgtaaaaatttttangaggtaggggtagaaagtcgtcgttgtgggggtaaaaagtcgcggcgaggggggtaagaagtcgcggcggtaaaaattcgcggcggggggtttaaaaagcggttggggtgataaaaagttacggtggcggaggtaggaagtcgcgtagggggtaaggagtcgcggttgcgggggtaaaacgtcgcggtggtagggataaatagtagtaaaaagtcgcggcgtaaaaagttcgggcggtgggggtaagaagtcgcggtaggaaaaattcgcggcggtaaaaagtcgtaaaaagtcgcggcgtcgggggttaaaagttataaaaagtcgcggcggaaaaagtcgcggtggcgggggtaaaaagttgcggtagtagggggnaaaaaagtcgtcgcggcggggggagaaagacgtaaaaagtcgcggtagtaaaaagtcgcggcggcgagggtaaagagttttaaaaagttacggcggtaggggttaaatttcgcgaggtcgggggtagaaagtcgcggtggtaggggtagaaagtcgcggtggcgggggtagaaagtaacggcggcgggggtaaaaagtcgtaaaaattcgtagtggcgggggtaaaaatttatggcggt

SEQ ID NO: 25408 - DNA, 1399 bp, Artificial Sequence
  chemically treated genomic DNA (Homo sapiens) CpG-island No: 25408
  misc_feature (240)..(240): n is either a, c, g or t
  misc_feature (618)..(618): n is either a, c, g or t
  misc_feature (693)..(693): n is either a, c, g or t
  misc_feature (701)..(701): n is either a, c, g or t
  misc_feature (743)..(743): n is either a, c, g or t
  misc_feature (819)..(819): n is either a, c, g or t
  misc_feature (843)..(843): n is either a, c, g or t
  misc_feature (855)..(855): n is either a, c, g or t
  misc_feature (883)..(883): n is either a, c, g or t
  misc_feature (1325)..(1325): n is either a, c, g or t
accgccataaatttttacccccgccactacgaatttttacgactttttacccccgccgccgttactttctacccccgccaccgcgactttctacccctaccaccgcgactttctacccccgacctcgcgaaatttaacccctaccgccgtaactttttaaaactctttaccctcgccgccgcgactttttactaccgcgactttttacgtctttctccccccgccgcgacgacttttttnccccctactaccgcaactttttacccccgccaccgcgactttttccgccgcgactttttataacttttaacccccgacgccgcgactttttacgactttttaccgccgcgaatttttcctaccgcgacttcttacccccaccgcccgaactttttacgccgcgactttttactactatttatccctaccaccgcgacgttttacccccgcaaccgcgactccttaccccctacgcgacttcctacctccgccaccgtaactttttatcaccccaaccgctttttaaaccccccgccgcgaatttttaccgccgcgacttcttacccccctcgccgcgactttttacccccacaacgacgactttctacccctacctcntaaaaatttttacgactttatatccccgctatcgtaactttttaccgccgcgacttttaaccccctccgccgcgnactttttnacgacttttaacacccaacgccgcgactttttaaaacttttnaatccccgccaccgaaacttttttcccccaccgccgcaaatttttcccgcccctactttttacccccgccaccgcnaacttcttacccccgccaccgcgnactttttacccnccgccgtcgcgactttttacccccgacnactacgactttttacgactttttacctccgccgccgcgacttattacccccgccaccgcgacttattacccccatcaccgcgactttttacccccaccgccgcgaatctaaaaacgaaatcgacaaactcgactaccaactctaccgacgtcctaactaaaacaacgccgaaaaacgctccttatccaactctcctaattcgaacgttccttacctaaacgctaacgccccgaactctactcctaaaccgctacaacctacataaaacaacgctacgctcgaccgcgttaaaaaaaaaaaaaaaaaacgataacgaaaataacgcgactatcgcgaaaaaaaatacaaaaaccgcgaccaaccgaacactacaacaatacgaacaactccaaaaactcatcgacatctccgttaacaacctacgcgaactacgcaccaaatnacgctatatccaaaaacctcacccaacaaaaaatacgaaccgtaaaaataaaaaaatcgaaaaccaaaactaaa

SEQ ID NO: 25409 - DNA, 585 bp, Artificial Sequence
  chemically treated genomic DNA (Homo sapiens) CpG-island No: 25409
  misc_feature (58)..(58): n is either a, c, g or t
  misc_feature (200)..(201): n is either a, c, g or t
  misc_feature (370)..(370): n is either a, c, g or t
  misc_feature (539)..(539): n is either a, c, g or t
agaaagcgcgtgcgttacggaacgcgcgtgcgcgttgcggttagcgtcgcggtttganggcgtagcgggagggggatcgcgaaagggtagcgtcgagaggaacgagtcgggagacgtcggacggtcgagcggtagggcgttcgcgcgcgtttattagtggtcggaggagaaggttttcgcggaggtcgcgttgttcgttnntttttttttggggaggttcgcgttttcgttgttcgcgtttgcgtcgttcgtcggttttaggaacgcgtttttttcgtcggcgcgcgttttcgtagttatcgttatttattagtttcggtattaatagtagcgtcgttgttatcgtttattttttgtcgtcgttattatnagttatttttttttttttcgttgttttttttcgttttcgtttttgtcgattattaggtaagcgtcgcggtttcgaaatttgtttcgtcgttcgtttttgtgtatttttgcgtcgtcgtttttcgtttttttttttcgtagattggggtttcgtgcgtcgggtatcggtncggggttatcgtagggtttttttttgttttttttgttcgggggttg

SEQ ID NO: 25410 - DNA, 585 bp, Artificial Sequence
  chemically treated genomic DNA (Homo sapiens) CpG-island No: 25410
  misc_feature (47)..(47): n is either a, c, g or t
  misc_feature (216)..(216): n is either a, c, g or t
  misc_feature (385)..(386): n is either a, c, g or t
  misc_feature (528)..(528): n is either a, c, g or t
caacccccgaacaaaaaaaacaaaaaaaaaccctacgataaccccgnaccgatacccgacgcacgaaaccccaatctacgaaaaaaaaaaacgaaaaacgacgacgcaaaaatacacaaaaacgaacgacgaaacaaatttcgaaaccgcgacgcttacctaataatcgacaaaaacgaaaacgaaaaaaaacaacgaaaaaaaaaaaaataactnataataacgacgacaaaaaataaacgataacaacgacgctactattaataccgaaactaataaataacgataactacgaaaacgcgcgccgacgaaaaaaacgcgttcctaaaaccgacgaacgacgcaaacgcgaacaacgaaaacgcgaacctccccaaaaaaaaannaacgaacaacgcgacctccgcgaaaaccttctcctccgaccactaataaacgcgcgcgaacgccctaccgctcgaccgtccgacgtctcccgactcgttcctctcgacgctaccctttcgcgatccccctcccgctacgccntcaaaccgcgacgctaaccgcaacgcgcacgcgcgttccgtaacgcacgcgctttct

SEQ ID NO: 25411 - DNA, 585 bp, Artificial Sequence
  chemically treated genomic DNA (Homo sapiens) CpG-island No: 25411
  misc_feature (47)..(47): n is either a, c, g or t
  misc_feature (216)..(216): n is either a, c, g or t
  misc_feature (385)..(386): n is either a, c, g or t
  misc_feature (528)..(528): n is either a, c, g or t
tagttttcgagtaggggaggtagggaggggttttgcggtggtttcgnatcgatgttcggcgtacgaagttttagtttgcggagagggagggcgaggggcggcggcgtaggggtgtatagaggcggacggcgaggtagatttcggagtcgcggcgtttatttgatagtcgatagaggcgaggacgggagaggatagcggaggaggagaaggtggttngtggtggcggcggtagaaggtgggcggtggtagcggcgttgttgttggtgtcggagttggtgggtggcggtgattgcgagggcgcgcgtcggcgaagagggcgcgtttttgaggtcggcgggcggcgtaggcgcgagtagcgggaacgcgagtttttttaggggagggnnggcgggtagcgcggttttcgcgggagttttttttttcggttattagtgggcgcgcgcgagcgttttgtcgttcggtcgttcggcgtttttcggttcgtttttttcggcgttgttttttcgcggtttttttttcgttacgttnttaggtcgcggcgttgatcgtagcgcgtacgcgcgtttcgtggcgtacgcgtttttt

SEQ ID NO: 25412 - DNA, 585 bp, Artificial Sequence
  chemically treated genomic DNA (Homo sapiens) CpG-island No: 25412
  misc_feature (58)..(58): n is either a, c, g or t
  misc_feature (200)..(201): n is either a, c, g or t
  misc_feature (370)..(370): n is either a, c, g or t
  misc_feature (539)..(539): n is either a, c, g or t
aaaaaacgcgtacgccacgaaacgcgcgtacgcgctacgatcaacgccgcgacctaanaacgtaacgaaaaaaaaaccgcgaaaaaacaacgccgaaaaaaacgaaccgaaaaacgccgaacgaccgaacgacaaaacgctcgcgcgcgcccactaataaccgaaaaaaaaaactcccgcgaaaaccgcgctacccgccnnccctcccctaaaaaaactcgcgttcccgctactcgcgcctacgccgcccgccgacctcaaaaacgcgccctcttcgccgacgcgcgccctcgcaatcaccgccacccaccaactccgacaccaacaacaacgccgctaccaccgcccaccttctaccgccgccaccacnaaccaccttctcctcctccgctatcctctcccgtcctcgcctctatcgactatcaaataaacgccgcgactccgaaatctacctcgccgtccgcctctatacacccctacgccgccgcccctcgccctccctctccgcaaactaaaacttcgtacgccgaacatcgatncgaaaccaccgcaaaacccctccctacctcccctactcgaaaacta

SEQ ID NO: 25413 - DNA, 646 bp, Artificial Sequence
  chemically treated genomic DNA (Homo sapiens) CpG-island No: 25413
  misc_feature (522)..(522): n is either a, c, g or t
  misc_feature (537)..(537): n is either a, c, g or t
ggttcgtcgcgaggggttgtagagcggtttagggatcgatttaagtatcgttttttttttttcgtttttagatagagttgggcgcggggttttttttttagatggagcgagggtttcggggtggtttcggaaaaggggagttcgcggttacggttacgtattgttatttcgcgagtagagatgttattttttgtttttggaggaaagggagttcggtggggatgagcgtatttagtttaatgttgggaataaagcgtatttcgcgtttttgcgatttcgttttattttgaaatgtgttggcgttttggtggggtcgttgcggtgggtaaggtcgggggcgttgttaatggaggaattttagggggacggtttttcgtaggaaattttattttggttttgcgcgcgttttaaggaaatggtttttttttaggatttcgagggatgtagtttttgcgcggatgacggtggggtgttgaattagtcggtgcgtttttggaaatgtttgggtacggattttggggnttatcgacgattttntttttatttttagtaggcgggagtttttatatttcgagcgagtgattttttttattttttggcgtttatatatttgtaattttaaattttcgttttagaatggtttagg

SEQ ID NO: 25414 - DNA, 646 bp, Artificial Sequence
  chemically treated genomic DNA (Homo sapiens) CpG-island No: 25414
  misc_feature (110)..(110): n is either a, c, g or t
  misc_feature (125)..(125): n is either a, c, g or t
cctaaaccattctaaaacgaaaatttaaaattacaaatatataaacgccaaaaaataaaaaaaatcactcgctcgaaatataaaaactcccgcctactaaaaataaaaanaaaatcgtcgataanccccaaaatccgtacccaaacatttccaaaaacgcaccgactaattcaacaccccaccgtcatccgcgcaaaaactacatccctcgaaatcctaaaaaaaaaccatttccttaaaacgcgcgcaaaaccaaaataaaatttcctacgaaaaaccgtccccctaaaattcctccattaacaacgcccccgaccttacccaccgcaacgaccccaccaaaacgccaacacatttcaaaataaaacgaaatcgcaaaaacgcgaaatacgctttattcccaacattaaactaaatacgctcatccccaccgaactccctttcctccaaaaacaaaaaataacatctctactcgcgaaataacaatacgtaaccgtaaccgcgaactccccttttccgaaaccaccccgaaaccctcgctccatctaaaaaaaaaaccccgcgcccaactctatctaaaaacgaaaaaaaaaaaacgatacttaaatcgatccctaaaccgctctacaacccctcgcgacgaacc

SEQ ID NO: 25415 - DNA, 646 bp, Artificial Sequence
  chemically treated genomic DNA (Homo sapiens) CpG-island No: 25415
  misc_feature (110)..(110): n is either a, c, g or t
  misc_feature (125)..(125): n is either a, c, g or t
tttggattattttgagacggaggtttggagttataggtgtgtgagcgttagagggtgagaggggttattcgttcggaatgtaagagttttcgtttgttgggaatgggganggagtcgtcgatggnttttaggattcgtgtttagatatttttagaggcgtatcggttggtttagtattttatcgttattcgcgtaaaagttgtatttttcgaggttttggagggaagttatttttttaaagcgcgcgtagagttaggatagagttttttacgaaggatcgtttttttgaggtttttttattaatagcgttttcggttttgtttatcgtagcggttttattaaagcgttaatatattttaaaatggagcgaaatcgtagaagcgcggagtgcgttttgtttttagtattgggttaaatgcgtttatttttatcgggtttttttttttttaaaggtaggaggtgatatttttgttcgcgagatggtaatacgtagtcgtggtcgcgggtttttttttttcggggttatttcgagattttcgttttatttggaaggggaatttcgcgtttagttttgtttgggggcgagggaggagagacgatgtttgaatcgatttttgagtcgttttgtaatttttcgcggcgggtt

SEQ ID NO: 25416 - DNA, 646 bp, Artificial Sequence
  chemically treated genomic DNA (Homo sapiens) CpG-island No: 25416
  misc_feature (522)..(522): n is either a, c, g or t
  misc_feature (537)..(537): n is either a, c, g or t
aacccgccgcgaaaaattacaaaacgactcaaaaatcgattcaaacatcgtctctcctccctcgcccccaaacaaaactaaacgcgaaattccccttccaaataaaacgaaaatctcgaaataaccccgaaaaaaaaaaacccgcgaccacgactacgtattaccatctcgcgaacaaaaatatcacctcctacctttaaaaaaaaaaaaacccgataaaaataaacgcatttaacccaatactaaaaacaaaacgcactccgcgcttctacgatttcgctccattttaaaatatattaacgctttaataaaaccgctacgataaacaaaaccgaaaacgctattaataaaaaaacctcaaaaaaacgatccttcgtaaaaaactctatcctaactctacgcgcgctttaaaaaaataacttccctccaaaacctcgaaaaatacaacttttacgcgaataacgataaaatactaaaccaaccgatacgcctctaaaaatatctaaacacgaatcctaaaanccatcgacgactccntccccattcccaacaaacgaaaactcttacattccgaacgaataacccctctcaccctctaacgctcacacacctataactccaaacctccgtctcaaaataatccaaa

SEQ ID NO: 25417 - DNA, 592 bp, Artificial Sequence
  chemically treated genomic DNA (Homo sapiens) CpG-island No: 25417
ttcgcgtcgttaattagtcgtttttagagcgtgggtggtaggcgtggttttgttcggggtcggtcgttttttttacgttttcggaggtttcggcggaaggcgtgtaggcggtttttgggcggcggttgtaggggagatagtggaggggttcggcgtttttgttcgttcgtacgtgttcggggcggggcggttggggttcgacgggcggggtcgggggcggtggcggcgggggcgtggtcgggcggttacgtgacgggcggcgcggttattaagtcgcgcggtagttgttcgtagtcggagttggtgtttcgttcgagatttagcgtttaggcgtgtcgtttcgagaggagtcgcgcgaaggttatttcgcgttcgtcgttcgtcgttcgtcgttttcgtgggttcgtttgttagttagttcgtgcgttcgagtttttcgcgtttcgtcgtagtttcggttaatcgagcgttatgaattagatagagttcggcgtgtagtataattacgtgtacgacgaggatgagtatatgatttaggaggaggagtgggatcgcgatttgtttttggatttagtttgggagaagtagtaga

SEQ ID NO: 25418 - DNA, 592 bp, Artificial Sequence
  chemically treated genomic DNA (Homo sapiens) CpG-island No: 25418
tctactacttctcccaaactaaatccaaaaacaaatcgcgatcccactcctcctcctaaatcatatactcatcctcgtcgtacacgtaattatactacacgccgaactctatctaattcataacgctcgattaaccgaaactacgacgaaacgcgaaaaactcgaacgcacgaactaactaacaaacgaacccacgaaaacgacgaacgacgaacgacgaacgcgaaataaccttcgcgcgactcctctcgaaacgacacgcctaaacgctaaatctcgaacgaaacaccaactccgactacgaacaactaccgcgcgacttaataaccgcgccgcccgtcacgtaaccgcccgaccacgcccccgccgccaccgcccccgaccccgcccgtcgaaccccaaccgccccgccccgaacacgtacgaacgaacaaaaacgccgaacccctccactatctcccctacaaccgccgcccaaaaaccgcctacacgccttccgccgaaacctccgaaaacgtaaaaaaaacgaccgaccccgaacaaaaccacgcctaccacccacgctctaaaaacgactaattaacgacgcgaa

SEQ ID NO: 25419 - DNA, 592 bp, Artificial Sequence
  chemically treated genomic DNA (Homo sapiens) CpG-island No: 25419
tttgttgttttttttaggttgggtttaggagtaggtcgcggttttatttttttttttggattatgtatttattttcgtcgtatacgtagttgtattgtacgtcgggttttatttggtttatggcgttcggttggtcggggttgcggcggggcgcgaggggttcggacgtacgggttgattggtaaacggatttacggaggcggcgggcggcgggcggcgggcgcggggtgattttcgcgcggtttttttcggggcgatacgtttgggcgttgggtttcgggcgaagtattagtttcggttgcgagtagttgtcgcgcggtttaatagtcgcgtcgttcgttacgtggtcgttcggttacgttttcgtcgttatcgttttcggtttcgttcgtcgggttttagtcgtttcgtttcgagtacgtgcgggcggataagggcgtcgggtttttttattgttttttttgtagtcgtcgtttagaggtcgtttgtacgtttttcgtcgaggttttcgggaacgtgaggggagcggtcggtttcgagtagagttacgtttgttatttacgttttgagagcggttggttagcggcgcggg

SEQ ID NO: 25420 - DNA, 592 bp, Artificial Sequence
  chemically treated genomic DNA (Homo sapiens) CpG-island No: 25420
cccgcgccgctaaccaaccgctctcaaaacgtaaataacaaacgtaactctactcgaaaccgaccgctcccctcacgttcccgaaaacctcgacgaaaaacgtacaaacgacctctaaacgacgactacaaaaaaaacaataaaaaaacccgacgcccttatccgcccgcacgtactcgaaacgaaacgactaaaacccgacgaacgaaaccgaaaacgataacgacgaaaacgtaaccgaacgaccacgtaacgaacgacgcgactattaaaccgcgcgacaactactcgcaaccgaaactaatacttcgcccgaaacccaacgcccaaacgtatcgccccgaaaaaaaccgcgcgaaaatcaccccgcgcccgccgcccgccgcccgccgcctccgtaaatccgtttaccaatcaacccgtacgtccgaacccctcgcgccccgccgcaaccccgaccaaccgaacgccataaaccaaataaaacccgacgtacaatacaactacgtatacgacgaaaataaatacataatccaaaaaaaaaaataaaaccgcgacctactcctaaacccaacctaaaaaaaacaacaaa

SEQ ID NO: 25421 - DNA, 950 bp, Artificial Sequence
  chemically treated genomic DNA (Homo sapiens) CpG-island No: 25421
taggcgcgtttttgtagtcggtcggtcggcgcgcgggatcgcggggtcgcgcgcgggcgtcgcgtttttttcgtttcgttttcgtttttaacgtgtcgtcgtcgtcgttcgttggcgttttagttcgcgcgttcgtcggcgttcggcggtttttcgttggtaaagttgcgcggtcgtttcgaaggggacgtcgtacggtttttcgtttcggcgtcgtcgtcgtttttttaggtcgtcgcgcgggaaggtttagtcggtggtttcgtttttttatttgttcggagttttcgcgcgcgcgttcgttcgatcgttcgtttttttttttttcgcgttcgtttttttttttttttttcgttttttcgttttttcgcgcggaagtttttttttttcgtgttgttcgcgttcgttcgttcgcgtttttttttttgttgggttcggcggagcggggcggtcggtagtttttttcgtttttttttattcgcgtttcggcggaggcggcggcggcgtttcgcgtttcgatttattttaatatggtacggacgtagggcgtatgcgttcgcgtttttttatttttagtttcgcggttttttaggtagtttgcgtttttcgcgtcgcgttcgtggagttttcgggttcggttgtttcgttttcgttttagcgttattttttttggttggggtcgcgcgggaggtaaggatttcgcgggttggtgtgtcgggggttcggcgtcgcgggttatttacgtttttagttagtaattcggcgcggacggtttcgaggtcgtggcgtaggatacgcggcggcgtttcgggttttcgacggcgttgtggtttcgagcggaacggttcggaagaggagacgcgttttcgggaatttagtgttcgttttggtttagtttcgatttagtttgcgttttatttcgggttgtagatagagcggggggggatttt

SEQ ID NO: 25422 - DNA, 950 bp, Artificial Sequence
  chemically treated genomic DNA (Homo sapiens) CpG-island No: 25422
aaaatccccccccgctctatctacaacccgaaataaaacgcaaactaaatcgaaactaaaccaaaacgaacactaaattcccgaaaacgcgtctcctcttccgaaccgttccgctcgaaaccacaacgccgtcgaaaacccgaaacgccgccgcgtatcctacgccacgacctcgaaaccgtccgcgccgaattactaactaaaaacgtaaataacccgcgacgccgaacccccgacacaccaacccgcgaaatccttacctcccgcgcgaccccaaccaaaaaaaataacgctaaaacgaaaacgaaacaaccgaacccgaaaactccacgaacgcgacgcgaaaaacgcaaactacctaaaaaaccgcgaaactaaaaataaaaaaacgcgaacgcatacgccctacgtccgtaccatattaaaataaatcgaaacgcgaaacgccgccgccgcctccgccgaaacgcgaataaaaaaaaacgaaaaaaactaccgaccgccccgctccgccgaacccaacaaaaaaaaaaacgcgaacgaacgaacgcgaacaacacgaaaaaaaaaaacttccgcgcgaaaaaacgaaaaaacgaaaaaaaaaaaaaaaaacgaacgcgaaaaaaaaaaaaacgaacgatcgaacgaacgcgcgcgcgaaaactccgaacaaataaaaaaacgaaaccaccgactaaaccttcccgcgcgacgacctaaaaaaacgacgacgacgccgaaacgaaaaaccgtacgacgtccccttcgaaacgaccgcgcaactttaccaacgaaaaaccgccgaacgccgacgaacgcgcgaactaaaacgccaacgaacgacgacgacgacacgttaaaaacgaaaacgaaacgaaaaaaacgcgacgcccgcgcgcgaccccgcgatcccgcgcgccgaccgaccgactacaaaaacgcgccta

SEQ ID NO: 25423 - DNA, 950 bp, Artificial Sequence
  chemically treated genomic DNA (Homo sapiens) CpG-island No: 25423
gggattttttttcgttttgtttataattcgaggtgaggcgtaggttggatcggggttgggttagggcgggtattgggttttcggggacgcgttttttttttcgggtcgtttcgttcggggttatagcgtcgtcgggggttcgaggcgtcgtcgcgtgttttgcgttacggtttcggggtcgttcgcgtcgagttgttggttgggggcgtgggtggttcgcggcgtcggattttcggtatattagttcgcggagtttttgtttttcgcgcggttttagttaggagggatggcgttggggcgggagcggggtagtcgggttcgggagttttacgggcgcggcgcgaggggcgtaggttgtttggaggatcgcggagttgggggtgggggggcgcgggcgtatgcgttttgcgttcgtgttatattggaatgagtcggagcgcggagcgtcgtcgtcgttttcgtcggagcgcgggtggaggggggcggggagagttgtcggtcgtttcgtttcgtcgaatttagtaggaaggagggcgcgagcgggcgagcgcgggtagtacgggaggaaaaagttttcgcgcgggggagcgaaaagacggaaagaaagaaagaaaacgagcgcgagagggggaaaagcgagcgatcgagcgagcgcgcgcgcgaaaatttcgggtaggtaaaaaagcggggttatcggttgggttttttcgcgcggcggtttggaggggcggcggcggcgtcggggcgggggatcgtacggcgtttttttcgaagcggtcgcgtaattttgttaacgggaaatcgtcgggcgtcggcgggcgcgcgggttgaggcgttaacgggcggcggcggcggtacgttgggggcgggggcggggcggggggagcgcggcgttcgcgcgcggtttcgcggtttcgcgcgtcggtcggtcggttgtaggggcgcgtttg

SEQ ID NO: 25424 - DNA, 950 bp, Artificial Sequence
  chemically treated genomic DNA (Homo sapiens) CpG-island No: 25424
caaacgcgcccctacaaccgaccgaccgacgcgcgaaaccgcgaaaccgcgcgcgaacgccgcgctccccccgccccgcccccgcccccaacgtaccgccgccgccgcccgttaacgcctcaacccgcgcgcccgccgacgcccgacgatttcccgttaacaaaattacgcgaccgcttcgaaaaaaacgccgtacgatcccccgccccgacgccgccgccgcccctccaaaccgccgcgcgaaaaaacccaaccgataaccccgcttttttacctacccgaaattttcgcgcgcgcgctcgctcgatcgctcgcttttccccctctcgcgctcgttttctttctttctttccgtcttttcgctcccccgcgcgaaaactttttcctcccgtactacccgcgctcgcccgctcgcgccctccttcctactaaattcgacgaaacgaaacgaccgacaactctccccgcccccctccacccgcgctccgacgaaaacgacgacgacgctccgcgctccgactcattccaatataacacgaacgcaaaacgcatacgcccgcgcccccccacccccaactccgcgatcctccaaacaacctacgcccctcgcgccgcgcccgtaaaactcccgaacccgactaccccgctcccgccccaacgccatccctcctaactaaaaccgcgcgaaaaacaaaaactccgcgaactaatataccgaaaatccgacgccgcgaaccacccacgcccccaaccaacaactcgacgcgaacgaccccgaaaccgtaacgcaaaacacgcgacgacgcctcgaacccccgacgacgctataaccccgaacgaaacgacccgaaaaaaaaaacgcgtccccgaaaacccaatacccgccctaacccaaccccgatccaacctacgcctcacctcgaattataaacaaaacgaaaaaaaatccc

SEQ ID NO: 25425 - DNA, 627 bp, Artificial Sequence
  chemically treated genomic DNA (Homo sapiens) CpG-island No: 25425
tgttggcgcggcgatttgttcgtcgtgcggtcggcgttttcggtcgaggatatgttggcgcggcgagcgttgggcgcggcgtgggggtttggttttttggtcgggaggcggcggatacggcgggggagcggggagttgtaggttcggggtagagtaggcgagcggggtcggagcgcgagcggtcgtcggtgggtcggagtttagtttggttggttggttggttgggacgcgggggcgttgttgttcgtgtttttagaggttgcggtcgtcgcggtgtttcgtcggtagtagaaagttttcgattcggatttaaatttttgttaaattcgtagcgaatttggtcgtcgggttacgtggcgtgcgttttcgaatttttttttcgttttttttgtttttttttttcgttcgtcgggtattttaaagggattagaggttttcgtggttagtttcgtcgcggggcgggggggatttcgggtttttttcgtcgaagttttcgggatcggtttttatcgagatatcgcggtcgtcggaaattttagttaggcgtatttggacgtataggttttaggtttatttttttttatttttttggattgtaaattgtttagcgtcggttttttttttttt

SEQ ID NO: 25426 - DNA, 627 bp, Artificial Sequence
  chemically treated genomic DNA (Homo sapiens) CpG-island No: 25426
aaaaaaaaaaaaaccgacgctaaacaatttacaatccaaaaaaataaaaaaaaataaacctaaaacctatacgtccaaatacgcctaactaaaatttccgacgaccgcgatatctcgataaaaaccgatcccgaaaacttcgacgaaaaaaacccgaaatcccccccgccccgcgacgaaactaaccacgaaaacctctaatccctttaaaatacccgacgaacgaaaaaaaaaaacaaaaaaaacgaaaaaaaaattcgaaaacgcacgccacgtaacccgacgaccaaattcgctacgaatttaacaaaaatttaaatccgaatcgaaaactttctactaccgacgaaacaccgcgacgaccgcaacctctaaaaacacgaacaacaacgcccccgcgtcccaaccaaccaaccaaccaaactaaactccgacccaccgacgaccgctcgcgctccgaccccgctcgcctactctaccccgaacctacaactccccgctcccccgccgtatccgccgcctcccgaccaaaaaaccaaacccccacgccgcgcccaacgctcgccgcgccaacatatcctcgaccgaaaacgccgaccgcacgacgaacaaatcgccgcgccaaca

SEQ ID NO: 25427 - DNA, 627 bp, Artificial Sequence
  chemically treated genomic DNA (Homo sapiens) CpG-island No: 25427
aagaggagaaaaatcggcgttgggtagtttgtaatttaggaaaatagggaaggataaatttgaagtttgtgcgtttaggtgcgtttggttagggttttcgacggtcgcggtgtttcggtggggatcggtttcggaggtttcggcgaggaggattcggagtttttttcgtttcgcggcggaattaattacggaggtttttggtttttttaaggtgttcggcgagcggagaaagggagtagagggggcgggaggagggttcgggagcgtacgttacgtgattcggcggttaagttcgttgcgagtttgatagaagtttgaattcgagtcgggggttttttgttgtcggcggggtatcgcggcggtcgtagtttttgagagtacgaatagtagcgttttcgcgttttagttagttagttagttagattggatttcggtttatcgacggtcgttcgcgtttcggtttcgttcgtttgttttgtttcggatttgtagtttttcgttttttcgtcgtgttcgtcgtttttcggttagagagttaagtttttacgtcgcgtttagcgttcgtcgcgttagtatgttttcgatcgagagcgtcggtcgtacggcggataagtcgtcgcgttagta

SEQ ID NO: 25428 - DNA, 627 bp, Artificial Sequence
  chemically treated genomic DNA (Homo sapiens) CpG-island No: 25428
tactaacgcgacgacttatccgccgtacgaccgacgctctcgatcgaaaacatactaacgcgacgaacgctaaacgcgacgtaaaaacttaactctctaaccgaaaaacgacgaacacgacgaaaaaacgaaaaactacaaatccgaaacaaaacaaacgaacgaaaccgaaacgcgaacgaccgtcgataaaccgaaatccaatctaactaactaactaactaaaacgcgaaaacgctactattcgtactctcaaaaactacgaccgccgcgataccccgccgacaacaaaaaacccccgactcgaattcaaacttctatcaaactcgcaacgaacttaaccgccgaatcacgtaacgtacgctcccgaaccctcctcccgccccctctactccctttctccgctcgccgaacaccttaaaaaaaccaaaaacctccgtaattaattccgccgcgaaacgaaaaaaactccgaatcctcctcgccgaaacctccgaaaccgatccccaccgaaacaccgcgaccgtcgaaaaccctaaccaaacgcacctaaacgcacaaacttcaaatttatccttccctattttcctaaattacaaactacccaacgccgatttttctcctctt

SEQ ID NO: 25429 - DNA, 572 bp, Artificial Sequence
  chemically treated genomic DNA (Homo sapiens) CpG-island No: 25429
  misc_feature (298)..(298): n is either a, c, g or t
gtgcgtataaaaataaaaaagatttcgcgcgttggtggggcgggggttacgcggggggcgggggtggcggggagcgggttggttcgcgcgtttttcgttttcgcgattcgcgcgtaacggttttttttttcgtatttaggataattttgtttttttttttttgtttttattaagttgtttattacgtacggtaaagttttaataataattttacggcgtagtcgttttattatattacgattttttatttttattattatttttattcgacgtcgtacggattcgaaggttcgcgggnattacgttcggttcgtatttatatttttttttttttatttatttttaattatcgtatattattagggttacggttttttatcgttttttattttttcgtattttattatattttttatatttattatttttttatagataaatttaataaaagattcgtcggcgttcgttttttattaacggtttatatttatatatttttttattttatttttcgtttttttaagaataaattttatcgtaataatagttttcgagtatatataattatagtt

SEQ ID NO: 25430 - DNA, 572 bp, Artificial Sequence
  chemically treated genomic DNA (Homo sapiens) CpG-island No: 25430
  misc_feature (275)..(275): n is either a, c, g or t
aactataattatatatactcgaaaactattattacgataaaatttattcttaaaaaaacgaaaaataaaataaaaaaatatataaatataaaccgttaataaaaaacgaacgccgacgaatcttttattaaatttatctataaaaaaataataaatataaaaaatataataaaatacgaaaaaataaaaaacgataaaaaaccgtaaccctaataatatacgataattaaaaataaataaaaaaaaaaaaatataaatacgaaccgaacgtaatncccgcgaaccttcgaatccgtacgacgtcgaataaaaataataataaaaataaaaaatcgtaatataataaaacgactacgccgtaaaattattattaaaactttaccgtacgtaataaacaacttaataaaaacaaaaaaaaaaaaacaaaattatcctaaatacgaaaaaaaaaaccgttacgcgcgaatcgcgaaaacgaaaaacgcgcgaaccaacccgctccccgccacccccgccccccgcgtaacccccgccccaccaacgcgcgaaatcttttttatttttatacgcac

SEQ ID NO: 25431 - DNA, 572 bp, Artificial Sequence
  chemically treated genomic DNA (Homo sapiens) CpG-island No: 25431
  misc_feature (275)..(275): n is either a, c, g or t
ggttgtggttgtgtgtgttcgggggttgttgttgcggtggggtttgtttttgggggggcggggggtggggtgggggggtgtgtgggtgtgggtcgttggtggggggcgggcgtcggcgggttttttgttgggtttgtttgtgggggggtggtgggtgtggggggtgtggtggggtgcgggggggtggggggcggtggggggtcgtggttttggtggtgtgcggtgattgggggtgggtgggggggggggggtgtgggtgcgggtcgggcgtggtnttcgcgggttttcgggttcgtgcggcgtcgggtggaggtggtggtgggggtggggggtcgtgatatggtggggcggttgcgtcgtggggttgttgttggggttttgtcgtgcgtggtggatagtttaatagaaataaaaaaaaaaaaataaggttgttttgggtgcgggggggggggtcgttgcgcgcgggtcgcgggggcggggggcgcgcgggttaattcgtttttcgttattttcgtttttcgcgtggttttcgttttattagcgcgcggggttttttttgtttttgtgcgtat

SEQ ID NO: 25432 - DNA, 572 bp, Artificial Sequence
  chemically treated genomic DNA (Homo sapiens) CpG-island No: 25432
  misc_feature (298)..(298): n is either a, c, g or t
atacgcacaaaaacaaaaaaaaccccgcgcgctaataaaacgaaaaccacgcgaaaaacgaaaataacgaaaaacgaattaacccgcgcgccccccgcccccgcgacccgcgcgcaacgacccccccccccgcacccaaaacaaccttatttttttttttttatttctattaaactatccaccacgcacgacaaaaccccaacaacaaccccacgacgcaaccgccccaccatatcacgaccccccacccccaccaccacctccacccgacgccgcacgaacccgaaaacccgcgaanaccacgcccgacccgcacccacacccccccccccccacccacccccaatcaccgcacaccaccaaaaccacgaccccccaccgccccccacccccccgcaccccaccacaccccccacacccaccacccccccacaaacaaacccaacaaaaaacccgccgacgcccgccccccaccaacgacccacacccacacacccccccaccccaccccccgcccccccaaaaacaaaccccaccgcaacaacaacccccgaacacacacaaccacaacc

SEQ ID NO: 25433 - DNA, 920 bp, Artificial Sequence
  chemically treated genomic DNA (Homo sapiens) CpG-island No: 25433
gtcgcgacgttaggagttcggggttcggcgggaaggtatgagaagtttttacgtgaattttataagtcgggttcgggagacgtcgggcgaggcggggttgattttagtagtttttgtttcgttttagttaattagtttcgtattttagtattcgaatttaggattttcgaagtcggaggcgacgcgagttaatgaggagtgggtcggggaagagggataggcggttagtttatggggcggagaggttcggtcgcgcgtatttaaggagcgtcgcgttcggttcgggggtgtggcgcgcgtcggcgggggtgggcgggcgcgtcgggcggtaggtgtcggcgtcggcggtattcggcggcgatggagcggttttggggagttgcggacggtttttcgcgttggttttatggtttcggtttttttttttttttgtagttgttgtcgtcgtcgatttttagttaggatcggttggacgcgtcgtcgtcgttcgttgcgtcgttgtcgcgttggtttggttttatcggggtgagttgggggttgcgggcggtcgtagtcgggggcgcgttttttcgcggcggtcgttggcgtcgtagcgcgtcgggcgaggacgaggagtgcggtcgggttcgggatttcgtcgttaagttggttaataatacgtattaggtgagcgggcgtcgggttcgggagtcgttcgggtgcgaggtgtcgttcgcgtgtttttttcggttcgtgcgtttcgcgattttcggaggagattttagttttgtcgcgttcgcgtttttcgggtcgtagtttcgaaattgcggcgggcgggcgggcggagtcgggttcgggcggtcggcggggttgtgttttgttataggggaggtaattttagatttttatcgtatttttttttttttttttaagttgttaaa

SEQ ID NO: 25434 - DNA, 920 bp, Artificial Sequence
  chemically treated genomic DNA (Homo sapiens) CpG-island No: 25434
tttaacaacttaaaaaaaaaaaaaaaaatacgataaaaatctaaaattacctcccctataacaaaacacaaccccgccgaccgcccgaacccgactccgcccgcccgcccgccgcaatttcgaaactacgacccgaaaaacgcgaacgcgacaaaactaaaatctcctccgaaaatcgcgaaacgcacgaaccgaaaaaaacacgcgaacgacacctcgcacccgaacgactcccgaacccgacgcccgctcacctaatacgtattattaaccaacttaacgacgaaatcccgaacccgaccgcactcctcgtcctcgcccgacgcgctacgacgccaacgaccgccgcgaaaaaacgcgcccccgactacgaccgcccgcaacccccaactcaccccgataaaaccaaaccaacgcgacaacgacgcaacgaacgacgacgacgcgtccaaccgatcctaactaaaaatcgacgacgacaacaactacaaaaaaaaaaaaaaaccgaaaccataaaaccaacgcgaaaaaccgtccgcaactccccaaaaccgctccatcgccgccgaataccgccgacgccgacacctaccgcccgacgcgcccgcccacccccgccgacgcgcgccacacccccgaaccgaacgcgacgctccttaaatacgcgcgaccgaacctctccgccccataaactaaccgcctatccctcttccccgacccactcctcattaactcgcgtcgcctccgacttcgaaaatcctaaattcgaatactaaaatacgaaactaattaactaaaacgaaacaaaaactactaaaatcaaccccgcctcgcccgacgtctcccgaacccgacttataaaattcacgtaaaaacttctcataccttcccgccgaaccccgaactcctaacgtcgcgac

SEQ ID NO: 25435 - DNA, 920 bp, Artificial Sequence
  chemically treated genomic DNA (Homo sapiens) CpG-island No: 25435
tttgataatttaaaaaaaaaaaaaagaatgcggtggaagtttaagattgttttttttatgataaaatatagtttcgtcggtcgttcgggttcgatttcgttcgttcgttcgtcgtagtttcggggttgcggttcgggggacgcgggcgcggtagggttggggtttttttcgggagtcgcggggcgtacgggtcgggaggggtacgcgggcggtatttcgtattcgagcggttttcgggttcggcgttcgtttatttggtgcgtgttgttggttagtttggcgacgaagtttcggattcggtcgtatttttcgttttcgttcggcgcgttgcgacgttaacggtcgtcgcggggaaacgcgttttcggttgcggtcgttcgtagtttttagtttatttcgatggggttagattagcgcggtagcggcgtagcgggcggcggcggcgcgtttagtcggttttggttgagggtcgacggcggtagtagttgtaggaggaggaggaggtcgaggttatggggttagcgcgagaggtcgttcgtagttttttagggtcgttttatcgtcgtcgaatgtcgtcgacgtcgatatttgtcgttcggcgcgttcgtttattttcgtcggcgcgcgttatattttcgagtcgagcgcggcgttttttggatacgcgcggtcgggttttttcgttttataggttggtcgtttgtttttttttttcggtttattttttattggttcgcgtcgttttcggtttcgggggttttggattcggatgttaagatgcgggattgattggttggaacggggtagagattgttgaggttaatttcgtttcgttcggcgtttttcgggttcggtttgtggagtttacgtaggagttttttatattttttcgtcgagtttcgggtttttggcgtcgcgat

SEQ ID NO: 25436 - DNA, 920 bp, Artificial Sequence
  chemically treated genomic DNA (Homo sapiens) CpG-island No: 25436
atcgcgacgccaaaaacccgaaactcgacgaaaaaatataaaaaactcctacgtaaactccacaaaccgaacccgaaaaacgccgaacgaaacgaaattaacctcaacaatctctaccccgttccaaccaatcaatcccgcatcttaacatccgaatccaaaacccccgaaaccgaaaacgacgcgaaccaataaaaaataaaccgaaaaaaaaaaacaaacgaccaacctataaaacgaaaaaacccgaccgcgcgtatccaaaaaacgccgcgctcgactcgaaaatataacgcgcgccgacgaaaataaacgaacgcgccgaacgacaaatatcgacgtcgacgacattcgacgacgataaaacgaccctaaaaaactacgaacgacctctcgcgctaaccccataacctcgacctcctcctcctcctacaactactaccgccgtcgaccctcaaccaaaaccgactaaacgcgccgccgccgcccgctacgccgctaccgcgctaatctaaccccatcgaaataaactaaaaactacgaacgaccgcaaccgaaaacgcgtttccccgcgacgaccgttaacgtcgcaacgcgccgaacgaaaacgaaaaatacgaccgaatccgaaacttcgtcgccaaactaaccaacaacacgcaccaaataaacgaacgccgaacccgaaaaccgctcgaatacgaaataccgcccgcgtacccctcccgacccgtacgccccgcgactcccgaaaaaaaccccaaccctaccgcgcccgcgtcccccgaaccgcaaccccgaaactacgacgaacgaacgaacgaaatcgaacccgaacgaccgacgaaactatattttatcataaaaaaaacaatcttaaacttccaccgcattcttttttttttttttaaattatcaaa

SEQ ID NO: 25437 - DNA, 629 bp, Artificial Sequence
  chemically treated genomic DNA (Homo sapiens) CpG-island No: 25437
cgttttttcgtcgaattttgggattagcgtcggggttttttggggaattttaataatttgaattgatttcggacgttaattcggtaggagtcgggacggtttcgttttttttcgcgtagtttaggcgtttcgttgagggcggtttcggcgtttattattagattttttttagttattttatgcgcggagagtttggacgcggtatttcgcggggattcgttatttagcggttttttttcggagttttagtttgtttatcgtaggtttttttcggggttgtttcgttcggcgtagggtcgttgtagtcgtcgttttatagcgcgattgaatattggggtatcgaatttggggttgcgttcggtttcgtcgtcggttcgcgtagcggtgcggtttatttcgtcggcgggaattagaatttttattttaggcgttttacgagttcggtcgtcgcggatgattttagttaaaatcgaaagcgtcgaggtaggggtatttttttgttttagttaattagtgtttttttttgttacggtagttcgttggggtcgaaaaagtttgttagtattaaagcgcgtaaatttaagatttttggtttgtttagtagtaaaattggtgtagtggagtttttt

SEQ ID NO: 25438 - DNA, 629 bp, Artificial Sequence
  chemically treated genomic DNA (Homo sapiens) CpG-island No: 25438
aaaaaactccactacaccaattttactactaaacaaaccaaaaatcttaaatttacgcgctttaatactaacaaactttttcgaccccaacgaactaccgtaacaaaaaaaaacactaattaactaaaacaaaaaaatacccctacctcgacgctttcgattttaactaaaatcatccgcgacgaccgaactcgtaaaacgcctaaaataaaaattctaattcccgccgacgaaataaaccgcaccgctacgcgaaccgacgacgaaaccgaacgcaaccccaaattcgataccccaatattcaatcgcgctataaaacgacgactacaacgaccctacgccgaacgaaacaaccccgaaaaaaacctacgataaacaaactaaaactccgaaaaaaaaccgctaaataacgaatccccgcgaaataccgcgtccaaactctccgcgcataaaataactaaaaaaaatctaataataaacgccgaaaccgccctcaacgaaacgcctaaactacgcgaaaaaaaacgaaaccgtcccgactcctaccgaattaacgtccgaaatcaattcaaattattaaaattccccaaaaaaccccgacgctaatcccaaaattcgacgaaaaaacg

SEQ ID NO: 25439 - DNA, 629 bp, Artificial Sequence
  chemically treated genomic DNA (Homo sapiens) CpG-island No: 25439
gaggaattttattgtattaattttgttattagataaattaggaattttggatttgcgcgttttggtgttgataggttttttcggttttagcgggttgtcgtagtagagaagagtattgattggttgaggtagaaaagtgtttttgtttcggcgttttcggttttggttgggattattcgcggcggtcgggttcgtggggcgtttggagtgagggttttggttttcgtcggcgaggtgagtcgtatcgttgcgcgggtcgacgacggggtcgggcgtagttttaggttcggtgttttagtgtttagtcgcgttgtggagcggcggttgtagcggttttacgtcgggcgaggtagtttcggaaagggtttgcggtgaataggttggggtttcgggaagggatcgttgggtggcgggttttcgcgaaatgtcgcgtttaagtttttcgcgtatggaatggttgggagaggtttgatggtgggcgtcgggatcgtttttagcgaggcgtttagattgcgcggagaggagcgggatcgtttcggtttttatcgagttggcgttcgagattaatttaggttgttgaagttttttagggagtttcgacgttaattttaagattcggcgggaaagcg

SEQ ID NO: 25440 - DNA, 629 bp, Artificial Sequence
  chemically treated genomic DNA (Homo sapiens) CpG-island No: 25440
cgctttcccgccgaatcttaaaattaacgtcgaaactccctaaaaaacttcaacaacctaaattaatctcgaacgccaactcgataaaaaccgaaacgatcccgctcctctccgcgcaatctaaacgcctcgctaaaaacgatcccgacgcccaccatcaaacctctcccaaccattccatacgcgaaaaacttaaacgcgacatttcgcgaaaacccgccacccaacgatcccttcccgaaaccccaacctattcaccgcaaaccctttccgaaactacctcgcccgacgtaaaaccgctacaaccgccgctccacaacgcgactaaacactaaaacaccgaacctaaaactacgcccgaccccgtcgtcgacccgcgcaacgatacgactcacctcgccgacgaaaaccaaaaccctcactccaaacgccccacgaacccgaccgccgcgaataatcccaaccaaaaccgaaaacgccgaaacaaaaacacttttctacctcaaccaatcaatactcttctctactacgacaacccgctaaaaccgaaaaaacctatcaacaccaaaacgcgcaaatccaaaattcctaatttatctaataacaaaattaatacaataaaattcctc

SEQ ID NO: 25441 - DNA, 509 bp, Artificial Sequence
  chemically treated genomic DNA (Homo sapiens) CpG-island No: 25441
gaggtatgtatcgtagtggtgaatatacgtcgattaggttttagtttaacgatatttggaggttagtacggtgtttacgtgtcgacggaatttgtttagggaggtatgtatcgtagtggtgaatataaggttttagtttaacgatatttggaggttagtacggtgtttacgtgtcgacggaatttgtatagggaggtatgtatcgtagtggtgaatatacgtcgattaggttttagtttaacgatatttggaggttagtacggtgtttacgtgtcgacggaatttgtttagggaggtatgtatcgtagtggtgaatataaggttttagtttaacgatatttggaggttagtacggtgtttacgtgtcgacggaatttgtatagggaggtatgtatcgtagtggtgaatatacgtcgatttaggtttttatttaaacgatattttggaggtttatatagtgtttattttgtcgacggaatttgttttagggaggtatgttttttttttat

SEQ ID NO: 25442 - DNA, 509 bp, Artificial Sequence
  chemically treated genomic DNA (Homo sapiens) CpG-island No: 25442
ataaaaaaaaaacatacctccctaaaacaaattccgtcgacaaaataaacactatataaacctccaaaatatcgtttaaataaaaacctaaatcgacgtatattcaccactacgatacatacctccctatacaaattccgtcgacacgtaaacaccgtactaacctccaaatatcgttaaactaaaaccttatattcaccactacgatacatacctccctaaacaaattccgtcgacacgtaaacaccgtactaacctccaaatatcgttaaactaaaacctaatcgacgtatattcaccactacgatacatacctccctatacaaattccgtcgacacgtaaacaccgtactaacctccaaatatcgttaaactaaaaccttatattcaccactacgatacatacctccctaaacaaattccgtcgacacgtaaacaccgtactaacctccaaatatcgttaaactaaaacctaatcgacgtatattcaccactacgatacatacctc

SEQ ID NO: 25443 - DNA, 509 bp, Artificial Sequence
  chemically treated genomic DNA (Homo sapiens) CpG-island No: 25443
gtagaaagagggtatgtttttttggaataagtttcgtcgataaggtgagtattgtgtggatttttaaaatatcgtttaagtgggagtttgggtcgacgtgtatttattattgcggtgtatgtttttttgtataagtttcgtcgatacgtgagtatcgtgttgatttttaaatatcgttaagttggagttttgtatttattattgcggtgtatgtttttttggataagtttcgtcgatacgtgagtatcgtgttgatttttaaatatcgttaagttggagtttggtcgacgtgtatttattattgcggtgtatgtttttttgtataagtttcgtcgatacgtgagtatcgtgttgatttttaaatatcgttaagttggagttttgtatttattattgcggtgtatgtttttttggataagtttcgtcgatacgtgagtatcgtgttgatttttaaatatcgttaagttggagtttggtcgacgtgtatttattattgcggtgtatgtttt

SEQ ID NO: 25444 - DNA, 509 bp, Artificial Sequence
  chemically treated genomic DNA (Homo sapiens) CpG-island No: 25444
aaaacatacaccgcaataataaatacacgtcgaccaaactccaacttaacgatatttaaaaatcaacacgatactcacgtatcgacgaaacttatccaaaaaaacatacaccgcaataataaatacaaaactccaacttaacgatatttaaaaatcaacacgatactcacgtatcgacgaaacttatacaaaaaaacatacaccgcaataataaatacacgtcgaccaaactccaacttaacgatatttaaaaatcaacacgatactcacgtatcgacgaaacttatccaaaaaaacatacaccgcaataataaatacaaaactccaacttaacgatatttaaaaatcaacacgatactcacgtatcgacgaaacttatacaaaaaaacatacaccgcaataataaatacacgtcgacccaaactcccacttaaacgatattttaaaaatccacacaatactcaccttatcgacgaaacttattccaaaaaaacataccctctttctac

SEQ ID NO: 25445 - DNA, 501 bp, Artificial Sequence
  chemically treated genomic DNA (Homo sapiens) CpG-island No: 25445
ggtcggcgatttggaacgtattttggtacgtttggttttacgaattgttcgtttacgcgatttggttcgtatgcgttacgttttttagtaattgtcggagttgcgtgcgtagttagaaattgtcgatagtgtatcggtataggcgttacgtgagaagatgggcgagtttgtcgagttgcgcgatttgttggagcgagtaattatcgatatatcgtcggtgttggtacgcgacggtggtgttatcgtatcgggttataacgaagagttggatgagtggcgcgcgttggttgacggcgcgatcgattatttggagcgtttggaagttcgcgagcgtgaacgtatcggtttggatacgttgaaagttggttttaatgcggtgtacggttattatatttaaattagtcgtgggtaaagttatttggtatttattaattatatgcgtcgttagatagtgaaaaacgtcgagcgttatattattttagagttaaaagagtacgaaga

SEQ ID NO: 25446 - DNA, 501 bp, Artificial Sequence
  chemically treated genomic DNA (Homo sapiens) CpG-island No: 25446
tcttcgtactcttttaactctaaaataatataacgctcgacgtttttcactatctaacgacgcatataattaataaataccaaataactttacccacgactaatttaaatataataaccgtacaccgcattaaaaccaactttcaacgtatccaaaccgatacgttcacgctcgcgaacttccaaacgctccaaataatcgatcgcgccgtcaaccaacgcgcgccactcatccaactcttcgttataacccgatacgataacaccaccgtcgcgtaccaacaccgacgatatatcgataattactcgctccaacaaatcgcgcaactcgacaaactcgcccatcttctcacgtaacgcctataccgatacactatcgacaatttctaactacgcacgcaactccgacaattactaaaaaacgtaacgcatacgaaccaaatcgcgtaaacgaacaattcgtaaaaccaaacgtaccaaaatacgttccaaatcgccgacc

SEQ ID NO: 25447 - DNA, 501 bp, Artificial Sequence
  chemically treated genomic DNA (Homo sapiens) CpG-island No: 25447
ttttcgtatttttttagttttggaatgatgtagcgttcggcgttttttattgtttggcgacgtatgtagttgatgggtgttagatggttttgtttacggttgatttgaatgtagtagtcgtgtatcgtattaaagttaatttttagcgtgtttaggtcggtacgtttacgttcgcggatttttagacgttttagataatcggtcgcgtcgttagttagcgcgcgttatttatttagtttttcgttatagttcgatgcgataatattatcgtcgcgtattagtatcggcggtgtgtcgatgattgttcgttttagtagatcgcgtagttcggtaaattcgtttatttttttacgtagcgtttgtatcggtgtattatcgatagtttttaattgcgtacgtagtttcggtagttgttggaaagcgtggcgtatacgggttagatcgcgtgggcgagtagttcgtaaagttagacgtgttagaatacgttttaggtcgtcgatt

SEQ ID NO: 25448 - DNA, 501 bp, Artificial Sequence
  chemically treated genomic DNA (Homo sapiens) CpG-island No: 25448
aatcgacgacctaaaacgtattctaacacgtctaactttacgaactactcgcccacgcgatctaacccgtatacgccacgctttccaacaactaccgaaactacgtacgcaattaaaaactatcgataatacaccgatacaaacgctacgtaaaaaaataaacgaatttaccgaactacgcgatctactaaaacgaacaatcatcgacacaccgccgatactaatacgcgacgataatattatcgcatcgaactataacgaaaaactaaataaataacgcgcgctaactaacgacgcgaccgattatctaaaacgtctaaaaatccgcgaacgtaaacgtaccgacctaaacacgctaaaaattaactttaatacgatacacgactactacattcaaatcaaccgtaaacaaaaccatctaacacccatcaactacatacgtcgccaaacaataaaaaacgccgaacgctacatcattccaaaactaaaaaaatacgaaaa

SEQ ID NO: 25449 - DNA, 752 bp, Artificial Sequence
  chemically treated genomic DNA (Homo sapiens) CpG-island No: 25449
  misc_feature (1)..(1): n is either a, c, g or t
  misc_feature (206)..(206): n is either a, c, g or t
  misc_feature (316)..(316): n is either a, c, g or t
  misc_feature (420)..(420): n is either a, c, g or t
  misc_feature (592)..(592): n is either a, c, g or t
nagcgcgcgtcgtttttcgcgttgggacgggacgggataggataggaggggacgttcgggtttggtcgcgcgggatcggttttggtacgtttacgatttcggtagggtcgcgcgggggaggaagcgcgggcgcgtcggatttgtttgttggttttatcgaagaagacgtagttgatagggttcgttttttcgaattgtatcggttngttcgtatagttttagatagtagtttttttcgtttatggcgggcgtcgcgttcgcggcgggggtttcgggggcggtcgttagagtggagtaggatgcgcggtggagtttnggttcggattgtagcggcggttgcggttgcggttttgggttcggcgcggacgtcgttttttggtgttacgtttttatttcgtttattacgtgattcgcggtttntttgcgtttaaacgggtagcgtttggttgcggtggggtttatcggttttaattacgtttcgttcggcgttggaggtttttttttttttttcgagggcggtcggaacgcggcggcgtgattcggaagttcgcgtggtttttcgcggatcgagggcggcgtagtcgttaatttntattttgttgcgagtttttgtgttcggttcggtcgtttttgttttaatttgtattttcgcgtgggatcgttttcggtttaggaaaggtttttttttgttttcgggaggattttttaagtgtttttcgcgttagagttttagtttttgggagtttcgttag

SEQ ID NO: 25450 - DNA, 752 bp, Artificial Sequence
  chemically treated genomic DNA (Homo sapiens) CpG-island No: 25450
  misc_feature (161)..(161): n is either a, c, g or t
  misc_feature (333)..(333): n is either a, c, g or t
  misc_feature (437)..(437): n is either a, c, g or t
  misc_feature (547)..(547): n is either a, c, g or t
  misc_feature (752)..(752): n is either a, c, g or t
ctaacgaaactcccaaaaactaaaactctaacgcgaaaaacacttaaaaaatcctcccgaaaacaaaaaaaaacctttcctaaaccgaaaacgatcccacgcgaaaatacaaattaaaacaaaaacgaccgaaccgaacacaaaaactcgcaacaaaatanaaattaacgactacgccgccctcgatccgcgaaaaaccacgcgaacttccgaatcacgccgccgcgttccgaccgccctcgaaaaaaaaaaaaaaacctccaacgccgaacgaaacgtaattaaaaccgataaaccccaccgcaaccaaacgctacccgtttaaacgcaaanaaaccgcgaatcacgtaataaacgaaataaaaacgtaacaccaaaaaacgacgtccgcgccgaacccaaaaccgcaaccgcaaccgccgctacaatccgaaccnaaactccaccgcgcatcctactccactctaacgaccgcccccgaaacccccgccgcgaacgcgacgcccgccataaacgaaaaaaactactatctaaaactatacgaacnaaccgatacaattcgaaaaaacgaaccctatcaactacgtcttcttcgataaaaccaacaaacaaatccgacgcgcccgcgcttcctcccccgcgcgaccctaccgaaatcgtaaacgtaccaaaaccgatcccgcgcgaccaaacccgaacgtcccctcctatcctatcccgtcccgtcccaacgcgaaaaacgacgcgcgctn

SEQ ID NO: 25451 - DNA, 752 bp, Artificial Sequence
  chemically treated genomic DNA (Homo sapiens) CpG-island No: 25451
  misc_feature (161)..(161): n is either a, c, g or t
  misc_feature (333)..(333): n is either a, c, g or t
  misc_feature (437)..(437): n is either a, c, g or t
  misc_feature (547)..(547): n is either a, c, g or t
  misc_feature (752)..(752): n is either a, c, g or t
ttgacgaagtttttagaggttggaattttggcgcgggaggtatttgggaaattttttcgaaagtaaggaggagttttttttagatcgggagcggttttacgcgggggtataggttggggtaggggcgatcgagtcgggtataggaattcgtagtagggtangggttggcggttacgtcgttttcggttcgcggggaattacgcgggttttcgggttacgtcgtcgcgtttcgatcgttttcggggagaggggaggagtttttagcgtcgggcggggcgtggttaaggtcggtgggttttatcgtagttagacgttgttcgtttaagcgtagangggtcgcgggttacgtggtgggcggggtgggggcgtggtattaggaagcggcgttcgcgtcgggtttagagtcgtagtcgtagtcgtcgttatagttcgggttngggttttatcgcgtattttgttttattttggcgatcgttttcggggttttcgtcgcgggcgcggcgttcgttatgggcgaggaggattattatttggagttgtgcgagtnggtcggtgtagttcgagaaggcgaattttgttaattgcgtttttttcgatgaggttaataagtaggttcggcgcgttcgcgttttttttttcgcgcggttttgtcggggtcgtgggcgtgttaaggtcggtttcgcgcgattaggttcgagcgtttttttttgttttgtttcgtttcgttttagcgcgggaggcggcgcgcgttn

SEQ ID NO: 25452 - DNA, 752 bp, Artificial Sequence
  chemically treated genomic DNA (Homo sapiens) CpG-island No: 25452
  misc_feature (1)..(1): n is either a, c, g or t
  misc_feature (206)..(206): n is either a, c, g or t
  misc_feature (316)..(316): n is either a, c, g or t
  misc_feature (420)..(420): n is either a, c, g or t
  misc_feature (592)..(592): n is either a, c, g or t
naacgcgcgccgcctcccgcgctaaaacgaaacgaaacaaaacaaaaaaaaacgctcgaacctaatcgcgcgaaaccgaccttaacacgcccacgaccccgacaaaaccgcgcgaaaaaaaaaacgcgaacgcgccgaacctacttattaacctcatcgaaaaaaacgcaattaacaaaattcgccttctcgaactacaccgaccnactcgcacaactccaaataataatcctcctcgcccataacgaacgccgcgcccgcgacgaaaaccccgaaaacgatcgccaaaataaaacaaaatacgcgataaaacccnaacccgaactataacgacgactacgactacgactctaaacccgacgcgaacgccgcttcctaataccacgcccccaccccgcccaccacgtaacccgcgacccntctacgcttaaacgaacaacgtctaactacgataaaacccaccgaccttaaccacgccccgcccgacgctaaaaactcctcccctctccccgaaaacgatcgaaacgcgacgacgtaacccgaaaacccgcgtaattccccgcgaaccgaaaacgacgtaaccgccaacccntaccctactacgaattcctatacccgactcgatcgcccctaccccaacctatacccccgcgtaaaaccgctcccgatctaaaaaaaactcctccttactttcgaaaaaatttcccaaatacctcccgcgccaaaattccaacctctaaaaacttcgtcaa

SEQ ID NO: 25453 - DNA, 734 bp, Artificial Sequence
  chemically treated genomic DNA (Homo sapiens) CpG-island No: 25453
  misc_feature (312)..(312): n is either a, c, g or t
  misc_feature (318)..(318): n is either a, c, g or t
  misc_feature (333)..(333): n is either a, c, g or t
  misc_feature (338)..(338): n is either a, c, g or t
  misc_feature (353)..(353): n is either a, c, g or t
  misc_feature (358)..(358): n is either a, c, g or t
  misc_feature (367)..(367): n is either a, c, g or t
  misc_feature (379)..(379): n is either a, c, g or t
  misc_feature (396)..(396): n is either a, c, g or t
  misc_feature (403)..(403): n is either a, c, g or t
  misc_feature (532)..(532): n is either a, c, g or t
  misc_feature (558)..(558): n is either a, c, g or t
ttgcgtttttcgttggttgttttttcgggcgggcgtttttttatttagtttaggtgttttttttcggtttcgcgttttgtttgtttttttcgggttttaagttcgtttttgtttcgcggagttttgttttttttacgtttagtttcgtagtttcgtagtttcgtcgcgtttcgtggagagtattttcgtttgcggttagttaggttttttcgttttggtagtttcgtatttgagtcggagtcgagttgggagggtcgcgggggtcgggtcggcggagttggtagataaaagagtagtcgggtagcggttttngttttnaagtcgggggagggncgggncggtttcgggcgttnttggnttatagttngttttcgcgggntttaggcgacgtcgagncgttttngtatttcgttcgtcgagtataagtagttttgtttcgttaggtttacgtgttgtacgcgcgggagaggggtcggtcgcgtagaggtggcgttttaggattttttgtggcgttatatagatgggaagattngaggttcgggagtggattttcggggntttttcggcgtagagttgtagtcgcgtttttcgtatttcgggacgacgggaagcgtaggtttcggtttttgggttcggttgattttgggagggtcggggagggcggtcgtaggagagtggttgcgttttttagttagagttcggtcggtttttacgtttatttagtttatttcgtt

SEQ ID NO: 25454 - DNA, 734 bp, Artificial Sequence
  chemically treated genomic DNA (Homo sapiens) CpG-island No: 25454
  misc_feature (177)..(177): n is either a, c, g or t
  misc_feature (203)..(203): n is either a, c, g or t
  misc_feature (332)..(332): n is either a, c, g or t
  misc_feature (339)..(339): n is either a, c, g or t
  misc_feature (356)..(356): n is either a, c, g or t
  misc_feature (368)..(368): n is either a, c, g or t
  misc_feature (377)..(377): n is either a, c, g or t
  misc_feature (382)..(382): n is either a, c, g or t
  misc_feature (397)..(397): n is either a, c, g or t
  misc_feature (402)..(402): n is either a, c, g or t
  misc_feature (417)..(417): n is either a, c, g or t
  misc_feature (423)..(423): n is either a, c, g or t
aacgaaataaactaaataaacgtaaaaaccgaccgaactctaactaaaaaacgcaaccactctcctacgaccgccctccccgaccctcccaaaatcaaccgaacccaaaaaccgaaacctacgcttcccgtcgtcccgaaatacgaaaaacgcgactacaactctacgccgaaaaanccccgaaaatccactcccgaacctcnaatcttcccatctatataacgccacaaaaaatcctaaaacgccacctctacgcgaccgacccctctcccgcgcgtacaacacgtaaacctaacgaaacaaaactacttatactcgacgaacgaaatacnaaaacgnctcgacgtcgcctaaancccgcgaaaacnaactataanccaanaacgcccgaaaccgncccgnccctcccccgacttnaaaacnaaaaccgctacccgactactcttttatctaccaactccgccgacccgacccccgcgaccctcccaactcgactccgactcaaatacgaaactaccaaaacgaaaaaacctaactaaccgcaaacgaaaatactctccacgaaacgcgacgaaactacgaaactacgaaactaaacgtaaaaaaaacaaaactccgcgaaacaaaaacgaacttaaaacccgaaaaaaacaaacaaaacgcgaaaccgaaaaaaaacacctaaactaaataaaaaaacgcccgcccgaaaaaacaaccaacgaaaaacgcaa

SEQ ID NO: 25455 - DNA, 734 bp, Artificial Sequence
  chemically treated genomic DNA (Homo sapiens) CpG-island No: 25455
  misc_feature (177)..(177): n is either a, c, g or t
  misc_feature (203)..(203): n is either a, c, g or t
  misc_feature (332)..(332): n is either a, c, g or t
  misc_feature (339)..(339): n is either a, c, g or t
  misc_feature (356)..(356): n is either a, c, g or t
  misc_feature (368)..(368): n is either a, c, g or t
  misc_feature (377)..(377): n is either a, c, g or t
  misc_feature (382)..(382): n is either a, c, g or t
  misc_feature (397)..(397): n is either a, c, g or t
  misc_feature (402)..(402): n is either a, c, g or t
  misc_feature (417)..(417): n is either a, c, g or t
  misc_feature (423)..(423): n is either a, c, g or t
ggcggggtgggttgagtaagcgtaggggtcggtcgagttttagttgggaaacgtagttatttttttgcggtcgtttttttcgatttttttagggttagtcgggtttagaagtcggagtttgcgtttttcgtcgtttcgaagtgcgagaagcgcggttgtagttttgcgtcgaggagntttcgggagtttattttcgggttttnggtttttttatttgtgtgacgttataggaagttttgagacgttatttttgcgcggtcgatttttttttcgcgcgtgtaatacgtgggtttggcggggtagagttgtttgtgttcggcgggcggggtgtnggggcgnttcggcgtcgtttgggnttcgcggaggtnggttgtagnttagnagcgttcgaggtcgnttcgnttttttttcggtttnggggtnggggtcgttgttcggttgtttttttatttgttagtttcgtcgattcggttttcgcggtttttttagttcggtttcggtttaggtacggggttgttaagacggggaggtttggttggtcgtagacgagggtgttttttacggggcgcggcggggttgcggggttgcggggttggacgtggaaagagtaaggtttcgcggggtaggggcggatttgggattcggggaagataggtaggacgcggagtcggaggggagtatttgggttaagtgagaggacgttcgttcggggaagtagttagcggagggcgtag

SEQ ID NO: 25456 - DNA, 734 bp, Artificial Sequence
  chemically treated genomic DNA (Homo sapiens) CpG-island No: 25456
  misc_feature (312)..(312): n is either a, c, g or t
  misc_feature (318)..(318): n is either a, c, g or t
  misc_feature (333)..(333): n is either a, c, g or t
  misc_feature (338)..(338): n is either a, c, g or t
  misc_feature (353)..(353): n is either a, c, g or t
  misc_feature (358)..(358): n is either a, c, g or t
  misc_feature (367)..(367): n is either a, c, g or t
  misc_feature (379)..(379): n is either a, c, g or t
  misc_feature (396)..(396): n is either a, c, g or t
  misc_feature (403)..(403): n is either a, c, g or t
  misc_feature (532)..(532): n is either a, c, g or t
  misc_feature (558)..(558): n is either a, c, g or t
ctacgccctccgctaactacttccccgaacgaacgtcctctcacttaacccaaatactcccctccgactccgcgtcctacctatcttccccgaatcccaaatccgcccctaccccgcgaaaccttactctttccacgtccaaccccgcaaccccgcaaccccgccgcgccccgtaaaaaacaccctcgtctacgaccaaccaaacctccccgtcttaacaaccccgtacctaaaccgaaaccgaactaaaaaaaccgcgaaaaccgaatcgacgaaactaacaaataaaaaaacaaccgaacaacgaccccnaccccnaaaccgaaaaaaaancgaancgacctcgaacgctnctaanctacaaccnacctccgcgaancccaaacgacgccgaancgccccnacaccccgcccgccgaacacaaacaactctaccccgccaaacccacgtattacacgcgcgaaaaaaaaatcgaccgcgcaaaaataacgtctcaaaacttcctataacgtcacacaaataaaaaaaccnaaaacccgaaaataaactcccgaaanctcctcgacgcaaaactacaaccgcgcttctcgcacttcgaaacgacgaaaaacgcaaactccgacttctaaacccgactaaccctaaaaaaatcgaaaaaaacgaccgcaaaaaaataactacgtttcccaactaaaactcgaccgacccctacgcttactcaacccaccccgcc

SEQ ID NO: 25457 - DNA, 679 bp, Artificial Sequence
  chemically treated genomic DNA (Homo sapiens) CpG-island No: 25457
  misc_feature (52)..(52): n is either a, c, g or t
  misc_feature (269)..(269): n is either a, c, g or t
  misc_feature (331)..(331): n is either a, c, g or t
  misc_feature (455)..(455): n is either a, c, g or t
  misc_feature (506)..(506): n is either a, c, g or t
aattttcgtcgtttttttttgcgtatcgtttttttagattttttaatagtancgtttttttttttcgttttttttattttttttaagtttcgttttttaattttttttagattataatttttttcgtttgtgaatttttaacgttgtttttttttttgttttcgatttcgtttttattatttttaggtgttttttaaatttttttcgttttacgtttttaggttttatttggtttttaacgtttttttattttttagcgttttatttgntatttttcgtttttttagcgtcgtcgcgtttagttatacgtcgtaggtttttttttcggggntttgttcgttttatggtcgttgaggagacgaagtcggtaggacgtcggcgtaggttttcggcgttttagggaacgttagaatcgcggtcgtcgacgttcggatttcgcgttaacgttggggggnggggttacgtcgcgatcgtttcgggcgttagtttcgtttcggtaaggtttntggtttttttcgttgtgtttcgtttacgtattaattttcgcggtcggttttttgagtgcgtgcggtatatttttttgcgcggaggagtgcgtgttttttttgattcgtttttttaagagcggattcggaagttgttgtgtgaacggttttcgatagttttagaaatgtatatt

SEQ ID NO: 25458 - DNA, 679 bp, Artificial Sequence
  chemically treated genomic DNA (Homo sapiens) CpG-island No: 25458
  misc_feature (174)..(174): n is either a, c, g or t
  misc_feature (225)..(225): n is either a, c, g or t
  misc_feature (349)..(349): n is either a, c, g or t
  misc_feature (411)..(411): n is either a, c, g or t
  misc_feature (628)..(628): n is either a, c, g or t
aatatacatttctaaaactatcgaaaaccgttcacacaacaacttccgaatccgctcttaaaaaaacgaatcaaaaaaaacacgcactcctccgcgcaaaaaaatataccgcacgcactcaaaaaaccgaccgcgaaaattaatacgtaaacgaaacacaacgaaaaaaaccanaaaccttaccgaaacgaaactaacgcccgaaacgatcgcgacgtaaccccnccccccaacgttaacgcgaaatccgaacgtcgacgaccgcgattctaacgttccctaaaacgccgaaaacctacgccgacgtcctaccgacttcgtctcctcaacgaccataaaacgaacaaanccccgaaaaaaaaacctacgacgtataactaaacgcgacgacgctaaaaaaacgaaaaatancaaataaaacgctaaaaaataaaaaaacgttaaaaaccaaataaaacctaaaaacgtaaaacgaaaaaaatttaaaaaacacctaaaaataataaaaacgaaatcgaaaacaaaaaaaaaaacaacgttaaaaattcacaaacgaaaaaaattataatctaaaaaaaattaaaaaacgaaacttaaaaaaaataaaaaaaacgaaaaaaaaaaacgntactattaaaaaatctaaaaaaacgatacgcaaaaaaaaacgacgaaaatt

SEQ ID NO: 25459 - DNA, 679 bp, Artificial Sequence
  chemically treated genomic DNA (Homo sapiens) CpG-island No: 25459
  misc_feature (174)..(174): n is either a, c, g or t
  misc_feature (225)..(225): n is either a, c, g or t
  misc_feature (349)..(349): n is either a, c, g or t
  misc_feature (411)..(411): n is either a, c, g or t
  misc_feature (628)..(628): n is either a, c, g or t
aatgtatatttttgaggttgtcgagaatcgtttatatagtagttttcgaattcgtttttgaaagagcggattagaaagaatacgtattttttcgcgtagggaaatatgtcgtacgtatttaagggatcggtcgcgaaagttagtgcgtgggcggggtatagcgaagggggttangggttttgtcggggcggggttggcgttcggggcggtcgcgacgtaattttnttttttagcgttggcgcgagattcgaacgtcggcggtcgcggttttggcgttttttgaggcgtcgggagtttgcgtcggcgttttgtcggtttcgtttttttagcggttatgaggcggataggntttcgaggaggaggtttgcggcgtgtggttggacgcggcggcgttgaagaggcggaaagtgntaggtgggacgttgggggatgagagggcgttgggaattaggtagggtttggaggcgtaagacgggaggagtttgggggatatttggagatgatgaaagcgaagtcggggatagagaagggaatagcgttggggatttataggcgagagggattgtggtttgaagaaggttgaaaaacggggtttggggaggatgggagggacggaaggaaagagcgntgttgttggggggtttggaggagcggtgcgtagggaggggcggcgaaggtt

SEQ ID NO: 25460 - DNA, 679 bp, Artificial Sequence
  chemically treated genomic DNA (Homo sapiens) CpG-island No: 25460
  misc_feature (52)..(52): n is either a, c, g or t
  misc_feature (269)..(269): n is either a, c, g or t
  misc_feature (331)..(331): n is either a, c, g or t
  misc_feature (455)..(455): n is either a, c, g or t
  misc_feature (506)..(506): n is either a, c, g or t
aaccttcgccgcccctccctacgcaccgctcctccaaaccccccaacaacancgctctttccttccgtccctcccatcctccccaaaccccgtttttcaaccttcttcaaaccacaatccctctcgcctataaatccccaacgctattcccttctctatccccgacttcgctttcatcatctccaaatatcccccaaactcctcccgtcttacgcctccaaaccctacctaattcccaacgccctctcatcccccaacgtcccacctancactttccgcctcttcaacgccgccgcgtccaaccacacgccgcaaacctcctcctcgaaancctatccgcctcataaccgctaaaaaaacgaaaccgacaaaacgccgacgcaaactcccgacgcctcaaaaaacgccaaaaccgcgaccgccgacgttcgaatctcgcgccaacgctaaaaaanaaaattacgtcgcgaccgccccgaacgccaaccccgccccgacaaaacccntaacccccttcgctataccccgcccacgcactaactttcgcgaccgatcccttaaatacgtacgacatatttccctacgcgaaaaaatacgtattctttctaatccgctctttcaaaaacgaattcgaaaactactatataaacgattctcgacaacctcaaaaatatacatt

SEQ ID NO: 25461 - DNA, 532 bp, Artificial Sequence
  chemically treated genomic DNA (Homo sapiens) CpG-island No: 25461
  misc_feature (69)..(69): n is either a, c, g or t
  misc_feature (80)..(80): n is either a, c, g or t
  misc_feature (105)..(105): n is either a, c, g or t
  misc_feature (445)..(445): n is either a, c, g or t
  misc_feature (456)..(456): n is either a, c, g or t
  misc_feature (466)..(466): n is either a, c, g or t
  misc_feature (528)..(528): n is either a, c, g or t
ggcgttttacgcgggttgtggggggcgggggcggtacgtgtcgtcgttttcggttaatgcggagttttngcgcggaggtntacgtgtttttgtttggcgtttttngtgcgcgttcgggtttgttggtgtttagagtgtggttaggcggttcggattgagtaggtgggtgcggggttcggaggaggcggcggttggttgaggttagtaagagggacgcggtcggcgggaggggttgggtcgtggtagcgattttttgttgtagggcggcgggcggggttgcgggtttcggaggggttggtgggcgggggtcgtttcgttttgtgtgtggttcgggcggagtttcgtttttgttttcgtttttcgggggcgcggttgttcgtgggtagggggttgggcgattatcgggcgttcgtttcggggtgtcgtcgaggagataatagggggncgtgggttttncgtttatttntttttttttttttttttttttgcgggtttcgtcgggttttttattgtttgaagggacggggncggt

SEQ ID NO: 25462 - DNA, 532 bp, Artificial Sequence
  chemically treated genomic DNA (Homo sapiens) CpG-island No: 25462
  misc_feature (5)..(5): n is either a, c, g or t
  misc_feature (67)..(67): n is either a, c, g or t
  misc_feature (77)..(77): n is either a, c, g or t
  misc_feature (88)..(88): n is either a, c, g or t
  misc_feature (428)..(428): n is either a, c, g or t
  misc_feature (453)..(453): n is either a, c, g or t
  misc_feature (464)..(464): n is either a, c, g or t
accgnccccgtcccttcaaacaataaaaaacccgacgaaacccgcaaaaaaaaaaaaaaaaaaaaanaaataaacgnaaaacccacgnccccctattatctcctcgacgacaccccgaaacgaacgcccgataatcgcccaaccccctacccacgaacaaccgcgcccccgaaaaacgaaaacaaaaacgaaactccgcccgaaccacacacaaaacgaaacgacccccgcccaccaacccctccgaaacccgcaaccccgcccgccgccctacaacaaaaaatcgctaccacgacccaacccctcccgccgaccgcgtccctcttactaacctcaaccaaccgccgcctcctccgaaccccgcacccacctactcaatccgaaccgcctaaccacactctaaacaccaacaaacccgaacgcgcacnaaaaacgccaaacaaaaacacgtanacctccgcgcnaaaactccgcattaaccgaaaacgacgacacgtaccgcccccgccccccacaacccgcgtaaaacgcc

SEQ ID NO: 25463 - DNA, 532 bp, Artificial Sequence
  chemically treated genomic DNA (Homo sapiens) CpG-island No: 25463
  misc_feature (5)..(5): n is either a, c, g or t
  misc_feature (67)..(67): n is either a, c, g or t
  misc_feature (77)..(77): n is either a, c, g or t
  misc_feature (88)..(88): n is either a, c, g or t
  misc_feature (428)..(428): n is either a, c, g or t
  misc_feature (453)..(453): n is either a, c, g or t
  misc_feature (464)..(464): n is either a, c, g or t
atcgntttcgtttttttagataatggggaattcggcggggttcgtagggaagggagggagggagggnaggtaaacgnagggtttacgnttttttattgttttttcgacggtatttcggagcggacgttcggtgatcgtttagttttttgtttacgaatagtcgcgttttcggagagcggggataaaggcgaggtttcgttcgagttatatataaagcggagcgattttcgtttattaattttttcgaggttcgtagtttcgttcgtcgttttgtagtagggggtcgttgttacggtttagtttttttcgtcgatcgcgttttttttgttggttttagttagtcgtcgtttttttcgagtttcgtatttatttgtttagttcgagtcgtttgattatattttgagtattaatagattcgggcgcgtatnaaaagcgttaaatagaggtacgtgnattttcgcgtnggggtttcgtattggtcgagagcggcggtacgtgtcgttttcgttttttataattcgcgtggagcgtt

SEQ ID NO: 25464 - DNA, 532 bp, Artificial Sequence
  chemically treated genomic DNA (Homo sapiens) CpG-island No: 25464
  misc_feature (69)..(69): n is either a, c, g or t
  misc_feature (80)..(80): n is either a, c, g or t
  misc_feature (105)..(105): n is either a, c, g or t
  misc_feature (445)..(445): n is either a, c, g or t
  misc_feature (456)..(456): n is either a, c, g or t
  misc_feature (466)..(466): n is either a, c, g or t
  misc_feature (528)..(528): n is either a, c, g or t
aacgctccacgcgaattataaaaaacgaaaacgacacgtaccgccgctctcgaccaatacgaaaccccnacgcgaaaatncacgtacctctatttaacgcttttnatacgcgcccgaatctattaatactcaaaatataatcaaacgactcgaactaaacaaataaatacgaaactcgaaaaaaacgacgactaactaaaaccaacaaaaaaaacgcgatcgacgaaaaaaactaaaccgtaacaacgaccccctactacaaaacgacgaacgaaactacgaacctcgaaaaaattaataaacgaaaatcgctccgctttatatataactcgaacgaaacctcgcctttatccccgctctccgaaaacgcgactattcgtaaacaaaaaactaaacgatcaccgaacgtccgctccgaaataccgtcgaaaaaacaataaaaaancgtaaaccctncgtttacctnccctccctccctcccttccctacgaaccccgccgaattccccattatctaaaaaaacgaaancgat

SEQ ID NO: 25465 - DNA, 683 bp, Artificial Sequence
  chemically treated genomic DNA (Homo sapiens) CpG-island No: 25465
gacgtcgtggggcgtgttcggtatgacgatttgttacgatttgcgttttttttatttttatcgcgatttcgcgtacgtcggcgcgacgatgtttgcgattttttcgttttttatcgtgtcgacgggttaggtttattggtatacgttgttgcgtgcgcgggcgatcgagatcggttgtttcgtgttcgcgtcggtttaggtcggtatttataagggttttaatcgtaagatttacgggtattcgatcgtcgtggtttcgtggggcgaggtgttggtcgacgtcggggttgagaaggtaggtttcgttatcgtcgaggtcgatttcgttaaggtcgcggaggttcgtaagatggtgtcgtttttgacgtacgatcggaaatacgtcgcgtcggtgttgtataagtcggcggtcgcgaaggcggcggagtaattcgttagagttttcgcgcggcgatgcgttggattatcgttattttcggttcgttgattaggcgtgtttcgtaggcgacgacggagaatcgatcgcgtacgagttcgagtagttcgtcgttttttagtaggaatttcggattgttcggacggtcgaagcgtttattgttttttatgaaagtttcgtagaggagtacgtcgtcgcgtttgagggaatcgattagcgtcggtatttgtaacgtttgttttagttt

SEQ ID NO: 25466 - DNA, 683 bp, Artificial Sequence
  chemically treated genomic DNA (Homo sapiens) CpG-island No: 25466
aaactaaaacaaacgttacaaataccgacgctaatcgattccctcaaacgcgacgacgtactcctctacgaaactttcataaaaaacaataaacgcttcgaccgtccgaacaatccgaaattcctactaaaaaacgacgaactactcgaactcgtacgcgatcgattctccgtcgtcgcctacgaaacacgcctaatcaacgaaccgaaaataacgataatccaacgcatcgccgcgcgaaaactctaacgaattactccgccgccttcgcgaccgccgacttatacaacaccgacgcgacgtatttccgatcgtacgtcaaaaacgacaccatcttacgaacctccgcgaccttaacgaaatcgacctcgacgataacgaaacctaccttctcaaccccgacgtcgaccaacacctcgccccacgaaaccacgacgatcgaatacccgtaaatcttacgattaaaacccttataaataccgacctaaaccgacgcgaacacgaaacaaccgatctcgatcgcccgcgcacgcaacaacgtataccaataaacctaacccgtcgacacgataaaaaacgaaaaaatcgcaaacatcgtcgcgccgacgtacgcgaaatcgcgataaaaataaaaaaaacgcaaatcgtaacaaatcgtcataccgaacacgccccacgacgtc

SEQ ID NO: 25467 - DNA, 683 bp, Artificial Sequence
  chemically treated genomic DNA (Homo sapiens) CpG-island No: 25467
aggttgaggtaggcgttgtaagtgtcgacgttggtcgatttttttaagcgcggcggcgtgtttttttacgagatttttatggaaggtaatgagcgtttcggtcgttcgagtaattcggagtttttgttgaaggacggcgagttgttcgagttcgtgcgcggtcggtttttcgtcgtcgtttacgaagtacgtttgattagcgaatcgaagatggcgatggtttagcgtatcgtcgcgcgaaagttttagcgagttatttcgtcgttttcgcgatcgtcggtttgtgtagtatcggcgcggcgtattttcgatcgtgcgttagggacggtattattttgcgggttttcgcgattttggcgaggtcgatttcggcgatgacgaagtttgtttttttagtttcggcgtcggttagtatttcgttttacggggttacggcgatcgagtgttcgtaggttttgcggttggagtttttgtgggtgtcgatttgggtcggcgcgaatacgaagtagtcggtttcgatcgttcgcgtacgtagtagcgtgtgttagtgagtttggttcgtcggtacggtgaaggacgaggggatcgtaagtatcgtcgcgtcggcgtgcgcgagatcgcgatagagataggggaagcgtaggtcgtagtagatcgttatgtcgagtacgttttacggcgtt

SEQ ID NO: 25468 - DNA, 683 bp, Artificial Sequence
  chemically treated genomic DNA (Homo sapiens) CpG-island No: 25468
aacgccgtaaaacgtactcgacataacgatctactacgacctacgcttcccctatctctatcgcgatctcgcgcacgccgacgcgacgatacttacgatcccctcgtccttcaccgtaccgacgaaccaaactcactaacacacgctactacgtacgcgaacgatcgaaaccgactacttcgtattcgcgccgacccaaatcgacacccacaaaaactccaaccgcaaaacctacgaacactcgatcgccgtaaccccgtaaaacgaaatactaaccgacgccgaaactaaaaaaacaaacttcgtcatcgccgaaatcgacctcgccaaaatcgcgaaaacccgcaaaataataccgtccctaacgcacgatcgaaaatacgccgcgccgatactacacaaaccgacgatcgcgaaaacgacgaaataactcgctaaaactttcgcgcgacgatacgctaaaccatcgccatcttcgattcgctaatcaaacgtacttcgtaaacgacgacgaaaaaccgaccgcgcacgaactcgaacaactcgccgtccttcaacaaaaactccgaattactcgaacgaccgaaacgctcattaccttccataaaaatctcgtaaaaaaacacgccgccgcgcttaaaaaaatcgaccaacgtcgacacttacaacgcctacctcaacct

SEQ ID NO: 25469 - DNA, 757 bp, Artificial Sequence
  chemically treated genomic DNA (Homo sapiens) CpG-island No: 25469
ggttcgcgtttgtatgttagcggtcgtttttagtggtggttatcgttagtgttaattttttgcgtcgtcgtgtagtttcgttttttgtcgttgtagtcgtcgcgttcgttttagtgtttttaattcgcgttcgggagtgaggagtcgttaatattttagtttcgttgttgtcgttatcgtagtgttttttagtcgttattggttatttaaattttttagtattcgcgattttttcgggatttcgcggcggcggggtagaggcggtttaggggcggtacgcggttgtttcggtgcgtcgggtttttttcggtcgtcgtacggtcgggttttataggttgtttttttgagagaggtttagaatacggttaggtacgcgtcgtcgttatagttgcgttgttagcgacgaggtgagtgttaggtgtttggtgggtcgggcgcggggttcgtaaatttttgcgtacggcgttgattttttgcggttttgtcggcggtttcggtcgtttagacgtttcgttcgttacgaatttttggagacgtagggttttagttgttatcgtagtatttggattagggtgcggagcgttttttggatttaataatatcgggaggttttcgtttttttaaagtgcgtgcgcgtcgtgtggggagtgtacggaggttggcgggagacgtttttttggggaagggggaggcggttgttaagtttaggaaagtattcggtttttttttggtgtttttttgtttgtcgtttttggga

SEQ ID NO: 25470 - DNA, 757 bp, Artificial Sequence
  chemically treated genomic DNA (Homo sapiens) CpG-island No: 25470
tcccaaaaacgacaaacaaaaaaacaccaaaaaaaaaccgaatactttcctaaacttaacaaccgcctcccccttccccaaaaaaacgtctcccgccaacctccgtacactccccacacgacgcgcacgcactttaaaaaaacgaaaacctcccgatattattaaatccaaaaaacgctccgcaccctaatccaaatactacgataacaactaaaaccctacgtctccaaaaattcgtaacgaacgaaacgtctaaacgaccgaaaccgccgacaaaaccgcaaaaaatcaacgccgtacgcaaaaatttacgaaccccgcgcccgacccaccaaacacctaacactcacctcgtcgctaacaacgcaactataacgacgacgcgtacctaaccgtattctaaacctctctcaaaaaaacaacctataaaacccgaccgtacgacgaccgaaaaaaacccgacgcaccgaaacaaccgcgtaccgcccctaaaccgcctctaccccgccgccgcgaaatcccgaaaaaatcgcgaatactaaaaaatttaaataaccaataacgactaaaaaacactacgataacgacaacaacgaaactaaaatattaacgactcctcactcccgaacgcgaattaaaaacactaaaacgaacgcgacgactacaacgacaaaaaacgaaactacacgacgacgcaaaaaattaacactaacgataaccaccactaaaaacgaccgctaacatacaaacgcgaacc

SEQ ID NO: 25471 - DNA, 757 bp, Artificial Sequence
  chemically treated genomic DNA (Homo sapiens) CpG-island No: 25471
ttttaagagcggtaaataaaggggtattaggaagaaatcgagtatttttttaaatttagtagtcgttttttttttttttaaaggagcgtttttcgttaattttcgtatattttttatacggcgcgtacgtattttgggggagcggaaatttttcggtattgttgagtttagggagcgtttcgtattttagtttaagtgttgcggtaatagttggggttttgcgtttttaggagttcgtggcgagcggagcgtttggacggtcggagtcgtcggtaggatcgtagggagttagcgtcgtacgtaaaagtttgcggatttcgcgttcggtttattaaatatttagtatttatttcgtcgttagtagcgtaattgtggcggcggcgcgtatttggtcgtgttttgagttttttttaggagggtagtttgtgaggttcggtcgtgcggcggtcgaaaagagttcggcgtatcggagtagtcgcgtgtcgtttttgggtcgtttttgtttcgtcgtcgcggagtttcggaaaggtcgcgggtattggaaagtttaggtaattaatggcgattagagagtattgcggtggcggtagtagcggagttggggtgttggcggttttttattttcgagcgcgaattgggggtattggagcgggcgcggcggttgtagcgatagagggcgggattgtacggcggcgtaagggattggtattggcggtgattattattgggagcggtcgttagtatgtaaacgcggatt

SEQ ID NO: 25472 - DNA, 757 bp, Artificial Sequence
  chemically treated genomic DNA (Homo sapiens) CpG-island No: 25472
aatccgcgtttacatactaacgaccgctcccaataataatcaccgccaataccaatcccttacgccgccgtacaatcccgccctctatcgctacaaccgccgcgcccgctccaatacccccaattcgcgctcgaaaataaaaaaccgccaacaccccaactccgctactaccgccaccgcaatactctctaatcgccattaattacctaaactttccaatacccgcgacctttccgaaactccgcgacgacgaaacaaaaacgacccaaaaacgacacgcgactactccgatacgccgaactcttttcgaccgccgcacgaccgaacctcacaaactaccctcctaaaaaaaactcaaaacacgaccaaatacgcgccgccgccacaattacgctactaacgacgaaataaatactaaatatttaataaaccgaacgcgaaatccgcaaacttttacgtacgacgctaactccctacgatcctaccgacgactccgaccgtccaaacgctccgctcgccacgaactcctaaaaacgcaaaaccccaactattaccgcaacacttaaactaaaatacgaaacgctccctaaactcaacaataccgaaaaatttccgctcccccaaaatacgtacgcgccgtataaaaaatatacgaaaattaacgaaaaacgctcctttaaaaaaaaaaaaaacgactactaaatttaaaaaaatactcgatttcttcctaatacccctttatttaccgctcttaaaa

SEQ ID NO: 25473 - DNA, 638 bp, Artificial Sequence
  chemically treated genomic DNA (Homo sapiens) CpG-island No: 25473
acggtgatgtggcgaaattggcgggattttcgcgtcgcgcgtaggtgggcggtgtgttaaagcgtttttttgaaggtagtattttattttggtatcgggtggttaatcgttacggtataatttcgttaatcggatcggatttatagcgttcgtttaggtattattggtagaaggtgtgatggtatcgggaagcgggtaaatcgatttgtagcgttatcgttggaattattaatttttttcgggcggagagggttaacgtcgtttaatattgcgtaggagttggaattgtcgaagacggatttatttgagttggtgaagtttaaggtatcgtagtcgttgcgttatcgttggtttgaatcggtacgcgcgtttgttgtatcggtattaatgttaggtcggttttagtttcgttttggttgagttatcggttgaacggtatcggtgataaatattagtttgttatttatcgtaatcgtcgtatttatagaatatttcggttcggtttgatattttgttcggttagatgcggattaagttcgatggtggacgtttatttttttatatcgaacgtttttttcgttatttttgaatgtaggtcgatgaggagttttagtaacgcgttttttcggtttaggtga

SEQ ID NO: 25474 - DNA, 638 bp, Artificial Sequence
  chemically treated genomic DNA (Homo sapiens) CpG-island No: 25474
tcacctaaaccgaaaaaacgcgttactaaaactcctcatcgacctacattcaaaaataacgaaaaaaacgttcgatataaaaaaataaacgtccaccatcgaacttaatccgcatctaaccgaacaaaatatcaaaccgaaccgaaatattctataaatacgacgattacgataaataacaaactaatatttatcaccgataccgttcaaccgataactcaaccaaaacgaaactaaaaccgacctaacattaataccgatacaacaaacgcgcgtaccgattcaaaccaacgataacgcaacgactacgataccttaaacttcaccaactcaaataaatccgtcttcgacaattccaactcctacgcaatattaaacgacgttaaccctctccgcccgaaaaaaattaataattccaacgataacgctacaaatcgatttacccgcttcccgataccatcacaccttctaccaataatacctaaacgaacgctataaatccgatccgattaacgaaattataccgtaacgattaaccacccgataccaaaataaaatactaccttcaaaaaaacgctttaacacaccgcccacctacgcgcgacgcgaaaatcccgccaatttcgccacatcaccgt

SEQ ID NO: 25475 - DNA, 638 bp, Artificial Sequence
  chemically treated genomic DNA (Homo sapiens) CpG-island No: 25475
ttatttgggtcggaagggcgcgttgttaaaattttttatcggtttatatttaaaagtggcggagaaagcgttcgatatggaggggtaaacgtttattatcgggtttggttcgtatttaatcgggtagaatgttaagtcgaatcggggtattttgtgagtgcggcgattacggtgaatgataaattggtatttattatcgatatcgtttagtcggtgatttaattagggcgaaattaaagtcgatttgatattggtgtcggtatagtaaacgcgcgtgtcggtttaggttagcggtggcgtaacgattacggtattttggattttattaatttaggtgaattcgttttcggtagttttagtttttacgtaatattaagcgacgttaatttttttcgttcggagagggttagtagttttagcgataacgttgtaagtcgatttgttcgtttttcgatattattatattttttgttagtaatgtttgggcggacgttgtaaattcggttcggttagcgaaattgtgtcgtggcgattaattattcggtgttagggtaaggtgttgtttttagggagacgttttaatatatcgtttatttgcgcgcggcgcggggatttcgttagtttcgttatattatcgt

SEQ ID NO: 25476 - DNA, 638 bp, Artificial Sequence
  chemically treated genomic DNA (Homo sapiens) CpG-island No: 25476
acgataatataacgaaactaacgaaatccccgcgccgcgcgcaaataaacgatatattaaaacgtctccctaaaaacaacaccttaccctaacaccgaataattaatcgccacgacacaatttcgctaaccgaaccgaatttacaacgtccgcccaaacattactaacaaaaaatataataatatcgaaaaacgaacaaatcgacttacaacgttatcgctaaaactactaaccctctccgaacgaaaaaaattaacgtcgcttaatattacgtaaaaactaaaactaccgaaaacgaattcacctaaattaataaaatccaaaataccgtaatcgttacgccaccgctaacctaaaccgacacgcgcgtttactataccgacaccaatatcaaatcgactttaatttcgccctaattaaatcaccgactaaacgatatcgataataaataccaatttatcattcaccgtaatcgccgcactcacaaaataccccgattcgacttaacattctacccgattaaatacgaaccaaacccgataataaacgtttacccctccatatcgaacgctttctccgccacttttaaatataaaccgataaaaaattttaacaacgcgcccttccgacccaaataa

SEQ ID NO: 25477 - DNA, 649 bp, Artificial Sequence
  chemically treated genomic DNA (Homo sapiens) CpG-island No: 25477
  misc_feature (118)..(118): n is either a, c, g or t
  misc_feature (633)..(633): n is either a, c, g or t
  misc_feature (639)..(639): n is either a, c, g or t
  misc_feature (641)..(641): n is either a, c, g or t
  misc_feature (644)..(644): n is either a, c, g or t
gttaagttcgcgatcgcgtttggcggcgttaagtcgatgtgtagttcggggtttagtttttaaaggttttcgagattggttatcggaggggtttaaggagtgcgagtgtattggtcgntttttgttttaggttacgcgagattttgtttttagttgttgcgtttgggaaacggttcgtttggggcgtcgggttttatggaggttttgcgatttgatgtcgggttgggtttattttaagttttgggtttgtaatgggttgtggggtttgatggtaatggttcggttgtttcggttttcgtggtcgggtaggttattaatttttcgggtatgtggagggtggtttttcggggtcggttgtatgtgcggttgtttcgtagttttcgttatttcgttgttacggtgtagttgtgaacgtttttcgggtcggtgtattagcgtcgtgtggtgtggtttcgttcgggttgttgtgggagcgcgttcgtgttagtcggcgttttatgaggtcggcgtggcgggaggcgtgggcgcggcgtgacgtgggttgtttttatcggcggtggtgtgttttggtgtaggtgaagggggggtggttatgcgtcgggacgtagtcgcgcgtgtttttttttgttggtnatttgngnggngtttt

SEQ ID NO: 25478 - DNA, 649 bp, Artificial Sequence
  chemically treated genomic DNA (Homo sapiens) CpG-island No: 25478
  misc_feature (6)..(6): n is either a, c, g or t
  misc_feature (9)..(9): n is either a, c, g or t
  misc_feature (11)..(11): n is either a, c, g or t
  misc_feature (17)..(17): n is either a, c, g or t
  misc_feature (532)..(532): n is either a, c, g or t
aaaacnccncncaaatnaccaacaaaaaaaaacacgcgcgactacgtcccgacgcataaccacccccccttcacctacaccaaaacacaccaccgccgataaaaacaacccacgtcacgccgcgcccacgcctcccgccacgccgacctcataaaacgccgactaacacgaacgcgctcccacaacaacccgaacgaaaccacaccacacgacgctaatacaccgacccgaaaaacgttcacaactacaccgtaacaacgaaataacgaaaactacgaaacaaccgcacatacaaccgaccccgaaaaaccaccctccacatacccgaaaaattaataacctacccgaccacgaaaaccgaaacaaccgaaccattaccatcaaaccccacaacccattacaaacccaaaacttaaaataaacccaacccgacatcaaatcgcaaaacctccataaaacccgacgccccaaacgaaccgtttcccaaacgcaacaactaaaaacaaaatctcgcgtaacctaaaacaaaaancgaccaatacactcgcactccttaaacccctccgataaccaatctcgaaaacctttaaaaactaaaccccgaactacacatcgacttaacgccgccaaacgcgatcgcgaacttaac

SEQ ID NO: 25479 - DNA, 649 bp, Artificial Sequence
  chemically treated genomic DNA (Homo sapiens) CpG-island No: 25479
  misc_feature (6)..(6): n is either a, c, g or t
  misc_feature (9)..(9): n is either a, c, g or t
  misc_feature (11)..(11): n is either a, c, g or t
  misc_feature (17)..(17): n is either a, c, g or t
  misc_feature (532)..(532): n is either a, c, g or t
ggggtnttntntaggtngttagtaagggggggtacgcgcggttgcgtttcgacgtatagttattttttttttatttgtattaaaatatattatcgtcgatgaagataatttacgttacgtcgcgtttacgtttttcgttacgtcgattttatggggcgtcggttaatacgggcgcgtttttataatagttcgagcggagttatattatacggcgttggtatatcgattcgaagagcgtttatagttgtatcgtggtaacgaggtgacggagattgcggaataatcgtatatataatcggtttcggggggttattttttatatattcggaaggttggtaatttgttcgattacgaaggtcggaataatcgaattattgttattagattttataatttattgtaaatttagagtttaaaataagtttaattcgatattaaatcgtagaatttttatagggttcgacgttttaaacgagtcgttttttaagcgtagtagttggaggtagaatttcgcgtggtttggagtaaaagncggttagtatattcgtattttttgagttttttcgatggttagtttcgggaatttttaggggttggatttcgagttatatatcggtttggcgtcgttaaacgcggtcgcggatttgat

SEQ ID NO: 25480 - DNA, 649 bp, Artificial Sequence
  chemically treated genomic DNA (Homo sapiens) CpG-island No: 25480
  misc_feature (118)..(118): n is either a, c, g or t
  misc_feature (633)..(633): n is either a, c, g or t
  misc_feature (639)..(639): n is either a, c, g or t
  misc_feature (641)..(641): n is either a, c, g or t
  misc_feature (644)..(644): n is either a, c, g or t
atcaaatccgcgaccgcgtttaacgacgccaaaccgatatataactcgaaatccaacccctaaaaattcccgaaactaaccatcgaaaaaactcaaaaaatacgaatatactaaccgncttttactccaaaccacgcgaaattctacctccaactactacgcttaaaaaacgactcgtttaaaacgtcgaaccctataaaaattctacgatttaatatcgaattaaacttattttaaactctaaatttacaataaattataaaatctaataacaataattcgattattccgaccttcgtaatcgaacaaattaccaaccttccgaatatataaaaaataaccccccgaaaccgattatatatacgattattccgcaatctccgtcacctcgttaccacgatacaactataaacgctcttcgaatcgatataccaacgccgtataatataactccgctcgaactattataaaaacgcgcccgtattaaccgacgccccataaaatcgacgtaacgaaaaacgtaaacgcgacgtaacgtaaattatcttcatcgacgataatatattttaatacaaataaaaaaaaaataactatacgtcgaaacgcaaccgcgcgtacccccccttactaacnacctananaanacccc

SEQ ID NO: 25481 - DNA, 598 bp, Artificial Sequence
  chemically treated genomic DNA (Homo sapiens) CpG-island No: 25481
tggttagtgttatcggattcgttttgttgtttttttagaagcgcgggaagtatttgtgattattgtgatttgattcgcgtagcggggattttgaaaatacgggtaaaggttttagtcgcgaggttgtcgtttcgggttgggatgtgcgtttttaatgtcgggggatgagttttttttcgagtgttttttttgtttcgtcggtagggcgtttgtcgtggttgggcgagagagttgttggaggtcggaggtcggtgtttttcgggtgtgtagcggtttcgtgagagttgtcgggaggttgcggttgcgagatttggaagtgtgtgttgcgttcgtttgtgtaagttgtaaagtgtttcgagagtgttgtcggcgatggttgtgtgttttgtaggtgtaggatgttcgtgtgtttgtagaacgcgggagtgtgtcgtcgtcgtgtggtgtgttcgcgggtgtttcggagagagtgcgttggggttttttcggtgttgagtgtcgtttggtttagtggaggtatgtgtggggtgttcggtggtgtgtggttcgttgtggggtgcggtgggttatgtgttttgttgggtggttggtggtttgt

SEQ ID NO: 25482 - DNA, 598 bp, Artificial Sequence
  chemically treated genomic DNA (Homo sapiens) CpG-island No: 25482
acaaaccaccaaccacccaacaaaacacataacccaccgcaccccacaacgaaccacacaccaccgaacaccccacacatacctccactaaaccaaacgacactcaacaccgaaaaaaccccaacgcactctctccgaaacacccgcgaacacaccacacgacgacgacacactcccgcgttctacaaacacacgaacatcctacacctacaaaacacacaaccatcgccgacaacactctcgaaacactttacaacttacacaaacgaacgcaacacacacttccaaatctcgcaaccgcaacctcccgacaactctcacgaaaccgctacacacccgaaaaacaccgacctccgacctccaacaactctctcgcccaaccacgacaaacgccctaccgacgaaacaaaaaaaacactcgaaaaaaaactcatcccccgacattaaaaacgcacatcccaacccgaaacgacaacctcgcgactaaaacctttacccgtattttcaaaatccccgctacgcgaatcaaatcacaataatcacaaatacttcccgcgcttctaaaaaaacaacaaaacgaatccgataacactaacca

SEQ ID NO: 25483 - DNA, 598 bp, Artificial Sequence
  chemically treated genomic DNA (Homo sapiens) CpG-island No: 25483
atagattattaattatttaataaaatatatgatttatcgtattttataacgggttatatattatcggatattttatatatgtttttattgaattaaacgatatttaatatcgggaagattttaacgtatttttttcgggatattcgcgaatatattatacggcgacgatatattttcgcgttttataggtatacgagtattttgtatttgtagaatatataattatcgtcgataatattttcgaaatattttgtaatttatataaacgagcgtaatatatatttttaagtttcgtaatcgtaatttttcgatagtttttacgaaatcgttatatattcggaaagtatcgattttcggtttttaataattttttcgtttaattacgataaacgttttgtcggcggaataaaggaaatattcgagggaaagtttatttttcggtattgaaagcgtatattttaattcgaaacggtaatttcgcgattaaggtttttattcgtgtttttagaattttcgttacgcgaattaggttataatggttatagatgtttttcgcgtttttaaaaggatagtagagcgaattcggtaatattggtta

SEQ ID NO: 25484 - DNA, 598 bp, Artificial Sequence
  chemically treated genomic DNA (Homo sapiens) CpG-island No: 25484
taaccaatattaccgaattcgctctactatccttttaaaaacgcgaaaaacatctataaccattataacctaattcgcgtaacgaaaattctaaaaacacgaataaaaaccttaatcgcgaaattaccgtttcgaattaaaatatacgctttcaataccgaaaaataaactttccctcgaatatttcctttattccgccgacaaaacgtttatcgtaattaaacgaaaaaattattaaaaaccgaaaatcgatactttccgaatatataacgatttcgtaaaaactatcgaaaaattacgattacgaaacttaaaaatatatattacgctcgtttatataaattacaaaatatttcgaaaatattatcgacgataattatatattctacaaatacaaaatactcgtatacctataaaacgcgaaaatatatcgtcgccgtataatatattcgcgaatatcccgaaaaaaatacgttaaaatcttcccgatattaaatatcgtttaattcaataaaaacatatataaaatatccgataatatataacccgttataaaatacgataaatcatatattttattaaataattaataatctat

SEQ ID NO: 25485 - DNA, 593 bp, Artificial Sequence
  chemically treated genomic DNA (Homo sapiens) CpG-island No: 25485
taggcgcgtttttgcgtttttgttacggtatgatttagcgcggtgacgatagtacgcgttcgtcgttggttattatttgttcgttattcgttagttttgtgttcgcgtggaatattttgtcgtttgttattttttttagcggtaggtcgtggattacgttatcggtgcggtaattattcggatatttattcgtagttattattacgtcgagagaagcgcgtttattttattcggacgttttttcgtttagtttgtttttataggtcgttagaggagtttaattagatcggattttatgcgtagtaagtcggttgggttttcggatcgttaaagcggtagttaaatttaataattttcggattgttttgtttgtcgattattaggttcgcgtagagaaaatcggtgtaggtgttgtttttcggcgttatgttttttacggttggttagataatacgttttatggtgcgttgatgaacgttatcggttattatcggcgcgggggagtaagggttatttcgtcggtgtttggttcgggttttatgtttgtaggtttagtagaaaattgaatttataaatgtaagaatgaaaatttt

SEQ ID NO: 25486 - DNA, 593 bp, Artificial Sequence
  chemically treated genomic DNA (Homo sapiens) CpG-island No: 25486
aaaattttcattcttacatttataaattcaattttctactaaacctacaaacataaaacccgaaccaaacaccgacgaaataacccttactcccccgcgccgataataaccgataacgttcatcaacgcaccataaaacgtattatctaaccaaccgtaaaaaacataacgccgaaaaacaacacctacaccgattttctctacgcgaacctaataatcgacaaacaaaacaatccgaaaattattaaatttaactaccgctttaacgatccgaaaacccaaccgacttactacgcataaaatccgatctaattaaactcctctaacgacctataaaaacaaactaaacgaaaaaacgtccgaataaaataaacgcgcttctctcgacgtaataataactacgaataaatatccgaataattaccgcaccgataacgtaatccacgacctaccgctaaaaaaaataacaaacgacaaaatattccacgcgaacacaaaactaacgaataacgaacaaataataaccaacgacgaacgcgtactatcgtcaccgcgctaaatcataccgtaacaaaaacgcaaaaacgcgccta

SEQ ID NO: 25487 - DNA, 593 bp, Artificial Sequence
  chemically treated genomic DNA (Homo sapiens) CpG-island No: 25487
aagatttttatttttgtatttgtgaatttagttttttgttggatttgtaggtatgaaattcggattaaatatcggcgggatggtttttattttttcgcgtcggtagtaatcgatgacgtttattagcgtattatggaacgtattatttggttaatcgtgaaaggtatggcgtcggaaggtaatatttatatcggttttttttacgcgggtttgatgatcgataaatagggtaattcgaaggttattgaatttaattgtcgttttggcgattcggaaatttagtcgatttattgcgtatgaagttcgatttggttgagtttttttggcggtttgtgaaagtaaattggacgagaaaacgttcgagtgggatgaacgcgtttttttcggcgtggtgatggttgcgggtggatattcgggtgattatcgtatcggtgacgtgatttacggtttgtcgttggaagaagtggtaggcggtaaagtgttttacgcgggtataaaattggcggatgacgagtaggtagtgattaacggcgggcgcgtattgtcgttatcgcgttgggttatatcgtggtagaagcgtagaaacgcgttta

SEQ ID NO: 25488 - DNA, 593 bp, Artificial Sequence
  chemically treated genomic DNA (Homo sapiens) CpG-island No: 25488
taaacgcgtttctacgcttctaccacgatataacccaacgcgataacgacaatacgcgcccgccgttaatcactacctactcgtcatccgccaattttatacccgcgtaaaacactttaccgcctaccacttcttccaacgacaaaccgtaaatcacgtcaccgatacgataatcacccgaatatccacccgcaaccatcaccacgccgaaaaaaacgcgttcatcccactcgaacgttttctcgtccaatttactttcacaaaccgccaaaaaaactcaaccaaatcgaacttcatacgcaataaatcgactaaatttccgaatcgccaaaacgacaattaaattcaataaccttcgaattaccctatttatcgatcatcaaacccgcgtaaaaaaaaccgatataaatattaccttccgacgccatacctttcacgattaaccaaataatacgttccataatacgctaataaacgtcatcgattactaccgacgcgaaaaaataaaaaccatcccgccgatatttaatccgaatttcatacctacaaatccaacaaaaaactaaattcacaaatacaaaaataaaaatctt

SEQ ID NO: 25489 - DNA, 601 bp, Artificial Sequence
  chemically treated genomic DNA (Homo sapiens) CpG-island No: 25489
ggtggttaggataaagagtcgatgcgcgttattttgaatgcgttaggtcgttataacgcgttgaacgtcgtagttgcgttgcggttgttacggaagagggtattgacgacgaggttattttgcgggcgtttgaaagtttttaggggattggtcgtcgttttgattttttcggtgaattttcgttggagttagtgaatggtaaaagcggtacggtaatgttggtcgatgattacggttattattcgacggaagtggacgttattattaaagcggcgtcgtaggttggtcggataaaaatttggtaatgttgttttagtcgtatcgttttattcgtacgcgcgatttgtatgatgatttcgttaatgtgttgacgtaggttgatattttgttgatgttggaagtgtattcggttggcgaagttaatttcgggagcggatagtcgttcgttgtgtcgtataattcgtggacgtggggaaattgattttattttggtgtcggatcgggcgggtagttagatgttggtatcgggattaatcggtaacgatttgattttcgtttagggggttggaaatttggaaaaattgtcggttttttagttgaa

SEQ ID NO: 25490 - DNA, 601 bp, Artificial Sequence
  chemically treated genomic DNA (Homo sapiens) CpG-island No: 25490
ttcaactaaaaaaccgacaatttttccaaatttccaaccccctaaacgaaaatcaaatcgttaccgattaatcccgataccaacatctaactacccgcccgatccgacaccaaaataaaatcaatttccccacgtccacgaattatacgacacaacgaacgactatccgctcccgaaattaacttcgccaaccgaatacacttccaacatcaacaaaatatcaacctacgtcaacacattaacgaaatcatcatacaaatcgcgcgtacgaataaaacgatacgactaaaacaacattaccaaatttttatccgaccaacctacgacgccgctttaataataacgtccacttccgtcgaataataaccgtaatcatcgaccaacattaccgtaccgcttttaccattcactaactccaacgaaaattcaccgaaaaaatcaaaacgacgaccaatcccctaaaaactttcaaacgcccgcaaaataacctcgtcgtcaataccctcttccgtaacaaccgcaacgcaactacgacgttcaacgcgttataacgacctaacgcattcaaaataacgcgcatcgactctttatcctaaccacc

SEQ ID NO: 25491 - DNA, 601 bp, Artificial Sequence
  chemically treated genomic DNA (Homo sapiens) CpG-island No: 25491
tttagttaaagaatcggtaatttttttaaatttttagttttttgaacgagaattaggtcgttatcggttaatttcggtgttagtatttggttattcgttcgattcggtattagaatgggattaatttttttacgtttacgaattgtgcgatatagcgaacggttgttcgttttcggaattggtttcgttagtcggatatatttttagtattaatagggtattaatttgcgttagtatattggcgaaattattatataggtcgcgcgtacgggtaaaacggtgcggttgaaatagtattattaggtttttattcggttagtttgcggcgtcgttttaatggtggcgtttattttcgtcgggtggtggtcgtagttatcgattagtattgtcgtatcgtttttattatttattggttttagcgggaatttatcgaggaaattaaaacggcgattagttttttggaagtttttaagcgttcgtaaaatagtttcgtcgttaatgttttttttcgtagtaatcgtaacgtagttgcggcgtttagcgcgttatgacgatttggcgtatttagggtgacgcgtatcggttttttgttttggttatt

SEQ ID NO: 25492 - DNA, 601 bp, Artificial Sequence
  chemically treated genomic DNA (Homo sapiens) CpG-island No: 25492
aataaccaaaacaaaaaaccgatacgcgtcaccctaaatacgccaaatcgtcataacgcgctaaacgccgcaactacgttacgattactacgaaaaaaaacattaacgacgaaactattttacgaacgcttaaaaacttccaaaaaactaatcgccgttttaatttcctcgataaattcccgctaaaaccaataaataataaaaacgatacgacaatactaatcgataactacgaccaccacccgacgaaaataaacgccaccattaaaacgacgccgcaaactaaccgaataaaaacctaataatactatttcaaccgcaccgttttacccgtacgcgcgacctatataataatttcgccaatatactaacgcaaattaataccctattaatactaaaaatatatccgactaacgaaaccaattccgaaaacgaacaaccgttcgctatatcgcacaattcgtaaacgtaaaaaaattaatcccattctaataccgaatcgaacgaataaccaaatactaacaccgaaattaaccgataacgacctaattctcgttcaaaaaactaaaaatttaaaaaaattaccgattctttaactaaa

SEQ ID NO: 25493 - DNA, 737 bp, Artificial Sequence
  chemically treated genomic DNA (Homo sapiens) CpG-island No: 25493
  misc_feature (658)..(658): n is either a, c, g or t
tcgaggtggaatttacgtagtattacgtggtttatcgttagcgttattgtcgtatcggtgttttgtttcggtgttagttatagatcgtatagtttggcgattttagcgtagtttggtgtgacggtaatagttttggtttttttgtaacgtattttagtaaagaagtgagtattcggggtacgcgtttgcggtacgtttgatttttaggcgatgatgtagttggagttgtattagttagtagatttcggtacgttagtttgttcgttttaggtttgcggagacgtaggaggtaagtcgtagtattagtcgtagaagtttaagtaagtatcgttaattagcgagagatagcgtgtattcgatgcgtaagaaattatcgatattgtcggaattggcgagaaattagtaatacggttcgggtcgtagtttttgatggtgtaaacgttagatgcggcgattagttcgtttattttttgttaggaagaacgaataaatttatcgcgtttacgcgtttgtttagagtttttcgttttatcggcgtttttaatgatagaagtttatggtttaaacggatcgttatgtagcgttttcgttttacgttatagttttattagcgtttgcgtattatcgggtattaagcggttggtattgtaaaattcgnatattgtattttcggttatttagtattggtggttattcgacggtacggaagtaattttggtttttcggttaatttttta

SEQ ID NO: 25494 - DNA, 737 bp, Artificial Sequence
  chemically treated genomic DNA (Homo sapiens) CpG-island No: 25494
  misc_feature (80)..(80): n is either a, c, g or t
taaaaaattaaccgaaaaaccaaaattacttccgtaccgtcgaataaccaccaatactaaataaccgaaaatacaatatncgaattttacaataccaaccgcttaatacccgataatacgcaaacgctaataaaactataacgtaaaacgaaaacgctacataacgatccgtttaaaccataaacttctatcattaaaaacgccgataaaacgaaaaactctaaacaaacgcgtaaacgcgataaatttattcgttcttcctaacaaaaaataaacgaactaatcgccgcatctaacgtttacaccatcaaaaactacgacccgaaccgtattactaatttctcgccaattccgacaatatcgataatttcttacgcatcgaatacacgctatctctcgctaattaacgatacttacttaaacttctacgactaatactacgacttacctcctacgtctccgcaaacctaaaacgaacaaactaacgtaccgaaatctactaactaatacaactccaactacatcatcgcctaaaaatcaaacgtaccgcaaacgcgtaccccgaatactcacttctttactaaaatacgttacaaaaaaaccaaaactattaccgtcacaccaaactacgctaaaatcgccaaactatacgatctataactaacaccgaaacaaaacaccgatacgacaataacgctaacgataaaccacgtaatactacgtaaattccacctcga

SEQ ID NO: 25495 - DNA, 737 bp, Artificial Sequence
  chemically treated genomic DNA (Homo sapiens) CpG-island No: 25495
  misc_feature (80)..(80): n is either a, c, g or t
taaaaggttggtcgagaaattaggattgttttcgtatcgtcgaatggttattaatattgggtggtcgagggtgtagtatncgaattttatagtgttaatcgtttaatattcgatgatgcgtaaacgttgatgaaattgtggcgtgaagcgaaggcgttgtatagcgattcgtttgagttatgggtttttattattgaagacgtcgataaagcgaaaagttttaagtaggcgcgtggacgcggtggatttgttcgttttttttggtaggaggtgaacgaattgatcgtcgtatttaacgtttatattattaaaaattacggttcggatcgtgttgttggtttttcgttaatttcggtaatgtcgatggttttttacgtatcgggtgtacgttatttttcgttgattggcggtatttgtttaagtttttacgattggtattgcgatttgttttttgcgttttcgtaaatttggggcgagtaaattgacgtatcggaatttgttgattggtataattttagttatattatcgtttgggggttaaacgtgtcgtagacgcgtatttcggatgtttatttttttattgaagtgcgttataaagggattaaaattgttgtcgttatattagattacgttgaaatcgttaaattgtgcgatttgtggttggtatcgaaatagggtatcgatgcggtaatggcgttggcgatgggttacgtaatgttgcgtgaattttatttcga

SEQ ID NO: 25496 - DNA, 737 bp, Artificial Sequence
  chemically treated genomic DNA (Homo sapiens) CpG-island No: 25496
  misc_feature (658)..(658): n is either a, c, g or t
tcgaaataaaattcacgcaacattacgtaacccatcgccaacgccattaccgcatcgataccctatttcgataccaaccacaaatcgcacaatttaacgatttcaacgtaatctaatataacgacaacaattttaatccctttataacgcacttcaataaaaaaataaacatccgaaatacgcgtctacgacacgtttaacccccaaacgataatataactaaaattataccaatcaacaaattccgatacgtcaatttactcgccccaaatttacgaaaacgcaaaaaacaaatcgcaataccaatcgtaaaaacttaaacaaataccgccaatcaacgaaaaataacgtacacccgatacgtaaaaaaccatcgacattaccgaaattaacgaaaaaccaacaacacgatccgaaccgtaatttttaataatataaacgttaaatacgacgatcaattcgttcacctcctaccaaaaaaaacgaacaaatccaccgcgtccacgcgcctacttaaaacttttcgctttatcgacgtcttcaataataaaaacccataactcaaacgaatcgctatacaacgccttcgcttcacgccacaatttcatcaacgtttacgcatcatcgaatattaaacgattaacactataaaattcgnatactacaccctcgaccacccaatattaataaccattcgacgatacgaaaacaatcctaatttctcgaccaacctttta

SEQ ID NO: 25497 - DNA, 677 bp, Artificial Sequence
  chemically treated genomic DNA (Homo sapiens) CpG-island No: 25497
gtgcggcggttgttttttattggttcgtcggagtcgttcgttacgtcggcggcgggaggggcgatttttttttttttcgtcgtttttttagcggttgggtttttagagtgtttcgcggtcgtgtggagcgaggttttgttttcgcgttgagtcgtcgtcgtcgtcgtcgtttttttagttttagttttcgcgttaggttcggtttcgtcgcgttatgtcggattatagtacgggaggattttcgttcggtcgtcgtcgtcgttcgtcggcgggggcgggggaatcggaggcgtcgggggaggtttttcgtcgggttcgttagcgcgggggatcggggcggcggcggtttcggcggcggcggttcgggcggggggtcggtcgggggttttttttagttattcggcggaggcggttcgggaattcgtaaggacgttttcgtcgacgtcgtgtagcgggttcgttaggtgaggaggtcgagggtttgaggggcgcgttcgcgcgcgcgcgtaggcgggggagggggcgggggttacgtgcgcgcgcgcgcgtagggtcgcggaggggggtcggggtcgtcgcggggttacgtgggcggtaggcgggggtttggttttttcgttgcgtttcgagtgggattttaacgggtgatttttttgtagggagtaggggcgtattgg

SEQ ID NO: 25498 - DNA, 677 bp, Artificial Sequence
  chemically treated genomic DNA (Homo sapiens) CpG-island No: 25498
ccaatacgcccctactccctacaaaaaaatcacccgttaaaatcccactcgaaacgcaacgaaaaaaccaaacccccgcctaccgcccacgtaaccccgcgacgaccccgacccccctccgcgaccctacgcgcgcgcgcgcacgtaacccccgccccctcccccgcctacgcgcgcgcgcgaacgcgcccctcaaaccctcgacctcctcacctaacgaacccgctacacgacgtcgacgaaaacgtccttacgaattcccgaaccgcctccgccgaataactaaaaaaaacccccgaccgaccccccgcccgaaccgccgccgccgaaaccgccgccgccccgatcccccgcgctaacgaacccgacgaaaaacctcccccgacgcctccgattcccccgcccccgccgacgaacgacgacgacgaccgaacgaaaatcctcccgtactataatccgacataacgcgacgaaaccgaacctaacgcgaaaactaaaactaaaaaaacgacgacgacgacgacgactcaacgcgaaaacaaaacctcgctccacacgaccgcgaaacactctaaaaacccaaccgctaaaaaaacgacgaaaaaaaaaaaaatcgcccctcccgccgccgacgtaacgaacgactccgacgaaccaataaaaaacaaccgccgcac

SEQ ID NO: 25499 - DNA, 677 bp, Artificial Sequence
  chemically treated genomic DNA (Homo sapiens) CpG-island No: 25499
ttagtgcgtttttattttttgtaggggggttattcgttgggattttattcgaggcgtagcgggagggttaggttttcgtttatcgtttacgtgatttcgcgacggtttcggttttttttcgcgattttgcgcgcgcgcgcgtacgtgattttcgttttttttttcgtttgcgcgcgcgcgcgagcgcgttttttaggttttcggtttttttatttggcgggttcgttgtacggcgtcggcgaaagcgtttttgcggattttcgggtcgttttcgtcgggtggttgagaggggttttcggtcgatttttcgttcgggtcgtcgtcgtcgggatcgtcgtcgtttcggtttttcgcgttggcgggttcggcggagggtttttttcggcgttttcggttttttcgttttcgtcggcgggcggcggcggcggtcgggcgggggttttttcgtgttgtagttcgatatggcgcggcggggtcgggtttggcgcggaggttgaagttgaggaggcggcggcggcggcggcggtttaacgcgggaataaggtttcgttttatacggtcgcggagtattttgggaatttagtcgttgggaggacgacgaggggggagagagtcgtttttttcgtcgtcgacgtgacggacgatttcggcgggttaatgggaggtagtcgtcgtat

SEQ ID NO: 25500 - DNA, 677 bp, Artificial Sequence
  chemically treated genomic DNA (Homo sapiens) CpG-island No: 25500
atacgacgactacctcccattaacccgccgaaatcgtccgtcacgtcgacgacgaaaaaaacgactctctcccccctcgtcgtcctcccaacgactaaattcccaaaatactccgcgaccgtataaaacgaaaccttattcccgcgttaaaccgccgccgccgccgccgcctcctcaacttcaacctccgcgccaaacccgaccccgccgcgccatatcgaactacaacacgaaaaaacccccgcccgaccgccgccgccgcccgccgacgaaaacgaaaaaaccgaaaacgccgaaaaaaaccctccgccgaacccgccaacgcgaaaaaccgaaacgacgacgatcccgacgacgacgacccgaacgaaaaatcgaccgaaaacccctctcaaccacccgacgaaaacgacccgaaaatccgcaaaaacgctttcgccgacgccgtacaacgaacccgccaaataaaaaaaccgaaaacctaaaaaacgcgctcgcgcgcgcgcgcaaacgaaaaaaaaaacgaaaatcacgtacgcgcgcgcgcgcaaaatcgcgaaaaaaaaccgaaaccgtcgcgaaatcacgtaaacgataaacgaaaacctaaccctcccgctacgcctcgaataaaatcccaacgaataacccccctacaaaaaataaaaacgcactaa

SEQ ID NO: 25501 - DNA, 876 bp, Artificial Sequence
  chemically treated genomic DNA (Homo sapiens) CpG-island No: 25501
  misc_feature (217)..(217): n is either a, c, g or t
tttttcgatatagtagtatattcgtaagttgacgatcgttgggtatatcgttaaataatttcgttacggtgcgaaaatttgtcggtcgttacgcgttggttgattgtgagttggttcgttgttgtgggtagaaagcgagcggggaatttgcgcgatattgttcggcgatgatgacgcgatattaattagcgagttgtagtagatgtttttcgttgtngataacgcgtttgtcgatttgatgttttagtaatatgtgcgtgaagtgatcgttagttttaattaacgcgatacgtcgttgacgttatcgttggatattcgcggtattgttttttagtaataagtttggtaggtattgcgtacgatattttgcggtgaaatcgttagttattagtaattggttaacgttatcggtaaatcgaaagcggtacgggtcgttgttagcgtttgtgtcgttaataagttggttattataatattttgttatcgggtggttcgtggtgatggtatatttttcggttatcgttggggcgtgtcgcgtaaagcgtaattgttgcgtcgcgaagttgaaaatgaggagaggtaatgttggatttgtttgtcgatgttgaatcgtggtaagagttattggcggttggtgcggtaattttacggcgttttgtttttaacgttgcggagtaattgattcgcgatattaatgacgttgttagttagtcgtcgtttcgttagatggttattttcgggggatatattatgtcggtggcgatgattaattgtgggtatttgggttggacgatttatcggtaaggttatttttattcgtttattgattcgtaaataaataaatcgtggttcgttatgttatagagtttttataat

SEQ ID NO: 25502 - DNA, 876 bp, Artificial Sequence
  chemically treated genomic DNA (Homo sapiens) CpG-island No: 25502
  misc_feature (660)..(660): n is either a, c, g or t
attataaaaactctataacataacgaaccacgatttatttatttacgaatcaataaacgaataaaaataaccttaccgataaatcgtccaacccaaatacccacaattaatcatcgccaccgacataatatatcccccgaaaataaccatctaacgaaacgacgactaactaacaacgtcattaatatcgcgaatcaattactccgcaacgttaaaaacaaaacgccgtaaaattaccgcaccaaccgccaataactcttaccacgattcaacatcgacaaacaaatccaacattacctctcctcattttcaacttcgcgacgcaacaattacgctttacgcgacacgccccaacgataaccgaaaaatataccatcaccacgaaccacccgataacaaaatattataataaccaacttattaacgacacaaacgctaacaacgacccgtaccgctttcgatttaccgataacgttaaccaattactaataactaacgatttcaccgcaaaatatcgtacgcaatacctaccaaacttattactaaaaaacaataccgcgaatatccaacgataacgtcaacgacgtatcgcgttaattaaaactaacgatcacttcacgcacatattactaaaacatcaaatcgacaaacgcgttatcnacaacgaaaaacatctactacaactcgctaattaatatcgcgtcatcatcgccgaacaatatcgcgcaaattccccgctcgctttctacccacaacaacgaaccaactcacaatcaaccaacgcgtaacgaccgacaaattttcgcaccgtaacgaaattatttaacgatatacccaacgatcgtcaacttacgaatatactactatatcgaaaaa

SEQ ID NO: 25503 - DNA, 876 bp, Artificial Sequence
  chemically treated genomic DNA (Homo sapiens) CpG-island No: 25503
  misc_feature (660)..(660): n is either a, c, g or t
attatgaagattttgtggtatggcgggttacggtttatttgtttgcggattaatgggcgaatagagataattttgtcgatgggtcgtttagtttagatgtttatagttggttatcgttatcgatatggtatatttttcgggggtgattatttggcgaaacggcgattggttggtaacgttattaatatcgcggattagttgtttcgtagcgttaaaagtaaaacgtcgtaaaattatcgtattagtcgttagtggtttttgttacggtttagtatcggtaaatagatttaatattatttttttttatttttagtttcgcggcgtagtagttgcgttttacgcgatacgttttagcggtaatcggaaagtgtgttattattacggattattcgatgatagggtattatgatagttagtttgttggcggtataggcgttggtaacggttcgtatcgttttcggtttgtcgatggcgttagttagttgttgataattgacggttttatcgtaaggtatcgtgcgtagtgtttgttagatttgttgttgaaaagtagtgtcgcgaatgtttagcggtaacgttagcggcgtatcgcgttgattgaggttggcgattattttacgtatatgttgttgaaatattaaatcggtaggcgcgttgttngtagcgggaaatatttgttgtaattcgttgattagtgtcgcgttattatcgtcgaataatatcgcgtaaatttttcgttcgttttttgtttatagtaacgaattagtttataattagttagcgcgtaacgatcggtagattttcgtatcgtgacgggattgtttagcggtatgtttaacggtcgttagtttgcgaatatattgttgtgtcggggaa

SEQ ID NO: 25504 - DNA, 876 bp, Artificial Sequence
  chemically treated genomic DNA (Homo sapiens) CpG-island No: 25504
  misc_feature (217)..(217): n is either a, c, g or t
ttccccgacacaacaatatattcgcaaactaacgaccgttaaacataccgctaaacaatcccgtcacgatacgaaaatctaccgatcgttacgcgctaactaattataaactaattcgttactataaacaaaaaacgaacgaaaaatttacgcgatattattcgacgataataacgcgacactaatcaacgaattacaacaaatatttcccgctacnaacaacgcgcctaccgatttaatatttcaacaacatatacgtaaaataatcgccaacctcaatcaacgcgatacgccgctaacgttaccgctaaacattcgcgacactacttttcaacaacaaatctaacaaacactacgcacgataccttacgataaaaccgtcaattatcaacaactaactaacgccatcgacaaaccgaaaacgatacgaaccgttaccaacgcctataccgccaacaaactaactatcataataccctatcatcgaataatccgtaataataacacactttccgattaccgctaaaacgtatcgcgtaaaacgcaactactacgccgcgaaactaaaaataaaaaaaaataatattaaatctatttaccgatactaaaccgtaacaaaaaccactaacgactaatacgataattttacgacgttttacttttaacgctacgaaacaactaatccgcgatattaataacgttaccaaccaatcgccgtttcgccaaataatcacccccgaaaaatataccatatcgataacgataaccaactataaacatctaaactaaacgacccatcgacaaaattatctctattcgcccattaatccgcaaacaaataaaccgtaacccgccataccacaaaatcttcataat

SEQ ID NO: 25505 - DNA, 548 bp, Artificial Sequence
  chemically treated genomic DNA (Homo sapiens) CpG-island No: 25505
tagatcgagggagatttttaggcgatcggatttttcggcgttaatgttgatattaatatcgtattgacgcgttatagggtgagtgattttagacgcgggtaaagtttttttattattcggttatattgggcgcggttataacgcggatgtagcgtcgatagtttgattgaaatgttcggttttttatagatgttacgatcgttagacgttttatcgatggcgtgaatcgttgttgataggaaattatatacgtttgtgtatttgcggcggttagcgcggtttcgttagtatatcgtaagagtaacggaaattttttttttttagtttgcgggtattggttaacgttttcgcgatggtttcgttagtgacgaattgtttatttattaggcgtatcgtatatttatatttttgcggattagcggtttatcgttttatcgataatgcggtttagcgagcgggagaggttggtttcgttatgggtggaaatagttttgtagtaaatagtagttttaggtgggggtattataaatagtgacgggttacgatta

SEQ ID NO: 25506 - DNA, 548 bp, Artificial Sequence
  chemically treated genomic DNA (Homo sapiens) CpG-island No: 25506
taatcgtaacccgtcactatttataatacccccacctaaaactactatttactacaaaactatttccacccataacgaaaccaacctctcccgctcgctaaaccgcattatcgataaaacgataaaccgctaatccgcaaaaatataaatatacgatacgcctaataaataaacaattcgtcactaacgaaaccatcgcgaaaacgttaaccaatacccgcaaactaaaaaaaaaaaatttccgttactcttacgatatactaacgaaaccgcgctaaccgccgcaaatacacaaacgtatataatttcctatcaacaacgattcacgccatcgataaaacgtctaacgatcgtaacatctataaaaaaccgaacatttcaatcaaactatcgacgctacatccgcgttataaccgcgcccaatataaccgaataataaaaaaactttacccgcgtctaaaatcactcaccctataacgcgtcaatacgatattaatatcaacattaacgccgaaaaatccgatcgcctaaaaatctccctcgatcta

SEQ ID NO: 25507 - DNA, 548 bp, Artificial Sequence
  chemically treated genomic DNA (Homo sapiens) CpG-island No: 25507
tggtcgtagttcgttattgtttgtaatgtttttatttggggttgttgtttattgtaaaattgtttttatttataacgaagttagtttttttcgttcgttgaatcgtattatcggtaaaacggtgaatcgttgattcgtaaaggtgtggatatgcgatgcgtttgatgggtgagtagttcgttattggcgaaattatcgcggaagcgttagttaatgttcgtaagttggaagagaaaggttttcgttatttttacgatatgttggcgaagtcgcgttgatcgtcgtagatgtataggcgtatatggttttttattagtagcgatttacgttatcggtaaagcgtttaacggtcgtggtatttatgaagggtcgggtattttaattaaattgtcggcgttgtattcgcgttatagtcgcgtttagtatgatcgggtaatggaagagttttattcgcgtttgaaattatttattttgtggcgcgttagtacgatattggtattaatattgacgtcgaagagttcgatcgtttggagatttttttcgatttg

SEQ ID NO: 25508 - DNA, 548 bp, Artificial Sequence
  chemically treated genomic DNA (Homo sapiens) CpG-island No: 25508
caaatcgaaaaaaatctccaaacgatcgaactcttcgacgtcaatattaataccaatatcgtactaacgcgccacaaaataaataatttcaaacgcgaataaaactcttccattacccgatcatactaaacgcgactataacgcgaatacaacgccgacaatttaattaaaatacccgacccttcataaataccacgaccgttaaacgctttaccgataacgtaaatcgctactaataaaaaaccatatacgcctatacatctacgacgatcaacgcgacttcgccaacatatcgtaaaaataacgaaaacctttctcttccaacttacgaacattaactaacgcttccgcgataatttcgccaataacgaactactcacccatcaaacgcatcgcatatccacacctttacgaatcaacgattcaccgttttaccgataatacgattcaacgaacgaaaaaaactaacttcgttataaataaaaacaattttacaataaacaacaaccccaaataaaaacattacaaacaataacgaactacgacca

SEQ ID NO: 25509 - DNA, 521 bp, Artificial Sequence
  chemically treated genomic DNA (Homo sapiens) CpG-island No: 25509
cggcgtgttgtatttcggatgtatatggtcgaagtatttaaagaataggttgtttttcgttatcgcgtattttagtcgcggttggtatattacgtagttggaaagcgaattaagaatgacgattatcgtcgtgatggtaataaagattttagcggtgttgtcgagtgcggggatttaggttagggcgtcggaaatcggcgttttagaattggcgagtttgtcgaagggtattaggtcggaaattattagcgttagtagggtgtagagtattagaattagtagataggaattaattagcgttcgtggtatggttttttcggggtttttaatttcgtcggttatataatagatagaggttatgtcggtatacgattaattggtggtagagattttcgtagtagcgttataaagttgttcgttgcgtaaatcgtagtggtgtaggggcggtaaaatttttcgttttaaatttagagattttagggttatgacgatagtgaacgggataattttggcgatgtaat

SEQ ID NO: 25510 - DNA, 521 bp, Artificial Sequence
  chemically treated genomic DNA (Homo sapiens) CpG-island No: 25510
attacatcgccaaaattatcccgttcactatcgtcataaccctaaaatctctaaatttaaaacgaaaaattttaccgcccctacaccactacgatttacgcaacgaacaactttataacgctactacgaaaatctctaccaccaattaatcgtataccgacataacctctatctattatataaccgacgaaattaaaaaccccgaaaaaaccataccacgaacgctaattaattcctatctactaattctaatactctacaccctactaacgctaataatttccgacctaatacccttcgacaaactcgccaattctaaaacgccgatttccgacgccctaacctaaatccccgcactcgacaacaccgctaaaatctttattaccatcacgacgataatcgtcattcttaattcgctttccaactacgtaatataccaaccgcgactaaaatacgcgataacgaaaaacaacctattctttaaatacttcgaccatatacatccgaaatacaacacgccg

SEQ ID NO: 25511 - DNA, 521 bp, Artificial Sequence
  chemically treated genomic DNA (Homo sapiens) CpG-island No: 25511
attatatcgttaaaattatttcgtttattatcgttatggttttgggatttttgggtttaaagcggagaattttgtcgtttttatattattgcgatttgcgtaacgggtagttttatggcgttgttgcggggatttttgttattagttggtcgtatatcggtatggtttttatttgttatatgatcggcgaaattaaaaatttcggaaaaattatgttacgagcgttgattggtttttgtttgttggttttggtgttttatattttgttggcgttggtgattttcggtttgatgtttttcgataaattcgttaattttgaaacgtcgattttcgacgttttgatttggattttcgtattcggtagtatcgttgggatttttgttgttattacggcgatgatcgttatttttggttcgttttttagttgcgtgatgtattagtcgcggttggaatacgcgatggcgaaagataatttgttttttaaatgtttcggttatgtgtattcgaaatataatacgtcg

SEQ ID NO: 25512 - DNA, 521 bp, Artificial Sequence
  chemically treated genomic DNA (Homo sapiens) CpG-island No: 25512
cgacgtattatatttcgaatacacataaccgaaacatttaaaaaacaaattatctttcgccatcgcgtattccaaccgcgactaatacatcacgcaactaaaaaacgaaccaaaaataacgatcatcgccgtaataacaacaaaaatcccaacgatactaccgaatacgaaaatccaaatcaaaacgtcgaaaatcgacgtttcaaaattaacgaatttatcgaaaaacatcaaaccgaaaatcaccaacgccaacaaaatataaaacaccaaaaccaacaaacaaaaaccaatcaacgctcgtaacataatttttccgaaatttttaatttcgccgatcatataacaaataaaaaccataccgatatacgaccaactaataacaaaaatccccgcaacaacgccataaaactacccgttacgcaaatcgcaataatataaaaacgacaaaattctccgctttaaacccaaaaatcccaaaaccataacgataataaacgaaataattttaacgatataat

SEQ ID NO: 25513 - DNA, 570 bp, Artificial Sequence
  chemically treated genomic DNA (Homo sapiens) CpG-island No: 25513
gggatcgcgtaggcgattatgtagtagtttgaagaggcgttaaaataattggcgtaggggttaggtagtagttaggcgttgacgtaggtgcgtcgttgggatagtgtttgttagaaattattcgatgttaatttggcgttgattttagtggttggcgagtatgcggcggagttggtaaattaggcgttggatcgtaattttaacgtgatgatgtttttcgataacgttacgttggaagatgaaatttaatttaaaatcgcgcgcgggaaaaaggtttgttggtgatggggtcggattgcggtacgtcgatgattgtcggtatatcgttggtttttgttaacgtgatgtcggaaggtaatattggcgttattggcgttttcggtatcgggatttaggagttgtgttcgtagattgcgttggtagatttgttaggcgggggggggaatagtacggatttaaattcggtattcggttaatttgaatagtttataggttacggtataatgttgttttttacgatcgtttttttaaatttgcgtggatttgttcgtttttaattacgttgtgggt

SEQ ID NO: 25514 - DNA, 570 bp, Artificial Sequence
  chemically treated genomic DNA (Homo sapiens) CpG-island No: 25514
acccacaacgtaattaaaaacgaacaaatccacgcaaatttaaaaaaacgatcgtaaaaaacaacattataccgtaacctataaactattcaaattaaccgaataccgaatttaaatccgtactattcccccccccgcctaacaaatctaccaacgcaatctacgaacacaactcctaaatcccgataccgaaaacgccaataacgccaatattaccttccgacatcacgttaacaaaaaccaacgatataccgacaatcatcgacgtaccgcaatccgaccccatcaccaacaaacctttttcccgcgcgcgattttaaattaaatttcatcttccaacgtaacgttatcgaaaaacatcatcacgttaaaattacgatccaacgcctaatttaccaactccgccgcatactcgccaaccactaaaatcaacgccaaattaacatcgaataatttctaacaaacactatcccaacgacgcacctacgtcaacgcctaactactacctaacccctacgccaattattttaacgcctcttcaaactactacataatcgcctacgcgatccc

SEQ ID NO: 25515 - DNA, 570 bp, Artificial Sequence
  chemically treated genomic DNA (Homo sapiens) CpG-island No: 25515
gtttataacgtagttgaaaacggataaatttacgtaggtttaggaaggcgatcgtaggaggtagtattatgtcgtgatttatagattgtttaggttggtcgggtatcgagtttgaattcgtattgttttttttttcgtttggtaggtttgttagcgtaatttgcgaatatagtttttgaatttcggtatcggaagcgttaatgacgttaatattgtttttcggtattacgttagtaaaagttagcggtgtgtcggtaattatcgacgtatcgtagttcggttttattattagtaagtttttttttcgcgcgcggttttaagttggattttattttttagcgtgacgttatcggagaatattattacgttgaggttgcgatttagcgtttggtttgttagtttcgtcgtatattcgttagttattgaaattagcgttagattggtatcgggtaatttttgataggtattgttttagcgacgtatttgcgttaacgtttggttgttgtttgatttttgcgttagttgttttagcgtttttttaagttgttgtataatcgtttgcgcgatttt

SEQ ID NO: 25516 - DNA, 570 bp, Artificial Sequence
  chemically treated genomic DNA (Homo sapiens) CpG-island No: 25516
aaaatcgcgcaaacgattatacaacaacttaaaaaaacgctaaaacaactaacgcaaaaatcaaacaacaaccaaacgttaacgcaaatacgtcgctaaaacaatacctatcaaaaattacccgataccaatctaacgctaatttcaataactaacgaatatacgacgaaactaacaaaccaaacgctaaatcgcaacctcaacgtaataatattctccgataacgtcacgctaaaaaataaaatccaacttaaaaccgcgcgcgaaaaaaaaacttactaataataaaaccgaactacgatacgtcgataattaccgacacaccgctaacttttactaacgtaataccgaaaaacaatattaacgtcattaacgcttccgataccgaaattcaaaaactatattcgcaaattacgctaacaaacctaccaaacgaaaaaaaaaacaatacgaattcaaactcgatacccgaccaacctaaacaatctataaatcacgacataatactacctcctacgatcgccttcctaaacctacgtaaatttatccgttttcaactacgttataaac

SEQ ID NO: 25517 - DNA, 588 bp, Artificial Sequence
  chemically treated genomic DNA (Homo sapiens) CpG-island No: 25517
taattttattaatttcggtgattcgaggttaaagcgttattcgtatagatattaggttttttcgttatatttattatcgtttttagtttttcgcgtagattttgcgtatgcgcgtatcggatattaagcgttgttttacgtttttattaatttgggcgttcgttggttcgtagtttaggttgggtttgttatcgttttagtgtttagtacggttttgcggtaggacgaattcgggttaggtaattttttgtttcgattttgtaatacggtcgattcgggttaagttagttcggtttttttttttagttagtattcgtaaggtcgttgggggttaagtttgaagggtcgagttgttcggcgatagtaagcgttcgcgcgcgggataatggttgtttttgtggtcgaattcggaagtgtatttgggttcggagagttagaattataatttttagaagttttcgcggcgcggacggttagtaggcggggtttcggtttttttaaggaagtggggcgggggatcgggttagaagttaagagggcgttttcgttcggggttcgggggggcgttatatttgtgtatgtgtaggt

SEQ ID NO: 25518 - DNA, 588 bp, Artificial Sequence
  chemically treated genomic DNA (Homo sapiens) CpG-island No: 25518
acctacacatacacaaatataacgcccccccgaaccccgaacgaaaacgccctcttaacttctaacccgatcccccgccccacttccttaaaaaaaccgaaaccccgcctactaaccgtccgcgccgcgaaaacttctaaaaattataattctaactctccgaacccaaatacacttccgaattcgaccacaaaaacaaccattatcccgcgcgcgaacgcttactatcgccgaacaactcgacccttcaaacttaacccccaacgaccttacgaatactaactaaaaaaaaaaaccgaactaacttaacccgaatcgaccgtattacaaaatcgaaacaaaaaattacctaacccgaattcgtcctaccgcaaaaccgtactaaacactaaaacgataacaaacccaacctaaactacgaaccaacgaacgcccaaattaataaaaacgtaaaacaacgcttaatatccgatacgcgcatacgcaaaatctacgcgaaaaactaaaaacgataataaatataacgaaaaaacctaatatctatacgaataacgctttaacctcgaatcaccgaaattaataaaatta

SEQ ID NO: 25519 - DNA, 588 bp, Artificial Sequence
  chemically treated genomic DNA (Homo sapiens) CpG-island No: 25519
atttgtatatgtataggtgtggcgttttttcgggtttcggacgaggacgtttttttagtttttggttcggtttttcgttttatttttttggagaagtcggaatttcgtttattgatcgttcgcgtcgcggaggtttttgggaattgtagttttggtttttcgagtttaagtgtattttcgggttcggttataagagtagttattgtttcgcgcgcggacgtttgttgtcgtcgagtagttcggttttttagatttaatttttagcggttttgcggatgttgattaggagaggggatcgaattagtttaattcgagtcggtcgtgttgtagaatcggggtagggggttgtttaattcgagttcgttttgtcgtagagtcgtgttaggtattgaggcggtgataggtttagtttgggttgcgggttagcggacgtttaggttggtaggggcgtggggtagcgtttggtgttcgatgcgcgtatgcgtagggtttacgcgggaagttggaagcggtggtgagtgtagcggggagatttggtatttgtgcgggtggcgttttagtttcgggttatcggggttgatggagtta

SEQ ID NO: 25520 - DNA, 588 bp, Artificial Sequence
  chemically treated genomic DNA (Homo sapiens) CpG-island No: 25520
taactccatcaaccccgataacccgaaactaaaacgccacccgcacaaataccaaatctccccgctacactcaccaccgcttccaacttcccgcgtaaaccctacgcatacgcgcatcgaacaccaaacgctaccccacgcccctaccaacctaaacgtccgctaacccgcaacccaaactaaacctatcaccgcctcaatacctaacacgactctacgacaaaacgaactcgaattaaacaaccccctaccccgattctacaacacgaccgactcgaattaaactaattcgatcccctctcctaatcaacatccgcaaaaccgctaaaaattaaatctaaaaaaccgaactactcgacgacaacaaacgtccgcgcgcgaaacaataactactcttataaccgaacccgaaaatacacttaaactcgaaaaaccaaaactacaattcccaaaaacctccgcgacgcgaacgatcaataaacgaaattccgacttctccaaaaaaataaaacgaaaaaccgaaccaaaaactaaaaaaacgtcctcgtccgaaacccgaaaaaacgccacacctatacatatacaaat

SEQ ID NO: 25521 - DNA, 1222 bp, Artificial Sequence
  chemically treated genomic DNA (Homo sapiens) CpG-island No: 25521
gcgtagagggagtttcgcgtttgttaaattatatagtggggattcggttttaggagggcggatgcgggtcggggacgacgtggcgtttagaggggtaggtcgagcgcgtggagaggaaagcgtttttaaggggggcgttagggagtcgcgggggggtttcgatttcgtaaggcgtttcggtgtcgtttttattttggaggtagtaggtttggtagtcgtcgtcgcgtagtttttgtaggagtaggtcgagtacggaggcgggagcgtcgggttcgggttgttattcggtcgtggtttcgtcgtagagtagtacggtggtcgttttgtagcgcgtggcgaagcgttttttgtcggcgtggttggggatgatggagcggatgggtaggttgtttttgcgtaggcggcgtaatatgaggttcgggatggttaggttgatggtcgtttcgatgtgcgacgattcgaagagttcgtgtcggttcggtagtcgagtagtagtaaggacgcgtcgtcgcgcgtttttagttttttttgtagttattcggcgtttttgtagggtatggtttttgttttcgtcgtcgcgttcgtttcggtgtttgcgtcggatttcgatttcgtatcgggttcggatttcgttcgggtgtttttagtcgtcgtcgttttcgaagtcgatatgtgcgttcgcgttggggggtcgcggagttggttttttatggggagcgcgggcggttcggggtcggggtcgggtagttttgttttgggacggcgtttcggtcgcgcgggttttagtcgcgttttcgggcgttcgtttttcgtcgagttgcgcgttcgtcgtttcggtttttcggtttttcggttttcgtttcgttcgttcgttcggtttttcgcgcgtatcgcggtttgatagttttaattaaacggcggtttcggcggtcgcgcgtcgaggcgtttttcggggggcggggtcgcgggggtcggcgttcgggtttaaaggcgtagcgtttttatcgtttttttttacggggtatgcgggcgcgttcgcgattcgagttcgggagattagcggcggggtttttttttatcgttttcgtatcgttgttttttggattagttcggagttgattacgattcgtttagggatttcggtttagacgtttttatgggtttattttgcgcgtgtttttaagtttttttggatattgcgggaagagaggttttgggggcg

SEQ ID NO: 25522 - DNA, 1222 bp, Artificial Sequence
  chemically treated genomic DNA (Homo sapiens) CpG-island No: 25522
cgcccccaaaacctctcttcccgcaatatccaaaaaaacttaaaaacacgcgcaaaataaacccataaaaacgtctaaaccgaaatccctaaacgaatcgtaatcaactccgaactaatccaaaaaacaacgatacgaaaacgataaaaaaaaaccccgccgctaatctcccgaactcgaatcgcgaacgcgcccgcataccccgtaaaaaaaaacgataaaaacgctacgcctttaaacccgaacgccgacccccgcgaccccgccccccgaaaaacgcctcgacgcgcgaccgccgaaaccgccgtttaattaaaactatcaaaccgcgatacgcgcgaaaaaccgaacgaacgaacgaaacgaaaaccgaaaaaccgaaaaaccgaaacgacgaacgcgcaactcgacgaaaaacgaacgcccgaaaacgcgactaaaacccgcgcgaccgaaacgccgtcccaaaacaaaactacccgaccccgaccccgaaccgcccgcgctccccataaaaaaccaactccgcgaccccccaacgcgaacgcacatatcgacttcgaaaacgacgacgactaaaaacacccgaacgaaatccgaacccgatacgaaatcgaaatccgacgcaaacaccgaaacgaacgcgacgacgaaaacaaaaaccataccctacaaaaacgccgaataactacaaaaaaaactaaaaacgcgcgacgacgcgtccttactactactcgactaccgaaccgacacgaactcttcgaatcgtcgcacatcgaaacgaccatcaacctaaccatcccgaacctcatattacgccgcctacgcaaaaacaacctacccatccgctccatcatccccaaccacgccgacaaaaaacgcttcgccacgcgctacaaaacgaccaccgtactactctacgacgaaaccacgaccgaataacaacccgaacccgacgctcccgcctccgtactcgacctactcctacaaaaactacgcgacgacgactaccaaacctactacctccaaaataaaaacgacaccgaaacgccttacgaaatcgaaacccccccgcgactccctaacgccccccttaaaaacgctttcctctccacgcgctcgacctacccctctaaacgccacgtcgtccccgacccgcatccgccctcctaaaaccgaatccccactatataatttaacaaacgcgaaactccctctacgc

SEQ ID NO: 25523 - DNA, 1222 bp, Artificial Sequence
  chemically treated genomic DNA (Homo sapiens) CpG-island No: 25523
cgtttttagggttttttttttcgtagtgtttagaagagtttgggagtacgcgtagagtgaatttatgagggcgtttaggtcggggtttttaggcggatcgtagttagtttcgagttagtttagggggtaacggtgcggaggcggtgggggagggtttcgtcgttggtttttcgggttcgggtcgcgagcgcgttcgtatatttcgtggggaggggcggtggaggcgttgcgtttttaagttcgggcgtcggttttcgcggtttcgtttttcggagaacgtttcggcgcgcggtcgtcggagtcgtcgtttaattggggttgttaggtcgcggtgcgcgcggagggtcgggcgggcgggcgggacggaggtcgggaggtcgggaggtcggggcggcgggcgcgtagttcggcgggaggcgggcgttcggagacgcggttggggttcgcgcggtcggggcgtcgttttagggtagggttgttcggtttcggtttcgggtcgttcgcgttttttatgaaaaattagtttcgcggttttttagcgcgggcgtatatgtcgatttcgggggcggcggcggttgggggtattcgggcggggttcgagttcggtgcggggtcggggttcggcgtaggtatcggggcgggcgcggcgacgggggtaggggttatgttttgtaagagcgtcgagtggttgtaggaggagttggaggcgcgcggcggcgcgtttttgttgttgttcgattgtcgggtcggtacgagtttttcgagtcgtcgtatatcgagacggttattaatttggttatttcgggttttatgttgcgtcgtttgcgtaagggtaatttgtttattcgttttattatttttaattacgtcgataaggagcgtttcgttacgcgttgtaaggcggttatcgtgttgttttacgacgaggttacggtcgagtggtagttcgagttcggcgttttcgttttcgtgttcggtttgtttttatagaagttgcgcgacgacggttgttaggtttattatttttaaggtgagggcggtatcgagacgttttacgggatcggggttttttcgcgattttttgacgttttttttggaggcgtttttttttttacgcgttcggtttgtttttttgggcgttacgtcgttttcggttcgtattcgtttttttggagtcgggtttttattgtgtggtttggtaggcgcggggttttttttgcgt

SEQ ID NO: 25524 - DNA, 1222 bp, Artificial Sequence
  chemically treated genomic DNA (Homo sapiens) CpG-island No: 25524
acgcaaaaaaaaccccgcgcctaccaaaccacacaataaaaacccgactccaaaaaaacgaatacgaaccgaaaacgacgtaacgcccaaaaaaacaaaccgaacgcgtaaaaaaaaaaacgcctccaaaaaaaacgtcaaaaaatcgcgaaaaaaccccgatcccgtaaaacgtctcgataccgccctcaccttaaaaataataaacctaacaaccgtcgtcgcgcaacttctataaaaacaaaccgaacacgaaaacgaaaacgccgaactcgaactaccactcgaccgtaacctcgtcgtaaaacaacacgataaccgccttacaacgcgtaacgaaacgctccttatcgacgtaattaaaaataataaaacgaataaacaaattacccttacgcaaacgacgcaacataaaacccgaaataaccaaattaataaccgtctcgatatacgacgactcgaaaaactcgtaccgacccgacaatcgaacaacaacaaaaacgcgccgccgcgcgcctccaactcctcctacaaccactcgacgctcttacaaaacataacccctacccccgtcgccgcgcccgccccgatacctacgccgaaccccgaccccgcaccgaactcgaaccccgcccgaatacccccaaccgccgccgcccccgaaatcgacatatacgcccgcgctaaaaaaccgcgaaactaatttttcataaaaaacgcgaacgacccgaaaccgaaaccgaacaaccctaccctaaaacgacgccccgaccgcgcgaaccccaaccgcgtctccgaacgcccgcctcccgccgaactacgcgcccgccgccccgacctcccgacctcccgacctccgtcccgcccgcccgcccgaccctccgcgcgcaccgcgacctaacaaccccaattaaacgacgactccgacgaccgcgcgccgaaacgttctccgaaaaacgaaaccgcgaaaaccgacgcccgaacttaaaaacgcaacgcctccaccgcccctccccacgaaatatacgaacgcgctcgcgacccgaacccgaaaaaccaacgacgaaaccctcccccaccgcctccgcaccgttaccccctaaactaactcgaaactaactacgatccgcctaaaaaccccgacctaaacgccctcataaattcactctacgcgtactcccaaactcttctaaacactacgaaaaaaaaaaccctaaaaacg

SEQ ID NO: 25525 - DNA, 509 bp, Artificial Sequence
  chemically treated genomic DNA (Homo sapiens) CpG-island No: 25525
agcgttgtcgggaagcgttttttttagggttttgcgggttaggttcggtgtttcggtttacgagtattagttttttttatcgggtcgttaagtttttggtaaagtcgtttacgtgttggtgttttcgtaggcgttttatcgtttttttgattttagttttcgttaggatgtttgcggttatgggtaaggcggagagtttttgtaaatatttttttagttttttcggtttcgttttagtggttagacgtatttgtagtttttttattgcgcgtagcgtagtggattttgtcgttatttcgttagagttgtgtaggcgtcgttgttttcgcggtcgcggttttgttcgagttcggggcggcggtataggtagtttggggtggtcggttttcgttgttcggtcgttaggcggcgatttcgggatgtggagttatagtttggagcgagttgggttttcggagtagcgggttatttggtttggaacgtcggtttttgtagatagttgagtaggt

SEQ ID NO: 25526 - DNA, 509 bp, Artificial Sequence
  chemically treated genomic DNA (Homo sapiens) CpG-island No: 25526
acctactcaactatctacaaaaaccgacgttccaaaccaaataacccgctactccgaaaacccaactcgctccaaactataactccacatcccgaaatcgccgcctaacgaccgaacaacgaaaaccgaccaccccaaactacctataccgccgccccgaactcgaacaaaaccgcgaccgcgaaaacaacgacgcctacacaactctaacgaaataacgacaaaatccactacgctacgcgcaataaaaaaactacaaatacgtctaaccactaaaacgaaaccgaaaaaactaaaaaaatatttacaaaaactctccgccttacccataaccgcaaacatcctaacgaaaactaaaatcaaaaaaacgataaaacgcctacgaaaacaccaacacgtaaacgactttaccaaaaacttaacgacccgataaaaaaaactaatactcgtaaaccgaaacaccgaacctaacccgcaaaaccctaaaaaaaacgcttcccgacaacgct

SEQ ID NO: 25527 - DNA, 509 bp, Artificial Sequence
  chemically treated genomic DNA (Homo sapiens) CpG-island No: 25527
gtttgtttagttgtttgtaaggatcggcgttttagattaagtggttcgttgtttcgaggatttagttcgttttaggttgtgattttatatttcgaggtcgtcgtttggcgatcgggtagcgaggatcggttattttagattgtttgtgtcgtcgtttcgagttcggatagagtcgcgatcgcgaggatagcgacgtttgtatagttttggcgagatggcggtagggtttattacgttgcgcgtagtggggaagttgtaggtgcgtttggttattaagacggagtcgaaaaagttagagaaatatttgtagaaatttttcgttttgtttatgatcgtagatattttggcggagattggaattagaaagacggtgaagcgtttgcggaagtattagtacgtgggcgattttgttagagatttagcggttcggtggaagaagttggtgttcgtggatcgaaatatcgggtttgattcgtaggattttgaggagagcgtttttcgatagcgtt

SEQ ID NO: 25528 - DNA, 509 bp, Artificial Sequence
  chemically treated genomic DNA (Homo sapiens) CpG-island No: 25528
aacgctatcgaaaaacgctctcctcaaaatcctacgaatcaaacccgatatttcgatccacgaacaccaacttcttccaccgaaccgctaaatctctaacaaaatcgcccacgtactaatacttccgcaaacgcttcaccgtctttctaattccaatctccgccaaaatatctacgatcataaacaaaacgaaaaatttctacaaatatttctctaactttttcgactccgtcttaataaccaaacgcacctacaacttccccactacgcgcaacgtaataaaccctaccgccatctcgccaaaactatacaaacgtcgctatcctcgcgatcgcgactctatccgaactcgaaacgacgacacaaacaatctaaaataaccgatcctcgctacccgatcgccaaacgacgacctcgaaatataaaatcacaacctaaaacgaactaaatcctcgaaacaacgaaccacttaatctaaaacgccgatccttacaaacaactaaacaaac

SEQ ID NO: 25529 - DNA, 510 bp, Artificial Sequence
  chemically treated genomic DNA (Homo sapiens) CpG-island No: 25529
ttcgaggtcgtcgtttggcgatcgggtagcgaggatcggttattttagattgtttgtgtcgtcgtttcgagttcggatagagtcgcgatcgcgaggatagcgacgtttgtatagttttggcgagatggcggtagggtttattacgttgcgcgtagtggggaagttgtaggtgcgtttggttattaagacggagtcgaaaaagttagagaaatatttgtagaaatttttcgttttgtttatgatcgtagatattttggcggagattggaattagaaagacggtgaagcgtttgcggaagtattagtacgtgggcgattttgttagagatttagcggttcggtggaagaagttggtgttcgtggatcgaaatatcgggtttgattcgtaggattttgaggagagcgtttttcgatagcgtttcggggaggttttttaggagcgggaaaaggtttggggttttttagaaaacgcgacggtttttaggagtttattttatagttttgagtatag

SEQ ID NO: 25530 - DNA, 510 bp, Artificial Sequence
  chemically treated genomic DNA (Homo sapiens) CpG-island No: 25530
ctatactcaaaactataaaataaactcctaaaaaccgtcgcgttttctaaaaaaccccaaaccttttcccgctcctaaaaaacctccccgaaacgctatcgaaaaacgctctcctcaaaatcctacgaatcaaacccgatatttcgatccacgaacaccaacttcttccaccgaaccgctaaatctctaacaaaatcgcccacgtactaatacttccgcaaacgcttcaccgtctttctaattccaatctccgccaaaatatctacgatcataaacaaaacgaaaaatttctacaaatatttctctaactttttcgactccgtcttaataaccaaacgcacctacaacttccccactacgcgcaacgtaataaaccctaccgccatctcgccaaaactatacaaacgtcgctatcctcgcgatcgcgactctatccgaactcgaaacgacgacacaaacaatctaaaataaccgatcctcgctacccgatcgccaaacgacgacctcgaa

SEQ ID NO: 25531 - DNA, 510 bp, Artificial Sequence
  chemically treated genomic DNA (Homo sapiens) CpG-island No: 25531
ttgtgtttagggttgtgagatgggtttttgggggtcgtcgcgttttttgggaagttttaggttttttttcgtttttgaagagttttttcgaagcgttgtcgggaagcgttttttttagggttttgcgggttaggttcggtgtttcggtttacgagtattagttttttttatcgggtcgttaagtttttggtaaagtcgtttacgtgttggtgttttcgtaggcgttttatcgtttttttgattttagttttcgttaggatgtttgcggttatgggtaaggcggagagtttttgtaaatatttttttagttttttcggtttcgttttagtggttagacgtatttgtagtttttttattgcgcgtagcgtagtggattttgtcgttatttcgttagagttgtgtaggcgtcgttgttttcgcggtcgcggttttgttcgagttcggggcggcggtataggtagtttggggtggtcggttttcgttgttcggtcgttaggcggcgatttcggg

SEQ ID NO: 25532 - DNA, 510 bp, Artificial Sequence
  chemically treated genomic DNA (Homo sapiens) CpG-island No: 25532
cccgaaatcgccgcctaacgaccgaacaacgaaaaccgaccaccccaaactacctataccgccgccccgaactcgaacaaaaccgcgaccgcgaaaacaacgacgcctacacaactctaacgaaataacgacaaaatccactacgctacgcgcaataaaaaaactacaaatacgtctaaccactaaaacgaaaccgaaaaaactaaaaaaatatttacaaaaactctccgccttacccataaccgcaaacatcctaacgaaaactaaaatcaaaaaaacgataaaacgcctacgaaaacaccaacacgtaaacgactttaccaaaaacttaacgacccgataaaaaaaactaatactcgtaaaccgaaacaccgaacctaacccgcaaaaccctaaaaaaaacgcttcccgacaacgcttcgaaaaaactcttcaaaaacgaaaaaaaacctaaaacttcccaaaaaacgcgacgacccccaaaaacccatctcacaaccctaaacacaa

SEQ ID NO: 25533 - DNA, 1416 bp, Artificial Sequence
  chemically treated genomic DNA (Homo sapiens) CpG-island No: 25533
  misc_feature (1074)..(1074): n is either a, c, g or t
  misc_feature (1234)..(1234): n is either a, c, g or t
acggtcgtcgtatagttcgtagtagtttagggttcgttttcgggatagttttacggcggcggtagtagcggtatttagggcgaaggttgcggcggcgtgacgggtacggggttttcgtaggggcggggtagcgacgggggatagcgagcgttgtttgtattggtagttttcgtgtagcgggaggtagtcgagcgggtcggcgggcgcgggcggttttgggggaggcgtggaagcggcggcgttgttgttgttatttcgtcgattgttttcgtcgtcgttacgtaggtatacgggttttattttgagcgggcggtcgtagagtagtagttgtcgggttagggcgtgttggcgggtttcgcgtgcgttttgtgggtgtcggaaatttacgtaggttatacggtttagtttaggcgtgtgcgataggcggaggttgatttcgtcgaagcgtttgaattggtggaagagtcggttttcgaggtgttcggcgggtagcgcggggtttaagttgttgatgagtaacgttttgtatttaggcgcggtcgcggatgagtcgggatacgcgggttcggttttaggcggtggcggaggcggcggtagaggagacgcgcggggcgatatgtcggaggcgttcgggtttttcgaggttttgtcgtcgcgtttttcgtcgttagcgtcggagttcgaggagcgttcgttattcgcgcggtgattcgcgttttcggtgtcgcggtcgtcgcgatgttcgttttcgtcgttttcgttgtcgcggggtttgtcgcgggttcgcgttggaatcgggtgtttggcgtcgttagaggttttgtgcgtcgttcgtcgttcgttcgttttcgtttttcgttcgcgttttcgcggacgtttggcggacgatgacgagtcgcgttcgttcgggttagagtttcgttcgttttgtcgttttatggcgttggcgcggcgggcgggcggttcgtaggttttttatagcggcggcggcggaggcggcggtcgaggaggtagcgttttcggcgtcgttattttggataaaaggattcggcgcggcggtggcggcggggcggngcgggagcggcgtcgaggggtcgggtattgcgttattaaggtgcgtcgttttgttacgtgattttgcggcgggcggagtaagattcgcgtcgggtttgttttatcgcgttgcgtcgtttagtgttaggtgattttgtgagtgttgggtgagtgggatcgntcgcgcgttttggcgttatcgcgcggttcgtatgggtcgatgtttgaggttacgcggagtgtagtgaattttgagaggtcggcgagacgatttaacgttttgtgtttttagtcgtgttttgtcgttttgggtttagttatttttttttgtaggtattggagttcgcgttgattggagtagga

SEQ ID NO: 25534 - DNA, 1416 bp, Artificial Sequence
  chemically treated genomic DNA (Homo sapiens) CpG-island No: 25534
  misc_feature (183)..(183): n is either a, c, g or t
  misc_feature (343)..(343): n is either a, c, g or t
tcctactccaatcaacgcgaactccaatacctacaaaaaaaaataactaaacccaaaacgacaaaacacgactaaaaacacaaaacgttaaatcgtctcgccgacctctcaaaattcactacactccgcgtaacctcaaacatcgacccatacgaaccgcgcgataacgccaaaacgcgcgancgatcccactcacccaacactcacaaaatcacctaacactaaacgacgcaacgcgataaaacaaacccgacgcgaatcttactccgcccgccgcaaaatcacgtaacaaaacgacgcaccttaataacgcaatacccgacccctcgacgccgctcccgcnccgccccgccgccaccgccgcgccgaatccttttatccaaaataacgacgccgaaaacgctacctcctcgaccgccgcctccgccgccgccgctataaaaaacctacgaaccgcccgcccgccgcgccaacgccataaaacgacaaaacgaacgaaactctaacccgaacgaacgcgactcgtcatcgtccgccaaacgtccgcgaaaacgcgaacgaaaaacgaaaacgaacgaacgacgaacgacgcacaaaacctctaacgacgccaaacacccgattccaacgcgaacccgcgacaaaccccgcgacaacgaaaacgacgaaaacgaacatcgcgacgaccgcgacaccgaaaacgcgaatcaccgcgcgaataacgaacgctcctcgaactccgacgctaacgacgaaaaacgcgacgacaaaacctcgaaaaacccgaacgcctccgacatatcgccccgcgcgtctcctctaccgccgcctccgccaccgcctaaaaccgaacccgcgtatcccgactcatccgcgaccgcgcctaaatacaaaacgttactcatcaacaacttaaaccccgcgctacccgccgaacacctcgaaaaccgactcttccaccaattcaaacgcttcgacgaaatcaacctccgcctatcgcacacgcctaaactaaaccgtataacctacgtaaatttccgacacccacaaaacgcacgcgaaacccgccaacacgccctaacccgacaactactactctacgaccgcccgctcaaaataaaacccgtatacctacgtaacgacgacgaaaacaatcgacgaaataacaacaacaacgccgccgcttccacgcctcccccaaaaccgcccgcgcccgccgacccgctcgactacctcccgctacacgaaaactaccaatacaaacaacgctcgctatcccccgtcgctaccccgcccctacgaaaaccccgtacccgtcacgccgccgcaaccttcgccctaaataccgctactaccgccgccgtaaaactatcccgaaaacgaaccctaaactactacgaactatacgacgaccgt

SEQ ID NO: 25535 - DNA, 1416 bp, Artificial Sequence
  chemically treated genomic DNA (Homo sapiens) CpG-island No: 25535
  misc_feature (183)..(183): n is either a, c, g or t
  misc_feature (343)..(343): n is either a, c, g or t
ttttgttttaattagcgcgggttttagtgtttgtaagaggagatagttggatttagagcggtaaagtacggttgggagtataaagcgttaggtcgtttcgtcggttttttagggtttattatatttcgcgtagttttaagtatcggtttatgcgggtcgcgcggtggcgttagagcgcgcggncggttttatttatttagtatttatagggttatttggtattgggcgacgtagcgcgatgaggtaggttcggcgcgggttttgtttcgttcgtcgtagagttacgtggtaggacggcgtattttgataacgtaatgttcggtttttcggcgtcgttttcgtntcgtttcgtcgttatcgtcgcgtcgagtttttttgtttaagatggcggcgtcgggggcgttgttttttcggtcgtcgttttcgtcgtcgtcgttgtgagaaatttacgggtcgttcgttcgtcgcgttagcgttatgaagcggtagagcgagcgagattttagttcgagcgggcgcggttcgttatcgttcgttaagcgttcgcgggagcgcgaacgggaggcggaggcgggcgggcggcgggcggcgtataaggtttttggcggcgttaagtattcggttttagcgcgggttcgcgataaatttcgcggtagcggaagcggcgggggcgggtatcgcgacggtcgcggtatcggggacgcgaattatcgcgcgagtagcgggcgtttttcgggtttcggcgttggcggcgggggacgcggcggtaaggtttcgggggattcgggcgttttcggtatgtcgtttcgcgcgttttttttgtcgtcgttttcgttatcgtttggggtcgagttcgcgtgtttcggtttattcgcggtcgcgtttgagtataagacgttgtttattagtagtttgagtttcgcgttgttcgtcgagtatttcgaggatcggtttttttattagtttaagcgtttcggcgagattagttttcgtttgtcgtatacgtttgagttgggtcgtgtggtttacgtgaattttcggtatttataggacgtacgcgaggttcgttagtacgttttggttcggtagttgttgttttacgatcgttcgtttaaggtagagttcgtgtatttgcgtggcggcggcgggagtagtcggcgaagtagtagtagtagcgtcgtcgtttttacgttttttttagggtcgttcgcgttcgtcgattcgttcggttatttttcgttatacggaggttattagtataagtagcgttcgttgtttttcgtcgttgtttcgtttttgcgggagtttcgtgttcgttacgtcgtcgtagttttcgttttggatgtcgttgttgtcgtcgtcgtgggattgtttcgggagcgggttttggattattacgggttgtacgacgatcgt

SEQ ID NO: 25536 - DNA, 1416 bp, Artificial Sequence
  chemically treated genomic DNA (Homo sapiens) CpG-island No: 25536
  misc_feature (1074)..(1074): n is either a, c, g or t
  misc_feature (1234)..(1234): n is either a, c, g or t
acgatcgtcgtacaacccgtaataatccaaaacccgctcccgaaacaatcccacgacgacgacaacaacgacatccaaaacgaaaactacgacgacgtaacgaacacgaaactcccgcaaaaacgaaacaacgacgaaaaacaacgaacgctacttatactaataacctccgtataacgaaaaataaccgaacgaatcgacgaacgcgaacgaccctaaaaaaaacgtaaaaacgacgacgctactactactacttcgccgactactcccgccgccgccacgcaaatacacgaactctaccttaaacgaacgatcgtaaaacaacaactaccgaaccaaaacgtactaacgaacctcgcgtacgtcctataaataccgaaaattcacgtaaaccacacgacccaactcaaacgtatacgacaaacgaaaactaatctcgccgaaacgcttaaactaataaaaaaaccgatcctcgaaatactcgacgaacaacgcgaaactcaaactactaataaacaacgtcttatactcaaacgcgaccgcgaataaaccgaaacacgcgaactcgaccccaaacgataacgaaaacgacgacaaaaaaaacgcgcgaaacgacataccgaaaacgcccgaatcccccgaaaccttaccgccgcgtcccccgccgccaacgccgaaacccgaaaaacgcccgctactcgcgcgataattcgcgtccccgataccgcgaccgtcgcgatacccgcccccgccgcttccgctaccgcgaaatttatcgcgaacccgcgctaaaaccgaatacttaacgccgccaaaaaccttatacgccgcccgccgcccgcccgcctccgcctcccgttcgcgctcccgcgaacgcttaacgaacgataacgaaccgcgcccgctcgaactaaaatctcgctcgctctaccgcttcataacgctaacgcgacgaacgaacgacccgtaaatttctcacaacgacgacgacgaaaacgacgaccgaaaaaacaacgcccccgacgccgccatcttaaacaaaaaaactcgacgcgacgataacgacgaaacganacgaaaacgacgccgaaaaaccgaacattacgttatcaaaatacgccgtcctaccacgtaactctacgacgaacgaaacaaaacccgcgccgaacctacctcatcgcgctacgtcgcccaataccaaataaccctataaatactaaataaataaaaccgnccgcgcgctctaacgccaccgcgcgacccgcataaaccgatacttaaaactacgcgaaatataataaaccctaaaaaaccgacgaaacgacctaacgctttatactcccaaccgtactttaccgctctaaatccaactatctcctcttacaaacactaaaacccgcgctaattaaaacaaaa

SEQ ID NO: 25537 - DNA, 514 bp, Artificial Sequence
  chemically treated genomic DNA (Homo sapiens) CpG-island No: 25537
agggagaattcgggtcgggtaatttttaggtttggttaggcggacgtaggggtatttcgggcgaggcgcgttttgcgttacgtgggtatcgtttttgtagtgatcggagaacggcgtgtttttagggttttgttgtcgtcgtggaagtaggattttcgcggttgtgtaacggtttgtcgtaggcgtgtagggatttggatttcgtttcgttttcggggttcgggtagtcgagttatggcggggaattgtggggttcgcggcgcgttgtcggcgtatacgttgttgttcgatttgtcgttcgcgttgttcggagagttttgcgttgttttggatagttgggatagcgttttgggttggcgcggtttgggtgagttcggggggatcgggtcggggtcggcgggggaagtttaacgtcgtcgcgggggtttcgttcgggcgtcgtttttgtatgggatggggggttttttttcggggttggaggcgggttttcggggaaaattatttttttaaggga

SEQ ID NO: 25538 - DNA, 514 bp, Artificial Sequence
  chemically treated genomic DNA (Homo sapiens) CpG-island No: 25538
tcccttaaaaaaataattttccccgaaaacccgcctccaaccccgaaaaaaaaccccccatcccatacaaaaacgacgcccgaacgaaacccccgcgacgacgttaaacttcccccgccgaccccgacccgatccccccgaactcacccaaaccgcgccaacccaaaacgctatcccaactatccaaaacaacgcaaaactctccgaacaacgcgaacgacaaatcgaacaacaacgtatacgccgacaacgcgccgcgaaccccacaattccccgccataactcgactacccgaaccccgaaaacgaaacgaaatccaaatccctacacgcctacgacaaaccgttacacaaccgcgaaaatcctacttccacgacgacaacaaaaccctaaaaacacgccgttctccgatcactacaaaaacgatacccacgtaacgcaaaacgcgcctcgcccgaaatacccctacgtccgcctaaccaaacctaaaaattacccgacccgaattctccct

SEQ ID NO: 25539 - DNA, 514 bp, Artificial Sequence
  chemically treated genomic DNA (Homo sapiens) CpG-island No: 25539
ttttttgggggagtaatttttttcgagggttcgtttttagtttcggggaagggttttttattttatgtaggggcgacgttcgagcggggttttcgcggcggcgttgggtttttttcgtcggtttcggttcggttttttcggatttatttaggtcgcgttagtttagggcgttgttttagttgtttagaatagcgtagagtttttcgagtagcgcgggcggtaggtcgaatagtagcgtgtgcgtcgatagcgcgtcgcgggttttatagtttttcgttatggttcggttgttcgagtttcggggacgaggcggagtttaggtttttgtacgtttgcgataggtcgttatataatcgcggaaattttgtttttacgacggtagtagagttttaggaatacgtcgtttttcggttattgtaggggcggtgtttacgtgacgtaaggcgcgtttcgttcgagatgtttttgcgttcgtttggttaggtttgggggttattcgattcgggtttttttt

SEQ ID NO: 25540 - DNA, 514 bp, Artificial Sequence
  chemically treated genomic DNA (Homo sapiens) CpG-island No: 25540
aaaaaaaacccgaatcgaataacccccaaacctaaccaaacgaacgcaaaaacatctcgaacgaaacgcgccttacgtcacgtaaacaccgcccctacaataaccgaaaaacgacgtattcctaaaactctactaccgtcgtaaaaacaaaatttccgcgattatataacgacctatcgcaaacgtacaaaaacctaaactccgcctcgtccccgaaactcgaacaaccgaaccataacgaaaaactataaaacccgcgacgcgctatcgacgcacacgctactattcgacctaccgcccgcgctactcgaaaaactctacgctattctaaacaactaaaacaacgccctaaactaacgcgacctaaataaatccgaaaaaaccgaaccgaaaccgacgaaaaaaacccaacgccgccgcgaaaaccccgctcgaacgtcgcccctacataaaataaaaaacccttccccgaaactaaaaacgaaccctcgaaaaaaattactcccccaaaaaa

SEQ ID NO: 25541 - DNA, 559 bp, Artificial Sequence
  chemically treated genomic DNA (Homo sapiens) CpG-island No: 25541
  misc_feature (80)..(80): n is either a, c, g or t
  misc_feature (91)..(91): n is either a, c, g or t
  misc_feature (439)..(439): n is either a, c, g or t
  misc_feature (475)..(475): n is either a, c, g or t
  misc_feature (500)..(500): n is either a, c, g or t
tgcggtcgagtttcgcggtcgggttttttcgtcgttatttcggcgtttgtttagtcgcgagcgagaattaagtcgggttngggcgcggggnttcgggcgaggtcgttaagatggtcgacgcgttcggtagcgcgcggattacgcgggaaggttgtttttggtttttcgggaaatagttaaggtttcgtcgttttttttggcgttttgtttcggtcggtttgtcgggatttttttttcggcgcggtttgcggttttcggggtttcgtaaattttttaggttcgaggttatttagacgtgtatattaggttcggttcgcgaggggagatataggggtcggggttgcggcggttgagttttttgggcggttcggaacgtaaggggtcggcgagtcgacgttgttgtaggaggttgcggcgtggggcgaggttttcgttacgngtttcgttttcgttttttcgcggtcgtttttttttnggaagttttcggaggtagtacgatnggacgtggttatattgttttttagtggttagttcgtcgaataatacgtttgggtttttt

SEQ ID NO: 25542 - DNA, 559 bp, Artificial Sequence
  chemically treated genomic DNA (Homo sapiens) CpG-island No: 25542
  misc_feature (60)..(60): n is either a, c, g or t
  misc_feature (85)..(85): n is either a, c, g or t
  misc_feature (121)..(121): n is either a, c, g or t
  misc_feature (469)..(469): n is either a, c, g or t
  misc_feature (480)..(480): n is either a, c, g or t
aaaaaacccaaacgtattattcgacgaactaaccactaaaaaacaatataaccacgtccnatcgtactacctccgaaaacttccnaaaaaaaaacgaccgcgaaaaaacgaaaacgaaacncgtaacgaaaacctcgccccacgccgcaacctcctacaacaacgtcgactcgccgaccccttacgttccgaaccgcccaaaaaactcaaccgccgcaaccccgacccctatatctcccctcgcgaaccgaacctaatatacacgtctaaataacctcgaacctaaaaaatttacgaaaccccgaaaaccgcaaaccgcgccgaaaaaaaaatcccgacaaaccgaccgaaacaaaacgccaaaaaaaacgacgaaaccttaactatttcccgaaaaaccaaaaacaaccttcccgcgtaatccgcgcgctaccgaacgcgtcgaccatcttaacgacctcgcccgaanccccgcgcccnaacccgacttaattctcgctcgcgactaaacaaacgccgaaataacgacgaaaaaacccgaccgcgaaactcgaccgca

SEQ ID NO: 25543 - DNA, 559 bp, Artificial Sequence
  chemically treated genomic DNA (Homo sapiens) CpG-island No: 25543
  misc_feature (60)..(60): n is either a, c, g or t
  misc_feature (85)..(85): n is either a, c, g or t
  misc_feature (121)..(121): n is either a, c, g or t
  misc_feature (469)..(469): n is either a, c, g or t
  misc_feature (480)..(480): n is either a, c, g or t
aaggggtttagacgtgttgttcggcgagttggttattggagggtagtgtggttacgtttnatcgtgttgttttcgagggtttttngggggagagcggtcgcgggaggacgggaacgaagtncgtagcgagaatttcgttttacgtcgtagttttttgtagtagcgtcggttcgtcggttttttgcgtttcgagtcgtttagggagtttagtcgtcgtagtttcggtttttgtgttttttttcgcgggtcgggtttggtgtgtacgtttggatggtttcgggtttggaaggtttgcgaggtttcgggagtcgtagatcgcgtcggggaggagatttcggtaggtcggtcggggtagagcgttaaggagggcggcggaattttggttgtttttcgggaggttaagggtagttttttcgcgtgattcgcgcgttgtcgagcgcgtcggttattttggcggtttcgttcgggntttcgcgtttnggttcggtttggttttcgttcgcggttgagtagacgtcggggtggcgacgggagagttcgatcgcgaagttcggtcgta

SEQ ID NO: 25544 - DNA, 559 bp, Artificial Sequence
  chemically treated genomic DNA (Homo sapiens) CpG-island No: 25544
  misc_feature (80)..(80): n is either a, c, g or t
  misc_feature (91)..(91): n is either a, c, g or t
  misc_feature (439)..(439): n is either a, c, g or t
  misc_feature (475)..(475): n is either a, c, g or t
  misc_feature (500)..(500): n is either a, c, g or t
tacgaccgaacttcgcgatcgaactctcccgtcgccaccccgacgtctactcaaccgcgaacgaaaaccaaaccgaaccnaaacgcgaaancccgaacgaaaccgccaaaataaccgacgcgctcgacaacgcgcgaatcacgcgaaaaaactacccttaacctcccgaaaaacaaccaaaattccgccgccctccttaacgctctaccccgaccgacctaccgaaatctcctccccgacgcgatctacgactcccgaaacctcgcaaaccttccaaacccgaaaccatccaaacgtacacaccaaacccgacccgcgaaaaaaaacacaaaaaccgaaactacgacgactaaactccctaaacgactcgaaacgcaaaaaaccgacgaaccgacgctactacaaaaaactacgacgtaaaacgaaattctcgctacgnacttcgttcccgtcctcccgcgaccgctctcccccnaaaaaccctcgaaaacaacacgatnaaacgtaaccacactaccctccaataaccaactcgccgaacaacacgtctaaacccctt

SEQ ID NO: 25545 - DNA, 726 bp, Artificial Sequence
  chemically treated genomic DNA (Homo sapiens) CpG-island No: 25545
tcgtttcgcgttttttcggttttcgtttcggcgtaaggtaggtcgagaatcgttagttgcgttttcgggttcggttttgattgacgggcgtttcggattattataaataacgggttttcgaagcgtgggttcggtttagcggacgtagacggttcgtatttatcgcgtcgtagttcgttttatagtttatagattatagttcggggcggggtaaggggtttcgggtacgagtgtgggttgtgaaaatacgggtataagtttgggtcgagtatcgatttgggagtttcgtatttttttcgcgtaatatcggtttttgggtagcgtaattgtaaggataggaatcgtcgcggttcgtttttagttttttttttattttttttcgttcgatttgtcgcgcgttcgcgttttttttttaattttaaaggattttttcggggttggaaaacgtttttttttcgttttttttttgtgcgcgtgaattaggtagttgttagatttcgcgagaggttcgttttttagtcgtttttttttttagttagtgagtgcgcgaacgagaaaggaggagggcgttttaggcgatagtattgtagacgttattattttttgtttttttgttgtatcgatttcgacgttttgtttgtgttttatttgttcgcggtttataggtaattggagttattggagtttgggtattgttgattcgggtaagggttggggttttttgaa

SEQ ID NO: 25546 - DNA, 726 bp, Artificial Sequence
  chemically treated genomic DNA (Homo sapiens) CpG-island No: 25546
ttcaaaaaaccccaacccttacccgaatcaacaatacccaaactccaataactccaattacctataaaccgcgaacaaataaaacacaaacaaaacgtcgaaatcgatacaacaaaaaaacaaaaaataataacgtctacaatactatcgcctaaaacgccctcctcctttctcgttcgcgcactcactaactaaaaaaaaaaacgactaaaaaacgaacctctcgcgaaatctaacaactacctaattcacgcgcacaaaaaaaaaacgaaaaaaaaacgttttccaaccccgaaaaaatcctttaaaattaaaaaaaaaacgcgaacgcgcgacaaatcgaacgaaaaaaaataaaaaaaaaactaaaaacgaaccgcgacgattcctatccttacaattacgctacccaaaaaccgatattacgcgaaaaaaatacgaaactcccaaatcgatactcgacccaaacttatacccgtattttcacaacccacactcgtacccgaaaccccttaccccgccccgaactataatctataaactataaaacgaactacgacgcgataaatacgaaccgtctacgtccgctaaaccgaacccacgcttcgaaaacccgttatttataataatccgaaacgcccgtcaatcaaaaccgaacccgaaaacgcaactaacgattctcgacctaccttacgccgaaacgaaaaccgaaaaaacgcgaaacga

SEQ ID NO: 25547 - DNA, 726 bp, Artificial Sequence
  chemically treated genomic DNA (Homo sapiens) CpG-island No: 25547
tttagggagttttaatttttattcgaattagtaatatttaagttttaataattttaattatttataggtcgcgaataagtgggatataggtaagacgtcgaggtcggtgtagtagagaaatagaggataatggcgtttgtaatgttgtcgtttggagcgttttttttttttttcgttcgcgtatttattagttggggggaggggcggttaggggacgaatttttcgcgagatttaataattgtttagtttacgcgtatagggagggggcggggaaggggcgttttttagtttcgaaggagttttttggggttggaggaggggcgcgagcgcgcggtaaatcgggcgggaagaggtaaaaaaggaattgggagcgagtcgcggcggtttttgtttttatagttgcgttgtttagggatcgatgttgcgcgaggaaaatgcgggatttttaggtcggtgttcggtttagatttatgttcgtgtttttatagtttatattcgtgttcgaagttttttatttcgtttcgggttgtggtttgtgggttgtgggacgagttgcggcgcggtaagtgcgggtcgtttgcgttcgttgggtcgggtttacgtttcggaaattcgttgtttgtaatggttcggggcgttcgttagttaaggtcgggttcgggggcgtagttggcggttttcggtttgttttgcgtcggggcgggagtcggggaaacgcggggcga

SEQ ID NO: 25548 - DNA, 726 bp, Artificial Sequence
  chemically treated genomic DNA (Homo sapiens) CpG-island No: 25548
tcgccccgcgtttccccgactcccgccccgacgcaaaacaaaccgaaaaccgccaactacgcccccgaacccgaccttaactaacgaacgccccgaaccattacaaacaacgaatttccgaaacgtaaacccgacccaacgaacgcaaacgacccgcacttaccgcgccgcaactcgtcccacaacccacaaaccacaacccgaaacgaaataaaaaacttcgaacacgaatataaactataaaaacacgaacataaatctaaaccgaacaccgacctaaaaatcccgcattttcctcgcgcaacatcgatccctaaacaacgcaactataaaaacaaaaaccgccgcgactcgctcccaattccttttttacctcttcccgcccgatttaccgcgcgctcgcgcccctcctccaaccccaaaaaactccttcgaaactaaaaaacgccccttccccgccccctccctatacgcgtaaactaaacaattattaaatctcgcgaaaaattcgtcccctaaccgcccctccccccaactaataaatacgcgaacgaaaaaaaaaaaaaacgctccaaacgacaacattacaaacgccattatcctctatttctctactacaccgacctcgacgtcttacctatatcccacttattcgcgacctataaataattaaaattattaaaacttaaatattactaattcgaataaaaattaaaactccctaaa

SEQ ID NO: 25549 - DNA, 526 bp, Artificial Sequence
  chemically treated genomic DNA (Homo sapiens) CpG-island No: 25549
cgcgcggcggtgttcggaggttggacgttcgttttcggggcggtagtcgagcgtttagttaggaatttgttaataggtttcgaataaagagtcgttaattcggcgggcggtcgcgggcgggttggcgggcggaggtatttcgttttttttcggtttggtcgtcggagtttgtagcgcgttaattatttcgcgttcggttgtttcgcggtatttattttcggtttggacgttttcgggcgcgagtttttcgtagtttcgttcgacgggcgtcgcggcgaatggcgaagtttttttgtttcggttgtcgtgggttcgggtattcgcgttttacggtagtttacgtgtttcgtagattcgtcggtttaagggttttcgcgtattaagttatttagatagcggggcggggattggcgaagttagagatacgcgttgaggaggggttgttattcgttagtgacgggtatatttgtttgggcgggggtggggaggggcggggtggggggcggtgttggaaagatgtagagtt

SEQ ID NO: 25550 - DNA, 526 bp, Artificial Sequence
  chemically treated genomic DNA (Homo sapiens) CpG-island No: 25550
aactctacatctttccaacaccgccccccaccccgcccctccccacccccgcccaaacaaatatacccgtcactaacgaataacaacccctcctcaacgcgtatctctaacttcgccaatccccgccccgctatctaaataacttaatacgcgaaaacccttaaaccgacgaatctacgaaacacgtaaactaccgtaaaacgcgaatacccgaacccacgacaaccgaaacaaaaaaacttcgccattcgccgcgacgcccgtcgaacgaaactacgaaaaactcgcgcccgaaaacgtccaaaccgaaaataaataccgcgaaacaaccgaacgcgaaataattaacgcgctacaaactccgacgaccaaaccgaaaaaaaacgaaatacctccgcccgccaacccgcccgcgaccgcccgccgaattaacgactctttattcgaaacctattaacaaattcctaactaaacgctcgactaccgccccgaaaacgaacgtccaacctccgaacaccgccgcgcg

SEQ ID NO: 25551 - DNA, 526 bp, Artificial Sequence
  chemically treated genomic DNA (Homo sapiens) CpG-island No: 25551
agttttgtatttttttagtatcgttttttatttcgtttttttttattttcgtttaaataaatgtgttcgttattggcgggtagtagtttttttttagcgcgtgtttttggtttcgttagttttcgtttcgttgtttaggtagtttggtacgcgagggtttttaggtcggcggatttgcggggtacgtgagttgtcgtggagcgcgggtgttcgagtttacggtagtcggggtagaggggtttcgttattcgtcgcggcgttcgtcgggcggggttgcgggaggttcgcgttcggggacgtttaggtcgggggtgggtgtcgcggggtagtcgggcgcggggtaattaacgcgttgtaaatttcggcggttaagtcgggaaggggcgggatgttttcgttcgttagttcgttcgcggtcgttcgtcggattagcggttttttgttcggggtttgttaataagtttttggttgagcgttcggttgtcgtttcgggagcgggcgtttagttttcgggtatcgtcgcgcg

SEQ ID NO: 25552 - DNA, 526 bp, Artificial Sequence
  chemically treated genomic DNA (Homo sapiens) CpG-island No: 25552
cgcgcgacgatacccgaaaactaaacgcccgctcccgaaacgacaaccgaacgctcaaccaaaaacttattaacaaaccccgaacaaaaaaccgctaatccgacgaacgaccgcgaacgaactaacgaacgaaaacatcccgccccttcccgacttaaccgccgaaatttacaacgcgttaattaccccgcgcccgactaccccgcgacacccacccccgacctaaacgtccccgaacgcgaacctcccgcaaccccgcccgacgaacgccgcgacgaataacgaaacccctctaccccgactaccgtaaactcgaacacccgcgctccacgacaactcacgtaccccgcaaatccgccgacctaaaaaccctcgcgtaccaaactacctaaacaacgaaacgaaaactaacgaaaccaaaaacacgcgctaaaaaaaaactactacccgccaataacgaacacatttatttaaacgaaaataaaaaaaaacgaaataaaaaacgatactaaaaaaatacaaaact

SEQ ID NO: 25553 - DNA, 702 bp, Artificial Sequence
  chemically treated genomic DNA (Homo sapiens) CpG-island No: 25553
agagcgcgcggggaagttgcgtagtagtaagaagagtttttcgcgtttcgtttcgtaaagtttggtttcggggggtttttagtcgggtttggtagcgttggttagggatttttagagtagcgagcgttcgcgcgtacggtttttcgtaagtttttttagagcgcgcgcggcgtgatttattcgagtcgcggagttaagcggcgaggattatgtttaggagcgttggttataggtcgggtcggacggttatggtcgcgggcgggtaggcgggcgggtcgggcgcggggtttcgcgggcgggagggcggttttagcgttttagttcggagttttagttcggggcgttttcggggtttatgttagcggattgcgttgttttcgggcggtcggttgtcgggcgtacgcggcgcgtggtttttttgggtacgggagcgtagtaatgtagtcggggcggagcgtagcgttagtcgcgtcgcgtatcgagttagtcgcgtcgcggagttcgtagtcggagagcgggtcggtgggcgtcgtaaaattcggattggagcgacggagcggggcggcggttgggaggggcgggggaaggaaggaggggtcgggtcgtttcgcgtagcgcgcgcgggttatttttagtatcgggaatttttttgggcgatgtttgaggtttttttagggaggggtttggggtggtgggcgtgga

SEQ ID NO: 25554 - DNA, 702 bp, Artificial Sequence
  chemically treated genomic DNA (Homo sapiens) CpG-island No: 25554
tccacgcccaccaccccaaacccctccctaaaaaaacctcaaacatcgcccaaaaaaattcccgatactaaaaataacccgcgcgcgctacgcgaaacgacccgacccctccttccttcccccgcccctcccaaccgccgccccgctccgtcgctccaatccgaattttacgacgcccaccgacccgctctccgactacgaactccgcgacgcgactaactcgatacgcgacgcgactaacgctacgctccgccccgactacattactacgctcccgtacccaaaaaaaccacgcgccgcgtacgcccgacaaccgaccgcccgaaaacaacgcaatccgctaacataaaccccgaaaacgccccgaactaaaactccgaactaaaacgctaaaaccgccctcccgcccgcgaaaccccgcgcccgacccgcccgcctacccgcccgcgaccataaccgtccgacccgacctataaccaacgctcctaaacataatcctcgccgcttaactccgcgactcgaataaatcacgccgcgcgcgctctaaaaaaacttacgaaaaaccgtacgcgcgaacgctcgctactctaaaaatccctaaccaacgctaccaaacccgactaaaaaccccccgaaaccaaactttacgaaacgaaacgcgaaaaactcttcttactactacgcaacttccccgcgcgctct

SEQ ID NO: 25555 - DNA, 702 bp, Artificial Sequence
  chemically treated genomic DNA (Homo sapiens) CpG-island No: 25555
tttacgtttattattttaagtttttttttgggggagttttaggtatcgtttagagggattttcggtgttgggggtggttcgcgcgcgttgcgcggggcggttcggtttttttttttttttttcgttttttttagtcgtcgtttcgtttcgtcgttttagttcgggttttgcggcgtttatcggttcgtttttcggttgcgggtttcgcggcgcggttggttcggtgcgcggcgcggttggcgttgcgtttcgtttcggttgtattgttgcgttttcgtgtttaagggagttacgcgtcgcgtgcgttcggtagtcggtcgttcggaggtagcgtagttcgttggtatgggtttcgggggcgtttcgagttggggtttcgggttgaggcgttaaagtcgttttttcgttcgcggggtttcgcgttcggttcgttcgtttgttcgttcgcggttatggtcgttcggttcggtttgtggttagcgtttttgggtatagttttcgtcgtttggtttcgcggttcgggtgagttacgtcgcgcgcgttttggggaggtttgcgggggatcgtgcgcgcgaacgttcgttgttttgggggtttttgattagcgttgttagattcggttgggagtttttcgaggttaaattttgcgaggcgggacgcggggggttttttttgttgttgcgtagttttttcgcgcgtttt

SEQ ID NO: 25556 - DNA, 702 bp, Artificial Sequence
  chemically treated genomic DNA (Homo sapiens) CpG-island No: 25556
aaaacgcgcgaaaaaactacgcaacaacaaaaaaaaccccccgcgtcccgcctcgcaaaatttaacctcgaaaaactcccaaccgaatctaacaacgctaatcaaaaacccccaaaacaacgaacgttcgcgcgcacgatcccccgcaaacctccccaaaacgcgcgcgacgtaactcacccgaaccgcgaaaccaaacgacgaaaactatacccaaaaacgctaaccacaaaccgaaccgaacgaccataaccgcgaacgaacaaacgaacgaaccgaacgcgaaaccccgcgaacgaaaaaacgactttaacgcctcaacccgaaaccccaactcgaaacgcccccgaaacccataccaacgaactacgctacctccgaacgaccgactaccgaacgcacgcgacgcgtaactcccttaaacacgaaaacgcaacaatacaaccgaaacgaaacgcaacgccaaccgcgccgcgcaccgaaccaaccgcgccgcgaaacccgcaaccgaaaaacgaaccgataaacgccgcaaaacccgaactaaaacgacgaaacgaaacgacgactaaaaaaaacgaaaaaaaaaaaaaaaaaccgaaccgccccgcgcaacgcgcgcgaaccacccccaacaccgaaaatccctctaaacgatacctaaaactcccccaaaaaaaaacttaaaataataaacgtaaa

SEQ ID NO: 25557 - DNA, 1045 bp, Artificial Sequence
  chemically treated genomic DNA (Homo sapiens) CpG-island No: 25557
ttcgaacggttaggcggcgtatttcgtttttcgagaggtcgtcgaagtagaagttttggttaaaggaggttttgcggttgcgttttattatagtgttgtattgtcgaagcgcggtgttcggcggtcgtaggacgaggttgaggcgatagttgacggttcggggttcgggggcgttttcggtcgggttttcggcgcggagtagtcggaggcggagtcgttcggttttcggatagtattcggcggttaggcgtagggcgtcgtcggcgcggtttagagttacggtgttttcggtttttaggcgttcgggaaacgggattcgggacgacggcgggttcgtggagggggttcgggtcggggattgggagttcgcgcggcgttttttgttttcgttttcgttggagacggagcggacgcgggttaggcggcgattttttttagttcgtagcgcgcgatttagtagttcgtcggggacgcgtaggaggcggtagtcgcggggtcgtcgggcgagcgcgttttggggcgggcggggatagtcgggggtcgcgggggtcgtcgggttcggagttcgcgggacgcgtagggtttttaggagggcgttcgggtcgtcgtcgtcgtcgtaggtgtgggttcggggtcggggcgcgggcgggttttcgagtaggagcgattttttgcggcgcgtgtgcgggttttcgagtagcgcgtagaagtcgtaggcggtgcgtatacggggtaggtgcggtagtgatagcgcggtttgcgagcgcgggttttagtttgtgcggtcggcgttttcgtttatttttgttttttcgatttaagaatttcggagcgtagttaaggttaggcggggtatgagtcgtggcgggatgtagaatttagggatgcggttcggagtgagtatatttgcgtacgcggcggtggtgcgagatttggtttcgcgggttcgattcgggagaagttagttttcgtttcgtcgaaggtatttaggatttaagcggagtcgttttaggtattatatttggttattttttgttggagtttg

SEQ ID NO: 25558 - DNA, 1045 bp, Artificial Sequence
  chemically treated genomic DNA (Homo sapiens) CpG-island No: 25558
caaactccaacaaaaaataaccaaatataatacctaaaacgactccgcttaaatcctaaataccttcgacgaaacgaaaactaacttctcccgaatcgaacccgcgaaaccaaatctcgcaccaccgccgcgtacgcaaatatactcactccgaaccgcatccctaaattctacatcccgccacgactcataccccgcctaaccttaactacgctccgaaattcttaaatcgaaaaaacaaaaataaacgaaaacgccgaccgcacaaactaaaacccgcgctcgcaaaccgcgctatcactaccgcacctaccccgtatacgcaccgcctacgacttctacgcgctactcgaaaacccgcacacgcgccgcaaaaaatcgctcctactcgaaaacccgcccgcgccccgaccccgaacccacacctacgacgacgacgacgacccgaacgccctcctaaaaaccctacgcgtcccgcgaactccgaacccgacgacccccgcgacccccgactatccccgcccgccccaaaacgcgctcgcccgacgaccccgcgactaccgcctcctacgcgtccccgacgaactactaaatcgcgcgctacgaactaaaaaaaatcgccgcctaacccgcgtccgctccgtctccaacgaaaacgaaaacaaaaaacgccgcgcgaactcccaatccccgacccgaaccccctccacgaacccgccgtcgtcccgaatcccgtttcccgaacgcctaaaaaccgaaaacaccgtaactctaaaccgcgccgacgacgccctacgcctaaccgccgaatactatccgaaaaccgaacgactccgcctccgactactccgcgccgaaaacccgaccgaaaacgcccccgaaccccgaaccgtcaactatcgcctcaacctcgtcctacgaccgccgaacaccgcgcttcgacaatacaacactataataaaacgcaaccgcaaaacctcctttaaccaaaacttctacttcgacgacctctcgaaaaacgaaatacgccgcctaaccgttcgaa

SEQ ID NO: 25559 - DNA, 1045 bp, Artificial Sequence
  chemically treated genomic DNA (Homo sapiens) CpG-island No: 25559
taagttttagtagagagtggttagatgtggtgtttggagcgatttcgtttgggttttgagtgttttcggcggagcggagattggtttttttcgggtcgggttcgcggagttaagtttcgtattatcgtcgcgtgcgtaaatgtgtttatttcggatcgtatttttgagttttgtatttcgttacggtttatgtttcgtttggttttggttgcgtttcggaatttttgggtcgaagaagtagggatggacgagggcgtcggtcgtatagattgggattcgcgttcgtaggtcgcgttgttattgtcgtatttgtttcgtgtgcgtatcgtttacggtttttgcgcgttgttcgagagttcgtatacgcgtcgtaaggagtcgtttttgttcgggggttcgttcgcgtttcggtttcgggtttatatttacggcggcggcggcggttcggacgtttttttggggattttgcgcgtttcgcgagtttcgggttcggcgattttcgcggttttcggttgttttcgttcgttttaggacgcgttcgttcggcggtttcgcggttgtcgttttttgcgcgttttcgacgggttgttgagtcgcgcgttgcgggttgggaggagtcgtcgtttgattcgcgttcgtttcgtttttagcgggaacgaggataaggagcgtcgcgcgggtttttagttttcggttcgggttttttttacgagttcgtcgtcgtttcgggtttcgtttttcgagcgtttggaggtcgagggtatcgtggttttgggtcgcgtcggcgacgttttgcgtttggtcgtcgagtattgttcgggaatcgggcggtttcgttttcggttgtttcgcgtcgagagttcggtcggaggcgttttcgggtttcgagtcgttagttgtcgttttagtttcgttttgcggtcgtcgggtatcgcgtttcggtaatgtagtattgtggtggggcgtagtcgtaaggttttttttgattaggatttttgtttcgacggtttttcggaggacgaagtgcgtcgtttggtcgttcgag

SEQ ID NO: 25560 - DNA, 1045 bp, Artificial Sequence
  chemically treated genomic DNA (Homo sapiens) CpG-island No: 25560
ctcgaacgaccaaacgacgcacttcgtcctccgaaaaaccgtcgaaacaaaaatcctaatcaaaaaaaaccttacgactacgccccaccacaatactacattaccgaaacgcgatacccgacgaccgcaaaacgaaactaaaacgacaactaacgactcgaaacccgaaaacgcctccgaccgaactctcgacgcgaaacaaccgaaaacgaaaccgcccgattcccgaacaatactcgacgaccaaacgcaaaacgtcgccgacgcgacccaaaaccacgataccctcgacctccaaacgctcgaaaaacgaaacccgaaacgacgacgaactcgtaaaaaaaacccgaaccgaaaactaaaaacccgcgcgacgctccttatcctcgttcccgctaaaaacgaaacgaacgcgaatcaaacgacgactcctcccaacccgcaacgcgcgactcaacaacccgtcgaaaacgcgcaaaaaacgacaaccgcgaaaccgccgaacgaacgcgtcctaaaacgaacgaaaacaaccgaaaaccgcgaaaatcgccgaacccgaaactcgcgaaacgcgcaaaatccccaaaaaaacgtccgaaccgccgccgccgccgtaaatataaacccgaaaccgaaacgcgaacgaacccccgaacaaaaacgactccttacgacgcgtatacgaactctcgaacaacgcgcaaaaaccgtaaacgatacgcacacgaaacaaatacgacaataacaacgcgacctacgaacgcgaatcccaatctatacgaccgacgccctcgtccatccctacttcttcgacccaaaaattccgaaacgcaaccaaaaccaaacgaaacataaaccgtaacgaaatacaaaactcaaaaatacgatccgaaataaacacatttacgcacgcgacgataatacgaaacttaactccgcgaacccgacccgaaaaaaaccaatctccgctccgccgaaaacactcaaaacccaaacgaaatcgctccaaacaccacatctaaccactctctactaaaactta

SEQ ID NO: 25561 - DNA, 1618 bp, Artificial Sequence
  chemically treated genomic DNA (Homo sapiens) CpG-island No: 25561
  misc_feature (609)..(609): n is either a, c, g or t
  misc_feature (707)..(707): n is either a, c, g or t
  misc_feature (946)..(946): n is either a, c, g or t
  misc_feature (1276)..(1276): n is either a, c, g or t
  misc_feature (1583)..(1583): n is either a, c, g or t
  misc_feature (1599)..(1599): n is either a, c, g or t
cgatttaaatttttggtcggaaaggaaaaatcgttttttttttagttttattagtacggagatcggaagcgttttacggcgtggtcggaacggtagtacggcgttttttttagttttattagtacggggatcgaaagtattttttcggcgtggtcggaacgatagtacggcgttttttttagttttattagtacggagatcggaagcgttttacggcgtggtcggaacggtagtacggcgtttttattagttttattagtacggagatcggaagtatttttttggtgtggtcggaacggtagtacggcgttttttttagttttattagtacggagatcggaagcgttttacggcgtggttagaacggtagtacggcgttttttttagttttattagtacggggatcggaagtattttatcggcgtggtcggaacggtagtacggcgttttttttagttttattagtacggagatcggaagcgttttacggcgtggtcggaacggtagtacggcgttttttttagttttattagtagggagatcggaagcgttttatcggcgtggtcggaacggtagtacggcgttttttttagttttattagtacggangatcggaagcgttttacggcgtggtcggaacggtagtattgcgttttttttagttttattagtacggagatcggaagtatttttttggtgtggtcggnaacggtagtacggcgttttttttagttttattagtacggagatcggaagcgttttacggcgtggttagaacggtagtacggcgttttttttagttttattagtacggggatcggaagcgttttatcggcgtggtcggaacggtagtacggcgttttttttagttttattagtacggagatcggaagcgttttacggcgtggtcggaacggtagtacggcgttttttttagttttattangtacggagatcggaagcgttttacggcgtggtcggaacggtagtatggcgttttttttagttttattagtacggagatcggaagcgttttacggcgtggtcggaacggtagtacggcgttttttttagttttattagtacggggatcggaagtattttatcggcgtggtcggaacggtagtacggcgttttttttagttttattagtacggagatcggaagcgttttacggcgtggtcggaacggtagtacggcgttttttttagttttattagtacggagatcggaagtatttttttggtgtggtcggaacggtagtacggcgtttttntttagttttattagtacggagatcggaagcgttttacggcgtggttagaacggtagtacggcgttttttttagttttattagtacggggatcggaagtattttatcggcgtggtcggaacggtagtacggcgttttttttagttttattagtacgggagatcggaagcgttttacggcgtggtcggaacggtagtacggcgttttttttagttttattagtacgggggatcggaagcgttttatcggcgtggtcggaacggtagtataggtttttagtttcgcgttgttttcggattatcgagggtngtagtttatagggttnttgaaggttgggggttgtt

SEQ ID NO: 25562 - DNA, 1618 bp, Artificial Sequence
  chemically treated genomic DNA (Homo sapiens) CpG-island No: 25562
  misc_feature (20)..(20): n is either a, c, g or t
  misc_feature (36)..(36): n is either a, c, g or t
  misc_feature (343)..(343): n is either a, c, g or t
  misc_feature (673)..(673): n is either a, c, g or t
  misc_feature (912)..(912): n is either a, c, g or t
  misc_feature (1010)..(1010): n is either a, c, g or t
aacaacccccaaccttcaanaaccctataaactacnaccctcgataatccgaaaacaacgcgaaactaaaaacctatactaccgttccgaccacgccgataaaacgcttccgatcccccgtactaataaaactaaaaaaaacgccgtactaccgttccgaccacgccgtaaaacgcttccgatctcccgtactaataaaactaaaaaaaacgccgtactaccgttccgaccacgccgataaaatacttccgatccccgtactaataaaactaaaaaaaacgccgtactaccgttctaaccacgccgtaaaacgcttccgatctccgtactaataaaactaaanaaaaacgccgtactaccgttccgaccacaccaaaaaaatacttccgatctccgtactaataaaactaaaaaaaacgccgtactaccgttccgaccacgccgtaaaacgcttccgatctccgtactaataaaactaaaaaaaacgccgtactaccgttccgaccacgccgataaaatacttccgatccccgtactaataaaactaaaaaaaacgccgtactaccgttccgaccacgccgtaaaacgcttccgatctccgtactaataaaactaaaaaaaacgccatactaccgttccgaccacgccgtaaaacgcttccgatctccgtacntaataaaactaaaaaaaacgccgtactaccgttccgaccacgccgtaaaacgcttccgatctccgtactaataaaactaaaaaaaacgccgtactaccgttccgaccacgccgataaaacgcttccgatccccgtactaataaaactaaaaaaaacgccgtactaccgttctaaccacgccgtaaaacgcttccgatctccgtactaataaaactaaaaaaaacgccgtactaccgttnccgaccacaccaaaaaaatacttccgatctccgtactaataaaactaaaaaaaacgcaatactaccgttccgaccacgccgtaaaacgcttccgatcntccgtactaataaaactaaaaaaaacgccgtactaccgttccgaccacgccgataaaacgcttccgatctccctactaataaaactaaaaaaaacgccgtactaccgttccgaccacgccgtaaaacgcttccgatctccgtactaataaaactaaaaaaaacgccgtactaccgttccgaccacgccgataaaatacttccgatccccgtactaataaaactaaaaaaaacgccgtactaccgttctaaccacgccgtaaaacgcttccgatctccgtactaataaaactaaaaaaaacgccgtactaccgttccgaccacaccaaaaaaatacttccgatctccgtactaataaaactaataaaaacgccgtactaccgttccgaccacgccgtaaaacgcttccgatctccgtactaataaaactaaaaaaaacgccgtactatcgttccgaccacgccgaaaaaatactttcgatccccgtactaataaaactaaaaaaaacgccgtactaccgttccgaccacgccgtaaaacgcttccgatctccgtactaataaaactaaaaaaaaaacgatttttcctttccgaccaaaaatttaaatcg

SEQ ID NO: 25563 - DNA, 1618 bp, Artificial Sequence
  chemically treated genomic DNA (Homo sapiens) CpG-island No: 25563
  misc_feature (20)..(20): n is either a, c, g or t
  misc_feature (36)..(36): n is either a, c, g or t
  misc_feature (343)..(343): n is either a, c, g or t
  misc_feature (673)..(673): n is either a, c, g or t
  misc_feature (912)..(912): n is either a, c, g or t
  misc_feature (1010)..(1010): n is either a, c, g or t
agtagtttttagtttttaanggttttgtggattatnattttcggtagttcgagagtagcgcggggttgggagtttgtgttgtcgtttcggttacgtcggtgaagcgttttcggtttttcgtgttggtgggattgaggagagcgtcgtgttgtcgtttcggttacgtcgtgaagcgttttcgatttttcgtgttggtgggattgagaagaacgtcgtgttgtcgtttcggttacgtcggtgaagtgttttcggttttcgtgttggtgggattgagaagaacgtcgtgttgtcgttttggttacgtcgtgaagcgttttcggttttcgtgttggtgggattgagnaagaacgtcgtgttgtcgtttcggttatattagagaagtgttttcggttttcgtgttggtgggattgaggagaacgtcgtgttgtcgtttcggttacgtcgtgaagcgttttcggttttcgtgttggtgggattgagaagaacgtcgtgttgtcgtttcggttacgtcggtgaagtgttttcggttttcgtgttggtgggattgaggagaacgtcgtgttgtcgtttcggttacgtcgtgaagcgttttcggttttcgtgttggtgggattgagaagaacgttatgttgtcgtttcggttacgtcgtgaagcgttttcggttttcgtgtntggtgggattgaggagaacgtcgtgttgtcgtttcggttacgtcgtgaagcgttttcggttttcgtgttggtgggattgaggagaacgtcgtgttgtcgtttcggttacgtcggtgaagcgttttcggttttcgtgttggtgggattgaggagaacgtcgtgttgtcgttttggttacgtcgtgaagcgttttcggttttcgtgttggtgggattgagaagaacgtcgtgttgtcgttntcggttatattagagaagtgttttcggttttcgtgttggtgggattgaggagaacgtagtgttgtcgtttcggttacgtcgtgaagcgttttcggttnttcgtgttggtgggattgagaagaacgtcgtgttgtcgtttcggttacgtcggtgaagcgttttcggtttttttgttggtgggattgaggagagcgtcgtgttgtcgtttcggttacgtcgtgaagcgttttcggttttcgtgttggtgggattgagaagaacgtcgtgttgtcgtttcggttacgtcggtgaagtgttttcggttttcgtgttggtgggattgagaagaacgtcgtgttgtcgttttggttacgtcgtgaagcgttttcggttttcgtgttggtgggattgagaagaacgtcgtgttgtcgtttcggttatattagagaagtgttttcggttttcgtgttggtgggattgatgagaacgtcgtgttgtcgtttcggttacgtcgtgaagcgttttcggttttcgtgttggtgggattgagaagaacgtcgtgttgtcgtttcggttacgtcggggaagtgttttcggttttcgtgttggtgggattgaggagaacgtcgtgttgtcgtttcggttacgtcgtgaagcgttttcggttttcgtgttggtgggattgagaagggggcggtttttttttttcggttaggggtttgaatcg

SEQ ID NO: 25564 - DNA, 1618 bp, Artificial Sequence
  chemically treated genomic DNA (Homo sapiens) CpG-island No: 25564
  misc_feature (609)..(609): n is either a, c, g or t
  misc_feature (707)..(707): n is either a, c, g or t
  misc_feature (946)..(946): n is either a, c, g or t
  misc_feature (1276)..(1276): n is either a, c, g or t
  misc_feature (1583)..(1583): n is either a, c, g or t
  misc_feature (1599)..(1599): n is either a, c, g or t
cgattcaaacccctaaccgaaaaaaaaaaaccgcccccttctcaatcccaccaacacgaaaaccgaaaacgcttcacgacgtaaccgaaacgacaacacgacgttctcctcaatcccaccaacacgaaaaccgaaaacacttccccgacgtaaccgaaacgacaacacgacgttcttctcaatcccaccaacacgaaaaccgaaaacgcttcacgacgtaaccgaaacgacaacacgacgttctcatcaatcccaccaacacgaaaaccgaaaacacttctctaatataaccgaaacgacaacacgacgttcttctcaatcccaccaacacgaaaaccgaaaacgcttcacgacgtaaccaaaacgacaacacgacgttcttctcaatcccaccaacacgaaaaccgaaaacacttcaccgacgtaaccgaaacgacaacacgacgttcttctcaatcccaccaacacgaaaaccgaaaacgcttcacgacgtaaccgaaacgacaacacgacgctctcctcaatcccaccaacaaaaaaaccgaaaacgcttcaccgacgtaaccgaaacgacaacacgacgttcttctcaatcccaccaacacgaanaaccgaaaacgcttcacgacgtaaccgaaacgacaacactacgttctcctcaatcccaccaacacgaaaaccgaaaacacttctctaatataaccganaacgacaacacgacgttcttctcaatcccaccaacacgaaaaccgaaaacgcttcacgacgtaaccaaaacgacaacacgacgttctcctcaatcccaccaacacgaaaaccgaaaacgcttcaccgacgtaaccgaaacgacaacacgacgttctcctcaatcccaccaacacgaaaaccgaaaacgcttcacgacgtaaccgaaacgacaacacgacgttctcctcaatcccaccanacacgaaaaccgaaaacgcttcacgacgtaaccgaaacgacaacataacgttcttctcaatcccaccaacacgaaaaccgaaaacgcttcacgacgtaaccgaaacgacaacacgacgttctcctcaatcccaccaacacgaaaaccgaaaacacttcaccgacgtaaccgaaacgacaacacgacgttcttctcaatcccaccaacacgaaaaccgaaaacgcttcacgacgtaaccgaaacgacaacacgacgttctcctcaatcccaccaacacgaaaaccgaaaacacttctctaatataaccgaaacgacaacacgacgttcttnctcaatcccaccaacacgaaaaccgaaaacgcttcacgacgtaaccaaaacgacaacacgacgttcttctcaatcccaccaacacgaaaaccgaaaacacttcaccgacgtaaccgaaacgacaacacgacgttcttctcaatcccaccaacacgaaaaatcgaaaacgcttcacgacgtaaccgaaacgacaacacgacgctctcctcaatcccaccaacacgaaaaaccgaaaacgcttcaccgacgtaaccgaaacgacaacacaaactcccaaccccgcgctactctcgaactaccgaaaatnataatccacaaaaccnttaaaaactaaaaactact

SEQ ID NO: 25565 - DNA, 821 bp, Artificial Sequence
  chemically treated genomic DNA (Homo sapiens) CpG-island No: 25565
tcgcgtttgtattttttttttagttttagcggtttaagatagttgaacggtttttggagggtcggattgttacggtatttttcgcggtcgcgtagtgtggtttagttcggatttcgcggggcgagttgttttttttttttcgattttcgcgtaagtggtgtattggcgcgcggcgtcgaggggcggggttcgagtcgggcgcgcgcgggcgttgttttataaatatcgggtcgtatcgttcgttgtttcgttcgtttcgcgtcgttcgtttgttacgagtagaacgttgttcgtagtttgcgtatttcgtagtcgttgtcgtttcgtcgttgttttttcgtaaggttattttcgtatatcgatattaatatgaacggatagtttaacggtttttacgaggcgtttatcgaggagggtatatttttttttattttagagtcggtcggggaaggttatttaggtgaggggacggtttgaagcgaagcgtggggcggggtagaaggtagcgttaaggttcggttggttgcggtcggtcggtggtggggttcgcgcgggtcgttttcgttcgtcgggtgatggaagagcggcgatcgcgcgtttttttcgtggcgtcgttagggtttggcgcgtggtcgtcgtttttttttttttttttttttttatttttttttttttttttttttttttattcggtcgcgcgtttaggtatgcggaaggttttagaaaacgtgaagggcgggggttgtggtcgttagtgagttttggtcgggaagggagggtattgttaatttttttcggttttgtcgtttgataaatttgga

SEQ ID NO: 25566 - DNA, 821 bp, Artificial Sequence
  chemically treated genomic DNA (Homo sapiens) CpG-island No: 25566
tccaaatttatcaaacgacaaaaccgaaaaaaattaacaataccctcccttcccgaccaaaactcactaacgaccacaacccccgcccttcacgttttctaaaaccttccgcatacctaaacgcgcgaccgaataaaaaaaaaaaaaaaaaaaaaaaaataaaaaaaaaaaaaaaaaaaaaaacgacgaccacgcgccaaaccctaacgacgccacgaaaaaaacgcgcgatcgccgctcttccatcacccgacgaacgaaaacgacccgcgcgaaccccaccaccgaccgaccgcaaccaaccgaaccttaacgctaccttctaccccgccccacgcttcgcttcaaaccgtcccctcacctaaataaccttccccgaccgactctaaaataaaaaaaaatataccctcctcgataaacgcctcgtaaaaaccgttaaactatccgttcatattaatatcgatatacgaaaataaccttacgaaaaaacaacgacgaaacgacaacgactacgaaatacgcaaactacgaacaacgttctactcgtaacaaacgaacgacgcgaaacgaacgaaacaacgaacgatacgacccgatatttataaaacaacgcccgcgcgcgcccgactcgaaccccgcccctcgacgccgcgcgccaatacaccacttacgcgaaaatcgaaaaaaaaaaaacaactcgccccgcgaaatccgaactaaaccacactacgcgaccgcgaaaaataccgtaacaatccgaccctccaaaaaccgttcaactatcttaaaccgctaaaactaaaaaaaaaatacaaacgcga

SEQ ID NO: 25567 - DNA, 821 bp, Artificial Sequence
  chemically treated genomic DNA (Homo sapiens) CpG-island No: 25567
tttaggtttgttagacggtagggtcgggaggggttaatagtgtttttttttttcggttagaatttattagcgattatagttttcgttttttacgttttttggaatttttcgtatgtttaggcgcgcgatcgaatgaaaagggaggggggaagggaagggtggagaggggagggggaagaggagcggcggttacgcgttaggttttggcggcgttacgaggaaagcgcgcggtcgtcgtttttttattattcggcggacgaggacgattcgcgcgggttttattatcggtcggtcgtagttagtcggattttggcgttgttttttgtttcgttttacgtttcgttttaggtcgtttttttatttgggtggtttttttcgatcgattttgaggtgaaaaggaatgtgtttttttcgatgaacgtttcgtggaagtcgttgagttgttcgtttatgttggtgtcggtgtgcggaagtggttttacgaaggagtagcggcgaggcggtagcggttgcgaaatgcgtaagttgcggatagcgttttattcgtagtaggcgggcggcgcggagcgaacgaagtagcgggcggtgcggttcggtatttatagagtagcgttcgcgcgcgttcggttcgggtttcgtttttcggcgtcgcgcgttaatgtattatttgcgcgggggtcgggggaggaagggtagttcgtttcgcggagttcgggttgaattatattgcgcggtcgcgggaggtgtcgtggtaattcggttttttagagatcgtttagttattttgagtcgttagagttaggagaaaaatgtagacgcga

SEQ ID NO: 25568 - DNA, 821 bp, Artificial Sequence
  chemically treated genomic DNA (Homo sapiens) CpG-island No: 25568
tcgcgtctacatttttctcctaactctaacgactcaaaataactaaacgatctctaaaaaaccgaattaccacgacacctcccgcgaccgcgcaatataattcaacccgaactccgcgaaacgaactacccttcctcccccgacccccgcgcaaataatacattaacgcgcgacgccgaaaaacgaaacccgaaccgaacgcgcgcgaacgctactctataaataccgaaccgcaccgcccgctacttcgttcgctccgcgccgcccgcctactacgaataaaacgctatccgcaacttacgcatttcgcaaccgctaccgcctcgccgctactccttcgtaaaaccacttccgcacaccgacaccaacataaacgaacaactcaacgacttccacgaaacgttcatcgaaaaaaacacattccttttcacctcaaaatcgatcgaaaaaaaccacccaaataaaaaaacgacctaaaacgaaacgtaaaacgaaacaaaaaacaacgccaaaatccgactaactacgaccgaccgataataaaacccgcgcgaatcgtcctcgtccgccgaataataaaaaaacgacgaccgcgcgctttcctcgtaacgccgccaaaacctaacgcgtaaccgccgctcctcttccccctcccctctccacccttcccttcccccctcccttttcattcgatcgcgcgcctaaacatacgaaaaattccaaaaaacgtaaaaaacgaaaactataatcgctaataaattctaaccgaaaaaaaaaaacactattaacccctcccgaccctaccgtctaacaaacctaaa

SEQ ID NO: 25569 - DNA, 551 bp, Artificial Sequence
  chemically treated genomic DNA (Homo sapiens) CpG-island No: 25569
gagttcggggttcgttattagttttttttttgattggttttgtgtcgcgcgttcgagcgtgtttggcgtttgcgttggacgattcggtcggtagtggagatgttcggtcggtttaagcgggagtttcgcggttttattcgcgggaagcgagagtttgagtcgcggggtagtttcggtcgcgttaagcgggagcgagatcgggagcgggagtttgaggcggcgagttttcggggtagttttgtgcgcgtgaagcgggagttcgagtcggcgagcgcgcgcgaggtttcggtttttgttgtttcgtttgtgcgggtgaagcgggagcgcgaggtcgatgaggattcggagtttgagcgggaggtgcgaggtgcgcggggtcgggtcgggttaggcgcgagagtttgtttttttcgcgttttttttttttgtttttaatttttcgttaggttattgcgtcggagttgggggaggggtggggttggggtggagaagaggagggatttagattcgacgattttgttgttcgatttgttttgatgaagatagtattt

SEQ ID NO: 25570 - DNA, 551 bp, Artificial Sequence
  chemically treated genomic DNA (Homo sapiens) CpG-island No: 25570
aaatactatcttcatcaaaacaaatcgaacaacaaaatcgtcgaatctaaatccctcctcttctccaccccaaccccacccctcccccaactccgacgcaataacctaacgaaaaattaaaaacaaaaaaaaaaaacgcgaaaaaaacaaactctcgcgcctaacccgacccgaccccgcgcacctcgcacctcccgctcaaactccgaatcctcatcgacctcgcgctcccgcttcacccgcacaaacgaaacaacaaaaaccgaaacctcgcgcgcgctcgccgactcgaactcccgcttcacgcgcacaaaactaccccgaaaactcgccgcctcaaactcccgctcccgatctcgctcccgcttaacgcgaccgaaactaccccgcgactcaaactctcgcttcccgcgaataaaaccgcgaaactcccgcttaaaccgaccgaacatctccactaccgaccgaatcgtccaacgcaaacgccaaacacgctcgaacgcgcgacacaaaaccaatcaaaaaaaaaactaataacgaaccccgaactc

SEQ ID NO: 25571 - DNA, 551 bp, Artificial Sequence
  chemically treated genomic DNA (Homo sapiens) CpG-island No: 25571
gggtattgtttttattagaataagtcgaatagtagaatcgtcgagtttggatttttttttttttttattttaattttattttttttttaatttcggcgtagtgatttagcggaagattagagataagaaaaaaggacgcgaaaaaaataggttttcgcgtttagttcggttcggtttcgcgtatttcgtatttttcgtttaggtttcgagtttttatcgatttcgcgttttcgttttattcgtataaacgggataatagaagtcggggtttcgcgcgcgttcgtcggttcgaattttcgttttacgcgtatagggttgtttcgggagttcgtcgttttaggttttcgttttcgatttcgttttcgtttgacgcgatcggagttgtttcgcgatttagattttcgtttttcgcgagtggaatcgcgagattttcgtttagatcggtcggatatttttattatcggtcgagtcgtttagcgtaggcgttaagtacgttcgagcgcgcggtataaggttaattaggagaggggttggtagcgagtttcgaattt

SEQ ID NO: 25572 - DNA, 551 bp, Artificial Sequence
  chemically treated genomic DNA (Homo sapiens) CpG-island No: 25572
aaattcgaaactcgctaccaacccctctcctaattaaccttataccgcgcgctcgaacgtacttaacgcctacgctaaacgactcgaccgataataaaaatatccgaccgatctaaacgaaaatctcgcgattccactcgcgaaaaacgaaaatctaaatcgcgaaacaactccgatcgcgtcaaacgaaaacgaaatcgaaaacgaaaacctaaaacgacgaactcccgaaacaaccctatacgcgtaaaacgaaaattcgaaccgacgaacgcgcgcgaaaccccgacttctattatcccgtttatacgaataaaacgaaaacgcgaaatcgataaaaactcgaaacctaaacgaaaaatacgaaatacgcgaaaccgaaccgaactaaacgcgaaaacctatttttttcgcgtccttttttcttatctctaatcttccgctaaatcactacgccgaaattaaaaaaaaaataaaattaaaataaaaaaaaaaaaaaatccaaactcgacgattctactattcgacttattctaataaaaacaataccc

SEQ ID NO: 25573 - DNA, 745 bp, Artificial Sequence
  chemically treated genomic DNA (Homo sapiens) CpG-island No: 25573
cggcggcgcgtaggtaattatttgattatcggcgttttgggcgaggggcgggtttacgcggaaagtttagttcggttcggttttcgttcgtttgggcgcggggatttcggttggggtcggattttgcggtcggcgattttttaggattcgggacgcgagagtttttaggtgatttttggaagttcggaggaagggaaggagtttagtacgtattttttcggagcgtttcgtcgtcgtcgtattttgttcggttttttcgtggcgtcgattttagttgcggttttcggagtagttttgaaaggtttaaagggtcgagcggtttcgtttttggaggttttaggtttcgtcgcgtcgttcgtcgggacgtggagttcgcgtagtttcggtttcggtgttcgcgttttgttcgagattataattttcgagttttcgcgttcgcgttacgggggaaacgtgggcggtgttttaatttcggaggatttgggcgcggagggttgtggcgtgaagatcgttttaaaatcgagatgattagaggtttcgtttaatcgatttttgtcggggaagcgttagtaggtggggatttcggggtagtttgtattttagttttatttgggattgtcgtcgtgtatatggttggaggagcgttttttcgttattgcgtatattttgtagtttgtatcggttaacggtgagttttttaggaagtttttttaacgtggcgttttatgtttgtttttggttaggg

SEQ ID NO: 25574 - DNA, 745 bp, Artificial Sequence
  chemically treated genomic DNA (Homo sapiens) CpG-island No: 25574
ccctaaccaaaaacaaacataaaacgccacgttaaaaaaacttcctaaaaaactcaccgttaaccgatacaaactacaaaatatacgcaataacgaaaaaacgctcctccaaccatatacacgacgacaatcccaaataaaactaaaatacaaactaccccgaaatccccacctactaacgcttccccgacaaaaatcgattaaacgaaacctctaatcatctcgattttaaaacgatcttcacgccacaaccctccgcgcccaaatcctccgaaattaaaacaccgcccacgtttcccccgtaacgcgaacgcgaaaactcgaaaattataatctcgaacaaaacgcgaacaccgaaaccgaaactacgcgaactccacgtcccgacgaacgacgcgacgaaacctaaaacctccaaaaacgaaaccgctcgaccctttaaacctttcaaaactactccgaaaaccgcaactaaaatcgacgccacgaaaaaaccgaacaaaatacgacgacgacgaaacgctccgaaaaaatacgtactaaactccttcccttcctccgaacttccaaaaatcacctaaaaactctcgcgtcccgaatcctaaaaaatcgccgaccgcaaaatccgaccccaaccgaaatccccgcgcccaaacgaacgaaaaccgaaccgaactaaactttccgcgtaaacccgcccctcgcccaaaacgccgataatcaaataattacctacgcgccgccg

SEQ ID NO: 25575 - DNA, 745 bp, Artificial Sequence
  chemically treated genomic DNA (Homo sapiens) CpG-island No: 25575
ttttggttagaggtaggtatggggcgttacgttgagagagttttttagaggatttatcgttggtcggtgtaggttgtaaaatgtgcgtagtggcggagagacgtttttttagttatgtgtacggcgataattttaggtagagttggaatgtaggttgtttcgagatttttatttgttgacgttttttcggtaggaatcggttaaacggaatttttagttatttcggttttagagcggtttttacgttatagtttttcgcgtttaggtttttcgaagttgggatatcgtttacgtttttttcgtgacgcgggcgcgggggttcgggagttgtagtttcgggtagggcgcgggtatcgaggtcggggttgcgcggattttacgtttcggcgggcggcgcggcgaggtttggggtttttaggggcggggtcgttcggttttttaaattttttagggttgtttcgagggtcgtagttagagtcggcgttacgagggggtcgagtagggtgcggcggcggcggggcgtttcggggaggtgcgtattgggtttttttttttttttcgggtttttaggaattatttggggattttcgcgtttcgggttttggggggtcgtcggtcgtagggttcggttttagtcggggttttcgcgtttaggcgagcgggggtcgggtcgggttgggtttttcgcgtgaattcgtttttcgtttagggcgtcgatggttaggtggttgtttgcgcgtcgtcg

SEQ ID NO: 25576 - DNA, 745 bp, Artificial Sequence
  chemically treated genomic DNA (Homo sapiens) CpG-island No: 25576
cgacgacgcgcaaacaaccacctaaccatcgacgccctaaacgaaaaacgaattcacgcgaaaaacccaacccgacccgacccccgctcgcctaaacgcgaaaaccccgactaaaaccgaaccctacgaccgacgaccccccaaaacccgaaacgcgaaaatccccaaataattcctaaaaacccgaaaaaaaaaaaaaaacccaatacgcacctccccgaaacgccccgccgccgccgcaccctactcgaccccctcgtaacgccgactctaactacgaccctcgaaacaaccctaaaaaatttaaaaaaccgaacgaccccgcccctaaaaaccccaaacctcgccgcgccgcccgccgaaacgtaaaatccgcgcaaccccgacctcgatacccgcgccctacccgaaactacaactcccgaacccccgcgcccgcgtcacgaaaaaaacgtaaacgatatcccaacttcgaaaaacctaaacgcgaaaaactataacgtaaaaaccgctctaaaaccgaaataactaaaaattccgtttaaccgattcctaccgaaaaaacgtcaacaaataaaaatctcgaaacaacctacattccaactctacctaaaattatcgccgtacacataactaaaaaaacgtctctccgccactacgcacattttacaacctacaccgaccaacgataaatcctctaaaaaactctctcaacgtaacgccccatacctacctctaaccaaaa

SEQ ID NO: 25577 - DNA, 552 bp, Artificial Sequence
  chemically treated genomic DNA (Homo sapiens) CpG-island No: 25577
gggagcggcgcggggtatataggaggagggggaagaaaaagtaagatgtcggtggtttgcggttttattattcggaagttggattcgttttcgttttttttttttttggcgcggagcgcgcgagtgagattatttttacgtatttattcggcggttgcggtcgttttatttgtaggcggggcggggcgggtttagtagtttcgtttagggggtggaggaacgagggcgggtcggtagtcgttatgttagtttgtggttgtcggcgcggtaggacgcgttggtgggagggggggcggttttgcgtggggtcgtttcgtattttttttttcgtttttatttttcggatttagggacgcgagtttagagaaaatcggttgtgggttcgtagcgtgtgtgggaattttattttggacgtttttcgggggtcgtttttaaagaattatagaggtagagcgggacgtaatgagttatgaacgtttgggttttttttttagttttttcgtagtagattttgggggcgcggttgtaaaatttagttgtttataggggcgg

SEQ ID NO: 25578 - DNA, 552 bp, Artificial Sequence
  chemically treated genomic DNA (Homo sapiens) CpG-island No: 25578
ccgcccctataaacaactaaattttacaaccgcgcccccaaaatctactacgaaaaaactaaaaaaaaaacccaaacgttcataactcattacgtcccgctctacctctataattctttaaaaacgacccccgaaaaacgtccaaaataaaattcccacacacgctacgaacccacaaccgattttctctaaactcgcgtccctaaatccgaaaaataaaaacgaaaaaaaaaatacgaaacgaccccacgcaaaaccgccccccctcccaccaacgcgtcctaccgcgccgacaaccacaaactaacataacgactaccgacccgccctcgttcctccaccccctaaacgaaactactaaacccgccccgccccgcctacaaataaaacgaccgcaaccgccgaataaatacgtaaaaataatctcactcgcgcgctccgcgccaaaaaaaaaaaaaacgaaaacgaatccaacttccgaataataaaaccgcaaaccaccgacatcttactttttcttccccctcctcctatataccccgcgccgctccc

SEQ ID NO: 25579 - DNA, 552 bp, Artificial Sequence
  chemically treated genomic DNA (Homo sapiens) CpG-island No: 25579
tcgtttttgtgggtagttaggttttgtaatcgcgtttttagagtttattgcgggaaaattagggaagaagtttaggcgtttatggtttattgcgtttcgttttatttttgtggttttttgggagcgattttcgggaagcgtttaaagtggagtttttatatacgttgcgaatttatagtcggttttttttgaattcgcgtttttgagttcgggaggtggaggcggagaaaagggtgcggagcgattttacgtagggtcgtttttttttttattagcgcgttttgtcgcgtcggtagttataggttggtatagcggttgtcgattcgttttcgtttttttattttttgaacgggattgttgggttcgtttcgtttcgtttgtaggtgaagcggtcgtagtcgtcgagtaggtgcgtggggatgattttattcgcgcgtttcgcgttaggaggaggaggagcgggagcggatttaattttcgggtagtggagtcgtaagttatcggtattttgtttttttttttttttttttttgtgtgtttcgcgtcgttttt

SEQ ID NO: 25580 - DNA, 552 bp, Artificial Sequence
  chemically treated genomic DNA (Homo sapiens) CpG-island No: 25580
aaaaacgacgcgaaacacacaaaaaaaaaaaaaaaaaaaaacaaaataccgataacttacgactccactacccgaaaattaaatccgctcccgctcctcctcctcctaacgcgaaacgcgcgaataaaatcatccccacgcacctactcgacgactacgaccgcttcacctacaaacgaaacgaaacgaacccaacaatcccgttcaaaaaataaaaaaacgaaaacgaatcgacaaccgctataccaacctataactaccgacgcgacaaaacgcgctaataaaaaaaaaaacgaccctacgtaaaatcgctccgcacccttttctccgcctccacctcccgaactcaaaaacgcgaattcaaaaaaaaccgactataaattcgcaacgtatataaaaactccactttaaacgcttcccgaaaatcgctcccaaaaaaccacaaaaataaaacgaaacgcaataaaccataaacgcctaaacttcttccctaattttcccgcaataaactctaaaaacgcgattacaaaacctaactacccacaaaaacga

SEQ ID NO: 25581 - DNA, 1005 bp, Artificial Sequence
  chemically treated genomic DNA (Homo sapiens) CpG-island No: 25581
taattttcgtggtcgcggtgtaattttcgtagtcgcggtgtaattttcgtagtcgcggtgttattttcgagattgcggagtaattttcgtagttgcggtgtaattttcgagattgcggtgtgattttcgagattgcggtgtgattttcgagattgcggtgtgattttcgtagttgcggtggaattttcgagattgcggtgtaattttcgaggttgcggtgtaattttcgtggttgcggtgtaattttcgtggttgcggtgtaattttcgtggttgcggtgtaattttcgtggttgcggtgtaattttcgtggttgcggtgtaattttcgaggttgcggtgtaatgttcgtggttgcggtgtaatgttcgtggttgcggtgtaattttcgaggttgcggtgtaatgttcgaggttgcggtgtaattttcgaggttgcggtgtaattttcgtggttgcggtgtaatgttcgtggttgcggtgtaatgttcgtggttgcggtgtaattttcgtggttgcggtgtaattttcgaggttgcggtgtaattttcgaggttgcggtgtaatgttcgtggttgcggtgtaatgttcgtggttgcggtgtaatgttcgtggttgcggtgtaatgttcgtggttgcggtgtaatgttcgtggttgcggtgtaatttacgaggttgcggtgtaatgttcgaggttgcggtgtaatttacgaggttgcggtgtaatttacgaggttgcggtgtaatgttcgtggttgcggtgtaatgttcgaggttgcggtgtaatgttcgtggttgcggtgtaatgttcgtggttgcggtgtaatttatcgaggttgcggtgtaatgttcgtggttgcggtgtaatgttcgaggttgcggtgtaatgttcgaggtaacgtgtaggtgatcgggagggggggatgattcgattcgagttcggtatcgaaatgttattttagtattcgttattttatcggtatttaattttggtagttattggtgtga

SEQ ID NO: 25582 - DNA, 1005 bp, Artificial Sequence
  chemically treated genomic DNA (Homo sapiens) CpG-island No: 25582
tcacaccaataactaccaaaattaaataccgataaaataacgaatactaaaataacatttcgataccgaactcgaatcgaatcatccccccctcccgatcacctacacgttacctcgaacattacaccgcaacctcgaacattacaccgcaaccacgaacattacaccgcaacctcgataaattacaccgcaaccacgaacattacaccgcaaccacgaacattacaccgcaacctcgaacattacaccgcaaccacgaacattacaccgcaacctcgtaaattacaccgcaacctcgtaaattacaccgcaacctcgaacattacaccgcaacctcgtaaattacaccgcaaccacgaacattacaccgcaaccacgaacattacaccgcaaccacgaacattacaccgcaaccacgaacattacaccgcaaccacgaacattacaccgcaacctcgaaaattacaccgcaacctcgaaaattacaccgcaaccacgaaaattacaccgcaaccacgaacattacaccgcaaccacgaacattacaccgcaaccacgaaaattacaccgcaacctcgaaaattacaccgcaacctcgaacattacaccgcaacctcgaaaattacaccgcaaccacgaacattacaccgcaaccacgaacattacaccgcaacctcgaaaattacaccgcaaccacgaaaattacaccgcaaccacgaaaattacaccgcaaccacgaaaattacaccgcaaccacgaaaattacaccgcaaccacgaaaattacaccgcaacctcgaaaattacaccgcaatctcgaaaattccaccgcaactacgaaaatcacaccgcaatctcgaaaatcacaccgcaatctcgaaaatcacaccgcaatctcgaaaattacaccgcaactacgaaaattactccgcaatctcgaaaataacaccgcgactacgaaaattacaccgcgactacgaaaattacaccgcgaccacgaaaatta

SEQ ID NO: 25583 - DNA, 1005 bp, Artificial Sequence
  chemically treated genomic DNA (Homo sapiens) CpG-island No: 25583
ttatattagtgattattagagttgaatgtcgatagagtaacggatgttaagatgatatttcggtatcgaattcgagtcgaattatttttttttttcggttatttatacgttgtttcggatattatatcgtagtttcggatattatatcgtagttacggatattatatcgtagtttcggtaaattatatcgtagttacggatattatatcgtagttacggatattatatcgtagtttcggatattatatcgtagttacggatattatatcgtagtttcgtaaattatatcgtagtttcgtaaattatatcgtagtttcggatattatatcgtagtttcgtaaattatatcgtagttacggatattatatcgtagttacggatattatatcgtagttacggatattatatcgtagttacggatattatatcgtagttacggatattatatcgtagtttcggaaattatatcgtagtttcggaaattatatcgtagttacggaaattatatcgtagttacggatattatatcgtagttacggatattatatcgtagttacggaaattatatcgtagtttcggaaattatatcgtagtttcggatattatatcgtagtttcggaaattatatcgtagttacggatattatatcgtagttacggatattatatcgtagtttcggaaattatatcgtagttacggaaattatatcgtagttacggaaattatatcgtagttacggaaattatatcgtagttacggaaattatatcgtagttacggaaattatatcgtagtttcggaaattatatcgtagtttcggaaattttatcgtagttacggaaattatatcgtagtttcggaaattatatcgtagtttcggaaattatatcgtagtttcggaaattatatcgtagttacggaaattatttcgtagtttcggaaatgatatcgcggttacggaaattatatcgcggttacggaaattatatcgcggttacggaaatta

SEQ ID NO: 25584 - DNA, 1005 bp, Artificial Sequence
  chemically treated genomic DNA (Homo sapiens) CpG-island No: 25584
taatttccgtaaccgcgatataatttccgtaaccgcgatataatttccgtaaccgcgatatcatttccgaaactacgaaataatttccgtaactacgatataatttccgaaactacgatataatttccgaaactacgatataatttccgaaactacgatataatttccgtaactacgataaaatttccgaaactacgatataatttccgaaactacgatataatttccgtaactacgatataatttccgtaactacgatataatttccgtaactacgatataatttccgtaactacgatataatttccgtaactacgatataatttccgaaactacgatataatatccgtaactacgatataatatccgtaactacgatataatttccgaaactacgatataatatccgaaactacgatataatttccgaaactacgatataatttccgtaactacgatataatatccgtaactacgatataatatccgtaactacgatataatttccgtaactacgatataatttccgaaactacgatataatttccgaaactacgatataatatccgtaactacgatataatatccgtaactacgatataatatccgtaactacgatataatatccgtaactacgatataatatccgtaactacgatataatttacgaaactacgatataatatccgaaactacgatataatttacgaaactacgatataatttacgaaactacgatataatatccgtaactacgatataatatccgaaactacgatataatatccgtaactacgatataatatccgtaactacgatataatttaccgaaactacgatataatatccgtaactacgatataatatccgaaactacgatataatatccgaaacaacgtataaataaccgaaaaaaaaaaataattcgactcgaattcgataccgaaatatcatcttaacatccgttactctatcgacattcaactctaataatcactaatataa

SEQ ID NO: 25585 - DNA, 764 bp, Artificial Sequence
  chemically treated genomic DNA (Homo sapiens) CpG-island No: 25585
tgattgtcggacgttttaacgtcggtaaatcgagtttgttaaacgcgttggcggggcgtgaagcggtaatcgtaatcgatatcgtcggaattacgcgtgacgtgttgcgtgagtatatttatattgacggaatgtcgttgtatattatcgatatcgtcgggttacgtgaagttagtgacgaagtagaacgtattggtatcgagcgcgcgtggtaggaaattgaataggtcgatcgcgtgttgtttatggtcgatggtattataatagacgtcgtggattcggtagagatttggtcggaatttattgttcgtttgttagcgaaattgtcgattatcgtggtgcgttataaagtcgatattatcggcgaaacgttgggaatgagtgacgtgaacggttacgcgttaattcgtttttcggataggattggtgataggcgtggaacgtgttgcgtatttattttaaatagagtatgggtttcgatattaatatggaaggcggttttttggcgcgtcgtcgttattataggcgttggaataggtagggaaaatttatattaggttaacgcgtatagtgcgatttatttagataacggcggaggacgattgcgacggtatagtaagttagcgataacggggtttattttaattatagagggacgatattaaaattaaacggttaaacggtaataaattatggacgtaatcgttaagagtttatagaggttattttagttattttttattgtatattagttttatgtaatg

SEQ ID NO: 25586 - DNA, 764 bp, Artificial Sequence
  chemically treated genomic DNA (Homo sapiens) CpG-island No: 25586
cattacataaaactaatatacaataaaaaataactaaaataacctctataaactcttaacgattacgtccataatttattaccgtttaaccgtttaattttaatatcgtccctctataattaaaataaaccccgttatcgctaacttactataccgtcgcaatcgtcctccgccgttatctaaataaatcgcactatacgcgttaacctaatataaattttccctacctattccaacgcctataataacgacgacgcgccaaaaaaccgccttccatattaatatcgaaacccatactctatttaaaataaatacgcaacacgttccacgcctatcaccaatcctatccgaaaaacgaattaacgcgtaaccgttcacgtcactcattcccaacgtttcgccgataatatcgactttataacgcaccacgataatcgacaatttcgctaacaaacgaacaataaattccgaccaaatctctaccgaatccacgacgtctattataataccatcgaccataaacaacacgcgatcgacctattcaatttcctaccacgcgcgctcgataccaatacgttctacttcgtcactaacttcacgtaacccgacgatatcgataatatacaacgacattccgtcaatataaatatactcacgcaacacgtcacgcgtaattccgacgatatcgattacgattaccgcttcacgccccgccaacgcgtttaacaaactcgatttaccgacgttaaaacgtccgacaatca

SEQ ID NO: 25587 - DNA, 764 bp, Artificial Sequence
  chemically treated genomic DNA (Homo sapiens) CpG-island No: 25587
tattgtatgggattgatgtgtagtgaaagatggttggggtgatttttgtagatttttggcgattgcgtttatggtttgttgtcgtttggtcgtttggttttggtatcgtttttttgtggttggggtaggtttcgttgtcgttgatttgttgtgtcgtcgtagtcgtttttcgtcgttgtttgggtgggtcgtattgtgcgcgttggtttggtgtagattttttttgtttgttttagcgtttgtagtggcgacgacgcgttaggaagtcgttttttatgttggtgtcgaagtttatgttttgtttgagatgggtacgtagtacgttttacgtttgttattagttttgttcgagagacgaattaacgcgtgatcgtttacgttatttatttttagcgtttcgtcggtgatatcggttttatggcgtattacggtgatcggtagtttcgttggtagacgggtaataaatttcggttagatttttgtcggatttacggcgtttgttgtggtgttatcgattataaatagtacgcggtcggtttgtttaattttttgttacgcgcgttcgatattaatacgttttatttcgttattggttttacgtagttcggcggtatcgatgatatgtagcggtatttcgttaatgtggatatgtttacgtagtacgttacgcgtagtttcggcgatatcggttacgattgtcgttttacgtttcgttagcgcgtttaataggttcgatttatcggcgttaggacgttcggtaatta

SEQ ID NO: 25588 - DNA, 764 bp, Artificial Sequence
  chemically treated genomic DNA (Homo sapiens) CpG-island No: 25588
taattaccgaacgtcctaacgccgataaatcgaacctattaaacgcgctaacgaaacgtaaaacgacaatcgtaaccgatatcgccgaaactacgcgtaacgtactacgtaaacatatccacattaacgaaataccgctacatatcatcgataccgccgaactacgtaaaaccaataacgaaataaaacgtattaatatcgaacgcgcgtaacaaaaaattaaacaaaccgaccgcgtactatttataatcgataacaccacaacaaacgccgtaaatccgacaaaaatctaaccgaaatttattacccgtctaccaacgaaactaccgatcaccgtaatacgccataaaaccgatatcaccgacgaaacgctaaaaataaataacgtaaacgatcacgcgttaattcgtctctcgaacaaaactaataacaaacgtaaaacgtactacgtacccatctcaaacaaaacataaacttcgacaccaacataaaaaacgacttcctaacgcgtcgtcgccactacaaacgctaaaacaaacaaaaaaaatctacaccaaaccaacgcgcacaatacgacccacccaaacaacgacgaaaaacgactacgacgacacaacaaatcaacgacaacgaaacctaccccaaccacaaaaaaacgataccaaaaccaaacgaccaaacgacaacaaaccataaacgcaatcgccaaaaatctacaaaaatcaccccaaccatctttcactacacatcaatcccatacaata

SEQ ID NO: 25589 - DNA, 857 bp, Artificial Sequence
  chemically treated genomic DNA (Homo sapiens) CpG-island No: 25589
gttagcgttggatgcggcgtgcggtcggtaaagattagatcgtttatatagaattggcgatcgttcggcgtatcgttaaaattatcgtcgtaagtcgattacgggttgtcgtttttattatatttaattagcgattgatttatttagttttagacgaagtcgttttgtaaacggggatattgacgaaacgtttgttagtatttagcgaaatcgttaagattgttatttatcgcgtgggcgtattcgtaaaggattagcgggcgcgtttttttaggtagcgaaagttattttttgatggattatttcggtatagtcgggaagggttggtttttatttacgcgcgcgtatatcgggtaaataatatcggtggtcgtggtgtcggtttcgtcgtttttatattgtatcgggcgggaaggatcgatagatttgatttagcgatatagcgcgtcgtgattagcgtcgtggtttgatttattttttagcgattagatgattatattcgggtgattacgatcgcgttgtattattcgcgttatttttcgtttatcgcggtagtagcgcggattatcgttagtcgtttattggtattattcgtgggttttttattgggttgtttatatattaggtcgagaggtttttcgcggtatttagggatggtcgttaagcgttcggtcgcgtaagtcgcgcgtatagagaatttcgtttttcgttttttggtattattttcgcgtgaattatgtaacgttatcgatagtgtttattgtgatgatggattgggtttcgttcgatggcgatagcgattttatttaggataattcgttgttgggcggagatttagtaacgtaatatttgatcga

SEQ ID NO: 25590 - DNA, 857 bp, Artificial Sequence
  chemically treated genomic DNA (Homo sapiens) CpG-island No: 25590
tcgatcaaatattacgttactaaatctccgcccaacaacgaattatcctaaataaaatcgctatcgccatcgaacgaaacccaatccatcatcacaataaacactatcgataacgttacataattcacgcgaaaataataccaaaaaacgaaaaacgaaattctctatacgcgcgacttacgcgaccgaacgcttaacgaccatccctaaataccgcgaaaaacctctcgacctaatatataaacaacccaataaaaaacccacgaataataccaataaacgactaacgataatccgcgctactaccgcgataaacgaaaaataacgcgaataatacaacgcgatcgtaatcacccgaatataatcatctaatcgctaaaaaataaatcaaaccacgacgctaatcacgacgcgctatatcgctaaatcaaatctatcgatccttcccgcccgatacaatataaaaacgacgaaaccgacaccacgaccaccgatattatttacccgatatacgcgcgcgtaaataaaaaccaacccttcccgactataccgaaataatccatcaaaaaataactttcgctacctaaaaaaacgcgcccgctaatcctttacgaatacgcccacgcgataaataacaatcttaacgatttcgctaaatactaacaaacgtttcgtcaatatccccgtttacaaaacgacttcgtctaaaactaaataaatcaatcgctaattaaatataataaaaacgacaacccgtaatcgacttacgacgataattttaacgatacgccgaacgatcgccaattctatataaacgatctaatctttaccgaccgcacgccgcatccaacgctaac

SEQ ID NO: 25591 - DNA, 857 bp, Artificial Sequence
  chemically treated genomic DNA (Homo sapiens) CpG-island No: 25591
tcgattagatattgcgttgttaagttttcgtttagtaacgagttattttgaataagatcgttgtcgttatcgaacggagtttagtttattattatagtaggtattgtcgataacgttgtatgatttacgcgaaggtggtattagggggcgaagggcgagattttttgtgcgcgcgatttacgcggtcgggcgtttagcgattatttttgggtatcgcgggggatttttcggtttgatgtgtggataatttaataggaaatttacggatggtgttaatgagcggttgacgatgattcgcgttgttatcgcgatgagcgaagggtaacgcgaatggtgtagcgcgatcgtaattattcgagtgtgattatttggtcgttggggaatgaattaggttacggcgttaattacgacgcgttgtatcgttggattaaatttgtcgatttttttcgttcggtgtagtatgaaggcggcggagtcgatattacggttatcgatattatttgttcgatgtacgcgcgcgtggatgaagattagtttttttcggttgtgtcgaaatggtttattaaaaaatggttttcgttatttggagagacgcgttcgttgattttttgcgaatacgtttacgcgatgggtaatagttttggcggtttcgttaaatattggtaggcgtttcgttagtattttcgtttatagggcggtttcgtttgggattgggtggattagtcgttgattaaatatgatgaaaacggtaattcgtggtcggtttacggcggtgattttggcgatacgtcgaacgatcgttagttttgtatgaacggtttggtttttgtcgatcgtacgtcgtatttagcgttgat

SEQ ID NO: 25592 - DNA, 857 bp, Artificial Sequence
  chemically treated genomic DNA (Homo sapiens) CpG-island No: 25592
atcaacgctaaatacgacgtacgatcgacaaaaaccaaaccgttcatacaaaactaacgatcgttcgacgtatcgccaaaatcaccgccgtaaaccgaccacgaattaccgttttcatcatatttaatcaacgactaatccacccaatcccaaacgaaaccgccctataaacgaaaatactaacgaaacgcctaccaatatttaacgaaaccgccaaaactattacccatcgcgtaaacgtattcgcaaaaaatcaacgaacgcgtctctccaaataacgaaaaccattttttaataaaccatttcgacacaaccgaaaaaaactaatcttcatccacgcgcgcgtacatcgaacaaataatatcgataaccgtaatatcgactccgccgccttcatactacaccgaacgaaaaaaatcgacaaatttaatccaacgatacaacgcgtcgtaattaacgccgtaacctaattcattccccaacgaccaaataatcacactcgaataattacgatcgcgctacaccattcgcgttacccttcgctcatcgcgataacaacgcgaatcatcgtcaaccgctcattaacaccatccgtaaatttcctattaaattatccacacatcaaaccgaaaaatcccccgcgatacccaaaaataatcgctaaacgcccgaccgcgtaaatcgcgcgcacaaaaaatctcgcccttcgccccctaataccaccttcgcgtaaatcatacaacgttatcgacaatacctactataataataaactaaactccgttcgataacgacaacgatcttattcaaaataactcgttactaaacgaaaacttaacaacgcaatatctaatcga

SEQ ID NO: 25593 - DNA, 736 bp, Artificial Sequence
  chemically treated genomic DNA (Homo sapiens) CpG-island No: 25593
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagatacggttgattaagtttattttttattttcgggtaataagggcgtttgttattaataaaggtcgtttaattacggtttttgagagttattatatcgtatttgcgataggttgagattaat

SEQ ID NO: 25594 - DNA, 736 bp, Artificial Sequence
  chemically treated genomic DNA (Homo sapiens) CpG-island No: 25594
attaatctcaacctatcgcaaatacgatataataactctcaaaaaccgtaattaaacgacctttattaataacaaacgcccttattacccgaaaataaaaaataaacttaatcaaccgtatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 25595 - DNA, 736 bp, Artificial Sequence
  chemically treated genomic DNA (Homo sapiens) CpG-island No: 25595
gttaattttagtttgtcgtaagtacgatgtaatgatttttaagagtcgtgattggacggtttttattgatagtaagcgtttttattgttcggggatggggagtaagtttagttagtcgtgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 25596 - DNA, 736 bp, Artificial Sequence
  chemically treated genomic DNA (Homo sapiens) CpG-island No: 25596
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacacgactaactaaacttactccccatccccgaacaataaaaacgcttactatcaataaaaaccgtccaatcacgactcttaaaaatcattacatcgtacttacgacaaactaaaattaac

SEQ ID NO: 25597 - DNA, 660 bp, Artificial Sequence
  chemically treated genomic DNA (Homo sapiens) CpG-island No: 25597
  misc_feature (4)..(4): n is either a, c, g or t
  misc_feature (19)..(19): n is either a, c, g or t
  misc_feature (38)..(38): n is either a, c, g or t
  misc_feature (113)..(113): n is either a, c, g or t
  misc_feature (121)..(121): n is either a, c, g or t
  misc_feature (436)..(436): n is either a, c, g or t
  misc_feature (521)..(521): n is either a, c, g or t
  misc_feature (547)..(547): n is either a, c, g or t
  misc_feature (558)..(558): n is either a, c, g or t
  misc_feature (575)..(575): n is either a, c, g or t
  misc_feature (603)..(603): n is either a, c, g or t
  misc_feature (628)..(628): n is either a, c, g or t
  misc_feature (652)..(652): n is either a, c, g or t
tttnttcgtttcgaggttngcggggacggggtcgaggntaatgaggggattagtagggggagcgcgggtcgtttcgagattcgtgttttatttcgtttcgattttcgattggngcgtttanagggtcggagagggacggagaggggagtcgcgcgcgggtttcggcgggggagttttaaagataaagaggaggtcgggtcgcgttgagagaggtcggcggcggagacgtagttcggtgcgggagttagagggcggtggagacggtatagggattggagaggcggtgggagtggatggcgggggcggggagggaacgtcgtgtgtcgggattttaaggatagcggcgcggtgtgcggggtttagtcgcgggtagagtcggagaaagggcgatttggagaggcgtaggtaggggggtgcgttcgggaggttcgaggtnttcgaggaggttcggttattttcgttcggagggaatacggtcggattaaacgtagacgtcgttcggttttcgggggcgggaggangcgtggtttcggcgggcgcgtagttnggagaggaagnggtcggggagggaggangggagagagggagggaagaacggggganggcggggaggaagagggaggaggangagttcgtttttaggtaagggganggtgattt

SEQ ID NO: 25598 - DNA, 660 bp, Artificial Sequence
  chemically treated genomic DNA (Homo sapiens) CpG-island No: 25598
  misc_feature (9)..(9): n is either a, c, g or t
  misc_feature (33)..(33): n is either a, c, g or t
  misc_feature (58)..(58): n is either a, c, g or t
  misc_feature (86)..(86): n is either a, c, g or t
  misc_feature (103)..(103): n is either a, c, g or t
  misc_feature (114)..(114): n is either a, c, g or t
  misc_feature (140)..(140): n is either a, c, g or t
  misc_feature (225)..(225): n is either a, c, g or t
  misc_feature (540)..(540): n is either a, c, g or t
  misc_feature (548)..(548): n is either a, c, g or t
  misc_feature (623)..(623): n is either a, c, g or t
  misc_feature (642)..(642): n is either a, c, g or t
  misc_feature (657)..(657): n is either a, c, g or t
aaatcaccntccccttacctaaaaacgaactcntcctcctccctcttcctccccgccntcccccgttcttccctccctctctcccntcctccctccccgaccncttcctctccnaactacgcgcccgccgaaaccacgcntcctcccgcccccgaaaaccgaacgacgtctacgtttaatccgaccgtattccctccgaacgaaaataaccgaacctcctcgaanacctcgaacctcccgaacgcacccccctacctacgcctctccaaatcgccctttctccgactctacccgcgactaaaccccgcacaccgcgccgctatccttaaaatcccgacacacgacgttccctccccgcccccgccatccactcccaccgcctctccaatccctataccgtctccaccgccctctaactcccgcaccgaactacgtctccgccgccgacctctctcaacgcgacccgacctcctctttatctttaaaactcccccgccgaaacccgcgcgcgactcccctctccgtccctctccgaccctntaaacgcnccaatcgaaaatcgaaacgaaataaaacacgaatctcgaaacgacccgcgctccccctactaatcccctcattancctcgaccccgtccccgcnaacctcgaaacgaanaaa

SEQ ID NO: 25599 - DNA, 660 bp, Artificial Sequence
  chemically treated genomic DNA (Homo sapiens) CpG-island No: 25599
  misc_feature (9)..(9): n is either a, c, g or t
  misc_feature (33)..(33): n is either a, c, g or t
  misc_feature (58)..(58): n is either a, c, g or t
  misc_feature (86)..(86): n is either a, c, g or t
  misc_feature (103)..(103): n is either a, c, g or t
  misc_feature (114)..(114): n is either a, c, g or t
  misc_feature (140)..(140): n is either a, c, g or t
  misc_feature (225)..(225): n is either a, c, g or t
  misc_feature (540)..(540): n is either a, c, g or t
  misc_feature (548)..(548): n is either a, c, g or t
  misc_feature (623)..(623): n is either a, c, g or t
  misc_feature (642)..(642): n is either a, c, g or t
  misc_feature (657)..(657): n is either a, c, g or t
ggattattntttttttgtttgagggcgagtttnttttttttttttttttttttcgttntttttcgttttttttttttttttttttntttttttttttcggttnttttttttttnagttgcgcgttcgtcgggattacgtnttttttcgttttcgggagtcgagcggcgtttgcgtttggttcggtcgtgtttttttcgggcgggggtggtcgggttttttcgggngtttcgggtttttcgggcgtatttttttgtttgcgtttttttaagtcgtttttttttcggttttgttcgcggttgagtttcgtatatcgcgtcgttgtttttggggtttcggtatacggcgtttttttttcgttttcgttatttatttttatcgtttttttagtttttgtgtcgtttttatcgttttttgattttcgtatcgagttgcgttttcgtcgtcggttttttttagcgcggttcggttttttttttgtttttgaagttttttcgtcgaggttcgcgcgcggttttttttttcgttttttttcggttttntgggcgtnttagtcggaggtcggggcgggatggggtacgagtttcggggcggttcgcgttttttttattagtttttttattgntttcggtttcgttttcgtnagtttcggggcgggnagg

SEQ ID NO: 25600 - DNA, 660 bp, Artificial Sequence
  chemically treated genomic DNA (Homo sapiens) CpG-island No: 25600
  misc_feature (4)..(4): n is either a, c, g or t
  misc_feature (19)..(19): n is either a, c, g or t
  misc_feature (38)..(38): n is either a, c, g or t
  misc_feature (113)..(113): n is either a, c, g or t
  misc_feature (121)..(121): n is either a, c, g or t
  misc_feature (436)..(436): n is either a, c, g or t
  misc_feature (521)..(521): n is either a, c, g or t
  misc_feature (547)..(547): n is either a, c, g or t
  misc_feature (558)..(558): n is either a, c, g or t
  misc_feature (575)..(575): n is either a, c, g or t
  misc_feature (603)..(603): n is either a, c, g or t
  misc_feature (628)..(628): n is either a, c, g or t
  misc_feature (652)..(652): n is either a, c, g or t
cctncccgccccgaaactnacgaaaacgaaaccgaaancaataaaaaaactaataaaaaaaacgcgaaccgccccgaaactcgtaccccatcccgccccgacctccgactaanacgcccanaaaaccgaaaaaaaacgaaaaaaaaaaccgcgcgcgaacctcgacgaaaaaacttcaaaaacaaaaaaaaaaccgaaccgcgctaaaaaaaaccgacgacgaaaacgcaactcgatacgaaaatcaaaaaacgataaaaacgacacaaaaactaaaaaaacgataaaaataaataacgaaaacgaaaaaaaaacgccgtataccgaaaccccaaaaacaacgacgcgatatacgaaactcaaccgcgaacaaaaccgaaaaaaaaacgacttaaaaaaacgcaaacaaaaaaatacgcccgaaaaacccgaaacncccgaaaaaacccgaccacccccgcccgaaaaaaacacgaccgaaccaaacgcaaacgccgctcgactcccgaaaacgaaaaaanacgtaatcccgacgaacgcgcaactnaaaaaaaaaanaaccgaaaaaaaaaaanaaaaaaaaaaaaaaaaaaaacgaaaaanaacgaaaaaaaaaaaaaaaaaaaanaaactcgccctcaaacaaaaaaanaataatcc

SEQ ID NO: 25601 - DNA, 500 bp, Artificial Sequence
  chemically treated genomic DNA (Homo sapiens) CpG-island No: 25601
gcgtcgtcgtcgtcgtcgtttttgtagcgttgtcgatttagtcgttagtattttttcgagtatcgggatttcggggtaggaggcgacgcgggcgagtattagcgttagtcggttgcggttgtttatacggtttattatgggtttcgggcgtcgggttttgttcgcggtgtcggtcgtgttgttggtttttacgttgtcggggttgttcgtttgggtatagaacgatacggagtttatcgtgttggagggtaagtgtttggtggtgtgcgattcgaattcggttacggattttaagggttttttttttttttcgttggggatatcggttcgggcggttaattttaaggtcgttttttcggcggtgcggagtattaattacgagttattcgagatgagtaataagacgcgtattatttatttcgattaggttagattcggggggaagcgagtatttagggggtgggcggtttttaggtattttagtacgaggttgtttgttt

SEQ ID NO: 25602 - DNA, 500 bp, Artificial Sequence
  chemically treated genomic DNA (Homo sapiens) CpG-island No: 25602
aaacaaacaacctcgtactaaaatacctaaaaaccgcccaccccctaaatactcgcttccccccgaatctaacctaatcgaaataaataatacgcgtcttattactcatctcgaataactcgtaattaatactccgcaccgccgaaaaaacgaccttaaaattaaccgcccgaaccgatatccccaacgaaaaaaaaaaaaaacccttaaaatccgtaaccgaattcgaatcgcacaccaccaaacacttaccctccaacacgataaactccgtatcgttctatacccaaacgaacaaccccgacaacgtaaaaaccaacaacacgaccgacaccgcgaacaaaacccgacgcccgaaacccataataaaccgtataaacaaccgcaaccgactaacgctaatactcgcccgcgtcgcctcctaccccgaaatcccgatactcgaaaaaatactaacgactaaatcgacaacgctacaaaaacgacgacgacgacgacgc

SEQ ID NO: 25603 - DNA, 500 bp, Artificial Sequence
  chemically treated genomic DNA (Homo sapiens) CpG-island No: 25603
gggtaggtagtttcgtgttgaggtgtttggagatcgtttattttttaggtgttcgttttttttcgggtttgatttgatcgaagtaaatgatgcgcgttttgttgtttatttcggatggttcgtggttggtgtttcgtatcgtcgagaaggcgattttggagttggtcgttcggatcgatatttttagcggggaggaagaggagtttttggagttcgtggtcgggttcgagtcgtatattattagatatttgttttttagtacgatgggtttcgtgtcgttttgtgtttagacgggtagtttcggtagcgtgaggattagtagtacggtcggtatcgcggataaggttcggcgttcggagtttatggtgagtcgtgtgggtagtcgtagtcggttggcgttggtgttcgttcgcgtcgttttttatttcgggatttcggtgttcgggaagatgttagcggttaggtcgatagcgttgtaggagcgacggcggcggcggcgt

SEQ ID NO: 25604 - DNA, 500 bp, Artificial Sequence
  chemically treated genomic DNA (Homo sapiens) CpG-island No: 25604
acgccgccgccgccgtcgctcctacaacgctatcgacctaaccgctaacatcttcccgaacaccgaaatcccgaaataaaaaacgacgcgaacgaacaccaacgccaaccgactacgactacccacacgactcaccataaactccgaacgccgaaccttatccgcgataccgaccgtactactaatcctcacgctaccgaaactacccgtctaaacacaaaacgacacgaaacccatcgtactaaaaaacaaatatctaataatatacgactcgaacccgaccacgaactccaaaaactcctcttcctccccgctaaaaatatcgatccgaacgaccaactccaaaatcgccttctcgacgatacgaaacaccaaccacgaaccatccgaaataaacaacaaaacgcgcatcatttacttcgatcaaatcaaacccgaaaaaaaacgaacacctaaaaaataaacgatctccaaacacctcaacacgaaactacctaccc

SEQ ID NO: 25605 - DNA, 653 bp, Artificial Sequence
  chemically treated genomic DNA (Homo sapiens) CpG-island No: 25605
cgttgcgacgcggttttcgtgcggtttttatcgaggttgttgttttttgtcgcgcgggttcggtttttttcgtcgatcgaggcgcgtttcgggcgtagtgtcgtcgaggaggggatcggttttagtgtttacgcgggttttttcgtcgtcgcggtagggttcggttcgattttagcgagtagatttttcgtttgcggtcggtgattcgcgcgacgtttcggcggtatcgataatgttgtgttttagtttcgtaggcgtcgcggtagcgggtttcgggatgttttcgcggtttttatttggcgaggttcgtttcgtgcgttttcggggttttggttgggtcggcgtcgagtttagggcgatcgcggatcgtcggttacggcgtttttcggtgacgggggcgcgggttcgcggggcgcggggggcgttgtttaggttcggttcggtaggagttagagtttttagcggcgcgggcgagttcgggttagtagtcgagagggggttttgagcggagtcgcggtcgttttggtattttaaaggcgaggtagttggacgttgtttaagcggaaacgtagagagaaattttagttttcggggtagagcgttggtagcgaggggagggggtttaagagttttttgtaggcgtataaattaat

SEQ ID NO: 25606 - DNA, 653 bp, Artificial Sequence
  chemically treated genomic DNA (Homo sapiens) CpG-island No: 25606
attaatttatacgcctacaaaaaactcttaaaccccctcccctcgctaccaacgctctaccccgaaaactaaaatttctctctacgtttccgcttaaacaacgtccaactacctcgcctttaaaataccaaaacgaccgcgactccgctcaaaaccccctctcgactactaacccgaactcgcccgcgccgctaaaaactctaactcctaccgaaccgaacctaaacaacgccccccgcgccccgcgaacccgcgcccccgtcaccgaaaaacgccgtaaccgacgatccgcgatcgccctaaactcgacgccgacccaaccaaaaccccgaaaacgcacgaaacgaacctcgccaaataaaaaccgcgaaaacatcccgaaacccgctaccgcgacgcctacgaaactaaaacacaacattatcgataccgccgaaacgtcgcgcgaatcaccgaccgcaaacgaaaaatctactcgctaaaatcgaaccgaaccctaccgcgacgacgaaaaaacccgcgtaaacactaaaaccgatcccctcctcgacgacactacgcccgaaacgcgcctcgatcgacgaaaaaaaccgaacccgcgcgacaaaaaacaacaacctcgataaaaaccgcacgaaaaccgcgtcgcaacg

SEQ ID NO: 25607 - DNA, 653 bp, Artificial Sequence
  chemically treated genomic DNA (Homo sapiens) CpG-island No: 25607
attggtttgtgcgtttgtaaggagtttttgggtttttttttttcgttgttaacgttttgtttcgggggttgaagtttttttttgcgttttcgtttgaatagcgtttagttgtttcgtttttaaaatgttaggacggtcgcggtttcgtttagagttttttttcggttgttggttcgggttcgttcgcgtcgttgggggttttgatttttgtcgagtcgggtttgggtagcgtttttcgcgtttcgcgagttcgcgttttcgttatcgggaaacgtcgtagtcggcgattcgcggtcgttttgggttcggcgtcggtttagttaggatttcgggagcgtacgggacgggtttcgttaggtaaggatcgcgggagtatttcgggattcgttgtcgcggcgtttgcggggttggagtatagtattgtcggtgtcgtcggggcgtcgcgcgggttatcggtcgtaggcggaggatttgttcgttgaagtcgggtcgagttttgtcgcggcggcgaggagattcgcgtggatattgggatcgatttttttttcggcggtattgcgttcggggcgcgtttcggtcggcggggagggtcggattcgcgcggtaggggatagtagtttcggtgggagtcgtacgggagtcgcgtcgtagcg

SEQ ID NO: 25608 - DNA, 653 bp, Artificial Sequence
  chemically treated genomic DNA (Homo sapiens) CpG-island No: 25608
cgctacgacgcgactcccgtacgactcccaccgaaactactatcccctaccgcgcgaatccgaccctccccgccgaccgaaacgcgccccgaacgcaataccgccgaaaaaaaaatcgatcccaatatccacgcgaatctcctcgccgccgcgacaaaactcgacccgacttcaacgaacaaatcctccgcctacgaccgataacccgcgcgacgccccgacgacaccgacaatactatactccaaccccgcaaacgccgcgacaacgaatcccgaaatactcccgcgatccttacctaacgaaacccgtcccgtacgctcccgaaatcctaactaaaccgacgccgaacccaaaacgaccgcgaatcgccgactacgacgtttcccgataacgaaaacgcgaactcgcgaaacgcgaaaaacgctacccaaacccgactcgacaaaaatcaaaacccccaacgacgcgaacgaacccgaaccaacaaccgaaaaaaaactctaaacgaaaccgcgaccgtcctaacattttaaaaacgaaacaactaaacgctattcaaacgaaaacgcaaaaaaaaacttcaacccccgaaacaaaacgttaacaacgaaaaaaaaaaacccaaaaactccttacaaacgcacaaaccaat

SEQ ID NO: 25609 - DNA, 812 bp, Artificial Sequence
  chemically treated genomic DNA (Homo sapiens) CpG-island No: 25609
tcggttcgacgttgagattttggggtgagtgtgtgtaggggtcgcggttttattttcgggtgttcgagtacgtcgggtttagaaggtttttttgtcggagagaagtagtatgcgtatttgttgttcgttaaagagtttaggaggggttttttattggcggttttaggtttcgcgcgggcgttttcggggtacggaaatggtgtcggatgatgtgcgtgttatcgtgggggaaggttcggcgtttttagttttgagtattcgcggaggcgagttttcgaggtcgttgcgttcgtagtcgttttttcgtttttagttttcggggtagtattttttcgttggtttgtcgcggttgcgtttcgtttttattttcgggtcggtttaatataattttgcggcggtttcgcgggggcggggtttgagcgcggacggtaaggggtgggggaacgaggtggtcgaggtggtggcggttttttagttttttagttttttaacgggcgcgtattaggcggaggttatattgtagcgcggcggtaaagtcgttggcgtaggttgtttgttttgggtcggtcggtttcgttttttttttttcgttaatggggagcgcgcgcgtcgttgtgggtttgcgcgtgtttgtgagtgtgcgtgtgtgcgcgcgcggggtcgtttcgttagtcggttttttcgtttaggtgtgggttttagtttcgggtagttcgcgagggttttttgcgttttggagttcggggacgtagtttaggcgagtgcgtttggttggggggatacgttatagtttttttagggggatatttgaa

SEQ ID NO: 25610 - DNA, 812 bp, Artificial Sequence
  chemically treated genomic DNA (Homo sapiens) CpG-island No: 25610
ttcaaatatccccctaaaaaaactataacgtatccccccaaccaaacgcactcgcctaaactacgtccccgaactccaaaacgcaaaaaaccctcgcgaactacccgaaactaaaacccacacctaaacgaaaaaaccgactaacgaaacgaccccgcgcgcgcacacacgcacactcacaaacacgcgcaaacccacaacgacgcgcgcgctccccattaacgaaaaaaaaaaaacgaaaccgaccgacccaaaacaaacaacctacgccaacgactttaccgccgcgctacaatataacctccgcctaatacgcgcccgttaaaaaactaaaaaactaaaaaaccgccaccacctcgaccacctcgttcccccaccccttaccgtccgcgctcaaaccccgcccccgcgaaaccgccgcaaaattatattaaaccgacccgaaaataaaaacgaaacgcaaccgcgacaaaccaacgaaaaaatactaccccgaaaactaaaaacgaaaaaacgactacgaacgcaacgacctcgaaaactcgcctccgcgaatactcaaaactaaaaacgccgaaccttcccccacgataacacgcacatcatccgacaccatttccgtaccccgaaaacgcccgcgcgaaacctaaaaccgccaataaaaaacccctcctaaactctttaacgaacaacaaatacgcatactacttctctccgacaaaaaaaccttctaaacccgacgtactcgaacacccgaaaataaaaccgcgacccctacacacactcaccccaaaatctcaacgtcgaaccga

SEQ ID NO: 25611 - DNA, 812 bp, Artificial Sequence
  chemically treated genomic DNA (Homo sapiens) CpG-island No: 25611
tttaggtgtttttttaggggaattgtggcgtgtttttttaattaggcgtattcgtttaaattgcgttttcgaattttagggcgtagggagttttcgcgggttgttcggggttggggtttatatttgaacggaggagtcggttggcggagcggtttcgcgcgcgtatatacgtatatttatagatacgcgtaaatttatagcggcgcgcgcgttttttattggcgggaggaggaaggcggggtcggtcgatttaaaataaataatttgcgttagcgattttgtcgtcgcgttgtagtgtggttttcgtttggtgcgcgttcgttggggagttggggaattggggagtcgttattatttcggttatttcgtttttttattttttgtcgttcgcgtttaggtttcgttttcgcggagtcgtcgtagggttatattgggtcggttcgaaggtggaggcgagacgtagtcgcggtaggttagcggggagatgttgtttcggaggttgggagcgggaaggcggttgcgggcgtagcggtttcggggattcgttttcgcgggtgtttaaggttgaaggcgtcggatttttttttacggtggtacgtatattattcggtattattttcgtgtttcgaagacgttcgcgcgggatttgggatcgttagtgaagaattttttttgggttttttaacgagtagtagatgcgtatgttgttttttttcggtaggaaagttttttaagttcggcgtgttcgggtattcgagggtggaatcgcggtttttgtatatatttattttaaagttttaacgtcgaatcga

SEQ ID NO: 25612 - DNA, 812 bp, Artificial Sequence
  chemically treated genomic DNA (Homo sapiens) CpG-island No: 25612
tcgattcgacgttaaaactttaaaataaatatatacaaaaaccgcgattccaccctcgaatacccgaacacgccgaacttaaaaaactttcctaccgaaaaaaaacaacatacgcatctactactcgttaaaaaacccaaaaaaaattcttcactaacgatcccaaatcccgcgcgaacgtcttcgaaacacgaaaataataccgaataatatacgtaccaccgtaaaaaaaaatccgacgccttcaaccttaaacacccgcgaaaacgaatccccgaaaccgctacgcccgcaaccgccttcccgctcccaacctccgaaacaacatctccccgctaacctaccgcgactacgtctcgcctccaccttcgaaccgacccaatataaccctacgacgactccgcgaaaacgaaacctaaacgcgaacgacaaaaaataaaaaaacgaaataaccgaaataataacgactccccaattccccaactccccaacgaacgcgcaccaaacgaaaaccacactacaacgcgacgacaaaatcgctaacgcaaattatttattttaaatcgaccgaccccgccttcctcctcccgccaataaaaaacgcgcgcgccgctataaatttacgcgtatctataaatatacgtatatacgcgcgcgaaaccgctccgccaaccgactcctccgttcaaatataaaccccaaccccgaacaacccgcgaaaactccctacgccctaaaattcgaaaacgcaatttaaacgaatacgcctaattaaaaaaacacgccacaattcccctaaaaaaacacctaaa

SEQ ID NO: 25613 - DNA, 658 bp, Artificial Sequence
  chemically treated genomic DNA (Homo sapiens) CpG-island No: 25613
tttttcgacggcgcgtattcggcgttttcgggtttcgcggcgttatttaggttaggagcgtttttatcgggtacggtaggtgcgggttagggcggcggattgaggtcgtttgtagggttgcgggtagtcgtagggggtagtataggtgcgcgtcgtcggtcgtcgggtttcggagtggtttggcgggggtcgtcgtcgggagaggtgtaagtaggaggggcggcgcggtcggtggtatttcggtttcgcgcgcgtttagtcgcgtcggttcgttcgcgtcgtacgcgtagagcggtagtagggttttgtagggcgtcgcggggaggagcgcggggaacgcgggtagcggcgggtagggcgcggcgttttattgaagcgtcgtttcgggggtcgtgtttttgaggcggcggttgcggaagggtttgcgtaggatgttgtcgatggcgaaggagttggagaatttgttcgcggggttggcgcgttttttttggcgggcgggcgagcgtatgcggggcgaggtcggggcggcgggcgcgggcggcggggcggcggggaggttcggggttttttcgggtcgtagttcgggcgcggggatcggcgcgcggtggttgaggcgtttgcggcggcggcggaagatttcgtcggcgaaggtgtattt

SEQ ID NO: 25614 - DNA, 658 bp, Artificial Sequence
  chemically treated genomic DNA (Homo sapiens) CpG-island No: 25614
aaatacaccttcgccgacgaaatcttccgccgccgccgcaaacgcctcaaccaccgcgcgccgatccccgcgcccgaactacgacccgaaaaaaccccgaacctccccgccgccccgccgcccgcgcccgccgccccgacctcgccccgcatacgctcgcccgcccgccaaaaaaaacgcgccaaccccgcgaacaaattctccaactccttcgccatcgacaacatcctacgcaaacccttccgcaaccgccgcctcaaaaacacgacccccgaaacgacgcttcaataaaacgccgcgccctacccgccgctacccgcgttccccgcgctcctccccgcgacgccctacaaaaccctactaccgctctacgcgtacgacgcgaacgaaccgacgcgactaaacgcgcgcgaaaccgaaataccaccgaccgcgccgcccctcctacttacacctctcccgacgacgacccccgccaaaccactccgaaacccgacgaccgacgacgcgcacctatactaccccctacgactacccgcaaccctacaaacgacctcaatccgccgccctaacccgcacctaccgtacccgataaaaacgctcctaacctaaataacgccgcgaaacccgaaaacgccgaatacgcgccgtcgaaaaa

SEQ ID NO: 25615 - DNA, 658 bp, Artificial Sequence
  chemically treated genomic DNA (Homo sapiens) CpG-island No: 25615
gagtatattttcgtcgacggggtttttcgtcgtcgtcgtaagcgttttagttatcgcgcgtcggttttcgcgttcgggttgcggttcgaggaggtttcgggttttttcgtcgtttcgtcgttcgcgttcgtcgtttcggtttcgtttcgtatgcgttcgttcgttcgttaggaggagcgcgttagtttcgcgggtaagttttttagttttttcgttatcgatagtattttgcgtaagttttttcgtagtcgtcgttttagggatacggttttcgggacgacgttttagtggggcgtcgcgttttgttcgtcgttgttcgcgtttttcgcgttttttttcgcggcgttttgtagggttttgttgtcgttttgcgcgtacggcgcgggcgagtcggcgcggttgggcgcgcgcgaggtcgaggtgttatcgatcgcgtcgttttttttgtttgtatttttttcggcggcggttttcgttaagttatttcgaggttcggcggtcggcggcgcgtatttgtattgttttttgcggttgttcgtagttttgtaggcggttttagttcgtcgttttggttcgtatttgtcgtattcggtggagacgtttttagtttgagtagcgtcgcggggttcgggaacgtcgagtgcgcgtcgtcggggag

SEQ ID NO: 25616 - DNA, 658 bp, Artificial Sequence
  chemically treated genomic DNA (Homo sapiens) CpG-island No: 25616
ctccccgacgacgcgcactcgacgttcccgaaccccgcgacgctactcaaactaaaaacgtctccaccgaatacgacaaatacgaaccaaaacgacgaactaaaaccgcctacaaaactacgaacaaccgcaaaaaacaatacaaatacgcgccgccgaccgccgaacctcgaaataacttaacgaaaaccgccgccgaaaaaaatacaaacaaaaaaaacgacgcgatcgataacacctcgacctcgcgcgcgcccaaccgcgccgactcgcccgcgccgtacgcgcaaaacgacaacaaaaccctacaaaacgccgcgaaaaaaaacgcgaaaaacgcgaacaacgacgaacaaaacgcgacgccccactaaaacgtcgtcccgaaaaccgtatccctaaaacgacgactacgaaaaaacttacgcaaaatactatcgataacgaaaaaactaaaaaacttacccgcgaaactaacgcgctcctcctaacgaacgaacgaacgcatacgaaacgaaaccgaaacgacgaacgcgaacgacgaaacgacgaaaaaacccgaaacctcctcgaaccgcaacccgaacgcgaaaaccgacgcgcgataactaaaacgcttacgacgacgacgaaaaaccccgtcgacgaaaatatactc

SEQ ID NO: 25617 - DNA, 559 bp, Artificial Sequence
  chemically treated genomic DNA (Homo sapiens) CpG-island No: 25617
ttttcgcggtgcgtcggagtttagagttcgggttttagtattttgttcgttgcgtcgagggcgcgtttttttcgtgtcgggacgttcggtgtattttcggacggcgttggttaggttgggttttttttttagggatatcggcgcgggtcgggttcgtttttaagtttttcggcggttcgtaggggttattcggggcggggggggtgcggggcgtgtacgtgcgcgtcgggggcggggtcgttgcgttttttgggtagtttttagtttttagtcgcggttttacgtgggtttgcgggcgtggagcggcgatcggcgcgaggtttcgttttcgagttcgggagttaatgagcgtacgggggcgggatcggggcggggaggtttaagagcgcgggatattggtgttgcgttgttggattgcgtcgtcggagcgacgggtttcgggtcggtgtaaggtaggcgtacggggaagggcgcgtcgcgcggtcgttattttattatgtttaagcgttgcggtcggcgtttgttgttggcgttggcgggcgcgttgttcgtttgtttg

SEQ ID NO: 25618 - DNA, 559 bp, Artificial Sequence
  chemically treated genomic DNA (Homo sapiens) CpG-island No: 25618
caaacaaacgaacaacgcgcccgccaacgccaacaacaaacgccgaccgcaacgcttaaacataataaaataacgaccgcgcgacgcgcccttccccgtacgcctaccttacaccgacccgaaacccgtcgctccgacgacgcaatccaacaacgcaacaccaatatcccgcgctcttaaacctccccgccccgatcccgcccccgtacgctcattaactcccgaactcgaaaacgaaacctcgcgccgatcgccgctccacgcccgcaaacccacgtaaaaccgcgactaaaaactaaaaactacccaaaaaacgcaacgaccccgcccccgacgcgcacgtacacgccccgcaccccccccgccccgaataacccctacgaaccgccgaaaaacttaaaaacgaacccgacccgcgccgatatccctaaaaaaaaaacccaacctaaccaacgccgtccgaaaatacaccgaacgtcccgacacgaaaaaaacgcgccctcgacgcaacgaacaaaatactaaaacccgaactctaaactccgacgcaccgcgaaaa

SEQ ID NO: 25619 - DNA, 559 bp, Artificial Sequence
  chemically treated genomic DNA (Homo sapiens) CpG-island No: 25619
taggtaggcgagtagcgcgttcgttagcgttagtagtaggcgtcggtcgtagcgtttgagtatggtggggtggcggtcgcgcggcgcgttttttttcgtgcgtttgttttgtatcgattcgaagttcgtcgtttcggcggcgtagtttagtagcgtagtattagtgtttcgcgtttttaaattttttcgtttcggtttcgttttcgtgcgtttattggttttcgggttcgggggcggggtttcgcgtcggtcgtcgttttacgttcgtagatttacgtggggtcgcggttgggggttgggaattgtttagagggcgtagcggtttcgttttcggcgcgtacgtgtacgtttcgtatttttttcgtttcgggtagtttttgcgggtcgtcgaggggtttggggacgggttcggttcgcgtcggtgtttttgaagaggaaatttagtttggttagcgtcgttcggggatgtatcgggcgtttcggtacgggaggggcgcgttttcggcgtagcgggtagggtgttgagattcgggttttgggtttcgacgtatcgcggggg

SEQ ID NO: 25620 - DNA, 559 bp, Artificial Sequence
  chemically treated genomic DNA (Homo sapiens) CpG-island No: 25620
cccccgcgatacgtcgaaacccaaaacccgaatctcaacaccctacccgctacgccgaaaacgcgcccctcccgtaccgaaacgcccgatacatccccgaacgacgctaaccaaactaaatttcctcttcaaaaacaccgacgcgaaccgaacccgtccccaaacccctcgacgacccgcaaaaactacccgaaacgaaaaaaatacgaaacgtacacgtacgcgccgaaaacgaaaccgctacgccctctaaacaattcccaacccccaaccgcgaccccacgtaaatctacgaacgtaaaacgacgaccgacgcgaaaccccgcccccgaacccgaaaaccaataaacgcacgaaaacgaaaccgaaacgaaaaaatttaaaaacgcgaaacactaatactacgctactaaactacgccgccgaaacgacgaacttcgaatcgatacaaaacaaacgcacgaaaaaaaacgcgccgcgcgaccgccaccccaccatactcaaacgctacgaccgacgcctactactaacgctaacgaacgcgctactcgcctaccta

SEQ ID NO: 25621 - DNA, 1099 bp, Artificial Sequence
  chemically treated genomic DNA (Homo sapiens) CpG-island No: 25621
ggttttttttgttgttttttttttttaggcgtcggagtttcgtttttattaggtttacgtcgtttttttgtacgtgtaatgattgaagaaaataagggttatgtatagttatttatacgaagttgcgtatacgtcgtatatacgttttcgcgtatatagttacgtatacgttaatgcgggtacgtcgtatatacgtttttacgcgtatagttacgtatacgttattgcgcgtacgtcgtatatacgttttcgcgtatatagttacgtatacgttaatgcgtatacgtcgtatatacgttttcgcgcgtatagttaagtatacgttaatgcgtatacgtcgtacgtacgttttcgcgcgtatagttaagtatacgttaatgcgtatacgtcgtacgtacgttttcgcgcgtatagttacgtatacgttattgcgggtacgcgtacgtacgttttcgcgcgtatagttacgtatacgatattgcgggtacgcgtacgtacgttttcgcgcgtatagttacgtatacgttaatgcgcgtacgtcgtacgtacgttttcgcgcgtatagttacgtatacgttaatgcgcgtacgtcgtatataggttttcgcgcgtatagttacgtatacgttaatgcgtatacgtcgtatataggttttcgcgcgtatagttacgtatacgttaatgcgtatacgtcgtatatacgttttcgcgcgtatagttacgtatacgttaatcgggtacgtcgtatatacgttttcgtacgtatagttacgtatacgttaatcggtatacgtcgtatatacgttttcgcgcgtatagttaagtatacgttaatgcgtgtacgtcgtatatacgttttcgcgcgtatagttatgtatacgttaatgcgcgtacgtcgtatatacgttttcgtatatatagttacgtatacgttaatgtgtatatgtcgtatatatatttttacgggtatagttaagtatacgttattgcgtatatatcgtatatacgtttttacgtatatagttatgtatatattattgtatatatattatatatagttacgtatattatatcgcgtataggtttagggaagtattga

SEQ ID NO: 25622 - DNA, 1099 bp, Artificial Sequence
  chemically treated genomic DNA (Homo sapiens) CpG-island No: 25622
tcaatacttccctaaacctatacgcgatataatatacgtaactatatataatatatatacaataatatatacataactatatacgtaaaaacgtatatacgatatatacgcaataacgtatacttaactatacccgtaaaaatatatatacgacatatacacattaacgtatacgtaactatatatacgaaaacgtatatacgacgtacgcgcattaacgtatacataactatacgcgcgaaaacgtatatacgacgtacacgcattaacgtatacttaactatacgcgcgaaaacgtatatacgacgtataccgattaacgtatacgtaactatacgtacgaaaacgtatatacgacgtacccgattaacgtatacgtaactatacgcgcgaaaacgtatatacgacgtatacgcattaacgtatacgtaactatacgcgcgaaaacctatatacgacgtatacgcattaacgtatacgtaactatacgcgcgaaaacctatatacgacgtacgcgcattaacgtatacgtaactatacgcgcgaaaacgtacgtacgacgtacgcgcattaacgtatacgtaactatacgcgcgaaaacgtacgtacgcgtacccgcaatatcgtatacgtaactatacgcgcgaaaacgtacgtacgcgtacccgcaataacgtatacgtaactatacgcgcgaaaacgtacgtacgacgtatacgcattaacgtatacttaactatacgcgcgaaaacgtacgtacgacgtatacgcattaacgtatacttaactatacgcgcgaaaacgtatatacgacgtatacgcattaacgtatacgtaactatatacgcgaaaacgtatatacgacgtacgcgcaataacgtatacgtaactatacgcgtaaaaacgtatatacgacgtacccgcattaacgtatacgtaactatatacgcgaaaacgtatatacgacgtatacgcaacttcgtataaataactatacataacccttattttcttcaatcattacacgtacaaaaaaacgacgtaaacctaataaaaacgaaactccgacgcctaaaaaaaaaaaacaacaaaaaaaacc

SEQ ID NO: 25623 - DNA, 1099 bp, Artificial Sequence
  chemically treated genomic DNA (Homo sapiens) CpG-island No: 25623
ttagtgtttttttgggtttgtgcgcggtgtggtgtgcgtggttgtgtgtggtgtgtgtgtagtggtgtgtgtatggttgtgtacgtggggacgtgtgtgcggtgtgtgcgtagtggcgtgtgtttggttgtgttcgtggggatgtgtgtgcggtatatatatattggcgtgtgcgtggttgtgtgtgcggggacgtgtgtgcggcgtgcgcgtattggcgtgtgtatggttgtgcgcgcggggacgtgtgtgcggcgtgtacgtattggcgtgtatttggttgtgcgcgcggggacgtgtgtgcggcgtatatcgattggcgtgtgcgtggttgtgcgtgcggggacgtgtgtgcggcgtgttcgattggcgtgtgcgtggttgtgcgcgcggggacgtgtgtgcggcgtatacgtattggcgtgtgcgtggttgtgcgcgcggggatttgtgtgcggcgtatacgtattggcgtgtgcgtggttgtgcgcgcggggatttgtgtgcggcgtgcgcgtattggcgtgtgcgtggttgtgcgcgcggggacgtgcgtgcggcgtgcgcgtattggcgtgtgcgtggttgtgcgcgcggggacgtgcgtgcgcgtgttcgtagtgtcgtgtgcgtggttgtgcgcgcggggacgtgcgtgcgcgtgttcgtagtggcgtgtgcgtggttgtgcgcgcggggacgtgcgtgcggcgtgtgcgtattggcgtgtatttggttgtgcgcgcggggacgtgcgtgcggcgtgtgcgtattggcgtgtatttggttgtgcgcgcggggacgtgtgtgcggcgtgtgcgtattggcgtgtgcgtggttgtgtgcgcggggacgtgtgtgcggcgtgcgcgtagtggcgtgtgcgtggttgtgcgcgtggggacgtgtgtgcggcgtgttcgtattggcgtgtgcgtggttgtgtgcgcggggacgtgtgtgcggcgtgtgcgtagtttcgtgtggatggttgtgtatggtttttgttttttttagttattgtacgtgtagaagagcgacgtggatttgatgagaacgaagtttcggcgtttggaggaggaaaatagtaggaaggatt

SEQ ID NO: 25624 - DNA, 1099 bp, Artificial Sequence
  chemically treated genomic DNA (Homo sapiens) CpG-island No: 25624
aatccttcctactattttcctcctccaaacgccgaaacttcgttctcatcaaatccacgtcgctcttctacacgtacaataactaaaaaaaacaaaaaccatacacaaccatccacacgaaactacgcacacgccgcacacacgtccccgcgcacacaaccacgcacacgccaatacgaacacgccgcacacacgtccccacgcgcacaaccacgcacacgccactacgcgcacgccgcacacacgtccccgcgcacacaaccacgcacacgccaatacgcacacgccgcacacacgtccccgcgcgcacaaccaaatacacgccaatacgcacacgccgcacgcacgtccccgcgcgcacaaccaaatacacgccaatacgcacacgccgcacgcacgtccccgcgcgcacaaccacgcacacgccactacgaacacgcgcacgcacgtccccgcgcgcacaaccacgcacacgacactacgaacacgcgcacgcacgtccccgcgcgcacaaccacgcacacgccaatacgcgcacgccgcacgcacgtccccgcgcgcacaaccacgcacacgccaatacgcgcacgccgcacacaaatccccgcgcgcacaaccacgcacacgccaatacgtatacgccgcacacaaatccccgcgcgcacaaccacgcacacgccaatacgtatacgccgcacacacgtccccgcgcgcacaaccacgcacacgccaatcgaacacgccgcacacacgtccccgcacgcacaaccacgcacacgccaatcgatatacgccgcacacacgtccccgcgcgcacaaccaaatacacgccaatacgtacacgccgcacacacgtccccgcgcgcacaaccatacacacgccaatacgcgcacgccgcacacacgtccccgcacacacaaccacgcacacgccaatatatatataccgcacacacatccccacgaacacaaccaaacacacgccactacgcacacaccgcacacacgtccccacgtacacaaccatacacacaccactacacacacaccacacacaaccacgcacaccacaccgcgcacaaacccaaaaaaacactaa

SEQ ID NO: 25625 - DNA, 649 bp, Artificial Sequence
  chemically treated genomic DNA (Homo sapiens) CpG-island No: 25625
gtttcgttatttgcgggtcgtagattcgtaggcgtttagaggcgagggcgcggcgtttcggagagttttttggaagcggcggtttttgcgaaagcgggcgcgggcgaggttgtaggcggcgcggggtttgtagcgcgtttttgtgcggtaataataatggtagttgttattcggtcgtgcgtttcgtttttacgtttcgggtcggtttttgcgcggggtttcgaggttgcgggcgacggagacgagtcgaggtttcgcggacgttcgttcggcgtcgttttttcgttcgtttttatcgtgtttaaggtcggtttttcggtgtttaggaatatggtggcggcgttgttcggtcgttttttagggttgttggttcgggcgttcgggtttgggaattcgcgggtagttttggtcgttcgtagtttcggggttttttttggcgtcggttcgcgatttcgttgttatggtaattaggtcgtcgatttatttagtcgggtaagcgatttgcgttttttttggggcgattatgcgcgtgcgtagagttcgcgggcgtcggtcggtcgattaggagcgttttcggagttttcggggcggagcgcgggggttgagagggggaaaaaaatcggttcggcgtagtggttcgcgtttgtaa

SEQ ID NO: 25626 - DNA, 649 bp, Artificial Sequence
  chemically treated genomic DNA (Homo sapiens) CpG-island No: 25626
ttacaaacgcgaaccactacgccgaaccgatttttttccccctctcaacccccgcgctccgccccgaaaactccgaaaacgctcctaatcgaccgaccgacgcccgcgaactctacgcacgcgcataatcgccccaaaaaaaacgcaaatcgcttacccgactaaataaatcgacgacctaattaccataacaacgaaatcgcgaaccgacgccaaaaaaaaccccgaaactacgaacgaccaaaactacccgcgaattcccaaacccgaacgcccgaaccaacaaccctaaaaaacgaccgaacaacgccgccaccatattcctaaacaccgaaaaaccgaccttaaacacgataaaaacgaacgaaaaaacgacgccgaacgaacgtccgcgaaacctcgactcgtctccgtcgcccgcaacctcgaaaccccgcgcaaaaaccgacccgaaacgtaaaaacgaaacgcacgaccgaataacaactaccattattattaccgcacaaaaacgcgctacaaaccccgcgccgcctacaacctcgcccgcgcccgctttcgcaaaaaccgccgcttccaaaaaactctccgaaacgccgcgccctcgcctctaaacgcctacgaatctacgacccgcaaataacgaaac

SEQ ID NO: 25627 - DNA, 649 bp, Artificial Sequence
  chemically treated genomic DNA (Homo sapiens) CpG-island No: 25627
ttatagacgcgagttattgcgtcgggtcggttttttttttttttttagttttcgcgtttcgtttcgggaatttcgggagcgtttttggtcggtcggtcggcgttcgcggattttgcgtacgcgtatggtcgttttagggggaacgtaggtcgtttattcggttgggtaggtcggcggtttggttgttatggtagcggggtcgcgggtcggcgttagggaaggtttcgaggttgcgggcggttagggttgttcgcggatttttagattcggacgttcgagttagtaattttgaggggcggtcgggtagcgtcgttattatgtttttgggtatcggggagtcggttttggatacggtaagaacgggcgagggggcgacgtcgggcgggcgttcgcgaggtttcggttcgttttcgtcgttcgtagtttcggggtttcgcgtaggggtcggttcggggcgtgaggacggggcgtacggtcgggtgatagttgttattattgttatcgtataagagcgcgttgtaggtttcgcgtcgtttgtagtttcgttcgcgttcgttttcgtagaggtcgtcgtttttaggaagtttttcgggacgtcgcgttttcgtttttgggcgtttgcgagtttgcggttcgtaggtgacggagt

SEQ ID NO: 25628 - DNA, 649 bp, Artificial Sequence
  chemically treated genomic DNA (Homo sapiens) CpG-island No: 25628
actccgtcacctacgaaccgcaaactcgcaaacgcccaaaaacgaaaacgcgacgtcccgaaaaacttcctaaaaacgacgacctctacgaaaacgaacgcgaacgaaactacaaacgacgcgaaacctacaacgcgctcttatacgataacaataataacaactatcacccgaccgtacgccccgtcctcacgccccgaaccgacccctacgcgaaaccccgaaactacgaacgacgaaaacgaaccgaaacctcgcgaacgcccgcccgacgtcgccccctcgcccgttcttaccgtatccaaaaccgactccccgatacccaaaaacataataacgacgctacccgaccgcccctcaaaattactaactcgaacgtccgaatctaaaaatccgcgaacaaccctaaccgcccgcaacctcgaaaccttccctaacgccgacccgcgaccccgctaccataacaaccaaaccgccgacctacccaaccgaataaacgacctacgttccccctaaaacgaccatacgcgtacgcaaaatccgcgaacgccgaccgaccgaccaaaaacgctcccgaaattcccgaaacgaaacgcgaaaactaaaaaaaaaaaaaaaaccgacccgacgcaataactcgcgtctataa

SEQ ID NO: 25629 - DNA, 653 bp, Artificial Sequence
  chemically treated genomic DNA (Homo sapiens) CpG-island No: 25629
cgagcgagttaggtaaagttcggtttttttgaagtttttcgtagcggcgggggcggagaagagattttagtttcgcgggttcgtatagttggcgcggattacgttttcgttcgggcggcggttttagcgtttttcgaatgaatatttttcgttcgttggtcgtttcgaggcgggtcgtgtcgtggtttcggtgtacggagggggacgtcgaggttcggagtagggttcgtttcggtttgtgttcggagttaggcgtagggtcgcgggcgcggcggcgcggagacggttgcgttttcgtttttcgttagcgtttggcgtcgttttacgtgacgggaagcggcggttgcggggtcgggttagtttaggagtcgcgggtcggagcggggcgcggtggtttaggcgcggtggcgtttgggacggcgggcgcgcgcggtggagtgaggagggcggcggggtcggggtgcggggtttagggcgcggggcgtgggggtaggagggcggggagtaggagtggggggtaggcggcggggcggggtggagggcgagttcgtgcgtgtgcgttggggtaggtgtagtgggggttggaacgcggggtggggggagtaagtggttatatatttgggggtaggtgtgcgggtgtgcgatttggtagt

SEQ ID NO: 25630 - DNA, 653 bp, Artificial Sequence
  chemically treated genomic DNA (Homo sapiens) CpG-island No: 25630
actaccaaatcgcacacccgcacacctacccccaaatatataaccacttactccccccaccccgcgttccaacccccactacacctaccccaacgcacacgcacgaactcgccctccaccccgccccgccgcctaccccccactcctactccccgccctcctacccccacgccccgcgccctaaaccccgcaccccgaccccgccgccctcctcactccaccgcgcgcgcccgccgtcccaaacgccaccgcgcctaaaccaccgcgccccgctccgacccgcgactcctaaactaacccgaccccgcaaccgccgcttcccgtcacgtaaaacgacgccaaacgctaacgaaaaacgaaaacgcaaccgtctccgcgccgccgcgcccgcgaccctacgcctaactccgaacacaaaccgaaacgaaccctactccgaacctcgacgtccccctccgtacaccgaaaccacgacacgacccgcctcgaaacgaccaacgaacgaaaaatattcattcgaaaaacgctaaaaccgccgcccgaacgaaaacgtaatccgcgccaactatacgaacccgcgaaactaaaatctcttctccgcccccgccgctacgaaaaacttcaaaaaaaccgaactttacctaactcgctcg

SEQ ID NO: 25631 - DNA, 653 bp, Artificial Sequence
  chemically treated genomic DNA (Homo sapiens) CpG-island No: 25631
gttattaagtcgtatattcgtatatttgtttttaagtgtatagttatttgttttttttatttcgcgttttagtttttattatatttgttttagcgtatacgtacgggttcgttttttatttcgtttcgtcgtttattttttatttttgtttttcgtttttttgtttttacgtttcgcgttttgagtttcgtatttcggtttcgtcgttttttttattttatcgcgcgcgttcgtcgttttagacgttatcgcgtttgggttatcgcgtttcgtttcggttcgcggtttttgggttggttcgatttcgtagtcgtcgtttttcgttacgtggggcggcgttaggcgttggcggagggcgggagcgtagtcgttttcgcgtcgtcgcgttcgcggttttgcgtttggtttcgagtataggtcgagacgggttttgtttcgggtttcggcgttttttttcgtgtatcggggttacgatacggttcgtttcggggcggttagcgggcggaaggtgtttattcggggggcgttgaggtcgtcgttcgggcgagagcgtggttcgcgttagttgtgcgagttcgcggggttgaggtttttttttcgttttcgtcgttgcggggagttttagggaagtcgggttttgtttggttcgttcg

SEQ ID NO: 25632 - DNA, 653 bp, Artificial Sequence
  chemically treated genomic DNA (Homo sapiens) CpG-island No: 25632
cgaacgaaccaaacaaaacccgacttccctaaaactccccgcaacgacgaaaacgaaaaaaaaacctcaaccccgcgaactcgcacaactaacgcgaaccacgctctcgcccgaacgacgacctcaacgccccccgaataaacaccttccgcccgctaaccgccccgaaacgaaccgtatcgtaaccccgatacacgaaaaaaaacgccgaaacccgaaacaaaacccgtctcgacctatactcgaaaccaaacgcaaaaccgcgaacgcgacgacgcgaaaacgactacgctcccgccctccgccaacgcctaacgccgccccacgtaacgaaaaacgacgactacgaaatcgaaccaacccaaaaaccgcgaaccgaaacgaaacgcgataacccaaacgcgataacgtctaaaacgacgaacgcgcgcgataaaataaaaaaaacgacgaaaccgaaatacgaaactcaaaacgcgaaacgtaaaaacaaaaaaacgaaaaacaaaaataaaaaataaacgacgaaacgaaataaaaaacgaacccgtacgtatacgctaaaacaaatataataaaaactaaaacgcgaaataaaaaaaacaaataactatacacttaaaaacaaatatacgaatatacgacttaataac

SEQ ID NO: 25633 - DNA, 785 bp, Artificial Sequence
  chemically treated genomic DNA (Homo sapiens) CpG-island No: 25633
agatttacgcggcgaaggcgcgggtggatgtcgtatagtttttttttgtttgggaatttattttcgcggatttgtagttttttcggtagtaatttttaaatagtttcgcgcgttttcgagtttttttcgtatcgtcgtagtacgggcgtcggcggtcgtttcggcgggtatagcgtggatatttattttggaagcggtggtcgaagaagcggtttcgtagatttaggggtagaaatggagagggtttcggtgttgggcgtcgaagaaggagtgcgggggttgtagcggggaggcgtttagttggtgcgcgatatgtacggttagcgcggggtggtttatggtttcggggaatacgagttcgggtttatcgtagagcgagcgttcgcgttcggcggtcgcggtagggaagttatttacgaaggtcgtttcggtcgcgttggggtgagggtagttgagcgtcgtgggtcggagcggtttttcggaggcggtcgcgttaggagatgggagttcgcgttttcgtcgttagtgttttcgtcggtgtcgtcgtttttggttattaaggattttatggtaaagtcgcgtttggcgcgggttggaatatggtcgtagtcgcgggagttgtgcgaggtagtcgggttttggggagttcggttttgcgtcgcgtttgcgggtgtgtatttagttaggtatatgtatattcgttcgtattttttatttttttcgttcgttcgttcgcgttcggttttcgcgggcgagttaggcgcggagcggcgaggggtgtgtga

SEQ ID NO: 25634 - DNA, 785 bp, Artificial Sequence
  chemically treated genomic DNA (Homo sapiens) CpG-island No: 25634
tcacacacccctcgccgctccgcgcctaactcgcccgcgaaaaccgaacgcgaacgaacgaacgaaaaaaataaaaaatacgaacgaatatacatatacctaactaaatacacacccgcaaacgcgacgcaaaaccgaactccccaaaacccgactacctcgcacaactcccgcgactacgaccatattccaacccgcgccaaacgcgactttaccataaaatccttaataaccaaaaacgacgacaccgacgaaaacactaacgacgaaaacgcgaactcccatctcctaacgcgaccgcctccgaaaaaccgctccgacccacgacgctcaactaccctcaccccaacgcgaccgaaacgaccttcgtaaataacttccctaccgcgaccgccgaacgcgaacgctcgctctacgataaacccgaactcgtattccccgaaaccataaaccaccccgcgctaaccgtacatatcgcgcaccaactaaacgcctccccgctacaacccccgcactccttcttcgacgcccaacaccgaaaccctctccatttctacccctaaatctacgaaaccgcttcttcgaccaccgcttccaaaataaatatccacgctatacccgccgaaacgaccgccgacgcccgtactacgacgatacgaaaaaaactcgaaaacgcgcgaaactatttaaaaattactaccgaaaaaactacaaatccgcgaaaataaattcccaaacaaaaaaaaactatacgacatccacccgcgccttcgccgcgtaaatct

SEQ ID NO: 25635 - DNA, 785 bp, Artificial Sequence
  chemically treated genomic DNA (Homo sapiens) CpG-island No: 25635
ttatatatttttcgtcgtttcgcgtttggttcgttcgcgggggtcgagcgcgagcgggcgggcgggggaggtgaggggtgcgggcgggtgtgtatgtgtttggttgggtgtatattcgtaagcgcggcgtaggatcggattttttagagttcggttgtttcgtatagttttcgcggttgcgattatgttttagttcgcgttaagcgcggttttattatagagtttttggtggttaaggacggcggtatcggcgggggtattggcggcgggggcgcgggtttttattttttggcgcggtcgttttcgaggaatcgtttcggtttacggcgtttaattatttttattttagcgcggtcgaggcggttttcgtgagtggtttttttgtcgcggtcgtcgggcgcgggcgttcgttttacggtgggttcgagttcgtgtttttcgaggttatgaattatttcgcgttgatcgtgtatatcgcgtattagttgggcgttttttcgttgtagttttcgtatttttttttcggcgtttagtatcgggattttttttatttttatttttgggtttgcggaatcgttttttcggttatcgtttttagggtgagtgtttacgttgtgttcgtcgaggcggtcgtcggcgttcgtgttgcggcgatgcgggggaggttcgggggcgcgcggggttgtttagaagttattgtcgggaaggttgtaggttcgcggaggtagatttttaggtagggaagagttgtgcggtatttattcgcgttttcgtcgcgtaggttt

SEQ ID NO: 25636 - DNA, 785 bp, Artificial Sequence
  chemically treated genomic DNA (Homo sapiens) CpG-island No: 25636
aaacctacgcgacgaaaacgcgaataaataccgcacaactcttccctacctaaaaatctacctccgcgaacctacaaccttcccgacaataacttctaaacaaccccgcgcgcccccgaacctcccccgcatcgccgcaacacgaacgccgacgaccgcctcgacgaacacaacgtaaacactcaccctaaaaacgataaccgaaaaaacgattccgcaaacccaaaaataaaaataaaaaaaatcccgatactaaacgccgaaaaaaaaatacgaaaactacaacgaaaaaacgcccaactaatacgcgatatacacgatcaacgcgaaataattcataacctcgaaaaacacgaactcgaacccaccgtaaaacgaacgcccgcgcccgacgaccgcgacaaaaaaaccactcacgaaaaccgcctcgaccgcgctaaaataaaaataattaaacgccgtaaaccgaaacgattcctcgaaaacgaccgcgccaaaaaataaaaacccgcgcccccgccgccaatacccccgccgataccgccgtccttaaccaccaaaaactctataataaaaccgcgcttaacgcgaactaaaacataatcgcaaccgcgaaaactatacgaaacaaccgaactctaaaaaatccgatcctacgccgcgcttacgaatatacacccaaccaaacacatacacacccgcccgcacccctcacctcccccgcccgcccgctcgcgctcgacccccgcgaacgaaccaaacgcgaaacgacgaaaaatatataa

SEQ ID NO: 25637 - DNA, 616 bp, Artificial Sequence
  chemically treated genomic DNA (Homo sapiens) CpG-island No: 25637
gatttttattttttattcgcgatcggaatcgcggacgattttgtttcggttagttttttcgtacggcggacgaatttttcgggggtagtttttacgataggttgtgagagtcggatttttaaatttttttattttattttcgaggtcgtagaaaggcgtcgtttcgaggtttaggagggcgcgggcggcggtggggaggttgggatttggattttgtcggcgtattgcggagagggagtcgtagagagtttcgttttttcgtcgttgtcggggtttattttagcggtttgagcgttgtttgggcgcgtagatttgggttgggttttttgacgttttaaggttacggggttcgtgcgtcgcgtaattttgcggggattttaggtcgggttttggtagcggtcgtttgagcgtcgggagtcgtggtttggagagcgtttagggcgtttcggtcgttataaagcgggttaaagtttattttttattcgattgtttcgaaaagttttcgcgcgtcgacgtcgtttcggttttttgggcgaggtggggaggggcggttaggggtggggaggcgaggcggtcgtatttagtattttttcgcgttttgggaatttcggggttt

SEQ ID NO: 25638 - DNA, 616 bp, Artificial Sequence
  chemically treated genomic DNA (Homo sapiens) CpG-island No: 25638
aaaccccgaaattcccaaaacgcgaaaaaatactaaatacgaccgcctcgcctccccacccctaaccgcccctccccacctcgcccaaaaaaccgaaacgacgtcgacgcgcgaaaacttttcgaaacaatcgaataaaaaataaactttaacccgctttataacgaccgaaacgccctaaacgctctccaaaccacgactcccgacgctcaaacgaccgctaccaaaacccgacctaaaatccccgcaaaattacgcgacgcacgaaccccgtaaccttaaaacgtcaaaaaacccaacccaaatctacgcgcccaaacaacgctcaaaccgctaaaataaaccccgacaacgacgaaaaaacgaaactctctacgactccctctccgcaatacgccgacaaaatccaaatcccaacctccccaccgccgcccgcgccctcctaaacctcgaaacgacgcctttctacgacctcgaaaataaaataaaaaaatttaaaaatccgactctcacaacctatcgtaaaaactacccccgaaaaattcgtccgccgtacgaaaaaactaaccgaaacaaaatcgtccgcgattccgatcgcgaataaaaaataaaaatc

SEQ ID NO: 25639 - DNA, 616 bp, Artificial Sequence
  chemically treated genomic DNA (Homo sapiens) CpG-island No: 25639
aggtttcggggtttttaggacgcggaggagtgttgggtgcggtcgtttcgtttttttatttttggtcgtttttttttatttcgtttaaggggtcggaacggcgtcggcgcgcgggggtttttcggagtagtcgagtggaaaatagattttaattcgttttgtggcggtcggggcgttttgagcgttttttaaattacggttttcggcgtttaggcggtcgttgttaagattcggtttggagttttcgtagagttgcgcggcgtacggatttcgtggttttggggcgttaggaggtttaatttagatttgcgcgtttaggtagcgtttaggtcgttagaatggatttcggtagcggcgaggaagcggaattttttgcggtttttttttcgtagtgcgtcggtaaggtttaggttttagtttttttatcgtcgttcgcgtttttttaggtttcggagcggcgtttttttgcggtttcgaaggtggggtgggaaagtttgggagttcggtttttatagtttgtcgtgagaattgttttcggggaattcgttcgtcgtacggaaaaattggtcggagtagagtcgttcgcggtttcggtcgcgggtggaaggtgaaggtt

SEQ ID NO: 25640 - DNA, 616 bp, Artificial Sequence
  chemically treated genomic DNA (Homo sapiens) CpG-island No: 25640
aaccttcaccttccacccgcgaccgaaaccgcgaacgactctactccgaccaatttttccgtacgacgaacgaattccccgaaaacaattctcacgacaaactataaaaaccgaactcccaaactttcccaccccaccttcgaaaccgcaaaaaaacgccgctccgaaacctaaaaaaacgcgaacgacgataaaaaaactaaaacctaaaccttaccgacgcactacgaaaaaaaaaccgcaaaaaattccgcttcctcgccgctaccgaaatccattctaacgacctaaacgctacctaaacgcgcaaatctaaattaaacctcctaacgccccaaaaccacgaaatccgtacgccgcgcaactctacgaaaactccaaaccgaatcttaacaacgaccgcctaaacgccgaaaaccgtaatttaaaaaacgctcaaaacgccccgaccgccacaaaacgaattaaaatctattttccactcgactactccgaaaaacccccgcgcgccgacgccgttccgaccccttaaacgaaataaaaaaaaacgaccaaaaataaaaaaacgaaacgaccgcacccaacactcctccgcgtcctaaaaaccccgaaacct

SEQ ID NO: 25641 - DNA, 631 bp, Artificial Sequence
  chemically treated genomic DNA (Homo sapiens) CpG-island No: 25641
  misc_feature (98)..(98): n is either a, c, g or t
  misc_feature (114)..(114): n is either a, c, g or t
ttatcgtcgatttttatagggcgcgtagtgggtgattgcggtattggttcgcgttttcgttcgagggagacgaggcgggatagcgggcgggaaagggnagtttgcgtcgtaatnttttttcgttcgaaagattcgtttcgcggtgggttttagttttcgttcggttcgcggcgttgtcggttttttttcgtcgtcgcggagttggatcgtagttgtgtttcgtcgattatgcgtcgtttttcgcgggttttgttgttgtagttgcgtttcgttttgttggtggtcgcgggggtttcggaggtgttggttagcgcgtcgcggagtttggtgtgggggttcgggttgtaggcggtcgtcgttttgtcggttcgttatttttatttgtaggcggttaattcggagggttagaattttattcgttttttcgtaggtagtgtttagtcgtcggtttttttcgtttcgcggtcgggttttcgcgcgttttcgtcgttcgggagttcgttcgcggtttgcgtggcgttttttttcggcgtgtgtcgtttttttttgggtttggttagtttttttttttttttttcgtttatatttaaagcgggtaaaaattattacgaaagtttgtggaatgaatgaa

SEQ ID NO: 25642 - DNA, 631 bp, Artificial Sequence
  chemically treated genomic DNA (Homo sapiens) CpG-island No: 25642
  misc_feature (518)..(518): n is either a, c, g or t
  misc_feature (534)..(534): n is either a, c, g or t
ttcattcattccacaaactttcgtaataatttttacccgctttaaatataaacgaaaaaaaaaaaaaaaaactaaccaaacccaaaaaaaaacgacacacgccgaaaaaaaacgccacgcaaaccgcgaacgaactcccgaacgacgaaaacgcgcgaaaacccgaccgcgaaacgaaaaaaaccgacgactaaacactacctacgaaaaaacgaataaaattctaaccctccgaattaaccgcctacaaataaaaataacgaaccgacaaaacgacgaccgcctacaacccgaacccccacaccaaactccgcgacgcgctaaccaacacctccgaaacccccgcgaccaccaacaaaacgaaacgcaactacaacaacaaaacccgcgaaaaacgacgcataatcgacgaaacacaactacgatccaactccgcgacgacgaaaaaaaaccgacaacgccgcgaaccgaacgaaaactaaaacccaccgcgaaacgaatctttcgaacgaaaaaanattacgacgcaaactnccctttcccgcccgctatcccgcctcgtctccctcgaacgaaaacgcgaaccaataccgcaatcacccactacgcgccctataaaaatcgacgataa

SEQ ID NO: 25643 - DNA, 631 bp, Artificial Sequence
  chemically treated genomic DNA (Homo sapiens) CpG-island No: 25643
  misc_feature (518)..(518): n is either a, c, g or t
  misc_feature (534)..(534): n is either a, c, g or t
tttatttattttataaattttcgtggtgatttttgttcgttttgagtatgggcgggaggagggaagaggagttgattagatttaaaaaggggcgatatacgtcggggagggacgttacgtaggtcgcgggcggattttcgggcggcggggacgcgcggggattcggtcgcgggacgagggaggtcggcggttggatattatttgcgggagagcgagtgaggttttggtttttcgagttgatcgtttgtaggtagaaatagcggatcggtaggacgacggtcgtttgtagttcgggtttttatattaggtttcgcggcgcgttgattagtattttcggggttttcgcggttattagtagggcgaggcgtagttgtagtagtagggttcgcgggaggcggcgtatggtcggcggggtataattgcggtttagtttcgcggcggcgaggaggggtcggtagcgtcgcggatcgggcggggattggggtttatcgcggggcgggtttttcgggcgggaaagnattgcggcgtaggttnttttttttcgttcgttgtttcgtttcgtttttttcgggcgggaacgcgagttagtgtcgtaattatttattgcgcgttttgtaggggtcgacgatgg

SEQ ID NO: 25644 - DNA, 631 bp, Artificial Sequence
  chemically treated genomic DNA (Homo sapiens) CpG-island No: 25644
  misc_feature (98)..(98): n is either a, c, g or t
  misc_feature (114)..(114): n is either a, c, g or t
ccatcgtcgacccctacaaaacgcgcaataaataattacgacactaactcgcgttcccgcccgaaaaaaacgaaacgaaacaacgaacgaaaaaaaanaacctacgccgcaatnctttcccgcccgaaaaacccgccccgcgataaaccccaatccccgcccgatccgcgacgctaccgacccctcctcgccgccgcgaaactaaaccgcaattataccccgccgaccatacgccgcctcccgcgaaccctactactacaactacgcctcgccctactaataaccgcgaaaaccccgaaaatactaatcaacgcgccgcgaaacctaatataaaaacccgaactacaaacgaccgtcgtcctaccgatccgctatttctacctacaaacgatcaactcgaaaaaccaaaacctcactcgctctcccgcaaataatatccaaccgccgacctccctcgtcccgcgaccgaatccccgcgcgtccccgccgcccgaaaatccgcccgcgacctacgtaacgtccctccccgacgtatatcgcccctttttaaatctaatcaactcctcttccctcctcccgcccatactcaaaacgaacaaaaatcaccacgaaaatttataaaataaataaa

SEQ ID NO: 25645 - DNA, 752 bp, Artificial Sequence
  chemically treated genomic DNA (Homo sapiens) CpG-island No: 25645
tcggggtagagaagttatcggttacggtcgaaggggtggggtaaggtttgcgtgacggttagggtcgcggttgcgagaatttcgaggtggggtgagggtcggatttcggttttatttaaagtttttgtcgttggatgttattttttttagtaaattggaaatgtggtacgaggcgttcgttatgttgacggtttcgatttcgtttgttggcgttgttggagttgttgttcgttgtcgttgtcgtcgtcgtcgtcgtcgtcgtcgtcgtcgtcgtcgtcgtcgtcgttattggagttttttttttcgttcgcggcggttttcgtttttagggtcgtagcgcgacgtcgacgttgattagggaggcgtttcgacgggttgttttttttttggcgaggcgtgggtttgtttcggggtaagtcgaggttatagagttagtttaacgacggcgttgttcgcgtgagaacgagtttatgggcggcggggcgtatagaagggtttttacggggagttagatatttttatttagggtcgtttcgtttttattcgtttcgtattcgttttttagggtaaaaggttaaagttcgtttttttcgtttcgggggcgggggcggtagacgcgggcgttacggaaagttaaggttagagtttacggaggtttttttacgtacgttgtggagaagagagttaaaaaataattcggttggttgaagtttgtgttagtttttatgtgattcgttttttggaggtatgat

SEQ ID NO: 25646 - DNA, 752 bp, Artificial Sequence
  chemically treated genomic DNA (Homo sapiens) CpG-island No: 25646
atcatacctccaaaaaacgaatcacataaaaactaacacaaacttcaaccaaccgaattattttttaactctcttctccacaacgtacgtaaaaaaacctccgtaaactctaaccttaactttccgtaacgcccgcgtctaccgcccccgcccccgaaacgaaaaaaacgaactttaaccttttaccctaaaaaacgaatacgaaacgaataaaaacgaaacgaccctaaataaaaatatctaactccccgtaaaaacccttctatacgccccgccgcccataaactcgttctcacgcgaacaacgccgtcgttaaactaactctataacctcgacttaccccgaaacaaacccacgcctcgccaaaaaaaaaacaacccgtcgaaacgcctccctaatcaacgtcgacgtcgcgctacgaccctaaaaacgaaaaccgccgcgaacgaaaaaaaaaactccaataacgacgacgacgacgacgacgacgacgacgacgacgacgacgacgacaacgacaacgaacaacaactccaacaacgccaacaaacgaaatcgaaaccgtcaacataacgaacgcctcgtaccacatttccaatttactaaaaaaaataacatccaacgacaaaaactttaaataaaaccgaaatccgaccctcaccccacctcgaaattctcgcaaccgcgaccctaaccgtcacgcaaaccttaccccaccccttcgaccgtaaccgataacttctctaccccga

SEQ ID NO: 25647 - DNA, 752 bp, Artificial Sequence
  chemically treated genomic DNA (Homo sapiens) CpG-island No: 25647
gttatgtttttaaaaggcgggttatatgaaaattgatataggttttagttaatcgaattgttttttaatttttttttttatagcgtgcgtggggaggttttcgtgaattttgattttagtttttcgtagcgttcgcgtttgtcgttttcgttttcggagcgaaggaggcgggttttggttttttgttttagggagcgagtgcggagcgagtgggagcgagacggttttgagtggaagtgtttggtttttcgtagaggtttttttgtacgtttcgtcgtttatgagttcgtttttacgcgaatagcgtcgtcgttaggttggttttgtagtttcggtttatttcgggataggtttacgtttcgttagggagggggtagttcgtcgaggcgtttttttagttagcgtcggcgtcgcgttgcgattttggaagcgggagtcgtcgcgagcgagaggaggagttttagtggcggcggcggcggcggcggcggcggcggcggcggcggcggcggcggtagcggtagcgggtagtagttttagtagcgttagtaggcgggatcgaggtcgttaatatggcgagcgtttcgtattatatttttaatttgttggaaaaaatgatatttagcgataaggattttaggtgaggtcgagattcgatttttattttatttcggggttttcgtagtcgcggttttggtcgttacgtaggttttgttttattttttcggtcgtagtcggtagtttttttgtttcga

SEQ ID NO: 25648 - DNA, 752 bp, Artificial Sequence
  chemically treated genomic DNA (Homo sapiens) CpG-island No: 25648
tcgaaacaaaaaaactaccgactacgaccgaaaaaataaaacaaaacctacgtaacgaccaaaaccgcgactacgaaaaccccgaaataaaataaaaatcgaatctcgacctcacctaaaatccttatcgctaaatatcattttttccaacaaattaaaaatataatacgaaacgctcgccatattaacgacctcgatcccgcctactaacgctactaaaactactacccgctaccgctaccgccgccgccgccgccgccgccgccgccgccgccgccgccgccgccactaaaactcctcctctcgctcgcgacgactcccgcttccaaaatcgcaacgcgacgccgacgctaactaaaaaaacgcctcgacgaactaccccctccctaacgaaacgtaaacctatcccgaaataaaccgaaactacaaaaccaacctaacgacgacgctattcgcgtaaaaacgaactcataaacgacgaaacgtacaaaaaaacctctacgaaaaaccaaacacttccactcaaaaccgtctcgctcccactcgctccgcactcgctccctaaaacaaaaaaccaaaacccgcctccttcgctccgaaaacgaaaacgacaaacgcgaacgctacgaaaaactaaaatcaaaattcacgaaaacctccccacgcacgctataaaaaaaaaaattaaaaaacaattcgattaactaaaacctatatcaattttcatataacccgccttttaaaaacataac

SEQ ID NO: 25649 - DNA, 720 bp, Artificial Sequence
  chemically treated genomic DNA (Homo sapiens) CpG-island No: 25649
gcgttggggtcgtattttattattttattttatgtggtttgcgcgttattatattatacggttattttcgttttattttgaaattgatcgtagtaggttgggcgtggggttttcggttcggtttcgtttcgtttcgttttcgttttcgttttagattcgtttattttttatcgatttcgttttcgttagatttcgttttcggtttcgtttatttttcgtttcgtagcggcgggagggtaggtttgcgtcgttacgtgtttcgacgtaggagttgttcgtttgtagggtagagcgcgggtagattttgggtcgggtagtagtagtcgtagagcggcgcggcggcggtggcggtagtaggtagtaggtatgattatggtagcggcggcggtggtggtacgcggggtcggggcgagggtagcgatagcggcggttttgcggggtggttgcgggatcgcggttcgggggcggtcgtgtgcgggtttcgttcggtttttgtgtattgtattcgggatcgtttcggatatgaagcgttatttgtgggagcgttatcgggaggcgaagagaagtatagaaggtgagtgaggcggcgatttcgtttcggcgtttggggttttttttgcgcgtttagttgggaagcgggcgttttaggattcggattagtttagttgcggatttttagggtttttagtcgcgaatttcggtgtttatatttttagtcgt

SEQ ID NO: 25650 - DNA, 720 bp, Artificial Sequence
  chemically treated genomic DNA (Homo sapiens) CpG-island No: 25650
acgactaaaaatataaacaccgaaattcgcgactaaaaaccctaaaaatccgcaactaaactaatccgaatcctaaaacgcccgcttcccaactaaacgcgcaaaaaaaaccccaaacgccgaaacgaaatcgccgcctcactcaccttctatacttctcttcgcctcccgataacgctcccacaaataacgcttcatatccgaaacgatcccgaatacaatacacaaaaaccgaacgaaacccgcacacgaccgcccccgaaccgcgatcccgcaaccaccccgcaaaaccgccgctatcgctaccctcgccccgaccccgcgtaccaccaccgccgccgctaccataatcatacctactacctactaccgccaccgccgccgcgccgctctacgactactactacccgacccaaaatctacccgcgctctaccctacaaacgaacaactcctacgtcgaaacacgtaacgacgcaaacctaccctcccgccgctacgaaacgaaaaataaacgaaaccgaaaacgaaatctaacgaaaacgaaatcgataaaaaataaacgaatctaaaacgaaaacgaaaacgaaacgaaacgaaaccgaaccgaaaaccccacgcccaacctactacgatcaatttcaaaataaaacgaaaataaccgtataatataataacgcgcaaaccacataaaataaaataataaaatacgaccccaacgc

SEQ ID NO: 25651 - DNA, 720 bp, Artificial Sequence
  chemically treated genomic DNA (Homo sapiens) CpG-island No: 25651
gcggttgggggtgtgggtatcggggttcgcgattggaggttttggaggttcgtagttgggttggttcgggttttagggcgttcgttttttagttgagcgcgtaggaggggttttaggcgtcggggcggggtcgtcgttttatttattttttgtgttttttttcgtttttcggtagcgtttttataggtagcgttttatgttcggggcggtttcgggtgtagtgtataagggtcgggcggggttcgtatacggtcgttttcgagtcgcggtttcgtagttatttcgtaaagtcgtcgttgtcgttgttttcgtttcggtttcgcgtgttattatcgtcgtcgttgttatggttatgtttgttgtttgttgtcgttatcgtcgtcgcgtcgttttgcgattgttgttgttcggtttaagatttattcgcgttttgttttgtaggcgggtagtttttgcgtcggaatacgtggcggcgtaggtttgttttttcgtcgttgcggggcggggagtgggcggagtcggaggcggggtttaacgggggcggggtcgatggggagtgggcgggtttgggacgggggcggagacggggcggggcggggtcgggtcgggggttttacgtttagtttattgcggttaattttagggtggggcgggggtggtcgtgtggtgtggtggcgcgtaggttatatgggatggaatgatgaggtacgattttagcgt

SEQ ID NO: 25652 - DNA, 720 bp, Artificial Sequence
  chemically treated genomic DNA (Homo sapiens) CpG-island No: 25652
acgctaaaatcgtacctcatcattccatcccatataacctacgcgccaccacaccacacgaccacccccgccccaccctaaaattaaccgcaataaactaaacgtaaaacccccgacccgaccccgccccgccccgtctccgcccccgtcccaaacccgcccactccccatcgaccccgcccccgttaaaccccgcctccgactccgcccactccccgccccgcaacgacgaaaaaacaaacctacgccgccacgtattccgacgcaaaaactacccgcctacaaaacaaaacgcgaataaatcttaaaccgaacaacaacaatcgcaaaacgacgcgacgacgataacgacaacaaacaacaaacataaccataacaacgacgacgataataacacgcgaaaccgaaacgaaaacaacgacaacgacgactttacgaaataactacgaaaccgcgactcgaaaacgaccgtatacgaaccccgcccgacccttatacactacacccgaaaccgccccgaacataaaacgctacctataaaaacgctaccgaaaaacgaaaaaaaacacaaaaaataaataaaacgacgaccccgccccgacgcctaaaacccctcctacgcgctcaactaaaaaacgaacgccctaaaacccgaaccaacccaactacgaacctccaaaacctccaatcgcgaaccccgatacccacacccccaaccgc

SEQ ID NO: 25653 - DNA, 506 bp, Artificial Sequence
  chemically treated genomic DNA (Homo sapiens) CpG-island No: 25653
  misc_feature (49)..(49): n is either a, c, g or t
tatggcgcgaatattttgaattgtcggtatttcgttcgcgcgcgggcgncggttaatatttggatattagatttaattttttttcgttttcggtatttgggatggttgtcgcgtatagacggtcggtttttgtttaagttttatacggtcgttttttatttatattttaataggcgacggtttcgtgcgttgtgtagaggttattttttatttttttttttttttttttttcggtcggcgggcgagttattatgttatttgtgttcgtaatttttttcgttggtcggttatcggtcgtgttatatagtcgttttcgtgcgttattcgtcgcgttcgtattttttataataaggggggtggtcgtattcgttttttaatttacgtcgttttcgttcgcggaatatatgcgggcggtcgtcgcgcgtttttatatagatggtatataattaagatcgatacgattatgggttaatcggtttttcgatcggtacggttttttattatat

SEQ ID NO: 25654 - DNA, 506 bp, Artificial Sequence
  chemically treated genomic DNA (Homo sapiens) CpG-island No: 25654
  misc_feature (458)..(458): n is either a, c, g or t
atataataaaaaaccgtaccgatcgaaaaaccgattaacccataatcgtatcgatcttaattatataccatctatataaaaacgcgcgacgaccgcccgcatatattccgcgaacgaaaacgacgtaaattaaaaaacgaatacgaccaccccccttattataaaaaatacgaacgcgacgaataacgcacgaaaacgactatataacacgaccgataaccgaccaacgaaaaaaattacgaacacaaataacataataactcgcccgccgaccgaaaaaaaaaaaaaaaaaaaaataaaaaataacctctacacaacgcacgaaaccgtcgcctattaaaatataaataaaaaacgaccgtataaaacttaaacaaaaaccgaccgtctatacgcgacaaccatcccaaataccgaaaacgaaaaaaaattaaatctaatatccaaatattaaccgncgcccgcgcgcgaacgaaataccgacaattcaaaatattcgcgccata

SEQ ID NO: 25655 - DNA, 506 bp, Artificial Sequence
  chemically treated genomic DNA (Homo sapiens) CpG-island No: 25655
  misc_feature (458)..(458): n is either a, c, g or t
gtatggtagggggtcgtgtcggtcggggggtcggttggtttatgatcgtgtcggttttggttgtatattatttgtgtgagagcgcgcggcggtcgttcgtatgtgtttcgcgggcggaggcggcgtggattggggggcgggtgcggttattttttttgttgtgggggatacgggcgcggcgggtggcgtacgagggcggttgtatggtacggtcggtggtcggttagcgggggggattgcgggtatagatggtataatagttcgttcgtcggtcgggaggaggaaggagggggaggtgggaggtggtttttatatagcgtacgaggtcgtcgtttgttggggtgtgggtggggggcggtcgtgtgggatttgaataggaatcgatcgtttatgcgcggtagttattttaggtgtcgaaggcgaggggagattaggtttgatgtttagatattaatcgncgttcgcgcgcgggcgaaatatcgatagtttagagtgttcgcgttatg

SEQ ID NO: 25656 - DNA, 506 bp, Artificial Sequence
  chemically treated genomic DNA (Homo sapiens) CpG-island No: 25656
  misc_feature (49)..(49): n is either a, c, g or t
cataacgcgaacactctaaactatcgatatttcgcccgcgcgcgaacgncgattaatatctaaacatcaaacctaatctcccctcgccttcgacacctaaaataactaccgcgcataaacgatcgattcctattcaaatcccacacgaccgccccccacccacaccccaacaaacgacgacctcgtacgctatataaaaaccacctcccacctccccctccttcctcctcccgaccgacgaacgaactattataccatctatacccgcaatcccccccgctaaccgaccaccgaccgtaccatacaaccgccctcgtacgccacccgccgcgcccgtatcccccacaacaaaaaaaataaccgcacccgccccccaatccacgccgcctccgcccgcgaaacacatacgaacgaccgccgcgcgctctcacacaaataatatacaaccaaaaccgacacgatcataaaccaaccgaccccccgaccgacacgaccccctaccatac

SEQ ID NO: 25657 - DNA, 503 bp, Artificial Sequence
  chemically treated genomic DNA (Homo sapiens) CpG-island No: 25657
  misc_feature (326)..(326): n is either a, c, g or t
  misc_feature (437)..(437): n is either a, c, g or t
ggatggtgtcgtttcgtgtcgtgtggtggatcggcgttcgatacgcggtatcggtcgtatttttaggtcgggggtgggtcggtgttaggtttgtattattaaattacgtagtcgtcgggagcgggtcggcggtcggtcggggggcggcgtcgtcggcgttcgcgtttaatacgaagcgcgcgcgcgttgatacgattattgaaagtttaagttattaattaattcggtcgcgggtacgcggcgttgtatatttttttatatacgcgttcgtttatttcggtttcgttttattcgtttatttagtcgcgtatttttttcgcggtcgngcgtaacgtttggtttacgcggagacgattattatcgttggtcgatatttattattaattttcgttacgcgtgttatttataatattgtgaagtatataatataagcgttngttatacgggagagcggttttacggttcggttcgcgtttttgtagtatttaattatttacgtcgtt

SEQ ID NO: 25658 - DNA, 503 bp, Artificial Sequence
  chemically treated genomic DNA (Homo sapiens) CpG-island No: 25658
  misc_feature (67)..(67): n is either a, c, g or t
  misc_feature (178)..(178): n is either a, c, g or t
aacgacgtaaataattaaatactacaaaaacgcgaaccgaaccgtaaaaccgctctcccgtataacnaacgcttatattatatacttcacaatattataaataacacgcgtaacgaaaattaataataaatatcgaccaacgataataatcgtctccgcgtaaaccaaacgttacgcncgaccgcgaaaaaaatacgcgactaaataaacgaataaaacgaaaccgaaataaacgaacgcgtatataaaaaaatatacaacgccgcgtacccgcgaccgaattaattaataacttaaactttcaataatcgtatcaacgcgcgcgcgcttcgtattaaacgcgaacgccgacgacgccgccccccgaccgaccgccgacccgctcccgacgactacgtaatttaataatacaaacctaacaccgacccacccccgacctaaaaatacgaccgataccgcgtatcgaacgccgatccaccacacgacacgaaacgacaccatcc

SEQ ID NO: 25659 - DNA, 503 bp, Artificial Sequence
  chemically treated genomic DNA (Homo sapiens) CpG-island No: 25659
  misc_feature (67)..(67): n is either a, c, g or t
  misc_feature (178)..(178): n is either a, c, g or t
aacgacgtaagtgattaggtgttgtagggacgcggatcgagtcgtgggatcgttttttcgtatgatngacgtttatgttgtgtattttataatattgtgagtgatacgcgtggcggaggttggtggtgggtgtcggttaacgatggtggtcgttttcgcgtaagttagacgttgcgtncgatcgcggggagggtgcgcggttgaatgggcgggtgaggcgaggtcggggtgggcgggcgcgtgtgtgggagggtgtgtagcgtcgcgtgttcgcggtcgggttggttggtggtttggatttttagtaatcgtgttagcgcgcgcgcgtttcgtattgggcgcggacgtcggcggcgtcgtttttcggtcggtcgtcggttcgttttcggcggttgcgtggtttagtgatgtaagtttagtatcggtttattttcggtttgggggtgcgatcggtatcgcgtatcgggcgtcggtttattatacggtacgagacggtattattt

SEQ ID NO: 25660 - DNA, 503 bp, Artificial Sequence
  chemically treated genomic DNA (Homo sapiens) CpG-island No: 25660
  misc_feature (326)..(326): n is either a, c, g or t
  misc_feature (437)..(437): n is either a, c, g or t
aaataataccgtctcgtaccgtataataaaccgacgcccgatacgcgataccgatcgcacccccaaaccgaaaataaaccgatactaaacttacatcactaaaccacgcaaccgccgaaaacgaaccgacgaccgaccgaaaaacgacgccgccgacgtccgcgcccaatacgaaacgcgcgcgcgctaacacgattactaaaaatccaaaccaccaaccaacccgaccgcgaacacgcgacgctacacaccctcccacacacgcgcccgcccaccccgacctcgcctcacccgcccattcaaccgcgcaccctccccgcgatcgnacgcaacgtctaacttacgcgaaaacgaccaccatcgttaaccgacacccaccaccaacctccgccacgcgtatcactcacaatattataaaatacacaacataaacgtcnatcatacgaaaaaacgatcccacgactcgatccgcgtccctacaacacctaatcacttacgtcgtt

SEQ ID NO: 25661 - DNA, 504 bp, Artificial Sequence
  chemically treated genomic DNA (Homo sapiens) CpG-island No: 25661
ttttttttcgtttttttcgtttagtttgcgagtgttttgagggaagtaaggaggcggcggcggtcgtagcgagtggcgagtagtggaaacgttgtttttgaggggagtttaaggtagggaggcgaggcgacggtgtgcgggagcgggttttttagggatttttcgggttcgtaattggtagggtcgttcgattcgtaggggatttcgtttcgtttttgttgttttttttttatttttaggagtgttcggggcgacgggatttcgggagaggggaaagggaatagtttggggttcgggtatcgttgtgggtcgggttgggtttagggggacggcggtgcgggttgggtcggtttgggcgcggcgggggtcggatgatggggcgagttcggattttggcgggcgagtgttcggcgtaggcgtaagcgtagagttttttcgcggtcgtttttttggttttttttttttgggggatttttagtgttaggttgttagtgcgtagttttt

SEQ ID NO: 25662 - DNA, 504 bp, Artificial Sequence
  chemically treated genomic DNA (Homo sapiens) CpG-island No: 25662
aaaaactacgcactaacaacctaacactaaaaatcccccaaaaaaaaaaaaccaaaaaaacgaccgcgaaaaaactctacgcttacgcctacgccgaacactcgcccgccaaaatccgaactcgccccatcatccgacccccgccgcgcccaaaccgacccaacccgcaccgccgtccccctaaacccaacccgacccacaacgatacccgaaccccaaactattccctttcccctctcccgaaatcccgtcgccccgaacactcctaaaaataaaaaaaaaacaacaaaaacgaaacgaaatcccctacgaatcgaacgaccctaccaattacgaacccgaaaaatccctaaaaaacccgctcccgcacaccgtcgcctcgcctccctaccttaaactcccctcaaaaacaacgtttccactactcgccactcgctacgaccgccgccgcctccttacttccctcaaaacactcgcaaactaaacgaaaaaaacgaaaaaaaa

SEQ ID NO: 25663 - DNA, 504 bp, Artificial Sequence
  chemically treated genomic DNA (Homo sapiens) CpG-island No: 25663
gggggttgcgtattgatagtttggtattgggggttttttagaggggaggggttaaaaggacgatcgcgaggagattttgcgtttgcgtttgcgtcgagtattcgttcgttaaggttcggattcgttttattattcggttttcgtcgcgtttaaatcggtttagttcgtatcgtcgtttttttaaatttagttcggtttatagcgatgttcggattttagattgtttttttttttttttttcggggtttcgtcgtttcgggtatttttaaaaataaagggaaaataatagaaacgaaacgggattttttgcgaatcgaacggttttgttagttgcggattcgggaagtttttggagagttcgttttcgtatatcgtcgtttcgtttttttattttgggttttttttagaagtaacgtttttattattcgttattcgttgcggtcgtcgtcgtttttttgttttttttagaatattcgtaggttaggcgaaggaggcggagaggaa

SEQ ID NO: 25664 - DNA, 504 bp, Artificial Sequence
  chemically treated genomic DNA (Homo sapiens) CpG-island No: 25664
ttcctctccgcctccttcgcctaacctacgaatattctaaaaaaaacaaaaaaacgacgacgaccgcaacgaataacgaataataaaaacgttacttctaaaaaaaacccaaaataaaaaaacgaaacgacgatatacgaaaacgaactctccaaaaacttcccgaatccgcaactaacaaaaccgttcgattcgcaaaaaatcccgtttcgtttctattattttccctttatttttaaaaatacccgaaacgacgaaaccccgaaaaaaaaaaaaaaaaacaatctaaaatccgaacatcgctataaaccgaactaaatttaaaaaaacgacgatacgaactaaaccgatttaaacgcgacgaaaaccgaataataaaacgaatccgaaccttaacgaacgaatactcgacgcaaacgcaaacgcaaaatctcctcgcgatcgtccttttaacccctcccctctaaaaaacccccaataccaaactatcaatacgcaaccccc

SEQ ID NO: 25665 - DNA, 733 bp, Artificial Sequence
  chemically treated genomic DNA (Homo sapiens) CpG-island No: 25665
tgaaggtcgttggatttttcggcgttttcggttcggtttagtttttttcggggttcggataaggaggtcgggcgtttttttttttatttttttggggttttagatcggtcgtagtagcggtacggaagagattatcgggtgcgagtagtagacggggtgcgggaaggtgagtagcggttggttgattggtatcggggttttcgcggttgtagtcgtcgcgttttcggtcgtcgagttttcgtggtagaggatgggtatttttacgatgcgttgcgtcgcggtatggtttaagttggtcgtttttagtttagtcgagagttgtcgtttttatttgttgcggcggttttggaattaagtttttatttgggtttgcgggagttgtaggttggaggcgaggtaggcgcgtttcgagttgtttaggtagcgttttatgtcgaaggtggattcgagttggtatatttggttgcgcgaaaagacggtgcgcgttttttttttggtcgcgtcggtttgtcgtttagcgtcgtcgtttcgcggtcgttcggatttcggcgagggcgaagttcgcgggtaggagttttttttttttttttttaaagttcgagtgcgaaggagagaggaaaggcgtgcgttttaagtcgttcgggttcgagtttacgatgtttttgggggtatttgaggagcgagaatagatagaaaggttatggagttggttggggagtttcggagatcgtta

SEQ ID NO: 25666 - DNA, 733 bp, Artificial Sequence
  chemically treated genomic DNA (Homo sapiens) CpG-island No: 25666
taacgatctccgaaactccccaaccaactccataacctttctatctattctcgctcctcaaatacccccaaaaacatcgtaaactcgaacccgaacgacttaaaacgcacgcctttcctctctccttcgcactcgaactttaaaaaaaaaaaaaaaaaactcctacccgcgaacttcgccctcgccgaaatccgaacgaccgcgaaacgacgacgctaaacgacaaaccgacgcgaccaaaaaaaaaacgcgcaccgtcttttcgcgcaaccaaatataccaactcgaatccaccttcgacataaaacgctacctaaacaactcgaaacgcgcctacctcgcctccaacctacaactcccgcaaacccaaataaaaacttaattccaaaaccgccgcaacaaataaaaacgacaactctcgactaaactaaaaacgaccaacttaaaccataccgcgacgcaacgcatcgtaaaaatacccatcctctaccacgaaaactcgacgaccgaaaacgcgacgactacaaccgcgaaaaccccgataccaatcaaccaaccgctactcaccttcccgcaccccgtctactactcgcacccgataatctcttccgtaccgctactacgaccgatctaaaaccccaaaaaaataaaaaaaaaaacgcccgacctccttatccgaaccccgaaaaaaactaaaccgaaccgaaaacgccgaaaaatccaacgaccttca

SEQ ID NO: 25667 - DNA, 733 bp, Artificial Sequence
  chemically treated genomic DNA (Homo sapiens) CpG-island No: 25667
tggcggttttcgaggttttttaattaattttatggtttttttgtttgttttcgttttttaggtatttttaagggtatcgtaggttcgggttcgggcggtttggagcgtacgttttttttttttttttcgtattcggattttaaagaagagaaagagaggtttttgttcgcgggtttcgttttcgtcggggttcgagcggtcgcgggacggcggcgttgagcggtaggtcggcgcggttaagaagaagacgcgtatcgttttttcgcgtagttaggtgtattagttcgagtttattttcgatatgaagcgttatttgagtagttcggagcgcgtttgtttcgtttttagtttgtagttttcgtagatttaggtaaagatttggttttagaatcgtcgtaataagtggaagcggtagttttcggttgagttggaggcggttaatttgagttatgtcgcggcgtagcgtatcgtgagggtgtttattttttattacgagaattcggcggtcgagggcgcggcggttgtagtcgcgggggtttcggtgttagttagttagtcgttgtttattttttcgtatttcgtttattattcgtattcggtggtttttttcgtgtcgttgttacggtcggtttgaggttttagaggggtgggggagggagcgttcggtttttttgttcggatttcggaggagattgggtcgggtcgagggcgtcgagaagtttagcggttttta

SEQ ID NO: 25668 - DNA, 733 bp, Artificial Sequence
  chemically treated genomic DNA (Homo sapiens) CpG-island No: 25668
taaaaaccgctaaacttctcgacgccctcgacccgacccaatctcctccgaaatccgaacaaaaaaaccgaacgctccctcccccacccctctaaaacctcaaaccgaccgtaacaacgacacgaaaaaaaccaccgaatacgaataataaacgaaatacgaaaaaataaacaacgactaactaactaacaccgaaacccccgcgactacaaccgccgcgccctcgaccgccgaattctcgtaataaaaaataaacaccctcacgatacgctacgccgcgacataactcaaattaaccgcctccaactcaaccgaaaactaccgcttccacttattacgacgattctaaaaccaaatctttacctaaatctacgaaaactacaaactaaaaacgaaacaaacgcgctccgaactactcaaataacgcttcatatcgaaaataaactcgaactaatacacctaactacgcgaaaaaacgatacgcgtcttcttcttaaccgcgccgacctaccgctcaacgccgccgtcccgcgaccgctcgaaccccgacgaaaacgaaacccgcgaacaaaaacctctctttctcttctttaaaatccgaatacgaaaaaaaaaaaaaaaacgtacgctccaaaccgcccgaacccgaacctacgatacccttaaaaatacctaaaaaacgaaaacaaacaaaaaaaccataaaattaattaaaaaacctcgaaaaccgcca

SEQ ID NO: 25669 - DNA, 1128 bp, Artificial Sequence
  chemically treated genomic DNA (Homo sapiens) CpG-island No: 25669
tttttcggtttaggcgtattggaattattttttttttttaggtcgtgttttaagtttcggtcgttcgaagtttttttatttacgttcgaggttatttttttcgggaagtatcgtgttcggggttttaattttatttttttttttattaagtgggattggattaacgggtagcgtaatttagcgcgagggtaggttaggggtcgaaaaaaattgatcgagtagagggtttgcgggtgttggggttttagaattgcggagggaagtatcgcggggcggggacggggcgggcgcgtagggggataacgaaagtttaaagagaggtcggtatttttaggtcgtgggaggtggtcgtcggcgggggttagggtgtaggggtattattaggttggggagcgttttaggttgtgcgcgggtagggtaaatttttgtgtcgggattttaaagcgagggaaagttacgtcgtttatttgcgatagcgcgaagttcgcggcgttttttagggtttttttggttgtcgttggtagcggtagcggagttcgtggtggttgtttaggttgtcgcgaagagcgtttcgtgggtcggttgatgtttatggggcgttcggatgtggtttacgttgagtaggtttttgatggagaacggggattttttgggaacgggtggggggggcgtcggcggttggggttgtgcgttggcggtgtcggtagcgttcggttcgggtttcggtatggttttttttttttcgggttttcgggagggagggagcgggataggcgggcggcggggcgagtaggcgagaggtcggaaattagattataaacggaatttaattacggggcgtaaagtcgggggtcgtttcgggcgtaaatttaacggcgggagggcggagtgaggatttagacgggcgggttcgtatgagggaggggtgcgaggggcggggagcggttttgtcgcggtatcgagggatcgaggcggttcggttgcggttgcggttttcgcggaggaggtagtaagagtagttttcggttcgaggttgcgttaattcggcgtcggatgttaatgatgaaattaaaatgttatttaagttaaatgcggggagtatacggcgattgggcgcgtataatggta

SEQ ID NO: 25670 - DNA, 1128 bp, Artificial Sequence
  chemically treated genomic DNA (Homo sapiens) CpG-island No: 25670
taccattatacgcgcccaatcgccgtatactccccgcatttaacttaaataacattttaatttcatcattaacatccgacgccgaattaacgcaacctcgaaccgaaaactactcttactacctcctccgcgaaaaccgcaaccgcaaccgaaccgcctcgatccctcgataccgcgacaaaaccgctccccgcccctcgcacccctccctcatacgaacccgcccgtctaaatcctcactccgccctcccgccgttaaatttacgcccgaaacgacccccgactttacgccccgtaattaaattccgtttataatctaatttccgacctctcgcctactcgccccgccgcccgcctatcccgctccctccctcccgaaaacccgaaaaaaaaaaaaccataccgaaacccgaaccgaacgctaccgacaccgccaacgcacaaccccaaccgccgacgccccccccacccgttcccaaaaaatccccgttctccatcaaaaacctactcaacgtaaaccacatccgaacgccccataaacatcaaccgacccacgaaacgctcttcgcgacaacctaaacaaccaccacgaactccgctaccgctaccaacgacaaccaaaaaaaccctaaaaaacgccgcgaacttcgcgctatcgcaaataaacgacgtaactttccctcgctttaaaatcccgacacaaaaatttaccctacccgcgcacaacctaaaacgctccccaacctaataatacccctacaccctaacccccgccgacgaccacctcccacgacctaaaaataccgacctctctttaaactttcgttatccccctacgcgcccgccccgtccccgccccgcgatacttccctccgcaattctaaaaccccaacacccgcaaaccctctactcgatcaatttttttcgacccctaacctaccctcgcgctaaattacgctacccgttaatccaatcccacttaataaaaaaaaaaataaaattaaaaccccgaacacgatacttcccgaaaaaaataacctcgaacgtaaataaaaaaacttcgaacgaccgaaacttaaaacacgacctaaaaaaaaaaaataattccaatacgcctaaaccgaaaaa

SEQ ID NO: 25671 - DNA, 1128 bp, Artificial Sequence
  chemically treated genomic DNA (Homo sapiens) CpG-island No: 25671
tgttattgtacgcgtttaatcgtcgtatatttttcgtatttaatttggatgatattttgattttattattagtattcggcgtcggattgacgtagtttcgagtcggggattgtttttgttgtttttttcgcgggagtcgtagtcgtagtcgagtcgtttcgatttttcggtgtcgcggtagggtcgtttttcgtttttcgtattttttttttatgcgagttcgttcgtttgggtttttatttcgttttttcgtcgttggatttgcgttcggggcggttttcgattttgcgtttcgtagttgagtttcgtttatggtttgattttcggtttttcgtttgttcgtttcgtcgttcgtttgtttcgttttttttttttcggggattcggaggagaggggattatgtcggaattcgggtcggacgttgtcggtatcgttagcgtatagttttaatcgtcgacgttttttttattcgtttttaaggagttttcgttttttattaagaatttgtttaacgtaaattatattcggacgttttataagtattagtcgatttacgagacgtttttcgcggtagtttagataattattacggatttcgttgtcgttgttagcggtagttaaaggggttttggagggcgtcgcgggtttcgcgttatcgtaggtgggcgacgtggttttttttcgttttgagatttcggtatagaggtttgttttgttcgcgtataatttgaagcgttttttagtttggtggtatttttatattttgattttcgtcggcggttattttttacgatttgaaggtatcgatttttttttgaattttcgttgtttttttgcgcgttcgtttcgttttcgtttcgcgatgttttttttcgtagttttgggattttagtattcgtaaattttttgttcggttagtttttttcggtttttagtttgttttcgcgttgggttgcgttgttcgttaatttaattttatttggtgagaaaagaagtggaattggagtttcgggtacggtgtttttcgggaaaagtggtttcgggcgtgaatagggaggtttcggacggtcggggtttgggatacggtttggaaggagggggtgattttaatgcgtttaagtcgaaagg

SEQ ID NO: 25672 - DNA, 1128 bp, Artificial Sequence
  chemically treated genomic DNA (Homo sapiens) CpG-island No: 25672
cctttcgacttaaacgcattaaaatcaccccctccttccaaaccgtatcccaaaccccgaccgtccgaaacctccctattcacgcccgaaaccacttttcccgaaaaacaccgtacccgaaactccaattccacttcttttctcaccaaataaaattaaattaacgaacaacgcaacccaacgcgaaaacaaactaaaaaccgaaaaaaactaaccgaacaaaaaatttacgaatactaaaatcccaaaactacgaaaaaaaacatcgcgaaacgaaaacgaaacgaacgcgcaaaaaaacaacgaaaattcaaaaaaaaatcgataccttcaaatcgtaaaaaataaccgccgacgaaaatcaaaatataaaaataccaccaaactaaaaaacgcttcaaattatacgcgaacaaaacaaacctctataccgaaatctcaaaacgaaaaaaaaccacgtcgcccacctacgataacgcgaaacccgcgacgccctccaaaacccctttaactaccgctaacaacgacaacgaaatccgtaataattatctaaactaccgcgaaaaacgtctcgtaaatcgactaatacttataaaacgtccgaatataatttacgttaaacaaattcttaataaaaaacgaaaactccttaaaaacgaataaaaaaaacgtcgacgattaaaactatacgctaacgataccgacaacgtccgacccgaattccgacataatcccctctcctccgaatccccgaaaaaaaaaaaacgaaacaaacgaacgacgaaacgaacaaacgaaaaaccgaaaatcaaaccataaacgaaactcaactacgaaacgcaaaatcgaaaaccgccccgaacgcaaatccaacgacgaaaaaacgaaataaaaacccaaacgaacgaactcgcataaaaaaaaaatacgaaaaacgaaaaacgaccctaccgcgacaccgaaaaatcgaaacgactcgactacgactacgactcccgcgaaaaaaacaacaaaaacaatccccgactcgaaactacgtcaatccgacgccgaatactaataataaaatcaaaatatcatccaaattaaatacgaaaaatatacgacgattaaacgcgtacaataaca

SEQ ID NO: 25673 - DNA, 501 bp, Artificial Sequence
  chemically treated genomic DNA (Homo sapiens) CpG-island No: 25673
gaaattcgcgtggttttggtttttagttttggaaaatcgaagagtgagttttttttcgggattaggagtgggtgtgtttgtgtgcgtatgcgcgttgattcggttaaaattcgcgcgttattcggtggggttgttggggtaatagtttttcggtatcgacggttgttttcggaagggtatttttttgttttggtcgtcggtgtttaaggttcgcggattaatttcgagtttgtgatttcgacgatagtatttttttttaggaagttttttcggttagttggcgtttggagttgtttaattaacgttttaatgggggtaaggtgaatcgaaggcgtagcggcgtagtttttttcgtcgcggtaagtagcggtattcgttgcgcgtttcgacggtagcgaagtttttagagaattatattggatttttgtagaacggtttagtgaaaggatattttattttattggttttaaaaatagtttttcggttcgtacgagaagttta

SEQ ID NO: 25674 - DNA, 501 bp, Artificial Sequence
  chemically treated genomic DNA (Homo sapiens) CpG-island No: 25674
taaacttctcgtacgaaccgaaaaactatttttaaaaccaataaaataaaatatcctttcactaaaccgttctacaaaaatccaatataattctctaaaaacttcgctaccgtcgaaacgcgcaacgaataccgctacttaccgcgacgaaaaaaactacgccgctacgccttcgattcaccttacccccattaaaacgttaattaaacaactccaaacgccaactaaccgaaaaaacttcctaaaaaaaaatactatcgtcgaaatcacaaactcgaaattaatccgcgaaccttaaacaccgacgaccaaaacaaaaaaatacccttccgaaaacaaccgtcgataccgaaaaactattaccccaacaaccccaccgaataacgcgcgaattttaaccgaatcaacgcgcatacgcacacaaacacacccactcctaatcccgaaaaaaaactcactcttcgattttccaaaactaaaaaccaaaaccacgcgaatttc

SEQ ID NO: 25675 - DNA, 501 bp, Artificial Sequence
  chemically treated genomic DNA (Homo sapiens) CpG-island No: 25675
tgggtttttcgtgcgaatcggggagttgtttttaaagttagtggagtggaatgtttttttattaagtcgttttgtaaaggtttagtgtggttttttaaggatttcgttgtcgtcgagacgcgtagcggatgtcgttgtttgtcgcggcggaggaagttacgtcgttgcgttttcggtttattttgtttttattaaagcgttagttagatagttttaaacgttagttggtcggagagattttttgggagaaagtgttgtcgtcggggttatagattcggagttgattcgcgagttttgggtatcggcggttagagtagaggggtgttttttcgagagtagtcgtcggtgtcgagaagttgttgttttagtagttttatcgagtgacgcgcgggttttggtcgggttagcgcgtatacgtatataggtatatttatttttggtttcgggggaaggtttatttttcggttttttagggttaaaggttaaggttacgcggatttt

SEQ ID NO: 25676 - DNA, 501 bp, Artificial Sequence
  chemically treated genomic DNA (Homo sapiens) CpG-island No: 25676
aaaatccgcgtaaccttaacctttaaccctaaaaaaccgaaaaataaaccttcccccgaaaccaaaaataaatatacctatatacgtatacgcgctaacccgaccaaaacccgcgcgtcactcgataaaactactaaaacaacaacttctcgacaccgacgactactctcgaaaaaacacccctctactctaaccgccgatacccaaaactcgcgaatcaactccgaatctataaccccgacgacaacactttctcccaaaaaatctctccgaccaactaacgtttaaaactatctaactaacgctttaataaaaacaaaataaaccgaaaacgcaacgacgtaacttcctccgccgcgacaaacaacgacatccgctacgcgtctcgacgacaacgaaatccttaaaaaaccacactaaacctttacaaaacgacttaataaaaaaacattccactccactaactttaaaaacaactccccgattcgcacgaaaaaccca

SEQ ID NO: 25677 - DNA, 764 bp, Artificial Sequence
  chemically treated genomic DNA (Homo sapiens) CpG-island No: 25677
cgaaattcggtagcgtagttgttttttcgtagttgttttagttagttttagtaagttcgagcgttcggcgtcgtcgttatttttttcgtttttgcgcggcgcggttgggattggtttagaggcgtggtcgggagcggaggggcgtgttttgggtcgggggtggggcgagggagagttaggaggcggaagttttcgcgggcggtggggacggcgtttttatcgcgagttatttgttagtttttgtttgaggcggaggtagtttcgcgtcgcgtcggattcgaggtgagtggcggtcggtcggcgatgcgtttttcggattttcggtgggagaagggaaagaatcggtcgttgtgcgtcgaacgcgagaagggaagttcggttggggacgaggagggggcgtttttcgggtagggatggttttttaggtgttttttgggcgcggagcggcggaggtgggagagtagtttgggaaaaggagcgttcggaaaagggtagcgttggagttcgtatgaggttagagggcgagttttggggttttcgtagttcgggtcgatcgggattagcgtagcggagacggggacgcgggagggcgttcggaggtggcgagggtcggtagggacgggtattgtcgtttttatttattcggttgtcggcgtcgttcggtattatcgtggtgtggtgtttgagtgtttagttttgcgttagttttttggagggtaggaagcgggatttaaaggaaaaggcgcgttagtttttttttgttt

SEQ ID NO: 25678 - DNA, 764 bp, Artificial Sequence
  chemically treated genomic DNA (Homo sapiens) CpG-island No: 25678
aaacaaaaaaaaactaacgcgccttttcctttaaatcccgcttcctaccctccaaaaaactaacgcaaaactaaacactcaaacaccacaccacgataataccgaacgacgccgacaaccgaataaataaaaacgacaatacccgtccctaccgaccctcgccacctccgaacgccctcccgcgtccccgtctccgctacgctaatcccgatcgacccgaactacgaaaaccccaaaactcgccctctaacctcatacgaactccaacgctacccttttccgaacgctccttttcccaaactactctcccacctccgccgctccgcgcccaaaaaacacctaaaaaaccatccctacccgaaaaacgccccctcctcgtccccaaccgaacttcccttctcgcgttcgacgcacaacgaccgattctttcccttctcccaccgaaaatccgaaaaacgcatcgccgaccgaccgccactcacctcgaatccgacgcgacgcgaaactacctccgcctcaaacaaaaactaacaaataactcgcgataaaaacgccgtccccaccgcccgcgaaaacttccgcctcctaactctccctcgccccacccccgacccaaaacacgcccctccgctcccgaccacgcctctaaaccaatcccaaccgcgccgcgcaaaaacgaaaaaaataacgacgacgccgaacgctcgaacttactaaaactaactaaaacaactacgaaaaaacaactacgctaccgaatttcg

SEQ ID NO: 25679 - DNA, 764 bp, Artificial Sequence
  chemically treated genomic DNA (Homo sapiens) CpG-island No: 25679
gagtaaagaaaaattaacgcgtttttttttttgagtttcgttttttattttttaagagattggcgtaggattgggtatttagatattatattacggtggtgtcgggcgacgtcggtagtcgggtgggtgggagcggtagtgttcgtttttgtcggttttcgttattttcgggcgttttttcgcgttttcgttttcgttacgttggtttcggtcggttcgggttgcggggattttagggttcgttttttggttttatgcggattttagcgttgttttttttcgggcgtttttttttttaagttgtttttttattttcgtcgtttcgcgtttagaaagtatttgaggagttatttttgttcgaggagcgtttttttttcgtttttaatcgggttttttttttcgcgttcggcgtatagcggtcggttttttttttttttttatcggagattcgagaggcgtatcgtcggtcggtcgttatttatttcgggttcggcgcggcgcggggttgttttcgttttagataagggttgataagtgattcgcggtgagggcgtcgtttttatcgttcgcgggaattttcgttttttggttttttttcgttttattttcgatttaggatacgttttttcgttttcggttacgtttttgggttagttttagtcgcgtcgcgtaggggcggggaaggtggcggcggcgtcgggcgttcgggtttgttggggttggttgaagtagttgcggaaagataattgcgttatcgagtttcg

SEQ ID NO: 25680 - DNA, 764 bp, Artificial Sequence
  chemically treated genomic DNA (Homo sapiens) CpG-island No: 25680
cgaaactcgataacgcaattatctttccgcaactacttcaaccaaccccaacaaacccgaacgcccgacgccgccgccaccttccccgcccctacgcgacgcgactaaaactaacccaaaaacgtaaccgaaaacgaaaaaacgtatcctaaatcgaaaataaaacgaaaaaaaaccaaaaaacgaaaattcccgcgaacgataaaaacgacgccctcaccgcgaatcacttatcaacccttatctaaaacgaaaacaaccccgcgccgcgccgaacccgaaataaataacgaccgaccgacgatacgcctctcgaatctccgataaaaaaaaaaaaaaaaccgaccgctatacgccgaacgcgaaaaaaaaaacccgattaaaaacgaaaaaaaaacgctcctcgaacaaaaataactcctcaaatactttctaaacgcgaaacgacgaaaataaaaaaacaacttaaaaaaaaaaacgcccgaaaaaaaacaacgctaaaatccgcataaaaccaaaaaacgaaccctaaaatccccgcaacccgaaccgaccgaaaccaacgtaacgaaaacgaaaacgcgaaaaaacgcccgaaaataacgaaaaccgacaaaaacgaacactaccgctcccacccacccgactaccgacgtcgcccgacaccaccgtaatataatatctaaatacccaatcctacgccaatctcttaaaaaataaaaaacgaaactcaaaaaaaaaaacgcgttaatttttctttactc

SEQ ID NO: 25681 - DNA, 1164 bp, Artificial Sequence
  chemically treated genomic DNA (Homo sapiens) CpG-island No: 25681
gggggtcgcggttcggtggtagtttgggcgagggtttcgtgtttacgcgcgggttattcggcgtcgttattggtcggttattttcggcggggaagtaggtgacgggattcgcgcgggcgcgaggcggcgacgagggacgtagagacgtagagtttcgcgtcgggttttttagttaagagtcgataaaaataaaggggaaaaatttaaaatttttatttattaagtatagaaaggagaggggcgcggggagagttcgcggggaagaataaaacgagggacgtttttttcggggcgggtattgatttaggtggcggggtcggtttttcggtgtcgcgattttaagggggagggggagattaaaaaataatttagattcgtttaggaggcggggattcgggcggtaggtcggggttcgaggggtcgtgggggtcggattttcgcggtcgcgggttaggagggcgcggcgttcggtcgggttaggttcggggtttagcgtgttttgcgcggggaggagcggtcgtcgtaacgtcgcgttcgaagtttaggttttaggtttcgtcgatcgtttaggtttcgcgagaagagcggcgggtacggcggcggttttaggttcgttcgggtcggttggcgggcggcgttttttaggcgggcgggtattgcggttcggtttaggatggggcgtcgcggtttttgtagatggaatcggtttcggagggaaaaaattaataataggtttcgagattgtttttttaggcggttattcggttgtttttcggttatttagcgttcgtttcgttcggatgggtagtgtcggtcgtagtattcgtttttaatattttcgttattttcggagatcgcggtcgtattttttataatcgtgtattagcggcggtcgcggtcggagtcgagatataataattgacgtcgcgatgaggcggggtcggggcggggtttgtagggtgcgttcgtaggggtcgagggcggggaattcggggagtcgcggggttatcggattatcgaacgaggggcgggaggagaggcggagtcgtagcgtggtcggggttttttcgcggtgtcgaaagttgttttttcgtgtttttgcggcgtggtttttttttttgtttttttaatgtttagtaattgattttgtttgaggattagttt

SEQ ID NO: 25682 - DNA, 1164 bp, Artificial Sequence
  chemically treated genomic DNA (Homo sapiens) CpG-island No: 25682
aaactaatcctcaaacaaaatcaattactaaacattaaaaaaacaaaaaaaaaaaccacgccgcaaaaacacgaaaaaacaactttcgacaccgcgaaaaaaccccgaccacgctacgactccgcctctcctcccgcccctcgttcgataatccgataaccccgcgactccccgaattccccgccctcgacccctacgaacgcaccctacaaaccccgccccgaccccgcctcatcgcgacgtcaattattatatctcgactccgaccgcgaccgccgctaatacacgattataaaaaatacgaccgcgatctccgaaaataacgaaaatattaaaaacgaatactacgaccgacactacccatccgaacgaaacgaacgctaaataaccgaaaaacaaccgaataaccgcctaaaaaaacaatctcgaaacctattattaattttttccctccgaaaccgattccatctacaaaaaccgcgacgccccatcctaaaccgaaccgcaatacccgcccgcctaaaaaacgccgcccgccaaccgacccgaacgaacctaaaaccgccgccgtacccgccgctcttctcgcgaaacctaaacgatcgacgaaacctaaaacctaaacttcgaacgcgacgttacgacgaccgctcctccccgcgcaaaacacgctaaaccccgaacctaacccgaccgaacgccgcgccctcctaacccgcgaccgcgaaaatccgacccccacgacccctcgaaccccgacctaccgcccgaatccccgcctcctaaacgaatctaaattattttttaatctccccctcccccttaaaatcgcgacaccgaaaaaccgaccccgccacctaaatcaatacccgccccgaaaaaaacgtccctcgttttattcttccccgcgaactctccccgcgcccctctcctttctatacttaataaataaaaattttaaatttttcccctttatttttatcgactcttaactaaaaaacccgacgcgaaactctacgtctctacgtccctcgtcgccgcctcgcgcccgcgcgaatcccgtcacctacttccccgccgaaaataaccgaccaataacgacgccgaataacccgcgcgtaaacacgaaaccctcgcccaaactaccaccgaaccgcgaccccc

SEQ ID NO: 25683 - DNA, 1164 bp, Artificial Sequence
  chemically treated genomic DNA (Homo sapiens) CpG-island No: 25683
agattaatttttagataaaattaattgttaaatattggaggggtaaaaggggagattacgtcgtaaaagtacggagaggtaattttcggtatcgcgggaaggtttcgattacgttgcggtttcgttttttttttcgtttttcgttcggtagttcggtagtttcgcggtttttcgaatttttcgttttcggtttttgcgggcgtattttgtaggtttcgtttcggtttcgttttatcgcgacgttagttgttatgtttcggtttcggtcgcggtcgtcgttgatatacggttgtggagggtacggtcgcggttttcggaggtggcgggggtgttggggacgggtgttgcgatcggtattgtttattcgagcgggacgggcgttgagtggtcgggaggtagtcgggtagtcgtttggaggagtagtttcggggtttattattggtttttttttttcgagatcgattttatttgtagagatcgcgacgttttattttgggtcgggtcgtagtgttcgttcgtttgagaggcgtcgttcgttagtcggttcgagcgaatttggagtcgtcgtcgtgttcgtcgtttttttcgcggagtttgggcggtcggcggggtttggggtttgggtttcgggcgcggcgttgcggcggtcgttttttttcgcgtagaatacgttgggtttcgggtttggttcggtcgagcgtcgcgtttttttgattcgcggtcgcgggagttcggtttttacggtttttcgggtttcggtttgtcgttcggattttcgttttttgggcggatttgagttattttttggttttttttttttttttgagatcgcggtatcggagggtcgatttcgttatttgggttagtgttcgtttcgggggaagcgtttttcgttttgttttttttcgcgagtttttttcgcgttttttttttttttgtgtttaatggatgggggttttgagttttttttttttatttttgtcggtttttgattgggaggttcggcgcgaggttttgcgtttttgcgtttttcgtcgtcgtttcgcgttcgcgcggatttcgttatttgttttttcgtcggggatggtcggttagtgacggcgtcgggtggttcgcgcgtggatacggggttttcgtttaagttgttatcgagtcgcggttttt

SEQ ID NO: 25684 - DNA, 1164 bp, Artificial Sequence
  chemically treated genomic DNA (Homo sapiens) CpG-island No: 25684
aaaaaccgcgactcgataacaacttaaacgaaaaccccgtatccacgcgcgaaccacccgacgccgtcactaaccgaccatccccgacgaaaaaacaaataacgaaatccgcgcgaacgcgaaacgacgacgaaaaacgcaaaaacgcaaaacctcgcgccgaacctcccaatcaaaaaccgacaaaaataaaaaaaaaaaactcaaaacccccatccattaaacacaaaaaaaaaaaaaacgcgaaaaaaactcgcgaaaaaaaacaaaacgaaaaacgcttcccccgaaacgaacactaacccaaataacgaaatcgaccctccgataccgcgatctcaaaaaaaaaaaaaaaaccaaaaaataactcaaatccgcccaaaaaacgaaaatccgaacgacaaaccgaaacccgaaaaaccgtaaaaaccgaactcccgcgaccgcgaatcaaaaaaacgcgacgctcgaccgaaccaaacccgaaacccaacgtattctacgcgaaaaaaaacgaccgccgcaacgccgcgcccgaaacccaaaccccaaaccccgccgaccgcccaaactccgcgaaaaaaacgacgaacacgacgacgactccaaattcgctcgaaccgactaacgaacgacgcctctcaaacgaacgaacactacgacccgacccaaaataaaacgtcgcgatctctacaaataaaatcgatctcgaaaaaaaaaaaccaataataaaccccgaaactactcctccaaacgactacccgactacctcccgaccactcaacgcccgtcccgctcgaataaacaataccgatcgcaacacccgtccccaacacccccgccacctccgaaaaccgcgaccgtaccctccacaaccgtatatcaacgacgaccgcgaccgaaaccgaaacataacaactaacgtcgcgataaaacgaaaccgaaacgaaacctacaaaatacgcccgcaaaaaccgaaaacgaaaaattcgaaaaaccgcgaaactaccgaactaccgaacgaaaaacgaaaaaaaaaacgaaaccgcaacgtaatcgaaaccttcccgcgataccgaaaattacctctccgtacttttacgacgtaatctccccttttacccctccaatatttaacaattaattttatctaaaaattaatct

SEQ ID NO: 25685 - DNA, 1370 bp, Artificial Sequence
  chemically treated genomic DNA (Homo sapiens) CpG-island No: 25685
tgtcgtcgtggatttttgattatgtcgttgcgggtttttgcggttttttgttttcgtcgtcgcggttttttgattttggtttcgtcgaatttagtttttgtcgttacggttttttggggttttttgttttcgtcgtcgcggttttttgtcgtcgtagttttttgtatttttttttttttgttttcgtggttttttgtttttgaagttatagttttttgttttcgtcgtcgcggttttttgcgatttttttttttttgttgtcgtagttttttgtttttattatcgcgaatttttttgtcgcggttttttgttatcgtcgtcgtggttttttatggtttttggttttcggtgtcgtggttttttattgtttattgttttcgtcgtcgtaggtttttttcgtcgcggttttttgtttcgtagtttcggttttttgcggttttttgtcgtcgtggtttttggttttcgttattgtggttttttacgttttttcgttttcgtcgtcgtaggtttttttagtcgcggttttttgtttttattgttcgggttttttgtgtcgttttgttttcgtcgtcgcggttttttgttgttatttgtttttgttattatagttttttgttttcgtcgtcgcggttttttgttttttacgtggttttttgttttcgttttcgcggttttttattattttagtcgttttttgttttcgtcgttacgggtttttgtttttgtcgtcgagggtttttgcgtttttatgtttttatcgtcgtggttttttgtcgtttttgttttttgttttttttgacgcggttttttgcggttttttattatttttatcgtggttttttgcggtttttggtatcggacgttatggtttttttaggttttttgttttcgtcgttacggttttttgttgtcgttatatcgtttagtttttatcgcgtttttttgtattcgtagtcgtatttttttgtcgtcgcgattttttatttcgttatcgcggtttttgttttcgttgtcgtggttttttgttttcgatgttgcggttttttatagttttttgttttcgttatcgtagttttttgtttttattatcgcggttttttgttttcgttattatagttttttgttatcgcggttgtttgtttcgattgttatggtttgttgttttcgtcgtcgtggtttgttgtttttgtagttttagtttttttttttatcgtttcggttttttgattttatcgttgcggttttttacgttcgtcgtcgtggttttttgcggttttttgtttttatcgtcgcggttttttgtttttattatcgaggtttttttttcgtcgttgcggttttttgtacgtcgtttttaagtttttattttt

SEQ ID NO: 25686 - DNA, 1370 bp, Artificial Sequence
  chemically treated genomic DNA (Homo sapiens) CpG-island No: 25686
aaaaataaaaacttaaaaacgacgtacaaaaaaccgcaacgacgaaaaaaaaacctcgataataaaaacaaaaaaccgcgacgataaaaacaaaaaaccgcaaaaaaccacgacgacgaacgtaaaaaaccgcaacgataaaatcaaaaaaccgaaacgataaaaaaaaaaactaaaactacaaaaacaacaaaccacgacgacgaaaacaacaaaccataacaatcgaaacaaacaaccgcgataacaaaaaactataataacgaaaacaaaaaaccgcgataataaaaacaaaaaactacgataacgaaaacaaaaaactataaaaaaccgcaacatcgaaaacaaaaaaccacgacaacgaaaacaaaaaccgcgataacgaaataaaaaatcgcgacgacaaaaaaatacgactacgaatacaaaaaaacgcgataaaaactaaacgatataacgacaacaaaaaaccgtaacgacgaaaacaaaaaacctaaaaaaaccataacgtccgataccaaaaaccgcaaaaaaccacgataaaaataataaaaaaccgcaaaaaaccgcgtcaaaaaaaacaaaaaacaaaaacgacaaaaaaccacgacgataaaaacataaaaacgcaaaaaccctcgacgacaaaaacaaaaacccgtaacgacgaaaacaaaaaacgactaaaataataaaaaaccgcgaaaacgaaaacaaaaaaccacgtaaaaaacaaaaaaccgcgacgacgaaaacaaaaaactataataacaaaaacaaataacaacaaaaaaccgcgacgacgaaaacaaaacgacacaaaaaacccgaacaataaaaacaaaaaaccgcgactaaaaaaacctacgacgacgaaaacgaaaaaacgtaaaaaaccacaataacgaaaaccaaaaaccacgacgacaaaaaaccgcaaaaaaccgaaactacgaaacaaaaaaccgcgacgaaaaaaacctacgacgacgaaaacaataaacaataaaaaaccacgacaccgaaaaccaaaaaccataaaaaaccacgacgacgataacaaaaaaccgcgacaaaaaaattcgcgataataaaaacaaaaaactacgacaacaaaaaaaaaaaaatcgcaaaaaaccgcgacgacgaaaacaaaaaactataacttcaaaaacaaaaaaccacgaaaacaaaaaaaaaaaaatacaaaaaactacgacgacaaaaaaccgcgacgacgaaaacaaaaaaccccaaaaaaccgtaacgacaaaaactaaattcgacgaaaccaaaatcaaaaaaccgcgacgacgaaaacaaaaaaccgcaaaaacccgcaacgacataatcaaaaatccacgacgaca

SEQ ID NO: 25687 - DNA, 1370 bp, Artificial Sequence
  chemically treated genomic DNA (Homo sapiens) CpG-island No: 25687
agaagtgaaaatttaaaagcggcgtgtaaaaagtcgtagcggcggggaaaaagtttcggtgatggggataaaaagtcgcggcggtgggagtaaaaagtcgtaaaaagttacggcggcgggcgtaaaaagtcgtaacggtggggttaaaaagtcggggcggtgggggaaaaagttggggttataggggtaataagttacggcggcgggggtaataagttatgatagtcgaggtaaatagtcgcggtgataaaaagttgtggtggcgggggtaaaaagtcgcggtggtgggggtaaaaagttgcggtgacgggggtaaaaagttgtaaaaagtcgtagtatcgggggtagaaagttacgatagcggaggtaaaaatcgcggtggcggggtaagaagtcgcggcggtaaaaagatgcggttgcgggtgtaaaaaggcgcggtgggggttaaacggtgtggcggtagtaaaaagtcgtggcggcgggggtaaaaagtttgaaaaagttatggcgttcggtgttaaaagtcgtaaaaagttacggtggaggtggtaaaaagtcgtaaaaagtcgcgttagagggggtaaaaagtaggggcggtaaaaagttacgacggtggggatatgaaggcgtaaaaattttcggcggtaggagtaaaaattcgtggcggcgggggtaaaaagcggttggggtgataaaaagtcgcggaggcggggataggaagttacgtagggggtaaggagtcgcggcggcgggggtaaaaagttgtggtggtagggataaatagtagtaaaaagtcgcggcggcgggggtaaaacgatataaaaagttcgggtagtgggggtaagaagtcgcggttggaaaaatttgcggcggcgggggcgaaaaggcgtaaaaagttatagtggcgggggttaaaagttacggcggtaaaaagtcgtaaaaagtcggggttgcggggtaggaagtcgcggcgggaaaaatttgcggcggcgggggtaataagtagtaaaaagttacggtatcgggggttaaaagttataaaaagttacggcggcggtgataaaaagtcgcggtagaaaaattcgcggtggtgggggtaaaaagttgcggtagtaggggggaaaaggtcgtaaaaagtcgcggcggcgagggtaaaaagttgtggttttaggggtaaaaagttacggaggtagggggagaaagatgtaaaaagttgcggcggtaaaaagtcgcggcggcgagggtaaagagttttaaaaagtcgtgacggtaggggttaaattcggcgaggttagggttagaaagtcgcggcggcgggggtagaaagtcgtaaaaattcgtagcggtatggttaaaaatttacggcggta

SEQ ID NO: 25688 - DNA, 1370 bp, Artificial Sequence
  chemically treated genomic DNA (Homo sapiens) CpG-island No: 25688
taccgccgtaaatttttaaccataccgctacgaatttttacgactttctacccccgccgccgcgactttctaaccctaacctcgccgaatttaacccctaccgtcacgactttttaaaactctttaccctcgccgccgcgactttttaccgccgcaactttttacatctttctccccctacctccgtaactttttacccctaaaaccacaactttttaccctcgccgccgcgactttttacgaccttttcccccctactaccgcaactttttacccccaccaccgcgaatttttctaccgcgactttttatcaccgccgccgtaactttttataacttttaacccccgataccgtaactttttactacttattacccccgccgccgcaaatttttcccgccgcgacttcctaccccgcaaccccgactttttacgactttttaccgccgtaacttttaacccccgccactataactttttacgccttttcgcccccgccgccgcaaatttttccaaccgcgacttcttacccccactacccgaactttttatatcgttttacccccgccgccgcgactttttactactatttatccctaccaccacaactttttacccccgccgccgcgactccttaccccctacgtaacttcctatccccgcctccgcgactttttatcaccccaaccgctttttacccccgccgccacgaatttttactcctaccgccgaaaatttttacgccttcatatccccaccgtcgtaactttttaccgcccctactttttaccccctctaacgcgactttttacgactttttaccacctccaccgtaactttttacgacttttaacaccgaacgccataactttttcaaactttttacccccgccgccacgactttttactaccgccacaccgtttaacccccaccgcgcctttttacacccgcaaccgcatctttttaccgccgcgacttcttaccccgccaccgcgatttttacctccgctatcgtaactttctacccccgatactacgactttttacaactttttacccccgtcaccgcaactttttacccccaccaccgcgactttttacccccgccaccacaactttttatcaccgcgactatttacctcgactatcataacttattacccccgccgccgtaacttattacccctataaccccaactttttcccccaccgccccgactttttaaccccaccgttacgactttttacgcccgccgccgtaactttttacgactttttactcccaccgccgcgactttttatccccatcaccgaaactttttccccgccgctacgactttttacacgccgcttttaaattttcacttct

SEQ ID NO: 25689 - DNA, 647 bp, Artificial Sequence
  chemically treated genomic DNA (Homo sapiens) CpG-island No: 25689
taagagggtaaggggtaggggatacgaagggcggcgatagcgaacgaacggcgagtcggcggatataaaagtttagattacgggacgtgattatagagataagcgaggggggagcgaggaggggggaaggggacgcgtgcgggggggagaaagaggaaatacgaagaggagggagaaaaggaggaaaaaacgagcggagagggagagcggagaagggaggagaggagagggtaggaaaggggtaagagcggtaaaaggcgaaagataaggatagtagaagaggggggggcgggggggcgaggacggggggataggggaggggggagtcgggcgacgagggacgggtacgaaaaagggaaaagtagagggaaggggggagtaagttaagaaaaaaagggcgggaagaagaatagggggagaggagcggggagagcggaaggcgggggagggggggagaaagaagagacgagtaaggcggggggaggtagagaggaggaaaaaaaataaagaagcgggggggggcgaaaatacgggacgagacggggaggcggcgtttagcggaggggcggaagggtcgtttaaaaaaaaaggaggaaaataaaagaaaaagagggtagcggcgcgatttttttgaattgataatataa

SEQ ID NO: 25690 - DNA, 647 bp, Artificial Sequence
  chemically treated genomic DNA (Homo sapiens) CpG-island No: 25690
ttatattatcaattcaaaaaaatcgcgccgctaccctctttttcttttattttcctcctttttttttaaacgacccttccgcccctccgctaaacgccgcctccccgtctcgtcccgtattttcgcccccccccgcttctttattttttttcctcctctctacctccccccgccttactcgtctcttctttctccccccctcccccgccttccgctctccccgctcctctccccctattcttcttcccgccctttttttcttaacttactccccccttccctctacttttccctttttcgtacccgtccctcgtcgcccgactcccccctcccctatccccccgtcctcgcccccccgcccccccctcttctactatccttatctttcgccttttaccgctcttacccctttcctaccctctcctctcctcccttctccgctctccctctccgctcgttttttcctccttttctccctcctcttcgtatttcctctttctcccccccgcacgcgtccccttcccccctcctcgctcccccctcgcttatctctataatcacgtcccgtaatctaaacttttatatccgccgactcgccgttcgttcgctatcgccgcccttcgtatcccctaccccttaccctctta

SEQ ID NO: 25691 - DNA, 647 bp, Artificial Sequence
  chemically treated genomic DNA (Homo sapiens) CpG-island No: 25691
ttgtattgttaatttaaaaagatcgcgtcgttgtttttttttttttttgttttttttttttttttttgggcggttttttcgttttttcgttgggcgtcgttttttcgtttcgtttcgtgttttcgttttttttcgtttttttgttttttttttttttttttgttttttttcgttttgttcgttttttttttttttttttttttttcgtttttcgtttttttcgtttttttttttttgttttttttttcgtttttttttttttggtttgttttttttttttttttgtttttttttttttcgtgttcgtttttcgtcgttcggttttttttttttttgttttttcgttttcgttttttcgttttttttttttttgttgtttttgtttttcgttttttgtcgtttttgttttttttttgttttttttttttttttttttttcgtttttttttttcgttcgtttttttttttttttttttttttttttcgtgttttttttttttttttttcgtacgcgtttttttttttttttttcgtttttttttcgtttgtttttgtggttacgtttcgtggtttgggtttttgtattcgtcggttcgtcgttcgttcgttgtcgtcgtttttcgtgttttttgttttttgtttttttg

SEQ ID NO: 25692 - DNA, 647 bp, Artificial Sequence
  chemically treated genomic DNA (Homo sapiens) CpG-island No: 25692
caaaaaaacaaaaaacaaaaaacacgaaaaacgacgacaacgaacgaacgacgaaccgacgaatacaaaaacccaaaccacgaaacgtaaccacaaaaacaaacgaaaaaaaaacgaaaaaaaaaaaaaaaaacgcgtacgaaaaaaaaaaaaaaaaaacacgaaaaaaaaaaaaaaaaaaaaaaaaaaacgaacgaaaaaaaaaaacgaaaaaaaaaaaaaaaaaaaaaacaaaaaaaaaacaaaaacgacaaaaaacgaaaaacaaaaacaacaaaaaaaaaaaaaacgaaaaaacgaaaacgaaaaaacaaaaaaaaaaaaaaccgaacgacgaaaaacgaacacgaaaaaaaaaaaaacaaaaaaaaaaaaaaaacaaaccaaaaaaaaaaaaacgaaaaaaaaaacaaaaaaaaaaaaacgaaaaaaacgaaaaacgaaaaaaaaaaaaaaaaaaaaaaaacgaacaaaacgaaaaaaaacaaaaaaaaaaaaaaaaaacaaaaaaacgaaaaaaaacgaaaacacgaaacgaaacgaaaaaacgacgcccaacgaaaaaacgaaaaaaccgcccaaaaaaaaaaaaaaaaaacaaaaaaaaaaaaaaacaacgacgcgatctttttaaattaacaatacaa

SEQ ID NO: 25693 - DNA, 511 bp, Artificial Sequence
  chemically treated genomic DNA (Homo sapiens) CpG-island No: 25693
ttcgattcgaaatacgttcgaggtatttattttaaaaaacgataaggttcgggcgtttagtagaacggttcggttcgatcgcgcgtagtttgtaggtaggggggtgtgtaggttatcgtttatttcggcgagtagagtcgcggagggcgttacgtcggtgacgttatggttcgagcggggcgggatttttttgtattttcggaagttttcgcgggtagttggggaggaaaacgcggttacgcgttcggggggttcggttcgggaagggtagtgcgcgcgtatgcgttggggcggggcgtttgggatttgcgttttaggtttagcgcgtcgttagtcggagtgttcggcgttcgtcgaaaggtttttgcgtcggtttaggattcgtatttagtacgttgcggagttttagttcgtagtatttttttatttatcgtttttggttgttttttttttgagtttgcggggcggggtcgtttttgttttttataaaaatgtatgtaaaggtatttcg

SEQ ID NO: 25694 - DNA, 511 bp, Artificial Sequence
  chemically treated genomic DNA (Homo sapiens) CpG-island No: 25694
cgaaatacctttacatacatttttataaaaaacaaaaacgaccccgccccgcaaactcaaaaaaaaaacaaccaaaaacgataaataaaaaaatactacgaactaaaactccgcaacgtactaaatacgaatcctaaaccgacgcaaaaacctttcgacgaacgccgaacactccgactaacgacgcgctaaacctaaaacgcaaatcccaaacgccccgccccaacgcatacgcgcgcactacccttcccgaaccgaaccccccgaacgcgtaaccgcgttttcctccccaactacccgcgaaaacttccgaaaatacaaaaaaatcccgccccgctcgaaccataacgtcaccgacgtaacgccctccgcgactctactcgccgaaataaacgataacctacacacccccctacctacaaactacgcgcgatcgaaccgaaccgttctactaaacgcccgaaccttatcgttttttaaaataaatacctcgaacgtatttcgaatcgaa

SEQ ID NO: 25695 - DNA, 511 bp, Artificial Sequence
  chemically treated genomic DNA (Homo sapiens) CpG-island No: 25695
cgaaatatttttatatatatttttgtaaaaaataaaaacgatttcgtttcgtagatttaggagaaaagtagttaggagcggtgggtgggagggtgttgcgagttggggtttcgtagcgtattgggtgcgggttttgaatcggcgtaggggtttttcgacgggcgtcgggtatttcggttggcggcgcgttgggtttggggcgtaggttttaggcgtttcgttttaacgtatgcgcgcgtattgtttttttcgagtcgggtttttcgagcgcgtggtcgcgtttttttttttagttgttcgcgggggttttcgggggtataggaaggtttcgtttcgttcgggttatgacgttatcgacgtggcgtttttcgcggttttgttcgtcggggtgggcggtgatttgtatatttttttgtttgtaagttgcgcgcggtcgagtcgggtcgttttgttgggcgttcggattttgtcgttttttaggataaatgtttcgggcgtatttcgggtcgag

SEQ ID NO: 25696 - DNA, 511 bp, Artificial Sequence
  chemically treated genomic DNA (Homo sapiens) CpG-island No: 25696
ctcgacccgaaatacgcccgaaacatttatcctaaaaaacgacaaaatccgaacgcccaacaaaacgacccgactcgaccgcgcgcaacttacaaacaaaaaaatatacaaatcaccgcccaccccgacgaacaaaaccgcgaaaaacgccacgtcgataacgtcataacccgaacgaaacgaaaccttcctatacccccgaaaacccccgcgaacaactaaaaaaaaaaacgcgaccacgcgctcgaaaaacccgactcgaaaaaaacaatacgcgcgcatacgttaaaacgaaacgcctaaaacctacgccccaaacccaacgcgccgccaaccgaaatacccgacgcccgtcgaaaaacccctacgccgattcaaaacccgcacccaatacgctacgaaaccccaactcgcaacaccctcccacccaccgctcctaactacttttctcctaaatctacgaaacgaaatcgtttttattttttacaaaaatatatataaaaatatttcg

SEQ ID NO: 25697 - DNA, 581 bp, Artificial Sequence
  chemically treated genomic DNA (Homo sapiens) CpG-island No: 25697
aaggtttcggtcgattcgttttcggcgtcgttagggtatatttttattgggcgtcgttttttgtttatcggtttgttttagcggaagtgttttatggagtaggagcgtttgttttcgcgcgggttcggtttggtattatcgttgcggggttcggggtcgtttttaggtagcgggtcgtagttttcgttcgttgagacgttttcgcgtttttgttttgcgtcgttgttgtcgttgttgttgttgttgcggcggtcgaatcggttttagcggaagtggtttatgacgtattttcgggggttttcggttagaggttgttcgtcgttatttttcgggaatatgggagtttcggtcgagaggtcgggtttgtaggttcggatgtatttttgggggaagacgcgagggtatgagggtagttcgtgtttcgtatttcggttcggttgtcgcgttcgttattgcgtttaggttttggtcgttttcgttacgtgtcgaggatatagggtatagtgtcgggcgtgttaagcgtcgaggtttttttatagagtaggtttgtttatttgtttttttggtattcgtgggtattt

SEQ ID NO: 25698 - DNA, 581 bp, Artificial Sequence
  chemically treated genomic DNA (Homo sapiens) CpG-island No: 25698
aaatacccacgaataccaaaaaaacaaataaacaaacctactctataaaaaaacctcgacgcttaacacgcccgacactataccctatatcctcgacacgtaacgaaaacgaccaaaacctaaacgcaataacgaacgcgacaaccgaaccgaaatacgaaacacgaactaccctcataccctcgcgtcttcccccaaaaatacatccgaacctacaaacccgacctctcgaccgaaactcccatattcccgaaaaataacgacgaacaacctctaaccgaaaacccccgaaaatacgtcataaaccacttccgctaaaaccgattcgaccgccgcaacaacaacaacaacgacaacaacgacgcaaaacaaaaacgcgaaaacgtctcaacgaacgaaaactacgacccgctacctaaaaacgaccccgaaccccgcaacgataataccaaaccgaacccgcgcgaaaacaaacgctcctactccataaaacacttccgctaaaacaaaccgataaacaaaaaacgacgcccaataaaaatataccctaacgacgccgaaaacgaatcgaccgaaacctt

SEQ ID NO: 25699 - DNA, 581 bp, Artificial Sequence
  chemically treated genomic DNA (Homo sapiens) CpG-island No: 25699
agatgtttacgagtgttaagaaagtaggtgggtagatttgttttgtagggaggtttcgacgtttgatacgttcgatattgtgttttgtgttttcggtacgtggcgagggcggttagggtttaggcgtagtgacgggcgcggtagtcgggtcggggtgcggggtacgggttgtttttatgttttcgcgtttttttttaggagtgtattcgggtttgtaagttcgatttttcggtcgagatttttatgttttcgggaaatggcgacgagtagtttttgatcgagaattttcggaagtacgttatgggttattttcgttgggatcgattcggtcgtcgtaatagtagtagtagcggtagtagcggcgtagggtagaagcgcgaggacgttttagcgggcgaagattgcggttcgttgtttgagggcggtttcgagtttcgtagcgatggtgttaagtcgggttcgcgcgagggtaagcgtttttattttatggagtattttcgttggggtaagtcggtgggtaagaagcggcgtttagtgaaggtgtattttaacggcgtcgaggacgagtcggtcgaggtttt

SEQ ID NO: 25700 - DNA, 581 bp, Artificial Sequence
  chemically treated genomic DNA (Homo sapiens) CpG-island No: 25700
aaaacctcgaccgactcgtcctcgacgccgttaaaatacaccttcactaaacgccgcttcttacccaccgacttaccccaacgaaaatactccataaaataaaaacgcttaccctcgcgcgaacccgacttaacaccatcgctacgaaactcgaaaccgccctcaaacaacgaaccgcaatcttcgcccgctaaaacgtcctcgcgcttctaccctacgccgctactaccgctactactactattacgacgaccgaatcgatcccaacgaaaataacccataacgtacttccgaaaattctcgatcaaaaactactcgtcgccatttcccgaaaacataaaaatctcgaccgaaaaatcgaacttacaaacccgaatacactcctaaaaaaaaacgcgaaaacataaaaacaacccgtaccccgcaccccgacccgactaccgcgcccgtcactacgcctaaaccctaaccgccctcgccacgtaccgaaaacacaaaacacaatatcgaacgtatcaaacgtcgaaacctccctacaaaacaaatctacccacctactttcttaacactcgtaaacatct

SEQ ID NO: 25701 - DNA, 594 bp, Artificial Sequence
  chemically treated genomic DNA (Homo sapiens) CpG-island No: 25701
ggaacggatagttcggcgtttttcgaagcggcgcgtagttgtcggggcgagggggagaaagggagagagggagggggagggcgggcgaacgggagagttagagatttttcggcgttgagcggcggcggttcgggtagttttacgtttttgtttcgcgcgtcgttcgcgttatgaagtatatttcggttttcgaggacgggtcgtggaagatcgtgtgcgtgaaggagttgaacggttttaagaagtttaagcggaaaggtaaggagttggcgcgcgtcgaattagttataaaatttttcgattggatttggaagtattcgaatttcgcgtcgtagttattaataggttgcgggataggatttatcggttgtagggatttcggtatcggtagtcgtgttagttttagtggcgtcggtcgtttttttaagagggttacggatatagtcggggagcgcgggggttttcgggcgttcgaggttttcgacgcgcggaaacgtgtttcgttttagagttagtggggttaggattttttacgtcgtcgtcgtcgtcgttttttgcgttttagagttaggtatttgggggttagaggatagt

SEQ ID NO: 25702 - DNA, 594 bp, Artificial Sequence
  chemically treated genomic DNA (Homo sapiens) CpG-island No: 25702
actatcctctaacccccaaatacctaactctaaaacgcaaaaaacgacgacgacgacgacgtaaaaaatcctaaccccactaactctaaaacgaaacacgtttccgcgcgtcgaaaacctcgaacgcccgaaaacccccgcgctccccgactatatccgtaaccctcttaaaaaaacgaccgacgccactaaaactaacacgactaccgataccgaaatccctacaaccgataaatcctatcccgcaacctattaataactacgacgcgaaattcgaatacttccaaatccaatcgaaaaattttataactaattcgacgcgcgccaactccttacctttccgcttaaacttcttaaaaccgttcaactccttcacgcacacgatcttccacgacccgtcctcgaaaaccgaaatatacttcataacgcgaacgacgcgcgaaacaaaaacgtaaaactacccgaaccgccgccgctcaacgccgaaaaatctctaactctcccgttcgcccgccctccccctccctctctccctttctccccctcgccccgacaactacgcgccgcttcgaaaaacgccgaactatccgttcc

SEQ ID NO: 25703 - DNA, 594 bp, Artificial Sequence
  chemically treated genomic DNA (Homo sapiens) CpG-island No: 25703
gttgttttttggtttttaggtgtttggttttggggcgtaggaggcggcggcggcggcggcgtggggagttttggttttattggttttagggcgaagtacgttttcgcgcgtcggagatttcgggcgttcgagagttttcgcgtttttcggttgtgttcgtgatttttttgggggaacggtcggcgttattgggattggtacggttatcggtatcgggatttttgtagtcgatgagttttgtttcgtagtttgttggtggttacggcgcggggttcgggtgtttttaagtttagtcggaaagttttatagttagttcggcgcgcgttagttttttgttttttcgtttgagttttttaaggtcgtttagtttttttacgtatacggttttttacggttcgttttcgaggatcgggatgtgttttatgacgcgggcggcgcgcgaggtaggggcgtggggttgttcgggtcgtcgtcgtttagcgtcgaggagtttttggttttttcgttcgttcgttttttttttttttttttttttttttttttttcgtttcggtagttgcgcgtcgtttcgggaagcgtcgggttgttcgtttt

SEQ ID NO: 25704 - DNA, 594 bp, Artificial Sequence
  chemically treated genomic DNA (Homo sapiens) CpG-island No: 25704
aaaacgaacaacccgacgcttcccgaaacgacgcgcaactaccgaaacgaaaaaaaaaaaaaaaaaaaaaaaaaaaaaaaacgaacgaacgaaaaaaccaaaaactcctcgacgctaaacgacgacgacccgaacaaccccacgcccctacctcgcgcgccgcccgcgtcataaaacacatcccgatcctcgaaaacgaaccgtaaaaaaccgtatacgtaaaaaaactaaacgaccttaaaaaactcaaacgaaaaaacaaaaaactaacgcgcgccgaactaactataaaactttccgactaaacttaaaaacacccgaaccccgcgccgtaaccaccaacaaactacgaaacaaaactcatcgactacaaaaatcccgataccgataaccgtaccaatcccaataacgccgaccgttcccccaaaaaaatcacgaacacaaccgaaaaacgcgaaaactctcgaacgcccgaaatctccgacgcgcgaaaacgtacttcgccctaaaaccaataaaaccaaaactccccacgccgccgccgccgccgcctcctacgccccaaaaccaaacacctaaaaaccaaaaaacaac

SEQ ID NO: 25705 - DNA, 698 bp, Artificial Sequence
  chemically treated genomic DNA (Homo sapiens) CpG-island No: 25705
gtttgcgcggtatttttaggtaatacgggcggtgcggcggtagtattcgggggtttacggcggcgcggcgtttaagaggttttagtagtcgaagggaaatcggcgcgtttttcgttcgtttaggcgttagttgatgggttgtttgtcgaggaggtcgtagtagtcgtcgcgcgaatatggcggtcgaaatttattttaggtcgtagagtagtcgttcggtgttgttgagtaagatcgaggggtattaggacgtcgttacggcgcgttgtttatttttaaggaggacggcgtgattacggttagcgaggataggtagggttcgggcgtacgcggtttcgaatttcgcgacgacggggtgtgggggcggtggggttcgcggtttcggttttttttgcgtgagggggttttttcggtagtacggttttatttttattttgcgttttttagtttcgtcgggttttcgtttttttttcgtcggttttttagtttcgatttgtatttttttagtttgggatttcggtttcgtcgcgtttttttagttcggattttttgttttatcgcgtttttttagttcgggaatttcgttttatcgcgtcgtttaagttcgggatttttgttttaacgtgtttttttagtttaggatttttgttttagtgcgttttatcgcgttttttttagtttatttcgttttttttgtt

SEQ ID NO: 25706 - DNA, 698 bp, Artificial Sequence
  chemically treated genomic DNA (Homo sapiens) CpG-island No: 25706
aacaaaaaaaacgaaataaactaaaaaaaacgcgataaaacgcactaaaacaaaaatcctaaactaaaaaaacacgttaaaacaaaaatcccgaacttaaacgacgcgataaaacgaaattcccgaactaaaaaaacgcgataaaacaaaaaatccgaactaaaaaaacgcgacgaaaccgaaatcccaaactaaaaaaatacaaatcgaaactaaaaaaccgacgaaaaaaaaacgaaaacccgacgaaactaaaaaacgcaaaataaaaataaaaccgtactaccgaaaaaaccccctcacgcaaaaaaaaccgaaaccgcgaaccccaccgcccccacaccccgtcgtcgcgaaattcgaaaccgcgtacgcccgaaccctacctatcctcgctaaccgtaatcacgccgtcctccttaaaaataaacaacgcgccgtaacgacgtcctaatacccctcgatcttactcaacaacaccgaacgactactctacgacctaaaataaatttcgaccgccatattcgcgcgacgactactacgacctcctcgacaaacaacccatcaactaacgcctaaacgaacgaaaaacgcgccgatttcccttcgactactaaaacctcttaaacgccgcgccgccgtaaacccccgaatactaccgccgcaccgcccgtattacctaaaaataccgcgcaaac

SEQ ID NO: 25707 - DNA, 698 bp, Artificial Sequence
  chemically treated genomic DNA (Homo sapiens) CpG-island No: 25707
agtaggaggggcgaggtgggttgggaggggcgcggtagggcgtattggaataggggttttgggttggaaagatacgttggaataagggtttcgggtttgggcggcgcggtgagacggagttttcgggttggaggggcgcggtgggataggggattcgggttggaggggcgcggcgagatcggggttttaggttggaaaggtgtaagtcgaggttggaggatcggcgggagggaaacgggaattcggcggagttaaggggcgtagagtgggggtggggtcgtgttgtcgggggagtttttttacgtaggaaggatcggggtcgcggattttatcgtttttatatttcgtcgtcgcggagttcgggatcgcgtgcgttcgggttttatttgttttcgttggtcgtgattacgtcgttttttttggggatgagtagcgcgtcgtgacggcgttttggtgtttttcgattttgtttagtagtatcgggcggttgttttgcggtttggagtggatttcggtcgttatgttcgcgcggcgattgttgcggttttttcggtaggtagtttattagttgacgtttgggcgggcgggggacgcgtcggttttttttcggttgttggggttttttgggcgtcgcgtcgtcgtaagttttcgagtgttgtcgtcgtatcgttcgtattgtttggggatgtcgcgtaagt

SEQ ID NO: 25708 - DNA, 698 bp, Artificial Sequence
  chemically treated genomic DNA (Homo sapiens) CpG-island No: 25708
acttacgcgacatccccaaacaatacgaacgatacgacgacaacactcgaaaacttacgacgacgcgacgcccaaaaaaccccaacaaccgaaaaaaaaccgacgcgtcccccgcccgcccaaacgtcaactaataaactacctaccgaaaaaaccgcaacaatcgccgcgcgaacataacgaccgaaatccactccaaaccgcaaaacaaccgcccgatactactaaacaaaatcgaaaaacaccaaaacgccgtcacgacgcgctactcatccccaaaaaaaacgacgtaatcacgaccaacgaaaacaaataaaacccgaacgcacgcgatcccgaactccgcgacgacgaaatataaaaacgataaaatccgcgaccccgatccttcctacgtaaaaaaactcccccgacaacacgaccccacccccactctacgccccttaactccgccgaattcccgtttccctcccgccgatcctccaacctcgacttacacctttccaacctaaaaccccgatctcgccgcgcccctccaacccgaatcccctatcccaccgcgcccctccaacccgaaaactccgtctcaccgcgccgcccaaacccgaaacccttattccaacgtatctttccaacccaaaacccctattccaatacgccctaccgcgcccctcccaacccacctcgcccctcctact

SEQ ID NO: 25709 - DNA, 593 bp, Artificial Sequence
  chemically treated genomic DNA (Homo sapiens) CpG-island No: 25709
cgcgtttttttagttcgggatttttgttttattgcgttcgtttatttcgggagtttcgttttatcgcgtttttttagttcggattttttgttttattgcgtttttttagttcgggaattttgttttatcgcgttatttaagttcgggatttcggttttagtgcgttttaacgtatttttttagtttaggatttttgttttatcgcgtttttttagcgcgggaattttgttttatcgcgttgtttaagtcggggatttttgttttagtgcgtattaacgcgttttttttagtttatcgcgtttttttaattagggaatttcgatttgcggtgtcgtattagtttgggattttcgtttcggtttttttttttggcggggtttagtttggtattcggaaggtgttttttggttttttcgggttagttttaaatcgttttttttggaagcgtggaggatcggcggttggttattgcggattttggtgttcggggtttgtttttttgcgaggaattttagtcgttttcgttttttttttttttttgtatttagggattttacgttacgttaggtttttagattagttatttttgttat

SEQ ID NO: 25710 - DNA, 593 bp, Artificial Sequence
  chemically treated genomic DNA (Homo sapiens) CpG-island No: 25710
ataacaaaaataactaatctaaaaacctaacgtaacgtaaaatccctaaatacaaaaaaaaaaaaaaaacgaaaacgactaaaattcctcgcaaaaaaacaaaccccgaacaccaaaatccgcaataaccaaccgccgatcctccacgcttccaaaaaaaacgatttaaaactaacccgaaaaaaccaaaaaacaccttccgaataccaaactaaaccccgccaaaaaaaaaaaccgaaacgaaaatcccaaactaatacgacaccgcaaatcgaaattccctaattaaaaaaacgcgataaactaaaaaaaacgcgttaatacgcactaaaacaaaaatccccgacttaaacaacgcgataaaacaaaattcccgcgctaaaaaaacgcgataaaacaaaaatcctaaactaaaaaaatacgttaaaacgcactaaaaccgaaatcccgaacttaaataacgcgataaaacaaaattcccgaactaaaaaaacgcaataaaacaaaaaatccgaactaaaaaaacgcgataaaacgaaactcccgaaataaacgaacgcaataaaacaaaaatcccgaactaaaaaaacgcg

SEQ ID NO: 25711 - DNA, 593 bp, Artificial Sequence
  chemically treated genomic DNA (Homo sapiens) CpG-island No: 25711
gtggtaaaaataattgatttagaggtttggcgtggcgtgaaatttttgagtatagggggaggaagagagcgaaggcggttggagtttttcgtaaagaagtaagtttcgggtattagggttcgtagtgattagtcgtcggttttttacgtttttagaggagacgatttggaattgattcgggagggttaagaaatatttttcgagtattaggttaaatttcgttagggagagagatcgggacgaaggttttaggttagtgcgatatcgtaggtcggggttttttggttggaggagcgcggtgggttgggaggggcgcgttggtgcgtattggaataggggttttcggtttgagtagcgcggtgagatagagttttcgcgttggaggggcgcggtgagatagaggttttgggttggagaggtgcgttggggcgtattggaatcggggtttcgggtttgagtggcgcggtgggatagagttttcgggttggaggggcgtagtgggatagaagattcgggttagaggggcgcggtgggacggagttttcgggatggacgggcgtagtgggataagggtttcggattggaggggcgcg

SEQ ID NO: 25712 - DNA, 593 bp, Artificial Sequence
  chemically treated genomic DNA (Homo sapiens) CpG-island No: 25712
cgcgcccctccaatccgaaacccttatcccactacgcccgtccatcccgaaaactccgtcccaccgcgcccctctaacccgaatcttctatcccactacgcccctccaacccgaaaactctatcccaccgcgccactcaaacccgaaaccccgattccaatacgccccaacgcacctctccaacccaaaacctctatctcaccgcgcccctccaacgcgaaaactctatctcaccgcgctactcaaaccgaaaacccctattccaatacgcaccaacgcgcccctcccaacccaccgcgctcctccaaccaaaaaaccccgacctacgatatcgcactaacctaaaaccttcgtcccgatctctctccctaacgaaatttaacctaatactcgaaaaatatttcttaaccctcccgaatcaattccaaatcgtctcctctaaaaacgtaaaaaaccgacgactaatcactacgaaccctaatacccgaaacttacttctttacgaaaaactccaaccgccttcgctctcttcctccccctatactcaaaaatttcacgccacgccaaacctctaaatcaattatttttaccac

SEQ ID NO: 25713 - DNA, 1058 bp, Artificial Sequence
  chemically treated genomic DNA (Homo sapiens) CpG-island No: 25713
tagggacgcggtacgagttttggtatttttttcgttattttatatatttttattcgggagatttacgtgtagttgggttcgggttggcgtcgtatttcggggtttgcgcgttttttcggcgcgtttcgggcgtagttttacgatacggatttttggcggggcggtattcgagaagtcgtaggcggagagggggcgttttggaggtcgggcgcggggacgttgcggttcgcggttatataaaggaggcggcgggaaggcggggtaaggcgggtcgggggcgggggcggtaggaaggggcgggggtcgcgcggcgtcgtcgataaagttttcgtcgtcgcggtagttagtttgcgttgtggggttgttcgggttgcgcggcgtttgtaggcgttatcgttgttttttttcggttgtgatttttttcgtcgtcgtcgtttggttgcgtttttcgatttttcgcgtcgtcgagattaggttttcgtttcggttgcggtcgtatcgtttttcgcggtcgttttttggggatttagcgagcgcggtgagtataggttgcgcggtgagtttcgggcgcggtcggcgttgtttcggcgggggacgttttttcgggcgttcgcgtttatcggttttgttttttgattttgcgtcggtcgggaagttgcggggttagcgggattttggggcgtcgacgtcggggagtagagaatttttttagtttttcgcgggtcgttttggtcggggttgggtgttcgtcgggtatttcggtttcgttcgtcgggagtttcgagcgggattcgggtagggtaaggcggggcgtttcggggtggcgtttagtgatattcgtagttgggagtatcggggtcggcgtggtttttgttcggttattcgagtcggttttgattttgaatttgaggtttttagttgttcgtcggtaatttttatttcggatttaggttgcgcgtcgtcggatggggagagattggcgtatttttatttgttatttttgtttgggtagaggaggtgacgcgcggtgtggggaaagtttttaatttggtttttgg

SEQ ID NO: 25714 - DNA, 1058 bp, Artificial Sequence
  chemically treated genomic DNA (Homo sapiens) CpG-island No: 25714
ccaaaaaccaaattaaaaactttccccacaccgcgcgtcacctcctctacccaaacaaaaataacaaataaaaatacgccaatctctccccatccgacgacgcgcaacctaaatccgaaataaaaattaccgacgaacaactaaaaacctcaaattcaaaatcaaaaccgactcgaataaccgaacaaaaaccacgccgaccccgatactcccaactacgaatatcactaaacgccaccccgaaacgccccgccttaccctacccgaatcccgctcgaaactcccgacgaacgaaaccgaaatacccgacgaacacccaaccccgaccaaaacgacccgcgaaaaactaaaaaaattctctactccccgacgtcgacgccccaaaatcccgctaaccccgcaacttcccgaccgacgcaaaatcaaaaaacaaaaccgataaacgcgaacgcccgaaaaaacgtcccccgccgaaacaacgccgaccgcgcccgaaactcaccgcgcaacctatactcaccgcgctcgctaaatccccaaaaaacgaccgcgaaaaacgatacgaccgcaaccgaaacgaaaacctaatctcgacgacgcgaaaaatcgaaaaacgcaaccaaacgacgacgacgaaaaaaatcacaaccgaaaaaaaacaacgataacgcctacaaacgccgcgcaacccgaacaaccccacaacgcaaactaactaccgcgacgacgaaaactttatcgacgacgccgcgcgacccccgccccttcctaccgcccccgcccccgacccgccttaccccgccttcccgccgcctcctttatataaccgcgaaccgcaacgtccccgcgcccgacctccaaaacgccccctctccgcctacgacttctcgaataccgccccgccaaaaatccgtatcgtaaaactacgcccgaaacgcgccgaaaaaacgcgcaaaccccgaaatacgacgccaacccgaacccaactacacgtaaatctcccgaataaaaatatataaaataacgaaaaaaataccaaaactcgtaccgcgtcccta

SEQ ID NO: 25715 - DNA, 1058 bp, Artificial Sequence
  chemically treated genomic DNA (Homo sapiens) CpG-island No: 25715
ttagaggttaagttaaaggttttttttatatcgcgcgttattttttttgtttaggtagaggtaataagtaagagtgcgttagtttttttttattcggcggcgcgtagtttaagttcggggtaggggttgtcggcgagtagttggaaattttaggtttagggttagggtcggttcggatggtcgggtaggagttacgtcggtttcggtgtttttagttgcgggtattattggacgttatttcggggcgtttcgttttgttttgttcgggtttcgttcggggttttcggcgggcgggatcgggatgttcggcgagtatttagtttcggttaaggcggttcgcgggaggttgagaaagttttttgtttttcgacgtcggcgttttagggtttcgttggtttcgtagtttttcggtcggcgtaaggttagggagtagggtcggtgggcgcggacgttcggggaagcgtttttcgtcgaggtagcgtcggtcgcgttcgggatttatcgcgtagtttgtatttatcgcgttcgttggatttttagggggcggtcgcggagggcggtgcggtcgtaatcggagcgggagtttggtttcggcggcgcggggagtcggaggacgtagttaagcggcggcggcgaggagggttatagtcggaaagaggtagcggtggcgtttgtagacgtcgcgtagttcgggtagttttatagcgtaagttggttgtcgcggcggcgggggttttatcggcggcgtcgcgcggttttcgtttttttttgtcgttttcgttttcggttcgttttgtttcgttttttcgtcgttttttttgtgtggtcgcgggtcgtagcgttttcgcgttcggtttttaggacgtttttttttcgtttgcgatttttcggatgtcgtttcgttaggggttcgtgtcgtggggttgcgttcggaacgcgtcggggagacgcgtagatttcgaggtgcggcgttagttcgggtttagttgtacgtgggtttttcggatgggggtgtgtgaggtggcggggggaatattagggttcgtatcgcgtttttg

SEQ ID NO: 25716 - DNA, 1058 bp, Artificial Sequence
  chemically treated genomic DNA (Homo sapiens) CpG-island No: 25716
caaaaacgcgatacgaaccctaatattccccccgccacctcacacacccccatccgaaaaacccacgtacaactaaacccgaactaacgccgcacctcgaaatctacgcgtctccccgacgcgttccgaacgcaaccccacgacacgaacccctaacgaaacgacatccgaaaaatcgcaaacgaaaaaaaaacgtcctaaaaaccgaacgcgaaaacgctacgacccgcgaccacacaaaaaaaacgacgaaaaaacgaaacaaaacgaaccgaaaacgaaaacgacaaaaaaaaacgaaaaccgcgcgacgccgccgataaaacccccgccgccgcgacaaccaacttacgctataaaactacccgaactacgcgacgtctacaaacgccaccgctacctctttccgactataaccctcctcgccgccgccgcttaactacgtcctccgactccccgcgccgccgaaaccaaactcccgctccgattacgaccgcaccgccctccgcgaccgccccctaaaaatccaacgaacgcgataaatacaaactacgcgataaatcccgaacgcgaccgacgctacctcgacgaaaaacgcttccccgaacgtccgcgcccaccgaccctactccctaaccttacgccgaccgaaaaactacgaaaccaacgaaaccctaaaacgccgacgtcgaaaaacaaaaaactttctcaacctcccgcgaaccgccttaaccgaaactaaatactcgccgaacatcccgatcccgcccgccgaaaaccccgaacgaaacccgaacaaaacaaaacgaaacgccccgaaataacgtccaataatacccgcaactaaaaacaccgaaaccgacgtaactcctacccgaccatccgaaccgaccctaaccctaaacctaaaatttccaactactcgccgacaacccctaccccgaacttaaactacgcgccgccgaataaaaaaaaactaacgcactcttacttattacctctacctaaacaaaaaaaataacgcgcgatataaaaaaaacctttaacttaacctctaa

SEQ ID NO: 25717 - DNA, 634 bp, Artificial Sequence
  chemically treated genomic DNA (Homo sapiens) CpG-island No: 25717
gatgcgcgtttcgttcgtagtttttttttttttcgcgtatattttttatagatcgttattcgttatagtttcgttagttttcgtttttttttgtttagtcgtttttattttaatcgaattaaaggcggttcgtttcgatataatttttttttcgcgttttcggttcgggattttggttttttttttttttttgtttcgggttcgttagtagtcggttcggcggcgagggattaggacgcggttggagcggcgtcgggagacgaggggttgagagacggcggcggtcgaaagcggagagatgttgggcgtggcggtcgggatgatttataggttacgtatcgcgcggttttcgttacgttcgtttcgtagttttcggcgtgtttcgggtcgggtcgggtcgggtttggcgcgggcgggcggtcgggttttttttacggtttttttcggtcggtcggagtttcgatttttagcgttcgggtggcggcgtggttgcgttcgggttcgcggaggagacggttgttgtttattttcgggtgttcgcggtggtattagacgtgacgacgtttcgttgtttcgagagttttataagataaattagtatttgtcgagttaattatttattttttagtagtag

SEQ ID NO: 25718 - DNA, 634 bp, Artificial Sequence
  chemically treated genomic DNA (Homo sapiens) CpG-island No: 25718
ctactactaaaaaataaataattaactcgacaaatactaatttatcttataaaactctcgaaacaacgaaacgtcgtcacgtctaataccaccgcgaacacccgaaaataaacaacaaccgtctcctccgcgaacccgaacgcaaccacgccgccacccgaacgctaaaaatcgaaactccgaccgaccgaaaaaaaccgtaaaaaaaacccgaccgcccgcccgcgccaaacccgacccgacccgacccgaaacacgccgaaaactacgaaacgaacgtaacgaaaaccgcgcgatacgtaacctataaatcatcccgaccgccacgcccaacatctctccgctttcgaccgccgccgtctctcaacccctcgtctcccgacgccgctccaaccgcgtcctaatccctcgccgccgaaccgactactaacgaacccgaaacaaaaaaaaaaaaaaaaccaaaatcccgaaccgaaaacgcgaaaaaaaaattatatcgaaacgaaccgcctttaattcgattaaaataaaaacgactaaacaaaaaaaaacgaaaactaacgaaactataacgaataacgatctataaaaaatatacgcgaaaaaaaaaaaaactacgaacgaaacgcgcatc

SEQ ID NO: 25719 - DNA, 634 bp, Artificial Sequence
  chemically treated genomic DNA (Homo sapiens) CpG-island No: 25719
ttattgttagaagataaatgattagttcggtaaatattgatttgttttatggaattttcggagtagcggggcgtcgttacgtttgatgttatcgcggatattcgggagtgaatagtagtcgtttttttcgcgggttcggacgtagttacgtcgttattcgagcgttgggggtcggggtttcggtcgatcgggggaggtcgtagggaaagttcggtcgttcgttcgcgttaggttcggttcggttcggttcgaagtacgtcgggagttgcggggcggacgtggcgggggtcgcgcggtgcgtaatttgtgggttatttcggtcgttacgtttagtattttttcgttttcggtcgtcgtcgttttttagtttttcgtttttcggcgtcgttttagtcgcgttttagtttttcgtcgtcgggtcggttattggcgggttcggagtaggaaggggaggaaggttagggtttcgggtcgggggcgcgggaggggggttatgtcgaggcgggtcgtttttaattcggttggggtgggagcggttgggtaaggaggggcggggattggcggggttgtggcgaatggcgatttgtgagaggtatgcgcggaggaggggggggttgcgggcggggcgcgtatt

SEQ ID NO: 25720 - DNA, 634 bp, Artificial Sequence
  chemically treated genomic DNA (Homo sapiens) CpG-island No: 25720
aatacgcgccccgcccgcaacccccccctcctccgcgcatacctctcacaaatcgccattcgccacaaccccgccaatccccgcccctccttacccaaccgctcccaccccaaccgaattaaaaacgacccgcctcgacataacccccctcccgcgcccccgacccgaaaccctaaccttcctccccttcctactccgaacccgccaataaccgacccgacgacgaaaaactaaaacgcgactaaaacgacgccgaaaaacgaaaaactaaaaaacgacgacgaccgaaaacgaaaaaatactaaacgtaacgaccgaaataacccacaaattacgcaccgcgcgacccccgccacgtccgccccgcaactcccgacgtacttcgaaccgaaccgaaccgaacctaacgcgaacgaacgaccgaactttccctacgacctcccccgatcgaccgaaaccccgacccccaacgctcgaataacgacgtaactacgtccgaacccgcgaaaaaaacgactactattcactcccgaatatccgcgataacatcaaacgtaacgacgccccgctactccgaaaattccataaaacaaatcaatatttaccgaactaatcatttatcttctaacaataa

SEQ ID NO: 25721 - DNA, 674 bp, Artificial Sequence
  chemically treated genomic DNA (Homo sapiens) CpG-island No: 25721
tttcgttcgtttcgggtattattgttagttttcgtttagcgcgattcgtatttagaattcgtttttttcgattttacggagtatcgggtggagttcgtttgttttttttttttcgtttatgagttatttttttaatttttttatttgaacggtcgcgagatgattgtcggttatcgatatcgaggattcgttaggtgttttaatttcggaatttgtttcgtttggtttgggggtggagtcggtgggtaggcggttcgttttgtcgttattggtttgcgagatttcgttttttcggcgcggtgattggtttgtgtagttgtcgatatcgtgtgattcgcgcgaacgagtttttggcggttttagttattggtttcgcggatggagtgaggatagtgagattttagagttagttaatggtcggtatcgcggagttcggaggcggggaagcgtgagacggttacggcgtgagggggcgggtatagacggatggtcgtttcgttttgtagcgcggagtcgttttggtaattgcggtttcggtagatttttagtgagagtttgtttgtgcgggggagagtgtcgcgtcggtcgtcgttttaggatttttattttaaatgtgatttgtgtagtaatcgtagtttttaaattcgggaagaagagagtatagatgagtttta

SEQ ID NO: 25722 - DNA, 674 bp, Artificial Sequence
  chemically treated genomic DNA (Homo sapiens) CpG-island No: 25722
taaaactcatctatactctcttcttcccgaatttaaaaactacgattactacacaaatcacatttaaaataaaaatcctaaaacgacgaccgacgcgacactctcccccgcacaaacaaactctcactaaaaatctaccgaaaccgcaattaccaaaacgactccgcgctacaaaacgaaacgaccatccgtctatacccgccccctcacgccgtaaccgtctcacgcttccccgcctccgaactccgcgataccgaccattaactaactctaaaatctcactatcctcactccatccgcgaaaccaataactaaaaccgccaaaaactcgttcgcgcgaatcacacgatatcgacaactacacaaaccaatcaccgcgccgaaaaaacgaaatctcgcaaaccaataacgacaaaacgaaccgcctacccaccgactccacccccaaaccaaacgaaacaaattccgaaattaaaacacctaacgaatcctcgatatcgataaccgacaatcatctcgcgaccgttcaaataaaaaaattaaaaaaataactcataaacgaaaaaaaaaaaacaaacgaactccacccgatactccgtaaaatcgaaaaaaacgaattctaaatacgaatcgcgctaaacgaaaactaacaataatacccgaaacgaacgaaa

SEQ ID NO: 25723 - DNA, 674 bp, Artificial Sequence
  chemically treated genomic DNA (Homo sapiens) CpG-island No: 25723
taagatttatttatattttttttttttcgggtttgggaattgcggttgttatataggttatatttgaaataaaagttttgggacggcggtcggcgcgatattttttttcgtataggtaggtttttattgggaatttgtcgggatcgtagttgttaaggcgatttcgcgttgtagggcgaggcggttattcgtttgtgttcgtttttttacgtcgtggtcgttttacgttttttcgttttcgggtttcgcggtgtcgattattggttggttttgaggttttattatttttattttattcgcggagttaatggttgggatcgttaggagttcgttcgcgcgagttatacgatgtcggtaattgtatagattaattatcgcgtcgagaaggcgggatttcgtaggttaataacgataggacgggtcgtttgtttatcggttttatttttaagttaggcgaggtaggtttcgaggttggaatatttggcgagttttcggtgtcggtggtcggtagttatttcgcggtcgtttaggtgagggggttggaggagtggtttatgagcgaggaagggggagtaggcgggttttattcggtgtttcgtgagatcgaggggagcgggttttgggtgcggatcgcgttgggcgggagttggtagtggtattcgagacgggcggaa

SEQ ID NO: 25724 - DNA, 674 bp, Artificial Sequence
  chemically treated genomic DNA (Homo sapiens) CpG-island No: 25724
ttccgcccgtctcgaataccactaccaactcccgcccaacgcgatccgcacccaaaacccgctcccctcgatctcacgaaacaccgaataaaacccgcctactcccccttcctcgctcataaaccactcctccaaccccctcacctaaacgaccgcgaaataactaccgaccaccgacaccgaaaactcgccaaatattccaacctcgaaacctacctcgcctaacttaaaaataaaaccgataaacaaacgacccgtcctatcgttattaacctacgaaatcccgccttctcgacgcgataattaatctatacaattaccgacatcgtataactcgcgcgaacgaactcctaacgatcccaaccattaactccgcgaataaaataaaaataataaaacctcaaaaccaaccaataatcgacaccgcgaaacccgaaaacgaaaaaacgtaaaacgaccacgacgtaaaaaaacgaacacaaacgaataaccgcctcgccctacaacgcgaaatcgccttaacaactacgatcccgacaaattcccaataaaaacctacctatacgaaaaaaaatatcgcgccgaccgccgtcccaaaacttttatttcaaatataacctatataacaaccgcaattcccaaacccgaaaaaaaaaaaatataaataaatctta

SEQ ID NO: 25725 - DNA, 511 bp, Artificial Sequence
  chemically treated genomic DNA (Homo sapiens) CpG-island No: 25725
gcgtttgtcgttttttttgggtggttagtgcgcgggttgatatttatttagtcggggaaggtgaggcgagtagaggttggtgcggaatttgtcgttttagtagttcggcggttaagttagggtcggtagataaaagaggtcgttcgcgtaggaaggtacggcggacgcggcggattttatagtggcggcgacgggggtagtcgttcgtggttttgtgcggggtttggcgtgttgcgggtggtttttgggcgtcgattcgagaagagattgttcgcggcggtatgacggcggcgggcgttgtagtaagaggacggtatttttttcgagtatatcgttatttcgagttgcgaggcgtcgtgttcgtgtggttgtagtgtatcgttattagtaggatttatacggtggggcgtatttcgagggtcgggagtttttggttatcgagttgttcgataattttggcgtttatgagtttggtaagcgttgtttttgatattttgggtatttcggaggg

SEQ ID NO: 25726 - DNA, 511 bp, Artificial Sequence
  chemically treated genomic DNA (Homo sapiens) CpG-island No: 25726
ccctccgaaatacccaaaatatcaaaaacaacgcttaccaaactcataaacgccaaaattatcgaacaactcgataaccaaaaactcccgaccctcgaaatacgccccaccgtataaatcctactaataacgatacactacaaccacacgaacacgacgcctcgcaactcgaaataacgatatactcgaaaaaaataccgtcctcttactacaacgcccgccgccgtcataccgccgcgaacaatctcttctcgaatcgacgcccaaaaaccacccgcaacacgccaaaccccgcacaaaaccacgaacgactacccccgtcgccgccactataaaatccgccgcgtccgccgtaccttcctacgcgaacgacctcttttatctaccgaccctaacttaaccgccgaactactaaaacgacaaattccgcaccaacctctactcgcctcaccttccccgactaaataaatatcaacccgcgcactaaccacccaaaaaaaacgacaaacgc

SEQ ID NO: 25727 - DNA, 511 bp, Artificial Sequence
  chemically treated genomic DNA (Homo sapiens) CpG-island No: 25727
tttttcgggatgtttagggtgttaggggtagcgtttattaggtttatggacgttagggttgtcggatagttcgatgattaggagttttcggttttcgaagtgcgttttatcgtgtaaattttgttgatggcggtgtattgtagttatacggatacgacgtttcgtagttcggggtagcggtgtattcgaaggagatgtcgtttttttgttgtagcgttcgtcgtcgttatgtcgtcgcgggtagttttttttcgggtcggcgtttaggagttattcgtagtacgttaggtttcgtatagagttacgagcggttgttttcgtcgtcgttattatgaggttcgtcgcgttcgtcgtgtttttttacgcgggcggttttttttgtttgtcggttttggtttagtcgtcgggttgttggggcggtaagtttcgtattagtttttattcgttttatttttttcggttgaatgagtgttagttcgcgtattggttatttagaggagacggtaagcgt

SEQ ID NO: 25728 - DNA, 511 bp, Artificial Sequence
  chemically treated genomic DNA (Homo sapiens) CpG-island No: 25728
acgcttaccgtctcctctaaataaccaatacgcgaactaacactcattcaaccgaaaaaaataaaacgaataaaaactaatacgaaacttaccgccccaacaacccgacgactaaaccaaaaccgacaaacaaaaaaaaccgcccgcgtaaaaaaacacgacgaacgcgacgaacctcataataacgacgacgaaaacaaccgctcgtaactctatacgaaacctaacgtactacgaataactcctaaacgccgacccgaaaaaaaactacccgcgacgacataacgacgacgaacgctacaacaaaaaaacgacatctccttcgaatacaccgctaccccgaactacgaaacgtcgtatccgtataactacaatacaccgccatcaacaaaatttacacgataaaacgcacttcgaaaaccgaaaactcctaatcatcgaactatccgacaaccctaacgtccataaacctaataaacgctacccctaacaccctaaacatcccgaaaaa

SEQ ID NO: 25729 - DNA, 639 bp, Artificial Sequence
  chemically treated genomic DNA (Homo sapiens) CpG-island No: 25729
cgacggggcgcgtttgggtcgtgagtttgggtttttcgttttatcgtttgagttttagatttttttattttagtcggcgttagtaggatttcggtggtcgaggtcggcgtaggggtcgacgtcgacgttttgttagttttgtcgtttttgatgttagttacggcgggttggaagttaatttttattatggttgcgtcggttcgcgcgttcgtttcgtagtttttgtcggtgtagtttcggtttttgttttcgtcgtttcgagttttgtaggtatcggaagtttggatttcgttcgcgtttttttttttaattttatttttagtttttttcgtttcgttttcgcgggagggtttcggcgtcgcgcgtttgcgttttttttcgttcgcgggttcgtagtgatttttgtcgggcgcgtcgtttcgtatttggggcgggtcggagttttttttgtcgttcgttcgtatagttatttattcgttcgtttatttatttatttatttattcgtttatttatttatttagtcgttacgttcggattcgtttttcgtagtataattttttcgtattttttgtttaaggttagtattttcgtaacgtaagtttttgttaatttagtgtttgttaggtaaatgtagtttt

SEQ ID NO: 25730 - DNA, 639 bp, Artificial Sequence
  chemically treated genomic DNA (Homo sapiens) CpG-island No: 25730
aaaactacatttacctaacaaacactaaattaacaaaaacttacgttacgaaaatactaaccttaaacaaaaaatacgaaaaaattatactacgaaaaacgaatccgaacgtaacgactaaataaataaataaacgaataaataaataaataaataaacgaacgaataaataactatacgaacgaacgacaaaaaaaactccgacccgccccaaatacgaaacgacgcgcccgacaaaaatcactacgaacccgcgaacgaaaaaaaacgcaaacgcgcgacgccgaaaccctcccgcgaaaacgaaacgaaaaaaactaaaaataaaattaaaaaaaaaaacgcgaacgaaatccaaacttccgatacctacaaaactcgaaacgacgaaaacaaaaaccgaaactacaccgacaaaaactacgaaacgaacgcgcgaaccgacgcaaccataataaaaattaacttccaacccgccgtaactaacatcaaaaacgacaaaactaacaaaacgtcgacgtcgacccctacgccgacctcgaccaccgaaatcctactaacgccgactaaaataaaaaaatctaaaactcaaacgataaaacgaaaaacccaaactcacgacccaaacgcgccccgtcg

SEQ ID NO: 25731 - DNA, 639 bp, Artificial Sequence
  chemically treated genomic DNA (Homo sapiens) CpG-island No: 25731
gaagttgtatttgtttggtaaatattgggttaataaagatttgcgttgcggggatgttggttttggatagggaatgcgaagggattatgttacggagaacggattcgagcgtgacggttgaatgaatgagtgagcgagtgagtgagtgagtgagtgagcgagcgagtgagtgattgtgcgagcgagcggtagaaggaatttcgattcgttttaggtgcggagcggcgcgttcggtaggggttattgcgggttcgcgggcgggaaggggcgtaggcgcgcggcgtcggggttttttcgcggggacggggcggggagggttgggggtggggttagagagagggacgcgagcgggatttaaattttcggtgtttgtagagttcggagcggcggaggtagagatcgaggttgtatcggtagaggttgcggggcggacgcgcgggtcggcgtagttatggtgaagattagtttttagttcgtcgtggttggtattaagggcgataaggttgataaggcgtcggcgtcggtttttgcgtcggtttcggttatcgagattttgttgacgtcggttagggtgagagggtttggggtttaggcggtggggcgggggatttaggtttacgatttaggcgcgtttcgtcg

SEQ ID NO: 25732 - DNA, 639 bp, Artificial Sequence
  chemically treated genomic DNA (Homo sapiens) CpG-island No: 25732
cgacgaaacgcgcctaaatcgtaaacctaaatcccccgccccaccgcctaaaccccaaaccctctcaccctaaccgacgtcaacaaaatctcgataaccgaaaccgacgcaaaaaccgacgccgacgccttatcaaccttatcgcccttaataccaaccacgacgaactaaaaactaatcttcaccataactacgccgacccgcgcgtccgccccgcaacctctaccgatacaacctcgatctctacctccgccgctccgaactctacaaacaccgaaaatttaaatcccgctcgcgtccctctctctaaccccacccccaaccctccccgccccgtccccgcgaaaaaaccccgacgccgcgcgcctacgccccttcccgcccgcgaacccgcaataacccctaccgaacgcgccgctccgcacctaaaacgaatcgaaattccttctaccgctcgctcgcacaatcactcactcgctcgctcactcactcactcactcactcgctcactcattcattcaaccgtcacgctcgaatccgttctccgtaacataatcccttcgcattccctatccaaaaccaacatccccgcaacgcaaatctttattaacccaatatttaccaaacaaatacaacttc

SEQ ID NO: 25733 - DNA, 634 bp, Artificial Sequence
  chemically treated genomic DNA (Homo sapiens) CpG-island No: 25733
ggtcggcggattagtttcgtttcgggcgtgtagttggagcgttaggggagtttcgttcgtcgtagttttagcgtcgcgcgttttttttttttcgcggattggcggtgtcggcgttcggagtggtttttaaaaggtagtttattgttcggagggggcgggcggggggcgcgatcgggtttgaggttcggttttttttttttttttttttttgttttcgcgtcgtcgttggttagttcgttggttcgttcgttcgttcggcgtacgtttcgttttcgttagttgtttcgttgtcgggtgcgcggcgtggagcggtagtcggtttggacgcgcggtcggggttgggggttgggcgcggcgcgtaagattttttcggcgagagcgtttttgttatcgcgaggttgcgcgcgatggtagagatgggtagtaaaggggtgacggcgggaaagatcgttagtaacgtgtagaagaagtttattcgcgcgtaggagaaggtgagcgagtcggagttttagtagtcgcggagttttagtcgtcgggattcggttatttgtttttttatttttcgatttcggggtttggtttttcgttaggatttggtgttgttatttttagaggagcgttttcgaggggtttt

SEQ ID NO: 25734 - DNA, 634 bp, Artificial Sequence
  chemically treated genomic DNA (Homo sapiens) CpG-island No: 25734
aaaacccctcgaaaacgctcctctaaaaataacaacaccaaatcctaacgaaaaaccaaaccccgaaatcgaaaaataaaaaaacaaataaccgaatcccgacgactaaaactccgcgactactaaaactccgactcgctcaccttctcctacgcgcgaataaacttcttctacacgttactaacgatctttcccgccgtcacccctttactacccatctctaccatcgcgcgcaacctcgcgataacaaaaacgctctcgccgaaaaaatcttacgcgccgcgcccaacccccaaccccgaccgcgcgtccaaaccgactaccgctccacgccgcgcacccgacaacgaaacaactaacgaaaacgaaacgtacgccgaacgaacgaacgaaccaacgaactaaccaacgacgacgcgaaaacaaaaaaaaaaaaaaaaaaaaaaccgaacctcaaacccgatcgcgccccccgcccgccccctccgaacaataaactaccttttaaaaaccactccgaacgccgacaccgccaatccgcgaaaaaaaaaaaacgcgcgacgctaaaactacgacgaacgaaactcccctaacgctccaactacacgcccgaaacgaaactaatccgccgacc

SEQ ID NO: 25735 - DNA, 634 bp, Artificial Sequence
  chemically treated genomic DNA (Homo sapiens) CpG-island No: 25735
gaagtttttcgaaagcgtttttttagaggtgatagtattagattttggcgaaggattaggtttcggggtcggaggatagggggataggtggtcgggtttcggcggttgggatttcgcggttgttggggtttcggttcgtttatttttttttgcgcgcgggtgagttttttttgtacgttgttggcgatttttttcgtcgttatttttttattgtttatttttgttatcgcgcgtagtttcgcggtggtaggggcgttttcgtcggggagattttgcgcgtcgcgtttagtttttagtttcggtcgcgcgtttagatcggttgtcgttttacgtcgcgtattcgatagcggagtaattgacggaggcggagcgtgcgtcggacgggcgagcgagttagcgagttagttagcgacgacgcggggatagagggagggagaggggaggggtcgggttttaggttcggtcgcgtttttcgttcgtttttttcggataataagttgttttttaaaggttatttcgggcgtcggtatcgttagttcgcgaggagggaggggcgcgcggcgttggggttgcggcgagcgggatttttttgacgttttagttgtacgttcggggcgggattaattcgtcggtt

SEQ ID NO: 25736 - DNA, 634 bp, Artificial Sequence
  chemically treated genomic DNA (Homo sapiens) CpG-island No: 25736
aaccgacgaattaatcccgccccgaacgtacaactaaaacgtcaaaaaaatcccgctcgccgcaaccccaacgccgcgcgcccctccctcctcgcgaactaacgataccgacgcccgaaataacctttaaaaaacaacttattatccgaaaaaaacgaacgaaaaacgcgaccgaacctaaaacccgacccctcccctctccctccctctatccccgcgtcgtcgctaactaactcgctaactcgctcgcccgtccgacgcacgctccgcctccgtcaattactccgctatcgaatacgcgacgtaaaacgacaaccgatctaaacgcgcgaccgaaactaaaaactaaacgcgacgcgcaaaatctccccgacgaaaacgcccctaccaccgcgaaactacgcgcgataacaaaaataaacaataaaaaaataacgacgaaaaaaatcgccaacaacgtacaaaaaaaactcacccgcgcgcaaaaaaaaataaacgaaccgaaaccccaacaaccgcgaaatcccaaccgccgaaacccgaccacctatccccctatcctccgaccccgaaacctaatccttcgccaaaatctaatactatcacctctaaaaaaacgctttcgaaaaacttc

SEQ ID NO: 25737 - DNA, 659 bp, Artificial Sequence
  chemically treated genomic DNA (Homo sapiens) CpG-island No: 25737
ggcgagtatttcgtcgcggttgagacgtcgcgttggggtttcggatttcgggcgtcgttagggattgtttcggggtcggtgatttttcggggtcgttcgttatcgtgtatcgcggcgtttcgggtttttagcgcgtttgggaggggtttcggggagcggtttcgtttcggttggaaatttggttaacgcggttagggttcggggttcgtttgcgtttcgggcgttgggaaggggtcgggcgttcggggtcggggagggttaggatcggttttcgacgttcgtttttcggttcgtagggaatgggaaggcgcgggcggagtgcgtgcgtaggttatagtttttcgggaagtcgcgtcgggagcggttattattcgggtaagaatagcgtagagcgttgcggcggcgggaaggagagcgggggaaggtttcgtagattgcgggggagttttatttggagtcggggtagtcgtgaattatcgaggaggaggcggaggagacggcggttgttttagaggagggagtcgttataatcggttattgtcgtttatcggaaatttcgggcgcgggagttgggttagggggcgttaaggagtagttgggatattttggttagtcggcgtcgtgggcgggttcgggtttcgtagaggtaggatcgggat

SEQ ID NO: 25738 - DNA, 659 bp, Artificial Sequence
  chemically treated genomic DNA (Homo sapiens) CpG-island No: 25738
atcccgatcctacctctacgaaacccgaacccgcccacgacgccgactaaccaaaatatcccaactactccttaacgccccctaacccaactcccgcgcccgaaatttccgataaacgacaataaccgattataacgactccctcctctaaaacaaccgccgtctcctccgcctcctcctcgataattcacgactaccccgactccaaataaaactcccccgcaatctacgaaaccttcccccgctctccttcccgccgccgcaacgctctacgctattcttacccgaataataaccgctcccgacgcgacttcccgaaaaactataacctacgcacgcactccgcccgcgccttcccattccctacgaaccgaaaaacgaacgtcgaaaaccgatcctaaccctccccgaccccgaacgcccgaccccttcccaacgcccgaaacgcaaacgaaccccgaaccctaaccgcgttaaccaaatttccaaccgaaacgaaaccgctccccgaaacccctcccaaacgcgctaaaaacccgaaacgccgcgatacacgataacgaacgaccccgaaaaatcaccgaccccgaaacaatccctaacgacgcccgaaatccgaaaccccaacgcgacgtctcaaccgcgacgaaatactcgcc

SEQ ID NO: 25739 - DNA, 659 bp, Artificial Sequence
  chemically treated genomic DNA (Homo sapiens) CpG-island No: 25739
gtttcggttttgtttttgcggggttcgagttcgtttacggcgtcggttggttaaggtgttttagttgttttttggcgttttttggtttagttttcgcgttcgaggttttcggtgagcggtagtagtcggttatgacgatttttttttttggaatagtcgtcgtttttttcgtttttttttcggtagtttacggttgtttcggttttaggtgggattttttcgtaatttgcggagttttttttcgttttttttttcgtcgtcgtagcgttttgcgttgtttttgttcgggtggtagtcgttttcggcgcggtttttcggagggttatagtttacgtacgtatttcgttcgcgtttttttattttttgcgggtcgggaggcgggcgtcggaagtcgattttggtttttttcggtttcgggcgttcggtttttttttagcgttcggagcgtaggcgggtttcgggttttagtcgcgttgattaggtttttagtcggggcggagtcgtttttcggggttttttttaggcgcgttggggattcggggcgtcgcggtgtacggtggcgggcggtttcgggagattatcgatttcgaagtaatttttggcggcgttcggggttcggaattttagcgcggcgttttagtcgcggcggggtgttcgtt

SEQ ID NO: 25740 - DNA, 659 bp, Artificial Sequence
  chemically treated genomic DNA (Homo sapiens) CpG-island No: 25740
aacgaacaccccgccgcgactaaaacgccgcgctaaaattccgaaccccgaacgccgccaaaaattacttcgaaatcgataatctcccgaaaccgcccgccaccgtacaccgcgacgccccgaatccccaacgcgcctaaaaaaaaccccgaaaaacgactccgccccgactaaaaacctaatcaacgcgactaaaacccgaaacccgcctacgctccgaacgctaaaaaaaaaccgaacgcccgaaaccgaaaaaaaccaaaatcgacttccgacgcccgcctcccgacccgcaaaaaataaaaaaacgcgaacgaaatacgtacgtaaactataaccctccgaaaaaccgcgccgaaaacgactaccacccgaacaaaaacaacgcaaaacgctacgacgacgaaaaaaaaaacgaaaaaaaactccgcaaattacgaaaaaatcccacctaaaaccgaaacaaccgtaaactaccgaaaaaaaaacgaaaaaaacgacgactattccaaaaaaaaaaatcgtcataaccgactactaccgctcaccgaaaacctcgaacgcgaaaactaaaccaaaaaacgccaaaaaacaactaaaacaccttaaccaaccgacgccgtaaacgaactcgaaccccgcaaaaacaaaaccgaaac

SEQ ID NO: 25741 - DNA, 685 bp, Artificial Sequence
  chemically treated genomic DNA (Homo sapiens) CpG-island No: 25741
gtttcgttatcgtttcggttggcggtcgcggggtgtatttcgggaaagtgcgggttcgcgggggcgtggtgcgaggcggtgtcggtcgtatatcgtttattttttcgcgcggatttggcgcgtttttcgttgcggggtcgttcggttttcggaacgacgtttttcgttcgggcggcggttagagagggcgttacggggttgtttttgcgttcggttcggtttacgtagtatcgcggtttttacgttttagtcgaaagcgaaagatcggaaaacggttttcgggttttagggcgtagtgattgtacgggaggttcggaggttgcgtcgggaggaggtcggcgatattttcggtcgttttcggatgcggggttaggggcgtcggaaaggttatcgcggtagttcggcgcgttttagcggggttgttttgagggtgttgcgaggttgttttacgtgcgggatttcgcgggcgggtagtttgttttggagaggaaaggaaggcgtattcggttcggagtttagttttgttgcgcgtcgttcgttttttgcgtaatttgtagtttcgggaggcggggcgcgttttggttttcgcggggttatatggagtagcgggcgttgtaatttagggaggttttggggatataacgttagggaagttagttattcgtgtgtgttcgttggtttattg

SEQ ID NO: 25742 - DNA, 685 bp, Artificial Sequence
  chemically treated genomic DNA (Homo sapiens) CpG-island No: 25742
caataaaccaacgaacacacacgaataactaacttccctaacgttatatccccaaaacctccctaaattacaacgcccgctactccatataaccccgcgaaaaccaaaacgcgccccgcctcccgaaactacaaattacgcaaaaaacgaacgacgcgcaacaaaactaaactccgaaccgaatacgccttcctttcctctccaaaacaaactacccgcccgcgaaatcccgcacgtaaaacaacctcgcaacaccctcaaaacaaccccgctaaaacgcgccgaactaccgcgataacctttccgacgcccctaaccccgcatccgaaaacgaccgaaaatatcgccgacctcctcccgacgcaacctccgaacctcccgtacaatcactacgccctaaaacccgaaaaccgttttccgatctttcgctttcgactaaaacgtaaaaaccgcgatactacgtaaaccgaaccgaacgcaaaaacaaccccgtaacgccctctctaaccgccgcccgaacgaaaaacgtcgttccgaaaaccgaacgaccccgcaacgaaaaacgcgccaaatccgcgcgaaaaaataaacgatatacgaccgacaccgcctcgcaccacgcccccgcgaacccgcactttcccgaaatacaccccgcgaccgccaaccgaaacgataacgaaac

SEQ ID NO: 25743 - DNA, 685 bp, Artificial Sequence
  chemically treated genomic DNA (Homo sapiens) CpG-island No: 25743
tagtgggttagcggatatatacgggtagttgatttttttaacgttgtgtttttaaagtttttttggattatagcgttcgttgttttatgtgatttcgcgggagttaggacgcgtttcgtttttcggggttgtaagttgcgtagggagcgagcgacgcgtagtagagttgggtttcgagtcggatgcgttttttttttttttttagagtaggttgttcgttcgcggaatttcgtacgtagagtaatttcgtagtatttttagaatagtttcgttggggcgcgtcgggttgtcgcggtgattttttcgacgtttttgatttcgtattcggaggcggtcggaagtgtcgtcggttttttttcggcgtagttttcgggtttttcgtgtaattattacgttttggggttcggaaatcgtttttcggtttttcgttttcggttggggcgtggaggtcgcggtgttgcgtaggtcgggtcgggcgtaggaatagtttcgtggcgttttttttggtcgtcgttcgggcgggaaacgtcgtttcggggatcgggcgatttcgtagcggggagcgcgttaggttcgcgcggggaagtgggcggtgtgcggtcggtatcgtttcgtattacgttttcgcgggttcgtattttttcggagtgtatttcgcggtcgttagtcggggcgatggcggggt

SEQ ID NO: 25744 - DNA, 685 bp, Artificial Sequence
  chemically treated genomic DNA (Homo sapiens) CpG-island No: 25744
accccgccatcgccccgactaacgaccgcgaaatacactccgaaaaaatacgaacccgcgaaaacgtaatacgaaacgataccgaccgcacaccgcccacttccccgcgcgaacctaacgcgctccccgctacgaaatcgcccgatccccgaaacgacgtttcccgcccgaacgacgaccaaaaaaaacgccacgaaactattcctacgcccgacccgacctacgcaacaccgcgacctccacgccccaaccgaaaacgaaaaaccgaaaaacgatttccgaaccccaaaacgtaataattacacgaaaaacccgaaaactacgccgaaaaaaaaccgacgacacttccgaccgcctccgaatacgaaatcaaaaacgtcgaaaaaatcaccgcgacaacccgacgcgccccaacgaaactattctaaaaatactacgaaattactctacgtacgaaattccgcgaacgaacaacctactctaaaaaaaaaaaaaaaacgcatccgactcgaaacccaactctactacgcgtcgctcgctccctacgcaacttacaaccccgaaaaacgaaacgcgtcctaactcccgcgaaatcacataaaacaacgaacgctataatccaaaaaaactttaaaaacacaacgttaaaaaaatcaactacccgtatatatccgctaacccacta

SEQ ID NO: 25745 - DNA, 707 bp, Artificial Sequence
  chemically treated genomic DNA (Homo sapiens) CpG-island No: 25745
tttttttcggtcgtcgttaataggagtaattcgttgttgcgttgcggatcggttttaggtacggtggaaagttgtaggtattgacggcggcgtatttcggtcgagagggagtatcgcgcgtcgtcgttgtcgttcgggtttatggttttggtttgagagtaggacgaggcgttttcgatttcgagttgcggtagtaggagtagtaacggcggcgatcgtaggagtttgaatttttatatgggtcgtcgtcgcgagagcggttcggaggtggagggtggcggaggggtttttgagggagggattttagtaggcggtttagtcggcggtttaacggtcggcggtcgcggttcggtcgggagtcggcgttgaggcgacgacgttagaggtcgacgttcgcgcgtagcgtgcgtaaggaaaggaagggaggggtgtgggcgaaatcggttttgggatttcggagaagacggtgggcgtggtttgaggaagggcgtttgtgattggtgggttttgtcgcggtcgggaagttcgaatagaagtttggggaagagtcggcgaagagtaaagagataatatagtatttttagttatagtaagcggtagttatggagtatgcgtagtagtaggggcggtcgtaggtcgtcgtttaataatacgtaatgtatagatttttgagtatacgaagttttttgtttttttaggtttatttg

SEQ ID NO: 25746 - DNA, 707 bp, Artificial Sequence
  chemically treated genomic DNA (Homo sapiens) CpG-island No: 25746
caaataaacctaaaaaaacaaaaaacttcgtatactcaaaaatctatacattacgtattattaaacgacgacctacgaccgcccctactactacgcatactccataactaccgcttactataactaaaaatactatattatctctttactcttcgccgactcttccccaaacttctattcgaacttcccgaccgcgacaaaacccaccaatcacaaacgcccttcctcaaaccacgcccaccgtcttctccgaaatcccaaaaccgatttcgcccacacccctcccttcctttccttacgcacgctacgcgcgaacgtcgacctctaacgtcgtcgcctcaacgccgactcccgaccgaaccgcgaccgccgaccgttaaaccgccgactaaaccgcctactaaaatccctccctcaaaaacccctccgccaccctccacctccgaaccgctctcgcgacgacgacccatataaaaattcaaactcctacgatcgccgccgttactactcctactaccgcaactcgaaatcgaaaacgcctcgtcctactctcaaaccaaaaccataaacccgaacgacaacgacgacgcgcgatactccctctcgaccgaaatacgccgccgtcaatacctacaactttccaccgtacctaaaaccgatccgcaacgcaacaacgaattactcctattaacgacgaccgaaaaaaa

SEQ ID NO: 25747 - DNA, 707 bp, Artificial Sequence
  chemically treated genomic DNA (Homo sapiens) CpG-island No: 25747
taggtgaatttagagaaatagggagtttcgtatatttaaaagtttatatattacgtattattgaacggcgatttgcggtcgtttttgttgttgcgtatgttttataattgtcgtttgttatagttgggagtattgtattatttttttgtttttcgtcggtttttttttagatttttgttcgaatttttcggtcgcggtagaatttattaattataaacgtttttttttaagttacgtttatcgtttttttcgggattttaagatcgatttcgtttatatttttttttttttttttttacgtacgttgcgcgcggacgtcggtttttgacgtcgtcgttttagcgtcggttttcggtcgggtcgcggtcgtcgatcgttgagtcgtcggttgagtcgtttgttgaagttttttttttaggaattttttcgttattttttattttcgaatcgttttcgcggcggcgatttatgtgggggtttaggtttttgcggtcgtcgtcgttgttgtttttgttgtcgtagttcggaatcggaaacgtttcgttttgtttttaggttagaattatgaattcgggcggtagcggcggcgcgcgatgttttttttcggtcgaggtgcgtcgtcgttagtgtttgtagttttttatcgtgtttggagtcgattcgtagcgtagtaacgaattgtttttgttggcggcggtcggggaggg

SEQ ID NO: 25748 - DNA, 707 bp, Artificial Sequence
  chemically treated genomic DNA (Homo sapiens) CpG-island No: 25748
ccctccccgaccgccgccaacaaaaacaattcgttactacgctacgaatcgactccaaacacgataaaaaactacaaacactaacgacgacgcacctcgaccgaaaaaaaacatcgcgcgccgccgctaccgcccgaattcataattctaacctaaaaacaaaacgaaacgtttccgattccgaactacgacaacaaaaacaacaacgacgacgaccgcaaaaacctaaacccccacataaatcgccgccgcgaaaacgattcgaaaataaaaaataacgaaaaaattcctaaaaaaaaaacttcaacaaacgactcaaccgacgactcaacgatcgacgaccgcgacccgaccgaaaaccgacgctaaaacgacgacgtcaaaaaccgacgtccgcgcgcaacgtacgtaaaaaaaaaaaaaaaaaaatataaacgaaatcgatcttaaaatcccgaaaaaaacgataaacgtaacttaaaaaaaaacgtttataattaataaattctaccgcgaccgaaaaattcgaacaaaaatctaaaaaaaaaccgacgaaaaacaaaaaaataatacaatactcccaactataacaaacgacaattataaaacatacgcaacaacaaaaacgaccgcaaatcgccgttcaataatacgtaatatataaacttttaaatatacgaaactccctatttctctaaattcaccta

SEQ ID NO: 25749 - DNA, 703 bp, Artificial Sequence
  chemically treated genomic DNA (Homo sapiens) CpG-island No: 25749
tttgaattcgtcgtttgagtggtcggggtttttatcgttggtcgagagttcgtcgtcggggtttaacggcgatattaagttgtcggggtcgtttgcgtcggcgtttttgttgttttcgttgagtagggacgaattggagtcggattttagcgattggtaggagggcgggtcgtgcggaggttttgcgtcgtcgtcgtcgtcgttatcgtcgtcgttcgtcgcgtagtcgtatttgaagtcgagcgtaggcggtttcgacggttttagcgggagtagcgttgtttcgggttcggttttcgggtcgcgttcgcgttttttacgttttaggttttcgtcgttattttcggcgtacggttcgcggtagtaatttttgtcgttttttacgcgcgttagttcgtacgtgcggtcgaagggagggttgagagatattgggttgtcgaggtagggttgcgggtagttattgtacggtttcgtcgacggttaggatagggagtatacgttgtcgcggcgtgggtaggatagcgaaggtagttcgggaagttgcgtttcggacgcgcggaagttggggaagtagaaggtgtttttcgtgtggatgtttattagcggttttataaattcgggatttaggagattatgttcgtttattttcgcggggttcgatcggtagtttttattttattgttatttgatattaaatatagtt

SEQ ID NO: 25750 - DNA, 703 bp, Artificial Sequence
  chemically treated genomic DNA (Homo sapiens) CpG-island No: 25750
aactatatttaatatcaaataacaataaaataaaaactaccgatcgaaccccgcgaaaataaacgaacataatctcctaaatcccgaatttataaaaccgctaataaacatccacacgaaaaacaccttctacttccccaacttccgcgcgtccgaaacgcaacttcccgaactaccttcgctatcctacccacgccgcgacaacgtatactccctatcctaaccgtcgacgaaaccgtacaataactacccgcaaccctacctcgacaacccaatatctctcaaccctcccttcgaccgcacgtacgaactaacgcgcgtaaaaaacgacaaaaattactaccgcgaaccgtacgccgaaaataacgacgaaaacctaaaacgtaaaaaacgcgaacgcgacccgaaaaccgaacccgaaacaacgctactcccgctaaaaccgtcgaaaccgcctacgctcgacttcaaatacgactacgcgacgaacgacgacgataacgacgacgacgacgacgcaaaacctccgcacgacccgccctcctaccaatcgctaaaatccgactccaattcgtccctactcaacgaaaacaacaaaaacgccgacgcaaacgaccccgacaacttaatatcgccgttaaaccccgacgacgaactctcgaccaacgataaaaaccccgaccactcaaacgacgaattcaaa

SEQ ID NO: 25751 - DNA, 703 bp, Artificial Sequence
  chemically treated genomic DNA (Homo sapiens) CpG-island No: 25751
aattatgtttaatgttagatagtaataaagtagaagttgtcggtcgggtttcgcggaaatgggcgagtataattttttgaatttcgggtttgtggggtcgttggtaaatatttatacgggagatattttttatttttttaattttcgcgcgttcggggcgtagtttttcgggttgttttcgttgttttatttacgtcgcgataacgtgtgttttttgttttggtcgtcggcggagtcgtgtaatggttattcgtagttttatttcggtagtttagtgttttttaatttttttttcggtcgtacgtgcgagttggcgcgcgtggaggacggtaagggttattatcgcgagtcgtgcgtcgagggtggcggcgggggtttgaagcgtgaggagcgcgggcgcgattcgggagtcgggttcggggtagcgttgttttcgttggagtcgtcggggtcgtttgcgttcggttttaagtacgattacgcggcgggcggcggcggtggcgacggcggcggcggcgtaggattttcgtacgattcgtttttttgttagtcgttggaattcgattttagttcgtttttgtttaacgagggtaataagggcgtcggcgtaggcgatttcggtagtttggtatcgtcgttgaatttcggcggcgggttttcggttagcggtaaggatttcggttatttaagcggcggatttaaa

SEQ ID NO: 25752 - DNA, 703 bp, Artificial Sequence
  chemically treated genomic DNA (Homo sapiens) CpG-island No: 25752
tttaaatccgccgcttaaataaccgaaatccttaccgctaaccgaaaacccgccgccgaaattcaacgacgataccaaactaccgaaatcgcctacgccgacgcccttattaccctcgttaaacaaaaacgaactaaaatcgaattccaacgactaacaaaaaaacgaatcgtacgaaaatcctacgccgccgccgccgtcgccaccgccgccgcccgccgcgtaatcgtacttaaaaccgaacgcaaacgaccccgacgactccaacgaaaacaacgctaccccgaacccgactcccgaatcgcgcccgcgctcctcacgcttcaaacccccgccgccaccctcgacgcacgactcgcgataataacccttaccgtcctccacgcgcgccaactcgcacgtacgaccgaaaaaaaaattaaaaaacactaaactaccgaaataaaactacgaataaccattacacgactccgccgacgaccaaaacaaaaaacacacgttatcgcgacgtaaataaaacaacgaaaacaacccgaaaaactacgccccgaacgcgcgaaaattaaaaaaataaaaaatatctcccgtataaatatttaccaacgaccccacaaacccgaaattcaaaaaattatactcgcccatttccgcgaaacccgaccgacaacttctactttattactatctaacattaaacataatt

SEQ ID NO: 25753 - DNA, 660 bp, Artificial Sequence
  chemically treated genomic DNA (Homo sapiens) CpG-island No: 25753
agcgtttaggttttcggttatcggggtttatttcgtcgtcgttagatttagcggtttggtgtcggattgtagcgatttttcgttttgtagtttcgcgtttaagtcggtagtgtttagtacgtcgtgggcgttcgtgtttttttagtcgttcgtggtatattattcgtacggtttttagttttatttcggcgtcgatacgcgttatatgcggatttggttcgagtcgttgttcggcgtcgtttttttttttagtttttcggtcgggggtcgttattacgtttttaagtcggacgtttatttcgggcgtcgcgcggattgcggtttaggggagggtcgtagttattcggattatatgtacggttcgttcggggagttgcgcgatcgcgtttcgtagatattgttttcgttcgaggcggacgcgttcgtcggtagtaagtataaagaggagaaggtcgatttggattttagtaagttgggagtaatttttttttataatcggcgcgggaggggaggggaggacgggcgggggtagtcgaattatagttttttcgaatcgtgtagggagcgcgggagaggggcgagggggcgaggatttaataaaagcgaattattttggggagtttttaggggtaggaggtttgagaatggggtttagggaga

SEQ ID NO: 25754 - DNA, 660 bp, Artificial Sequence
  chemically treated genomic DNA (Homo sapiens) CpG-island No: 25754
tctccctaaaccccattctcaaacctcctacccctaaaaactccccaaaataattcgcttttattaaatcctcgccccctcgcccctctcccgcgctccctacacgattcgaaaaaactataattcgactacccccgcccgtcctcccctcccctcccgcgccgattataaaaaaaaattactcccaacttactaaaatccaaatcgaccttctcctctttatacttactaccgacgaacgcgtccgcctcgaacgaaaacaatatctacgaaacgcgatcgcgcaactccccgaacgaaccgtacatataatccgaataactacgaccctcccctaaaccgcaatccgcgcgacgcccgaaataaacgtccgacttaaaaacgtaataacgacccccgaccgaaaaactaaaaaaaaaaacgacgccgaacaacgactcgaaccaaatccgcatataacgcgtatcgacgccgaaataaaactaaaaaccgtacgaataatataccacgaacgactaaaaaaacacgaacgcccacgacgtactaaacactaccgacttaaacgcgaaactacaaaacgaaaaatcgctacaatccgacaccaaaccgctaaatctaacgacgacgaaataaaccccgataaccgaaaacctaaacgct

SEQ ID NO: 25755 - DNA, 660 bp, Artificial Sequence
  chemically treated genomic DNA (Homo sapiens) CpG-island No: 25755
tttttttgggttttatttttagattttttgtttttgaaagttttttaaggtaattcgtttttattgagttttcgttttttcgtttttttttcgcgttttttgtacggttcgggagggttgtaattcggttgttttcgttcgttttttttttttttttcgcgtcggttgtaaaggaaaattgtttttaatttattggggtttaggtcggtttttttttttttgtgtttgttgtcggcgagcgcgttcgtttcgggcgagggtagtgtttgcggggcgcggtcgcgtagtttttcgggcgagtcgtatatgtagttcgggtagttgcggtttttttttgggtcgtagttcgcgcggcgttcggggtaggcgttcggtttgagggcgtagtgacggttttcggtcgggaagttggggaaggagacggcgtcggatagcggttcgagttaagttcgtatgtagcgcgtgtcggcgtcgaggtggggttgggggtcgtacgggtgatatattacggacgattgagagggtacgggcgtttacgacgtgttgaatattgtcggtttgggcgcgaagttataggacggaaaatcgttatagttcggtattaaatcgttgggtttggcggcggcgggatgagtttcggtggtcggaaatttggacgtt

SEQ ID NO: 25756 - DNA, 660 bp, Artificial Sequence
  chemically treated genomic DNA (Homo sapiens) CpG-island No: 25756
aacgtccaaatttccgaccaccgaaactcatcccgccgccgccaaacccaacgatttaataccgaactataacgattttccgtcctataacttcgcgcccaaaccgacaatattcaacacgtcgtaaacgcccgtaccctctcaatcgtccgtaatatatcacccgtacgacccccaaccccacctcgacgccgacacgcgctacatacgaacttaactcgaaccgctatccgacgccgtctccttccccaacttcccgaccgaaaaccgtcactacgccctcaaaccgaacgcctaccccgaacgccgcgcgaactacgacccaaaaaaaaaccgcaactacccgaactacatatacgactcgcccgaaaaactacgcgaccgcgccccgcaaacactaccctcgcccgaaacgaacgcgctcgccgacaacaaacacaaaaaaaaaaaaaccgacctaaaccccaataaattaaaaacaattttcctttacaaccgacgcgaaaaaaaaaaaaaaaacgaacgaaaacaaccgaattacaaccctcccgaaccgtacaaaaaacgcgaaaaaaaaacgaaaaaacgaaaactcaataaaaacgaattaccttaaaaaactttcaaaaacaaaaaatctaaaaataaaacccaaaaaaa

SEQ ID NO: 25757 - DNA, 2308 bp, Artificial Sequence
  chemically treated genomic DNA (Homo sapiens) CpG-island No: 25757
ttttcgtttcgtttatcgttttttttttttgttatagcgcgttcgtttcgcggtcgttaattagtcgcgcgtttcggtcgcgcgtttcgtttcgttttcggtgggtgtgcgcgcggttaatgggcggtgcgcgggggtcgggtcgcggcggggcggggtagcggggcggtcgttaatcgtcgtggtgttgttgaaattgaaaatattatattatgttaatcgcggtcgggttcgcgcgtacgggggtggggttcgcgcgtataaagggggcgtaggcgggttgggcgttttataggttaagtgcgttgtgttcgaggggtgtcggttaggtttgagcgagcgagttagttagtaggtatcgagggggcgcggttgtcgttcggacgagataggcgaattcgacgtagaagagtttattatcggatagttaggtagtcgtcgcgtttttcgtatacgtagagtcgggcggcgcggggttttttttgcgttcggttttcgttttttttttttttttttttttttttttttcgttgtttttttttttttcgttgttcgcgtttgcgtagtttcgggttatgttcgacgcgttttttcgtagtatatttacgatggagcgttttgtcgttcgtgggatttttttagtattagtgcgtattagcgtttgtcgtagttttttcgggtcggtggattacgaggagttgagtcgcgagttgtaggttcgtttggtcgagttgaacgtcgaggattagaatcgttgggattacgatttttagtaggatatgtcgttgcggggttttggacgtttgtagtggatcgaagtggatagcgattcggtgttcgcgttttatcgcgagacggtgtaggtggggcgttgtcgtttgttgttggcgtcgcggttcgtcgcggtcgcggtggttgttagttcgtttttcgagtcggtcgttgagtttttcgacggtttcgaggaggcgtcggagtagttgtttagtgtttcggtttcggtttcggcgtttatttcgtttttagtttcggttttggttttagtttcggtttcggtttcggtttcggtcgcggtttcggtcgcggtttcggtcgcggtcgcggttttggtttcggtttcggtttcggtttcggtttcggtttcggtttcggttttagtcgcggtttcggttttagtttcggtttcggtttcggtttcggttttcgtttcggtttcggtttcggacgcggcgttttaagagagcgtcgagtagggcgcgaattaggggtagcgcggttaggagtttttcgttgattagttgtattcggggatttcgggacgtttcgcggtcggtatcgcggtcgttagcgttaacggcgcggcgattaagaagttgttcgggtttttgattttcggtgagtttcgtacggtttcgtttcggttcggttcggtttcgttttgttcggtcggtcggtttttttagttttcgggggtttcgttgggttttcgttttttttcgtggtattaaagggttcgtagcgtttagggcgcggttgcgtttttattttttttttcgtttcgttgttgtgttttttagcggtttcgcgcgggcggggtgggaggttgaatttcggtcgcgatttttcgggagcgtagttttcgttttcggtcgcgggagttttttttcgggcgcggtcgggcgtcgtgagtacggcgtggagggggttaagcgcggcggcggtttcggggggtttggtcgcgggataaggggaaatgtttatatagtatattgcgcggcgacgtaaataaagatgattcgtcgcggatttcggcgcgggcggggacggcgtttttatttcggtcggttcgcgtttcgcgttttttttcggttttttttcgggttttcgggtcggtttcgttttgatcggtcgcgcgcgttgtcgttcgtagattttttcgttaagcgtaagagattagcgtttgagaagtcgtcgggcgatgttttcgcgtcgtgtttttttttaagcgtcgtttttggcgtgggttcggtggagtagatttcgcgtaagaggttgcggtgagttaagtgagtatagcgtatttgggggggcgcggagggtcgattcgtcgggttttcgtcggttttgttgatcgttttttttttcgtagtttagagtttaaagagtttcgagggaatttgtcggggtagcggacgttggaagggcgttgggtttcggttgggatcgtttatgtagtagtaatcggcggcggttgtcgtagagtagcgttcggttttgtttttaaattttgaaaattgtgtaatgtatt

SEQ ID NO: 25758 - DNA, 2308 bp, Artificial Sequence
  chemically treated genomic DNA (Homo sapiens) CpG-island No: 25758
aatacattacacaattttcaaaatttaaaaacaaaaccgaacgctactctacgacaaccgccgccgattactactacataaacgatcccaaccgaaacccaacgcccttccaacgtccgctaccccgacaaattccctcgaaactctttaaactctaaactacgaaaaaaaaaacgatcaacaaaaccgacgaaaacccgacgaatcgaccctccgcgcccccccaaatacgctatactcacttaactcaccgcaacctcttacgcgaaatctactccaccgaacccacgccaaaaacgacgcttaaaaaaaaacacgacgcgaaaacatcgcccgacgacttctcaaacgctaatctcttacgcttaacgaaaaaatctacgaacgacaacgcgcgcgaccgatcaaaacgaaaccgacccgaaaacccgaaaaaaaaccgaaaaaaaacgcgaaacgcgaaccgaccgaaataaaaacgccgtccccgcccgcgccgaaatccgcgacgaatcatctttatttacgtcgccgcgcaatatactatataaacatttccccttatcccgcgaccaaaccccccgaaaccgccgccgcgcttaaccccctccacgccgtactcacgacgcccgaccgcgcccgaaaaaaaactcccgcgaccgaaaacgaaaactacgctcccgaaaaatcgcgaccgaaattcaacctcccaccccgcccgcgcgaaaccgctaaaaaacacaacaacgaaacgaaaaaaaaaataaaaacgcaaccgcgccctaaacgctacgaaccctttaataccacgaaaaaaaacgaaaacccaacgaaacccccgaaaactaaaaaaaccgaccgaccgaacaaaacgaaaccgaaccgaaccgaaacgaaaccgtacgaaactcaccgaaaatcaaaaacccgaacaacttcttaatcgccgcgccgttaacgctaacgaccgcgataccgaccgcgaaacgtcccgaaatccccgaatacaactaatcaacgaaaaactcctaaccgcgctacccctaattcgcgccctactcgacgctctcttaaaacgccgcgtccgaaaccgaaaccgaaacgaaaaccgaaaccgaaaccgaaaccgaaactaaaaccgaaaccgcgactaaaaccgaaaccgaaaccgaaaccgaaaccgaaaccgaaaccgaaaccaaaaccgcgaccgcgaccgaaaccgcgaccgaaaccgcgaccgaaaccgaaaccgaaaccgaaactaaaaccaaaaccgaaactaaaaacgaaataaacgccgaaaccgaaaccgaaacactaaacaactactccgacgcctcctcgaaaccgtcgaaaaactcaacgaccgactcgaaaaacgaactaacaaccaccgcgaccgcgacgaaccgcgacgccaacaacaaacgacaacgccccacctacaccgtctcgcgataaaacgcgaacaccgaatcgctatccacttcgatccactacaaacgtccaaaaccccgcaacgacatatcctactaaaaatcgtaatcccaacgattctaatcctcgacgttcaactcgaccaaacgaacctacaactcgcgactcaactcctcgtaatccaccgacccgaaaaaactacgacaaacgctaatacgcactaatactaaaaaaatcccacgaacgacaaaacgctccatcgtaaatatactacgaaaaaacgcgtcgaacataacccgaaactacgcaaacgcgaacaacgaaaaaaaaaaaaacaacgaaaaaaaaaaaaaaaaaaaaaaaaaaaaaacgaaaaccgaacgcaaaaaaaaccccgcgccgcccgactctacgtatacgaaaaacgcgacgactacctaactatccgataataaactcttctacgtcgaattcgcctatctcgtccgaacgacaaccgcgccccctcgatacctactaactaactcgctcgctcaaacctaaccgacacccctcgaacacaacgcacttaacctataaaacgcccaacccgcctacgccccctttatacgcgcgaaccccacccccgtacgcgcgaacccgaccgcgattaacataatataatattttcaatttcaacaacaccacgacgattaacgaccgccccgctaccccgccccgccgcgacccgacccccgcgcaccgcccattaaccgcgcgcacacccaccgaaaacgaaacgaaacgcgcgaccgaaacgcgcgactaattaacgaccgcgaaacgaacgcgctataacaaaaaaaaaaaacgataaacgaaacgaaaa

SEQ ID NO: 25759 - DNA, 2308 bp, Artificial Sequence
  chemically treated genomic DNA (Homo sapiens) CpG-island No: 25759
aatatattgtatagtttttaaaatttaaaaataaaatcgaacgttgttttgcggtagtcgtcgtcggttgttgttatatgaacggttttagtcgaggtttagcgtttttttaacgttcgttgtttcggtaggttttttcggggttttttgggttttaaattgcgaggagaggggcggttagtaaagtcggcggggattcggcgggtcggtttttcgcgtttttttaggtgcgttgtatttatttggtttatcgtagttttttgcgcggggtttgttttatcgagtttacgttaggggcggcgtttggagagggatacggcgcggggatatcgttcgacgattttttaggcgttgattttttgcgtttggcgaagaaatttgcgggcgatagcgcgcgcggtcggttagggcggggtcggttcggagattcgagagggggtcgggagagggcgcggggcgcgggtcggtcggggtgggggcgtcgttttcgttcgcgtcgaggttcgcggcgggttatttttgtttacgtcgtcgcgtaatgtgttgtgtaagtatttttttttgtttcgcggttaagtttttcggggtcgtcgtcgcgtttaattttttttacgtcgtgtttacggcgttcggtcgcgttcggggaggggttttcgcggtcgggggcgaaaattgcgttttcggggggtcgcggtcgggatttagttttttatttcgttcgcgcgaagtcgttggagggtataataacggggcggggaggggggtaagggcgtagtcgcgttttgagcgttgcgggttttttaatgttacgggaggaggcgggaatttagcgaggttttcgagggttggggggatcggtcggtcggataaagcggggtcgggtcgggtcggggcggggtcgtgcggggtttatcggagattagaggttcggatagttttttgatcgtcgcgtcgttggcgttggcggtcgcggtgtcggtcgcgggacgtttcgaaattttcgagtgtagttggttagcgagaggtttttggtcgcgttgtttttggttcgcgttttgttcggcgtttttttgaggcgtcgcgttcggggtcggggtcggggcgggggtcggggtcggggtcggggtcggggttggggtcggggtcgcgattggagtcggggtcggagtcggagtcggagtcggggtcggggtcggggttaggatcgcgatcgcgatcggagtcgcgatcggagtcgcgatcggagtcggagtcggggtcggggttggagttaggatcgggattgggggcggggtggacgtcggggtcgggatcgggatattaggtagttgtttcggcgttttttcgaggtcgtcgagggatttagcggtcggttcgaggggcgggttgatagttatcgcgatcgcgacgggtcgcggcgttagtagtaggcggtagcgttttatttgtatcgtttcgcggtagaacgcgggtatcgagtcgttgtttatttcggtttattgtaggcgtttagggtttcgtagcggtatgttttgttggaagtcgtaattttagcggttttggttttcggcgtttagttcggttaggcgggtttgtagttcgcggtttagtttttcgtggtttatcggttcgaagaggttgcggtaggcgttggtgcgtattagtattgggaaggttttacgggcgataagacgttttatcgtggatgtgttgcggagggacgcgtcggatatggttcggggttgcgtaaacgcgggtagcgagagaggagaggatagcgagaagaaggggaaaggagaggaggagagggcggaggtcgggcgtaagggagatttcgcgtcgttcgattttgcgtgtgcgagggacgcggcggttatttggttgttcggtggtggatttttttgcgtcgggttcgtttgtttcgttcggacggtagtcgcgttttttcgatgtttgttggttagttcgttcgtttaggtttggtcggtatttttcgagtatagcgtatttggtttgtggaacgtttagttcgtttgcgttttttttatacgcgcgggttttattttcgtgcgcgcgggttcggtcgcgattagtataatgtagtatttttagttttaataatattacggcgattggcggtcgtttcgttgtttcgtttcgtcgcggttcggttttcgcgtatcgtttattggtcgcgcgtatatttatcgggggcggggcggggcgcgcggtcggggcgcgcggttgattggcggtcgcggggcgagcgcgttgtagtaggggaagggggcggtgagcggggcggggg

SEQ ID NO: 25760 - DNA, 2308 bp, Artificial Sequence
  chemically treated genomic DNA (Homo sapiens) CpG-island No: 25760
cccccgccccgctcaccgcccccttcccctactacaacgcgctcgccccgcgaccgccaatcaaccgcgcgccccgaccgcgcgccccgccccgcccccgataaatatacgcgcgaccaataaacgatacgcgaaaaccgaaccgcgacgaaacgaaacaacgaaacgaccgccaatcgccgtaatattattaaaactaaaaatactacattatactaatcgcgaccgaacccgcgcgcacgaaaataaaacccgcgcgtataaaaaaaacgcaaacgaactaaacgttccacaaaccaaatacgctatactcgaaaaataccgaccaaacctaaacgaacgaactaaccaacaaacatcgaaaaaacgcgactaccgtccgaacgaaacaaacgaacccgacgcaaaaaaatccaccaccgaacaaccaaataaccgccgcgtccctcgcacacgcaaaatcgaacgacgcgaaatctcccttacgcccgacctccgccctctcctcctctcctttccccttcttctcgctatcctctcctctctcgctacccgcgtttacgcaaccccgaaccatatccgacgcgtccctccgcaacacatccacgataaaacgtcttatcgcccgtaaaaccttcccaatactaatacgcaccaacgcctaccgcaacctcttcgaaccgataaaccacgaaaaactaaaccgcgaactacaaacccgcctaaccgaactaaacgccgaaaaccaaaaccgctaaaattacgacttccaacaaaacataccgctacgaaaccctaaacgcctacaataaaccgaaataaacaacgactcgatacccgcgttctaccgcgaaacgatacaaataaaacgctaccgcctactactaacgccgcgacccgtcgcgatcgcgataactatcaacccgcccctcgaaccgaccgctaaatccctcgacgacctcgaaaaaacgccgaaacaactacctaatatcccgatcccgaccccgacgtccaccccgcccccaatcccgatcctaactccaaccccgaccccgactccgactccgatcgcgactccgatcgcgactccgatcgcgatcgcgatcctaaccccgaccccgaccccgactccgactccgactccgaccccgactccaatcgcgaccccgaccccaaccccgaccccgaccccgaccccgacccccgccccgaccccgaccccgaacgcgacgcctcaaaaaaacgccgaacaaaacgcgaaccaaaaacaacgcgaccaaaaacctctcgctaaccaactacactcgaaaatttcgaaacgtcccgcgaccgacaccgcgaccgccaacgccaacgacgcgacgatcaaaaaactatccgaacctctaatctccgataaaccccgcacgaccccgccccgacccgacccgaccccgctttatccgaccgaccgatccccccaaccctcgaaaacctcgctaaattcccgcctcctcccgtaacattaaaaaacccgcaacgctcaaaacgcgactacgcccttacccccctccccgccccgttattataccctccaacgacttcgcgcgaacgaaataaaaaactaaatcccgaccgcgaccccccgaaaacgcaattttcgcccccgaccgcgaaaacccctccccgaacgcgaccgaacgccgtaaacacgacgtaaaaaaaattaaacgcgacgacgaccccgaaaaacttaaccgcgaaacaaaaaaaaatacttacacaacacattacgcgacgacgtaaacaaaaataacccgccgcgaacctcgacgcgaacgaaaacgacgcccccaccccgaccgacccgcgccccgcgccctctcccgaccccctctcgaatctccgaaccgaccccgccctaaccgaccgcgcgcgctatcgcccgcaaatttcttcgccaaacgcaaaaaatcaacgcctaaaaaatcgtcgaacgatatccccgcgccgtatccctctccaaacgccgcccctaacgtaaactcgataaaacaaaccccgcgcaaaaaactacgataaaccaaataaatacaacgcacctaaaaaaacgcgaaaaaccgacccgccgaatccccgccgactttactaaccgcccctctcctcgcaatttaaaacccaaaaaaccccgaaaaaacctaccgaaacaacgaacgttaaaaaaacgctaaacctcgactaaaaccgttcatataacaacaaccgacgacgactaccgcaaaacaacgttcgattttatttttaaattttaaaaactatacaatatatt

SEQ ID NO: 25761 - DNA, 1106 bp, Artificial Sequence
  chemically treated genomic DNA (Homo sapiens) CpG-island No: 25761
tttcggcgtgagttatcgcgggtagggttggttgtagcgtattttttcgcggggtcggtttgcgagacggtgcgggcgagcgttcgggcggggcgggatttcgagttattttacggggtcggatagttggggtacggggggtaagaggagcgcgggtttttgagatgggaggggacggtcggggatcgattagagcgcggacgcgacggtgcgggttcggacggttgggtttggggagggtatggttcggggcgcgcggggtttaggcgggcggggtggttcgagggtcggggcggggcggggaggggcggggcggggaggggtagttataaaggtcgcgtcggggttacgaggagtagagtcggcgtcgttatcgttcgtattgtcgtttttagtttcgcgttcggtacgatatgaaatttttcgacgaggtgttacgcgagggcgagttggagaagcgtagcgatagttttttttagttatggaagaagaagcgcggggtgtttattttcgatcgtttgagtttgtttttcgttagttttcgcgcgcgttttaaggagttgcgtttttattttatttttaaggtggattgcgtggagcgtacgggtaagtacgtgtattttattatcgttattatcgattataaggagatcgattttcgttgcgcgggcgagagttgttggaacgcggttatcgcgttggcgtttatcgatttttagaatcgtcgcgttttgtaggattttcgtagtcgttaggaacgtatcgtattcgtcgtattcgtcgaggacgtcgtggttgtcgcggtcgtcgtatttttcgagttttcggagttttttaggttattttcgtagtttaaatttcgtacgttatgagttcgtcgcggtgagtgattgttcgcgtttcggcgagttttgcgttttaatagtcgggatcggggtttttgggaaaaattattttaattttagacggcggggcgggggcgttgtatttttttgggggattcggcgtttcgtaatcgcgttggttttttcgcgttagggtttcggggttttttaggttggattcggatcggttttggtatagttttttgatttagtttttttttt

SEQ ID NO: 25762 - DNA, 1106 bp, Artificial Sequence
  chemically treated genomic DNA (Homo sapiens) CpG-island No: 25762
aaaaaaaaaactaaatcaaaaaactataccaaaaccgatccgaatccaacctaaaaaaccccgaaaccctaacgcgaaaaaaccaacgcgattacgaaacgccgaatcccccaaaaaaatacaacgcccccgccccgccgtctaaaattaaaataatttttcccaaaaaccccgatcccgactattaaaacgcaaaactcgccgaaacgcgaacaatcactcaccgcgacgaactcataacgtacgaaatttaaactacgaaaataacctaaaaaactccgaaaactcgaaaaatacgacgaccgcgacaaccacgacgtcctcgacgaatacgacgaatacgatacgttcctaacgactacgaaaatcctacaaaacgcgacgattctaaaaatcgataaacgccaacgcgataaccgcgttccaacaactctcgcccgcgcaacgaaaatcgatctccttataatcgataataacgataataaaatacacgtacttacccgtacgctccacgcaatccaccttaaaaataaaataaaaacgcaactccttaaaacgcgcgcgaaaactaacgaaaaacaaactcaaacgatcgaaaataaacaccccgcgcttcttcttccataactaaaaaaaactatcgctacgcttctccaactcgccctcgcgtaacacctcgtcgaaaaatttcatatcgtaccgaacgcgaaactaaaaacgacaatacgaacgataacgacgccgactctactcctcgtaaccccgacgcgacctttataactacccctccccgccccgcccctccccgccccgccccgaccctcgaaccaccccgcccgcctaaaccccgcgcgccccgaaccataccctccccaaacccaaccgtccgaacccgcaccgtcgcgtccgcgctctaatcgatccccgaccgtcccctcccatctcaaaaacccgcgctcctcttaccccccgtaccccaactatccgaccccgtaaaataactcgaaatcccgccccgcccgaacgctcgcccgcaccgtctcgcaaaccgaccccgcgaaaaaatacgctacaaccaaccctacccgcgataactcacgccgaaa

SEQ ID NO: 25763 - DNA, 1106 bp, Artificial Sequence
  chemically treated genomic DNA (Homo sapiens) CpG-island No: 25763
ggggaaaggattgggttagagagttgtgttagggtcggttcgggtttagtttgaggggtttcgagattttgacgcgagggggttagcgcgattgcggggcgtcgggttttttaaggaggtgtagcgttttcgtttcgtcgtttggggttgaagtggttttttttaaaggtttcggtttcggttgttagggcgtagggttcgtcgggacgcgggtagttatttatcgcggcgggtttatggcgtgcggggtttgggttgcggggatggtttggagggtttcgagggttcggagggtgcggcggtcgcggtagttacggcgttttcggcgggtgcggcgggtgcggtgcgtttttggcggttgcgaaagttttgtagggcgcggcggttttggaaatcgatgagcgttagcgcgatggtcgcgttttagtagttttcgttcgcgtagcggaagtcgatttttttgtggtcggtggtgacgatggtgaagtatacgtatttgttcgtgcgttttacgtagtttattttgaggatggagtggaagcgtagttttttggggcgcgcgcgggggttggcggggaataggtttaggcggtcggaggtgagtatttcgcgtttttttttttatagttggaagaggttgtcgttgcgtttttttaattcgttttcgcgtagtatttcgtcgggggattttatgtcgtgtcgagcgcgggattgggagcggtaatgcgggcggtgacggcgtcggttttgtttttcgtggtttcggcgcggtttttatagttgttttttttcgtttcgttttttttcgtttcgtttcggttttcgggttatttcgttcgtttgagtttcgcgcgtttcgggttatattttttttaagtttagtcgttcgggttcgtatcgtcgcgttcgcgttttggtcggttttcggtcgtttttttttattttagaagttcgcgttttttttgtttttcgtgttttagttgttcggtttcgtggggtgattcgaggtttcgtttcgttcgggcgttcgttcgtatcgtttcgtaggtcggtttcgcggaagaatgcgttgtagttagttttgttcgcgatgatttacgtcgggg

SEQ ID NO: 25764 - DNA, 1106 bp, Artificial Sequence
  chemically treated genomic DNA (Homo sapiens) CpG-island No: 25764
ccccgacgtaaatcatcgcgaacaaaactaactacaacgcattcttccgcgaaaccgacctacgaaacgatacgaacgaacgcccgaacgaaacgaaacctcgaatcaccccacgaaaccgaacaactaaaacacgaaaaacaaaaaaaacgcgaacttctaaaataaaaaaaaacgaccgaaaaccgaccaaaacgcgaacgcgacgatacgaacccgaacgactaaacttaaaaaaaatataacccgaaacgcgcgaaactcaaacgaacgaaataacccgaaaaccgaaacgaaacgaaaaaaaacgaaacgaaaaaaaacaactataaaaaccgcgccgaaaccacgaaaaacaaaaccgacgccgtcaccgcccgcattaccgctcccaatcccgcgctcgacacgacataaaatcccccgacgaaatactacgcgaaaacgaattaaaaaaacgcaacgacaacctcttccaactataaaaaaaaaaacgcgaaatactcacctccgaccgcctaaacctattccccgccaacccccgcgcgcgccccaaaaaactacgcttccactccatcctcaaaataaactacgtaaaacgcacgaacaaatacgtatacttcaccatcgtcaccaccgaccacaaaaaaatcgacttccgctacgcgaacgaaaactactaaaacgcgaccatcgcgctaacgctcatcgatttccaaaaccgccgcgccctacaaaactttcgcaaccgccaaaaacgcaccgcacccgccgcacccgccgaaaacgccgtaactaccgcgaccgccgcaccctccgaaccctcgaaaccctccaaaccatccccgcaacccaaaccccgcacgccataaacccgccgcgataaataactacccgcgtcccgacgaaccctacgccctaacaaccgaaaccgaaacctttaaaaaaaaccacttcaaccccaaacgacgaaacgaaaacgctacacctccttaaaaaacccgacgccccgcaatcgcgctaaccccctcgcgtcaaaatctcgaaacccctcaaactaaacccgaaccgaccctaacacaactctctaacccaatcctttcccc

SEQ ID NO: 25765 - DNA, 741 bp, Artificial Sequence
  chemically treated genomic DNA (Homo sapiens) CpG-island No: 25765
ggggcgtgcgggtagttgcgtttaggcgggagggagcgcgcggcggtggtttaggcggttttgttcgattgtcggatcgagtttttttttttcggtcgcggtcgcgtttttcgttagcgggttcgcggggaggggcgggaaggtagttggacgcggcggcgatttatgggttttttaggcgagtaggtgttttttcgggtcgtttattgtttcgtcggttttataatggggttgttgtagtcgtagagtcggtttcgtcgttgttcgcggtttgtacgggtacgacggtttcgggacggcgggagagtttgcggtcggcgtatttgttcgcgcgttcgtcggtgcgttcgtcggtgtatcggttttgttgtttttcgcgcgtttgtttacgggaacgggttttgggcgtttagcgtttatttttgcgcgtagtacggtttcgttggttttcggggttttcgcgtttcgacggtgcgttcgcgttcgttgcgttcgttcgttttgcgttcgttcgttttgcgtcgtcgggtattcggtttcgttcggttggtacggttcgcgtcgttgcgtttcggtcgtatatataggggtttattttttttggtttcgcgtaattatatggtaaattcgcgtcgatatagtagttttcgtttatttaggcgtagaatgtttcgtaatagggaataattacgattttgttcgcgtttattatggatgcgaacggggcgagaaaaaaaatta

SEQ ID NO: 25766 - DNA, 741 bp, Artificial Sequence
  chemically treated genomic DNA (Homo sapiens) CpG-island No: 25766
taattttttttctcgccccgttcgcatccataataaacgcgaacaaaatcgtaattattccctattacgaaacattctacgcctaaataaacgaaaactactatatcgacgcgaatttaccatataattacgcgaaaccaaaaaaaataaacccctatatatacgaccgaaacgcaacgacgcgaaccgtaccaaccgaacgaaaccgaatacccgacgacgcaaaacgaacgaacgcaaaacgaacgaacgcaacgaacgcgaacgcaccgtcgaaacgcgaaaaccccgaaaaccaacgaaaccgtactacgcgcaaaaataaacgctaaacgcccaaaacccgttcccgtaaacaaacgcgcgaaaaacaacaaaaccgatacaccgacgaacgcaccgacgaacgcgcgaacaaatacgccgaccgcaaactctcccgccgtcccgaaaccgtcgtacccgtacaaaccgcgaacaacgacgaaaccgactctacgactacaacaaccccattataaaaccgacgaaacaataaacgacccgaaaaaacacctactcgcctaaaaaacccataaatcgccgccgcgtccaactaccttcccgcccctccccgcgaacccgctaacgaaaaacgcgaccgcgaccgaaaaaaaaaaactcgatccgacaatcgaacaaaaccgcctaaaccaccgccgcgcgctccctcccgcctaaacgcaactacccgcacgcccc

SEQ ID NO: 25767 - DNA, 741 bp, Artificial Sequence
  chemically treated genomic DNA (Homo sapiens) CpG-island No: 25767
tgattttttttttcgtttcgttcgtatttataatagacgcgaatagagtcgtgattgttttttgttgcgggatattttgcgtttgaatgagcgggggttgttgtgtcgacgcggatttgttatatggttgcgcggagttaggaagaatgggtttttgtgtgtgcgatcgggacgtagcggcgcgggtcgtgttagtcgggcggagtcgggtgttcgacggcgtaggacgagcgggcgtaggacgagcgagcgtagcgggcgcgggcgtatcgtcggggcgcggggatttcgagggttagcggagtcgtgttgcgcgtagggatggacgttgggcgtttaaggttcgttttcgtggataggcgcgcggagggtagtaggatcgatgtatcgacggacgtatcgacggacgcgcggatagatgcgtcgatcgtaggttttttcgtcgtttcggggtcgtcgtgttcgtgtaggtcgcgagtagcggcggggtcggttttgcggttgtagtagttttattgtgaggtcggcgagataatgggcggttcgaggaggtatttgttcgtttgaaaggtttataaatcgtcgtcgcgtttagttgttttttcgttttttttcgcggattcgttagcgggaagcgcggtcgcggtcgggagggggaggttcggttcgatagtcgggtagggtcgtttgggttatcgtcgcgcgttttttttcgtttgggcgtagttgttcgtacgtttt

SEQ ID NO: 25768 - DNA, 741 bp, Artificial Sequence
  chemically treated genomic DNA (Homo sapiens) CpG-island No: 25768
aaaacgtacgaacaactacgcccaaacgaaaaaaaacgcgcgacgataacccaaacgaccctacccgactatcgaaccgaacctccccctcccgaccgcgaccgcgcttcccgctaacgaatccgcgaaaaaaaacgaaaaaacaactaaacgcgacgacgatttataaacctttcaaacgaacaaatacctcctcgaaccgcccattatctcgccgacctcacaataaaactactacaaccgcaaaaccgaccccgccgctactcgcgacctacacgaacacgacgaccccgaaacgacgaaaaaacctacgatcgacgcatctatccgcgcgtccgtcgatacgtccgtcgatacatcgatcctactaccctccgcgcgcctatccacgaaaacgaaccttaaacgcccaacgtccatccctacgcgcaacacgactccgctaaccctcgaaatccccgcgccccgacgatacgcccgcgcccgctacgctcgctcgtcctacgcccgctcgtcctacgccgtcgaacacccgactccgcccgactaacacgacccgcgccgctacgtcccgatcgcacacacaaaaacccattcttcctaactccgcgcaaccatataacaaatccgcgtcgacacaacaacccccgctcattcaaacgcaaaatatcccgcaacaaaaaacaatcacgactctattcgcgtctattataaatacgaacgaaacgaaaaaaaaaatca

SEQ ID NO: 25769 - DNA, 517 bp, Artificial Sequence
  chemically treated genomic DNA (Homo sapiens) CpG-island No: 25769
gttgggtgttcgttcgtgttcggcggcgcgtcgagtggagggatagcggttttttttttgttttcggttttagtacgttcggtcgcggttttcggaggttcgaggaaggcggcgaggtcgcgtttatttgtatgaagcgtatattcgcggtttatttgtaaaggcgtaattaaacgcgggggtgggggggtaggggcgttcgaaattagtattttcgcggttatttggcgcgaggagcgggcgcggtcggataaagggcgtcgggcgaggggagaggcgagtgtgtcgcggtattgatttgtaaatgaggttttgtgcgcgtattaaagttcgtcggattttcgatttcggttttcgtttcgttcgttaggttcgcggtttttagcggtttaggttcggattgggtatttcgaaggtttgggggtcgggtcgggtagtgtcgcgattgggtagggggtcgggtcgggtcgggtttggtcgggttaggataggttgtggagcgtcggagttttttatt

SEQ ID NO: 25770 - DNA, 517 bp, Artificial Sequence
  chemically treated genomic DNA (Homo sapiens) CpG-island No: 25770
aataaaaaactccgacgctccacaacctatcctaacccgaccaaacccgacccgacccgaccccctacccaatcgcgacactacccgacccgacccccaaaccttcgaaatacccaatccgaacctaaaccgctaaaaaccgcgaacctaacgaacgaaacgaaaaccgaaatcgaaaatccgacgaactttaatacgcgcacaaaacctcatttacaaatcaataccgcgacacactcgcctctcccctcgcccgacgccctttatccgaccgcgcccgctcctcgcgccaaataaccgcgaaaatactaatttcgaacgcccctacccccccacccccgcgtttaattacgcctttacaaataaaccgcgaatatacgcttcatacaaataaacgcgacctcgccgccttcctcgaacctccgaaaaccgcgaccgaacgtactaaaaccgaaaacaaaaaaaaaaccgctatccctccactcgacgcgccgccgaacacgaacgaacacccaac

SEQ ID NO: 25771 - DNA, 517 bp, Artificial Sequence
  chemically treated genomic DNA (Homo sapiens) CpG-island No: 25771
ggtggggggtttcgacgttttatagtttgttttggttcggttaggttcggttcggttcggttttttgtttagtcgcggtattgttcggttcgatttttagattttcggggtgtttagttcgagtttgggtcgttaggggtcgcgggtttggcgggcggggcgggggtcggggtcgggggttcggcgagttttaatgcgcgtataaagttttatttgtaggttaatgtcgcggtatattcgttttttttttcgttcggcgttttttgttcggtcgcgttcgtttttcgcgttagatggtcgcggaaatgttaatttcgggcgtttttgtttttttattttcgcgtttaattgcgtttttgtagatgggtcgcgagtgtgcgttttatgtagatgagcgcggtttcgtcgtttttttcggattttcgggagtcgcggtcgggcgtgttggggtcgagggtagggagggggtcgttgtttttttattcgacgcgtcgtcgggtacgggcgggtatttagt

SEQ ID NO: 25772 - DNA, 517 bp, Artificial Sequence
  chemically treated genomic DNA (Homo sapiens) CpG-island No: 25772
actaaatacccgcccgtacccgacgacgcgtcgaataaaaaaacaacgaccccctccctaccctcgaccccaacacgcccgaccgcgactcccgaaaatccgaaaaaaacgacgaaaccgcgctcatctacataaaacgcacactcgcgacccatctacaaaaacgcaattaaacgcgaaaataaaaaaacaaaaacgcccgaaattaacatttccgcgaccatctaacgcgaaaaacgaacgcgaccgaacaaaaaacgccgaacgaaaaaaaaaacgaatataccgcgacattaacctacaaataaaactttatacgcgcattaaaactcgccgaacccccgaccccgacccccgccccgcccgccaaacccgcgacccctaacgacccaaactcgaactaaacaccccgaaaatctaaaaatcgaaccgaacaataccgcgactaaacaaaaaaccgaaccgaaccgaacctaaccgaaccaaaacaaactataaaacgtcgaaaccccccacc

SEQ ID NO: 25773 - DNA, 839 bp, Artificial Sequence
  chemically treated genomic DNA (Homo sapiens) CpG-island No: 25773
cgcgtatttttttttcgttttttcgcgtatttgatatatatacgcgcgaaatttcgcgtagttcgagcgtttttcgatttgtagaggtcggttttcgagttcggattttttttcgcgtcgattaaataagtatatcgttttgtggtcgacgttttcgttattttttttagtttttatagaggttttattaggttcgtcgtcgttcgtcgttgttatattggggaaaaggagaaaagatagcgacgtttgtcgtcgtcgggtttagggttgaggtgcgcgtttcgcgcggcgtttttagttttagttttcggggcggttcgaggtttcggttcggcgcgttgtagtttttcgttagcggcggcggtcgagtagcggtaggcgcgaggattattcgggaatcgatttaaacgcgtttttgttcgtgtattacgttattttcgcggttcgttatttttgaggagaaggggacgcgcggcgcgttttttatcgggttcgggtttagcgtttatcgtcgtttacgcgagttttacggtgcgattcgcgattagcgtcgtcgtcgggattgtggcgtaggaggaagagcggtggcgggtggcgggcggcgggcgatagcgaggggcggggcgaatttagtaggtcgcgcgggtaggggcggggtttcgtcgcgcgcgcgttcggggttcgttttttcggttttcgcgaagttggaaggaggttgagtttttcgcggttgtttgcgttttgcgggtagtttttagaggtcgaggcgggagagtagggttcgggggtagcgggggaatttttcgaagagttgtgttttttttgtggaaagggtttcg

SEQ ID NO: 25774 - DNA, 839 bp, Artificial Sequence
  chemically treated genomic DNA (Homo sapiens) CpG-island No: 25774
cgaaaccctttccacaaaaaaaacacaactcttcgaaaaattcccccgctacccccgaaccctactctcccgcctcgacctctaaaaactacccgcaaaacgcaaacaaccgcgaaaaactcaacctccttccaacttcgcgaaaaccgaaaaaacgaaccccgaacgcgcgcgcgacgaaaccccgcccctacccgcgcgacctactaaattcgccccgcccctcgctatcgcccgccgcccgccacccgccaccgctcttcctcctacgccacaatcccgacgacgacgctaatcgcgaatcgcaccgtaaaactcgcgtaaacgacgataaacgctaaacccgaacccgataaaaaacgcgccgcgcgtccccttctcctcaaaaataacgaaccgcgaaaataacgtaatacacgaacaaaaacgcgtttaaatcgattcccgaataatcctcgcgcctaccgctactcgaccgccgccgctaacgaaaaactacaacgcgccgaaccgaaacctcgaaccgccccgaaaactaaaactaaaaacgccgcgcgaaacgcgcacctcaaccctaaacccgacgacgacaaacgtcgctatcttttctccttttccccaatataacaacgacgaacgacgacgaacctaataaaacctctataaaaactaaaaaaaataacgaaaacgtcgaccacaaaacgatatacttatttaatcgacgcgaaaaaaaatccgaactcgaaaaccgacctctacaaatcgaaaaacgctcgaactacgcgaaatttcgcgcgtatatatatcaaatacgcgaaaaaacgaaaaaaaaatacgcg

SEQ ID NO: 25775 - DNA, 839 bp, Artificial Sequence
  chemically treated genomic DNA (Homo sapiens) CpG-island No: 25775
cggggttttttttatagagagaatatagtttttcgggagattttttcgttgttttcgagttttgttttttcgtttcggtttttgaggattattcgtagggcgtaggtagtcgcgaaagatttagtttttttttaatttcgcgagggtcgagggggcgggtttcgggcgcgcgcgcggcgaagtttcgtttttgttcgcgcggtttgttggattcgtttcgtttttcgttgtcgttcgtcgttcgttattcgttatcgtttttttttttgcgttatagtttcggcggcggcgttggtcgcgggtcgtatcgtgaggttcgcgtgggcggcgataggcgttgggttcgggttcggtgaggagcgcgtcgcgcgtttttttttttttaggagtggcgggtcgcggaagtgacgtggtgtacgggtaggagcgcgtttgaatcggttttcgggtgattttcgcgtttgtcgttgttcggtcgtcgtcgttgacgaggagttgtagcgcgtcgggtcgaggtttcgagtcgtttcgggagttggagttgaaggcgtcgcgcggagcgcgtattttagttttgagttcggcggcggtaggcgtcgttgttttttttttttttttttaatatggtagcggcggacggcggcgggtttggtggggtttttgtggggattgaggaggatggcggaggcgtcggttataggacggtgtatttgtttgatcggcgcgaaaaggagttcgagttcggggatcggtttttgtaggtcggggagcgttcggattacgcgggatttcgcgcgtgtgtgtgttaggtacgcgaaggggcgaggaagggatgcgcg

SEQ ID NO: 25776 - DNA, 839 bp, Artificial Sequence
  chemically treated genomic DNA (Homo sapiens) CpG-island No: 25776
cgcgcatcccttcctcgccccttcgcgtacctaacacacacacgcgcgaaatcccgcgtaatccgaacgctccccgacctacaaaaaccgatccccgaactcgaactccttttcgcgccgatcaaacaaatacaccgtcctataaccgacgcctccgccatcctcctcaatccccacaaaaaccccaccaaacccgccgccgtccgccgctaccatattaaaaaaaaaaaaaaaaaacaacgacgcctaccgccgccgaactcaaaactaaaatacgcgctccgcgcgacgccttcaactccaactcccgaaacgactcgaaacctcgacccgacgcgctacaactcctcgtcaacgacgacgaccgaacaacgacaaacgcgaaaatcacccgaaaaccgattcaaacgcgctcctacccgtacaccacgtcacttccgcgacccgccactcctaaaaaaaaaaaaacgcgcgacgcgctcctcaccgaacccgaacccaacgcctatcgccgcccacgcgaacctcacgatacgacccgcgaccaacgccgccgccgaaactataacgcaaaaaaaaaaacgataacgaataacgaacgacgaacgacaacgaaaaacgaaacgaatccaacaaaccgcgcgaacaaaaacgaaacttcgccgcgcgcgcgcccgaaacccgccccctcgaccctcgcgaaattaaaaaaaaactaaatctttcgcgactacctacgccctacgaataatcctcaaaaaccgaaacgaaaaaacaaaactcgaaaacaacgaaaaaatctcccgaaaaactatattctctctataaaaaaaaccccg

SEQ ID NO: 25777 - DNA, 687 bp, Artificial Sequence
  chemically treated genomic DNA (Homo sapiens) CpG-island No: 25777
gtgtttgtgatcgagtttaagcgttcgtttttagcgtttacgttttagttcgggtttacgtatttcgtaggagaagagtcggttacgggatgtagttgtatcgttagtttttcgagtttcgtgaaggcggcgtcggtcgtcgagaagattttttcgatttgggggcggggtagcgttacggggggtcggcgttcgtttttttcgtttcgttcggagtttttagttttattttaggttcggttttcgttcgtttttcgttcggggcggaagagtcgcgagttaagtggggggttcgttttttcgtggtcgttagggagcgttgttcgcgagggaggtcgaatttttgtggacgttgacgttatggtttcgcgcgtttttttacggagacgtcgtcgtcgtcgttatacgcgagtcgggattacggagagtagggagattgagcggttcgggttttcgcgtaggaagtttcgtttttttcgtagcggataggtttaattcggcggtttttcgttttattagacgtagtcgtttagatcgttcggcgcgtttagtcgatggggaaagttttcgttttattttcgcgttatatttcgttttattttcgtttagagatcgggattttttaggtagaggtcgatttttagttttagtttcgtgttcgtttttatttaagtatagatatagggt

SEQ ID NO: 25778 - DNA, 687 bp, Artificial Sequence
  chemically treated genomic DNA (Homo sapiens) CpG-island No: 25778
accctatatctatacttaaataaaaacgaacacgaaactaaaactaaaaatcgacctctacctaaaaaatcccgatctctaaacgaaaataaaacgaaatataacgcgaaaataaaacgaaaactttccccatcgactaaacgcgccgaacgatctaaacgactacgtctaataaaacgaaaaaccgccgaattaaacctatccgctacgaaaaaaacgaaacttcctacgcgaaaacccgaaccgctcaatctccctactctccgtaatcccgactcgcgtataacgacgacgacgacgtctccgtaaaaaaacgcgcgaaaccataacgtcaacgtccacaaaaattcgacctccctcgcgaacaacgctccctaacgaccacgaaaaaacgaaccccccacttaactcgcgactcttccgccccgaacgaaaaacgaacgaaaaccgaacctaaaataaaactaaaaactccgaacgaaacgaaaaaaacgaacgccgaccccccgtaacgctaccccgcccccaaatcgaaaaaatcttctcgacgaccgacgccgccttcacgaaactcgaaaaactaacgatacaactacatcccgtaaccgactcttctcctacgaaatacgtaaacccgaactaaaacgtaaacgctaaaaacgaacgcttaaactcgatcacaaacac

SEQ ID NO: 25779 - DNA, 687 bp, Artificial Sequence
  chemically treated genomic DNA (Homo sapiens) CpG-island No: 25779
gttttgtgtttgtgtttgagtgggggcgagtacggggttgagattagaggtcggtttttgtttggaaagtttcgatttttgagcggaagtggagcgaagtgtggcgcggaagtgaggcgaaggttttttttatcgattgggcgcgtcgagcggtttaagcgattgcgtttgatggggcggggagtcgtcgggttgagtttattcgttgcggggagggcgggattttttgcgcgggggttcgagtcgtttagtttttttgtttttcgtggtttcggttcgcgtgtagcggcggcggcggcgttttcgtgaggaggcgcgcggggttatgacgttagcgtttataaaggttcgatttttttcgcggatagcgttttttggcggttacgggagggcgggttttttatttggttcgcggttttttcgtttcgggcggggggcgggcgggagtcgagtttggggtggggttaggggtttcgggcgggacggggagggcgggcgtcggtttttcgtgacgttgtttcgtttttaggtcggagagattttttcggcggtcggcgtcgtttttacgaagttcggggagttgacgatgtagttgtatttcgtggtcgattttttttttgcggggtacgtgagttcggattgggacgtggacgttgagagcgggcgtttggattcggttatagatat

SEQ ID NO: 25780 - DNA, 687 bp, Artificial Sequence
  chemically treated genomic DNA (Homo sapiens) CpG-island No: 25780
atatctataaccgaatccaaacgcccgctctcaacgtccacgtcccaatccgaactcacgtaccccgcaaaaaaaaaatcgaccacgaaatacaactacatcgtcaactccccgaacttcgtaaaaacgacgccgaccgccgaaaaaatctctccgacctaaaaacgaaacaacgtcacgaaaaaccgacgcccgccctccccgtcccgcccgaaacccctaaccccaccccaaactcgactcccgcccgccccccgcccgaaacgaaaaaaccgcgaaccaaataaaaaacccgccctcccgtaaccgccaaaaaacgctatccgcgaaaaaaatcgaacctttataaacgctaacgtcataaccccgcgcgcctcctcacgaaaacgccgccgccgccgctacacgcgaaccgaaaccacgaaaaacaaaaaaactaaacgactcgaacccccgcgcaaaaaatcccgccctccccgcaacgaataaactcaacccgacgactccccgccccatcaaacgcaatcgcttaaaccgctcgacgcgcccaatcgataaaaaaaaccttcgcctcacttccgcgccacacttcgctccacttccgctcaaaaatcgaaactttccaaacaaaaaccgacctctaatctcaaccccgtactcgcccccactcaaacacaaacacaaaac

SEQ ID NO: 25781 - DNA, 620 bp, Artificial Sequence
  chemically treated genomic DNA (Homo sapiens) CpG-island No: 25781
tattgcgaggcgtttaattttatcgaggcgttttataatttgttcggtttgttgggtttgtttttgcgttataatagtttttcggagttgcgcgtcggttagtttacggggttaatgtagtttacgtggttttatttggattataattatatttgtttcgtgtagggggacgttttttagaaattgcgtcgagttaaggaatttacgttgagttttaattagattatttaattgtttaatattatttttcggtttatgtttaatttgcgtagcgtggatttttcgtataataagttgtaggcgttcgcgttcgattttttttacgggttgcggaagtttattacgttgtatatgcgggttaacgttatttagtttgtgttcgtgcgtattttttaggattgtcgtagttttaagtttttcgatatcggatataattagtttaagagtttggcgcgtaattttttcgtcggtttgtttaagtttatcgagttgtatttcgagtataacgatttggttaaggtgaatttcgtttatttttcgcgttttatttttttgtattcgttttgtttgcggaggaataaggtggttattgtggttagttcgttggattgggtttggaa

SEQ ID NO: 25782 - DNA, 620 bp, Artificial Sequence
  chemically treated genomic DNA (Homo sapiens) CpG-island No: 25782
ttccaaacccaatccaacgaactaaccacaataaccaccttattcctccgcaaacaaaacgaatacaaaaaaataaaacgcgaaaaataaacgaaattcaccttaaccaaatcgttatactcgaaatacaactcgataaacttaaacaaaccgacgaaaaaattacgcgccaaactcttaaactaattatatccgatatcgaaaaacttaaaactacgacaatcctaaaaaatacgcacgaacacaaactaaataacgttaacccgcatatacaacgtaataaacttccgcaacccgtaaaaaaaatcgaacgcgaacgcctacaacttattatacgaaaaatccacgctacgcaaattaaacataaaccgaaaaataatattaaacaattaaataatctaattaaaactcaacgtaaattccttaactcgacgcaatttctaaaaaacgtccccctacacgaaacaaatataattataatccaaataaaaccacgtaaactacattaaccccgtaaactaaccgacgcgcaactccgaaaaactattataacgcaaaaacaaacccaacaaaccgaacaaattataaaacgcctcgataaaattaaacgcctcgcaata

SEQ ID NO: 25783 - DNA, 620 bp, Artificial Sequence
  chemically treated genomic DNA (Homo sapiens) CpG-island No: 25783
ttttaaatttagtttagcgagttgattataatggttattttgttttttcgtaggtagagcgagtgtagggagatgaggcgcgggaagtgggcgaagtttattttgattaagtcgttgtgttcgaggtgtagttcggtgagtttaaataagtcggcgaaagagttgcgcgttagatttttgagttgattgtattcgatgtcgagaaatttgaggttgcggtagttttggaagatgcgtacgggtataaattggatggcgttggttcgtatatgtagcgtggtgagttttcgtagttcgtggaagaggtcgggcgcgagcgtttgtagtttgttgtacgagaggtttacgttgcgtaggttgggtatgggtcggaaggtggtgttgggtagttgggtgatttggttggaatttagcgtgagttttttaattcggcgtagtttttgaaaggcgtttttttgtacggagtagatgtgattgtgatttagatagagttacgtgagttgtattaatttcgtgaattggtcggcgcgtagtttcgagaggttgttgtagcgtagggataagtttagtaggtcggataggttgtggggcgtttcggtgaggttgagcgtttcgtagta

SEQ ID NO: 25784 - DNA, 620 bp, Artificial Sequence
  chemically treated genomic DNA (Homo sapiens) CpG-island No: 25784
tactacgaaacgctcaacctcaccgaaacgccccacaacctatccgacctactaaacttatccctacgctacaacaacctctcgaaactacgcgccgaccaattcacgaaattaatacaactcacgtaactctatctaaatcacaatcacatctactccgtacaaaaaaacgcctttcaaaaactacgccgaattaaaaaactcacgctaaattccaaccaaatcacccaactacccaacaccaccttccgacccatacccaacctacgcaacgtaaacctctcgtacaacaaactacaaacgctcgcgcccgacctcttccacgaactacgaaaactcaccacgctacatatacgaaccaacgccatccaatttatacccgtacgcatcttccaaaactaccgcaacctcaaatttctcgacatcgaatacaatcaactcaaaaatctaacgcgcaactctttcgccgacttatttaaactcaccgaactacacctcgaacacaacgacttaatcaaaataaacttcgcccacttcccgcgcctcatctccctacactcgctctacctacgaaaaaacaaaataaccattataatcaactcgctaaactaaatttaaaa

SEQ ID NO: 25785 - DNA, 1265 bp, Artificial Sequence
  chemically treated genomic DNA (Homo sapiens) CpG-island No: 25785
cgcgtatacgtcggttttttttgttattttttcgtgggtttttagttatatacgttttcgaatttacgtttacgtcgtattttttgttttttttttatttttaaatttagtttattttgttacgtttattttcgtgtttattttcgttggtatacgcgtttatattcgcgtcggtatatttcgttatttttaggtatattttaggatttttttattcgttcggggagacgtattaggttttgtttcgtttttttatttttcgtttacgcgcgcgtttttttttatatatatagatatatatatacgtatttatatttatatatattttcgcgcgcggagttattttttttcgtacgttttcgttttgggtattttttcgcggcgagatttcgggttttttttttttttttttttattgtttggcggttcggcgtttttcggttcggtttggggtcgttgggttcgcggggatcggaggggagtcgagggcgtagttttgtcgtttttttcggatttttttttttttttcgtttcgtttgcgtcgcgtttttattatttttttttttcgggaaagggatttcgggagaggtagttcgtggtcggtcgggtttcgttcggcgcggcgtcggtagcggcgggggaagggagagagcgagggagttcgcgagttcgcgagcggagcggcgaggcggggaggggacgcgttgtcgagtcggggttggagcggcggaggttgcggtagcggcggcggcggtagtggcggcggtagtggcggcggtagtggcggcgggggagggagggttttacggacggacggacgtacgaatcgatcgagcgagggaggtagcgagcgagattgcgttggcgaggaggagtcgcgcgagcggcggttgttgggcgttttttcgcgttgttgggcgttcggcgttttcgcggtttcggttttcggtcgtagttttttcgcgcgcgcggggcgtcgggcgcggggttcgggttggtttcgcggaaggtaagagggacgcgatcgagttttttggagttaggaagtgcgaggagcgttgtttttacgtttgttgtttcggttgtttacgcggtatttttttattttcgcgttcgggtgggtgggcgttggggcgtcggaaggattgggggtggggttcgtgtcgtgggggagtagatagtcggttcgggggcgtcggttttttcgggttgtggagttattttcgggtagttaggcgttggggttcgggggtggggtgtgaatt

SEQ ID NO: 25786 - DNA, 1265 bp, Artificial Sequence
  chemically treated genomic DNA (Homo sapiens) CpG-island No: 25786
aattcacaccccacccccgaaccccaacgcctaactacccgaaaataactccacaacccgaaaaaaccgacgcccccgaaccgactatctactcccccacgacacgaaccccacccccaatccttccgacgccccaacgcccacccacccgaacgcgaaaataaaaaaataccgcgtaaacaaccgaaacaacaaacgtaaaaacaacgctcctcgcacttcctaactccaaaaaactcgatcgcgtccctcttaccttccgcgaaaccaacccgaaccccgcgcccgacgccccgcgcgcgcgaaaaaactacgaccgaaaaccgaaaccgcgaaaacgccgaacgcccaacaacgcgaaaaaacgcccaacaaccgccgctcgcgcgactcctcctcgccaacgcaatctcgctcgctacctccctcgctcgatcgattcgtacgtccgtccgtccgtaaaaccctccctcccccgccgccactaccgccgccactaccgccgccactaccgccgccgccgctaccgcaacctccgccgctccaaccccgactcgacaacgcgtcccctccccgcctcgccgctccgctcgcgaactcgcgaactccctcgctctctcccttcccccgccgctaccgacgccgcgccgaacgaaacccgaccgaccacgaactacctctcccgaaatccctttcccgaaaaaaaaaaataataaaaacgcgacgcaaacgaaacgaaaaaaaaaaaaaaatccgaaaaaaacgacaaaactacgccctcgactcccctccgatccccgcgaacccaacgaccccaaaccgaaccgaaaaacgccgaaccgccaaacaataaaaaaaaaaaaaaaaaaaacccgaaatctcgccgcgaaaaaatacccaaaacgaaaacgtacgaaaaaaaataactccgcgcgcgaaaatatatataaatataaatacgtatatatatatctatatatataaaaaaaaacgcgcgcgtaaacgaaaaataaaaaaacgaaacaaaacctaatacgtctccccgaacgaataaaaaaatcctaaaatatacctaaaaataacgaaatataccgacgcgaatataaacgcgtataccaacgaaaataaacacgaaaataaacgtaacaaaataaactaaatttaaaaataaaaaaaaaacaaaaaatacgacgtaaacgtaaattcgaaaacgtatataactaaaaacccacgaaaaaataacaaaaaaaaccgacgtatacgcg

SEQ ID NO: 25787 - DNA, 1265 bp, Artificial Sequence
  chemically treated genomic DNA (Homo sapiens) CpG-island No: 25787
ggtttatattttattttcgaattttagcgtttggttgttcggaggtggttttatagttcgagggaatcgacgttttcgggtcggttgtttgtttttttacggtacgggttttatttttaattttttcggcgttttagcgtttatttattcgggcgcgggagtgggagggtgtcgcgtgggtagtcggagtaataggcgtgggagtagcgtttttcgtattttttggttttagaaggttcggtcgcgttttttttatttttcgcgaagttagttcgggtttcgcgttcggcgtttcgcgcgcgcgaggaagttgcggtcgggagtcggggtcgcggaggcgtcgagcgtttagtagcgcggggaagcgtttagtagtcgtcgttcgcgcggttttttttcgttagcgtagtttcgttcgttgtttttttcgttcggtcggttcgtgcgttcgttcgttcgtggggttttttttttttcgtcgttattgtcgtcgttattgtcgtcgttattgtcgtcgtcgtcgttgtcgtagttttcgtcgttttagtttcggttcggtagcgcgtttttttttcgtttcgtcgtttcgttcgcgggttcgcgggttttttcgtttttttttttttttcgtcgttgtcggcgtcgcgtcgagcggagttcggtcggttacgggttgtttttttcgaggtttttttttcgagggggggaggtggtgggggcgcggcgtaggcggggcggggaggagaggagagttcgggggaggcggtaaggttgcgttttcggttttttttcgattttcgcgggtttagcggttttaggtcgggtcggagagcgtcgagtcgttaggtagtggaggaagagaggaggaggattcggagtttcgtcgcgggagggtgtttagggcgagggcgtgcgagggggagtgatttcgcgcgcgagggtgtgtatgagtgtgagtgcgtgtgtgtgtgtttgtgtgtgtggagaggggcgcgcgcgtgagcggggggtggggagacgaggtagagtttagtgcgttttttcgggcgagtggaggaattttagggtgtgtttggaggtggcggagtgtatcgacgcgggtgtgagcgcgtgtgttagcgagggtgggtacgggggtgagcgtggtaaggtgagttgggtttgggggtgggggaggagtagggagtacggcgtgagcgtaagttcgggggcgtgtgtggttggggatttacggagaggtggtagggagggtcggcgtgtgcgcg

SEQ ID NO: 25788 - DNA, 1265 bp, Artificial Sequence
  chemically treated genomic DNA (Homo sapiens) CpG-island No: 25788
cgcgcacacgccgaccctccctaccacctctccgtaaatccccaaccacacacgcccccgaacttacgctcacgccgtactccctactcctcccccacccccaaacccaactcaccttaccacgctcacccccgtacccaccctcgctaacacacgcgctcacacccgcgtcgatacactccgccacctccaaacacaccctaaaattcctccactcgcccgaaaaaacgcactaaactctacctcgtctccccaccccccgctcacgcgcgcgcccctctccacacacacaaacacacacacacgcactcacactcatacacaccctcgcgcgcgaaatcactccccctcgcacgccctcgccctaaacaccctcccgcgacgaaactccgaatcctcctcctctcttcctccactacctaacgactcgacgctctccgacccgacctaaaaccgctaaacccgcgaaaatcgaaaaaaaaccgaaaacgcaaccttaccgcctcccccgaactctcctctcctccccgccccgcctacgccgcgcccccaccacctccccccctcgaaaaaaaaacctcgaaaaaaacaacccgtaaccgaccgaactccgctcgacgcgacgccgacaacgacgaaaaaaaaaaaaaaacgaaaaaacccgcgaacccgcgaacgaaacgacgaaacgaaaaaaaaacgcgctaccgaaccgaaactaaaacgacgaaaactacgacaacgacgacgacgacaataacgacgacaataacgacgacaataacgacgaaaaaaaaaaaaccccacgaacgaacgaacgcacgaaccgaccgaacgaaaaaaacaacgaacgaaactacgctaacgaaaaaaaaccgcgcgaacgacgactactaaacgcttccccgcgctactaaacgctcgacgcctccgcgaccccgactcccgaccgcaacttcctcgcgcgcgcgaaacgccgaacgcgaaacccgaactaacttcgcgaaaaataaaaaaaacgcgaccgaaccttctaaaaccaaaaaatacgaaaaacgctactcccacgcctattactccgactacccacgcgacaccctcccactcccgcgcccgaataaataaacgctaaaacgccgaaaaaattaaaaataaaacccgtaccgtaaaaaaacaaacaaccgacccgaaaacgtcgattccctcgaactataaaaccacctccgaacaaccaaacgctaaaattcgaaaataaaatataaacc

SEQ ID NO: 25789 - DNA, 878 bp, Artificial Sequence
  chemically treated genomic DNA (Homo sapiens) CpG-island No: 25789
cgcgtttttcgttcgatattatatttagtttgattagttgtatcgtgtaagtggttcgtttattggttagtagttttgtgtatttcgttttatattcgtttcgtagtcgagttcgggttacgggtatatagcgagtatgcgtttcggaattttagtagcgtttaggcggggtcggggcgtttgcgttcggggcgtcggtttaggcgaagtgagttaggtttagtcgggaagttttaggacgaagcggcgcgcggattatggttttaggtagatttcgttcgttcgagtagcgtttcgatagtggtcgcgtaggagtcggcgggcgaaggttatgggcgttttagcgacgtcgttttcgtttcgtttcggaaacgaaatttggcgggagttaggcgtcggcgggaaacgaaattcggagggagttaggcgttagcgggaaacgaaagcgaagcgttgcggggaaacgaaagtcggacgtttaggcggggtaggagttttggggttggggcgttttttcggtttttttttttcgtcgcgagatgtgcgcgataaacggtcggcgttcgggagtagacgtttggtttcggggttttaggtgcgcggtttcgcgggtttgcgcggtttttaggcgtcggttttcggggttgatatcgaatgaggtttcgcgtcgtcggttttaaggtagtttcgtgtgcgttttgcgggtggttggcggttcgattttggtttgagttttttttttgcggtttatgtcgggtgtatggaggggggcgggggtgtacgcgcgagggatagagaagttttttttcggtgtaacgggttttttaacgtttatttgtaggcgtattattgtttttggatgattgattaggttttgt

SEQ ID NO: 25790 - DNA, 878 bp, Artificial Sequence
  chemically treated genomic DNA (Homo sapiens) CpG-island No: 25790
acaaaacctaatcaatcatccaaaaacaataatacgcctacaaataaacgttaaaaaacccgttacaccgaaaaaaaacttctctatccctcgcgcgtacacccccgcccccctccatacacccgacataaaccgcaaaaaaaaaactcaaaccaaaatcgaaccgccaaccacccgcaaaacgcacacgaaactaccttaaaaccgacgacgcgaaacctcattcgatatcaaccccgaaaaccgacgcctaaaaaccgcgcaaacccgcgaaaccgcgcacctaaaaccccgaaaccaaacgtctactcccgaacgccgaccgtttatcgcgcacatctcgcgacgaaaaaaaaaaaccgaaaaaacgccccaaccccaaaactcctaccccgcctaaacgtccgactttcgtttccccgcaacgcttcgctttcgtttcccgctaacgcctaactccctccgaatttcgtttcccgccgacgcctaactcccgccaaatttcgtttccgaaacgaaacgaaaacgacgtcgctaaaacgcccataaccttcgcccgccgactcctacgcgaccactatcgaaacgctactcgaacgaacgaaatctacctaaaaccataatccgcgcgccgcttcgtcctaaaacttcccgactaaacctaactcacttcgcctaaaccgacgccccgaacgcaaacgccccgaccccgcctaaacgctactaaaattccgaaacgcatactcgctatatacccgtaacccgaactcgactacgaaacgaatataaaacgaaatacacaaaactactaaccaataaacgaaccacttacacgatacaactaatcaaactaaatataatatcgaacgaaaaacgcg

SEQ ID NO: 25791 - DNA, 878 bp, Artificial Sequence
  chemically treated genomic DNA (Homo sapiens) CpG-island No: 25791
gtagggtttggttagttatttaagggtagtagtgcgtttgtaagtgggcgttgaagagttcgttatatcgggaagggatttttttgtttttcgcgcgtgtattttcgtttttttttatgtattcggtataagtcgtagaggaggaatttaaattagggtcgggtcgttagttattcgtagaacgtatacggagttattttggagtcgacggcgcggggttttattcggtgttagtttcgggagtcggcgtttggggatcgcgtaggttcgcggagtcgcgtatttggggtttcggggttaagcgtttgttttcgagcgtcggtcgtttatcgcgtatatttcgcggcgaggaggagaggtcggaagggcgttttagttttagggtttttgtttcgtttgggcgttcggttttcgttttttcgtaacgtttcgttttcgtttttcgttggcgtttggtttttttcgggtttcgtttttcgtcggcgtttggttttcgttaggtttcgttttcgaggcggggcgagggcggcgtcgttgaggcgtttatggttttcgttcgtcggtttttgcgcggttattgtcggggcgttgttcgggcgggcggggtttgtttggggttatggttcgcgcgtcgtttcgttttggagtttttcgattgaatttggtttatttcgtttaggtcgacgtttcggacgtagacgtttcgatttcgtttgggcgttgttgggatttcggagcgtatattcgttgtgtgttcgtgattcggattcggttgcgggacgggtatggagcgggatgtatagggttgttgattagtggacgggttatttgtacggtgtagttggttaggttggatgtagtgtcgggcgggaggcgcg

SEQ ID NO: 25792 - DNA, 878 bp, Artificial Sequence
  chemically treated genomic DNA (Homo sapiens) CpG-island No: 25792
cgcgcctcccgcccgacactacatccaacctaaccaactacaccgtacaaataacccgtccactaatcaacaaccctatacatcccgctccatacccgtcccgcaaccgaatccgaatcacgaacacacaacgaatatacgctccgaaatcccaacaacgcccaaacgaaatcgaaacgtctacgtccgaaacgtcgacctaaacgaaataaaccaaattcaatcgaaaaactccaaaacgaaacgacgcgcgaaccataaccccaaacaaaccccgcccgcccgaacaacgccccgacaataaccgcgcaaaaaccgacgaacgaaaaccataaacgcctcaacgacgccgccctcgccccgcctcgaaaacgaaacctaacgaaaaccaaacgccgacgaaaaacgaaacccgaaaaaaaccaaacgccaacgaaaaacgaaaacgaaacgttacgaaaaaacgaaaaccgaacgcccaaacgaaacaaaaaccctaaaactaaaacgcccttccgacctctcctcctcgccgcgaaatatacgcgataaacgaccgacgctcgaaaacaaacgcttaaccccgaaaccccaaatacgcgactccgcgaacctacgcgatccccaaacgccgactcccgaaactaacaccgaataaaaccccgcgccgtcgactccaaaataactccgtatacgttctacgaataactaacgacccgaccctaatttaaattcctcctctacgacttataccgaatacataaaaaaaaacgaaaatacacgcgcgaaaaacaaaaaaatcccttcccgatataacgaactcttcaacgcccacttacaaacgcactactacccttaaataactaaccaaaccctac

SEQ ID NO: 25793 - DNA, 535 bp, Artificial Sequence
  chemically treated genomic DNA (Homo sapiens) CpG-island No: 25793
atattttggcgacggtacgagtatgagagtagatattttcgtagtatagcggtataagagagcgattgtatcgcgcgacgtcgtcgattgagatagtaatagtagtgtgcgtttatgttaggatacgatgtgagtaggcgagaggcggtggtgtagagattttgcgggtagattggcgtaagtgtggtttcgattagtatagcgggcgtgagttgggtatttcgcgtcgtgtgagaacgaggtatcgttttagttagacgtgagggtgcggtgtagaggatgtgtaatattatacggtggtatagtagcgaaattaagcgttgagggcgttgcgagagttgggttcggtacgacgtaaagagggtcggcgatgagtcgtcgaatgtgggagtagagcgtacgggcgggagagggtggggagtatagaggcggagtttcgggagcgttgagagtatgtggaacgttacgggtaggttggttagaagtagggtattttggggagggggtgagttggtttgtaaagaatggggtgtat

SEQ ID NO: 25794 - DNA, 535 bp, Artificial Sequence
  chemically treated genomic DNA (Homo sapiens) CpG-island No: 25794
atacaccccattctttacaaaccaactcaccccctccccaaaataccctacttctaaccaacctacccgtaacgttccacatactctcaacgctcccgaaactccgcctctatactccccaccctctcccgcccgtacgctctactcccacattcgacgactcatcgccgaccctctttacgtcgtaccgaacccaactctcgcaacgccctcaacgcttaatttcgctactataccaccgtataatattacacatcctctacaccgcaccctcacgtctaactaaaacgatacctcgttctcacacgacgcgaaatacccaactcacgcccgctatactaatcgaaaccacacttacgccaatctacccgcaaaatctctacaccaccgcctctcgcctactcacatcgtatcctaacataaacgcacactactattactatctcaatcgacgacgtcgcgcgatacaatcgctctcttataccgctatactacgaaaatatctactctcatactcgtaccgtcgccaaaatat

SEQ ID NO: 25795 - DNA, 535 bp, Artificial Sequence
  chemically treated genomic DNA (Homo sapiens) CpG-island No: 25795
atgtattttattttttataagttagtttattttttttttagagtattttatttttggttaatttattcgtagcgttttatatgtttttaacgttttcgaagtttcgtttttgtattttttattttttttcgttcgtgcgttttgtttttatattcgacggtttatcgtcggttttttttgcgtcgtgtcggatttagttttcgtaacgtttttaacgtttgatttcgttgttatgttatcgtgtggtgttatatattttttatatcgtatttttacgtttagttaagacggtatttcgtttttatacggcgcggaatgtttagtttacgttcgttatgttagtcgaggttatatttacgttagtttattcgtagggtttttatattatcgtttttcgtttatttatatcgtattttgatatgggcgtatattattattgttattttaatcgacgacgtcgcgcgatgtagtcgtttttttgtgtcgttatattgcgggagtgtttgtttttatgttcgtgtcgtcgttagggtat

SEQ ID NO: 25796 - DNA, 535 bp, Artificial Sequence
  chemically treated genomic DNA (Homo sapiens) CpG-island No: 25796
ataccctaacgacgacacgaacataaaaacaaacactcccgcaatataacgacacaaaaaaacgactacatcgcgcgacgtcgtcgattaaaataacaataataatatacgcccatatcaaaatacgatataaataaacgaaaaacgataatataaaaaccctacgaataaactaacgtaaatataacctcgactaacataacgaacgtaaactaaacattccgcgccgtataaaaacgaaataccgtcttaactaaacgtaaaaatacgatataaaaaatatataacaccacacgataacataacaacgaaatcaaacgttaaaaacgttacgaaaactaaatccgacacgacgcaaaaaaaaccgacgataaaccgtcgaatataaaaacaaaacgcacgaacgaaaaaaaataaaaaatacaaaaacgaaacttcgaaaacgttaaaaacatataaaacgctacgaataaattaaccaaaaataaaatactctaaaaaaaaaataaactaacttataaaaaataaaatacat

SEQ ID NO: 25797 - DNA, 597 bp, Artificial Sequence
  chemically treated genomic DNA (Homo sapiens) CpG-island No: 25797
gggacgggcgtttatagcggcgcgtggggggggcgcgcggaaggtcggtatgaggtacgagtgagggggagagcgggggcggtgagtaagttgagatagaagggagcgggaggcgggaggggaggcgtacgtggtcggagagtggtagggggacgcgcgttttagcggcggggtgtgatagtagaaaatgggagataagtttgcggcgggggtggttgaggagggagaagggggggggggcggtttcggtagtgcgtacgggggggggggggaggaggagacgagaagacgcggcgcggcgcggggggcgtgtgacgaatgagaaggagggtgtgggatgcgtagttcgcgaatatgttaggttggagacgcgaagagggggtcgtttagttgggaggggttatagagtgtgaagagtgtgggacgaatcgggagggttatatagtagggggggggggtaggcgcgtaagcgaggtgcggggtgtgcgcggggggagtgttcgggtgggggcgttaggggtcgtatggaatgtaaggtatttttttagattgtgagagtcgaatgtaagttatttttttagattgtgagagtcgatg

SEQ ID NO: 25798 - DNA, 597 bp, Artificial Sequence
  chemically treated genomic DNA (Homo sapiens) CpG-island No: 25798
catcgactctcacaatctaaaaaaataacttacattcgactctcacaatctaaaaaaataccttacattccatacgacccctaacgcccccacccgaacactccccccgcgcacaccccgcacctcgcttacgcgcctaccccccccccctactatataaccctcccgattcgtcccacactcttcacactctataacccctcccaactaaacgaccccctcttcgcgtctccaacctaacatattcgcgaactacgcatcccacaccctccttctcattcgtcacacgccccccgcgccgcgccgcgtcttctcgtctcctcctcccccccccccccgtacgcactaccgaaaccgcccccccccccttctccctcctcaaccacccccgccgcaaacttatctcccattttctactatcacaccccgccgctaaaacgcgcgtccccctaccactctccgaccacgtacgcctcccctcccgcctcccgctcccttctatctcaacttactcaccgcccccgctctccccctcactcgtacctcataccgaccttccgcgcgccccccccacgcgccgctataaacgcccgtccc

SEQ ID NO: 25799 - DNA, 597 bp, Artificial Sequence
  chemically treated genomic DNA (Homo sapiens) CpG-island No: 25799
tatcgatttttataatttgaaagaatggtttgtattcgatttttataatttgaaagaatgttttgtattttatgcggtttttaacgtttttattcggatatttttttcgcgtatatttcgtatttcgtttgcgcgtttgttttttttttttattatatggttttttcggttcgttttatattttttatattttataattttttttagttgggcggtttttttttcgcgtttttaatttagtatgttcgcgggttgcgtattttatatttttttttttattcgttatacgtttttcgcgtcgcgtcgcgttttttcgtttttttttttttttttttttcgtacgtattgtcgaagtcgtttttttttttttttttttttttagttattttcgtcgtaggtttattttttattttttgttgttatatttcgtcgttggggcgcgcgtttttttgttatttttcgattacgtgcgttttttttttcgtttttcgtttttttttattttagtttgtttatcgttttcgtttttttttttattcgtattttatatcgatttttcgcgcgttttttttacgcgtcgttatagacgttcgtttt

SEQ ID NO: 25800 - DNA, 597 bp, Artificial Sequence
  chemically treated genomic DNA (Homo sapiens) CpG-island No: 25800
aaaacgaacgtctataacgacgcgtaaaaaaaacgcgcgaaaaatcgatataaaatacgaataaaaaaaaaaacgaaaacgataaacaaactaaaataaaaaaaaacgaaaaacgaaaaaaaaaacgcacgtaatcgaaaaataacaaaaaaacgcgcgccccaacgacgaaatataacaacaaaaaataaaaaataaacctacgacgaaaataactaaaaaaaaaaaaaaaaaaaaaaacgacttcgacaatacgtacgaaaaaaaaaaaaaaaaaaaaacgaaaaaacgcgacgcgacgcgaaaaacgtataacgaataaaaaaaaaaatataaaatacgcaacccgcgaacatactaaattaaaaacgcgaaaaaaaaaccgcccaactaaaaaaaattataaaatataaaaaatataaaacgaaccgaaaaaaccatataataaaaaaaaaaaacaaacgcgcaaacgaaatacgaaatatacgcgaaaaaaatatccgaataaaaacgttaaaaaccgcataaaatacaaaacattctttcaaattataaaaatcgaatacaaaccattctttcaaattataaaaatcgata

SEQ ID NO: 25801 - DNA, 1200 bp, Artificial Sequence
  chemically treated genomic DNA (Homo sapiens) CpG-island No: 25801
  misc_feature (95)..(95): n is either a, c, g or t
  misc_feature (368)..(368): n is either a, c, g or t
  misc_feature (405)..(405): n is either a, c, g or t
  misc_feature (515)..(515): n is either a, c, g or t
  misc_feature (596)..(596): n is either a, c, g or t
  misc_feature (733)..(733): n is either a, c, g or t
  misc_feature (775)..(775): n is either a, c, g or t
  misc_feature (832)..(832): n is either a, c, g or t
  misc_feature (864)..(864): n is either a, c, g or t
  misc_feature (891)..(891): n is either a, c, g or t
  misc_feature (897)..(897): n is either a, c, g or t
  misc_feature (922)..(922): n is either a, c, g or t
  misc_feature (930)..(930): n is either a, c, g or t
  misc_feature (952)..(952): n is either a, c, g or t
  misc_feature (1080)..(1080): n is either a, c, g or t
  misc_feature (1134)..(1134): n is either a, c, g or t
gcgcgtcgcggtttttttttcgttttttttttttttttttttcgggtttttttttttttttttcgtttttttttcggttttcgtttttttttttnttttttgttttttttcgtttcgtcgtttttcgtttttttcgtttttttttttcgttttttttttcgcggcgtttttttttttcggttttttttttttttttttttttttttcgcgtcgtttttttttttttttttttttttttttttttttgtttttttttttttcgtggttcgttcgtttttgtttttttttcgcgttttttcgttgttttcgttttcgcgtgcgttttttttttcgttttttttttttttttcgttttttttttttttttntttttttttcgttcgcggtcgttcggttttcgttttntttttttttttttttttttttttttttttttttttttcgcgcgtcgttcggttttttttttttttttttttttttttttttttttttcgttgtgttttcgcgtttttcgntcgttttttttttttttttttttgttttttttttttcgcgtttcgtttttttttttttttttttttttttttttttttttntttttttgtcgttttttttttttcgttttttttttcgtttttttttttttttcgttttttcgttcgtcgtttttttcgtttttttcgtttttttttgcgcgttcgttcgtttttttttttttttttttttttttttntttcgtttttttttcgttttttttcgtttttttttttttttnttttttttttgtttttttttttcgttttttttgcggtcgtttttttttttttttttntttttcgtttgtcgcgtcgttttttttgtttngcgttttttttttcgtttcgtttcgtntttcgncgcggttcgtttttttttttttttnttttgttntttttttgcgttttttttcgtnttggcggcgtttttcgcgcgtcgttcgtttttttttttttttttttttttttttttttttttttttttttgtttcgcgttttttcgttgttttttttttcgttttcgttttttttttttttttttttnttttcgtcggtttcgtttcgttttttcgtgtttttcggtttttttttttttcgnttttcgtttttttttcgttttcgttttttttcgttttttttcgttttcggttgtttcgtttttttt

SEQ ID NO: 25802 - DNA, 1200 bp, Artificial Sequence
  chemically treated genomic DNA (Homo sapiens) CpG-island No: 25802
  misc_feature (67)..(67): n is either a, c, g or t
  misc_feature (121)..(121): n is either a, c, g or t
  misc_feature (249)..(249): n is either a, c, g or t
  misc_feature (271)..(271): n is either a, c, g or t
  misc_feature (279)..(279): n is either a, c, g or t
  misc_feature (304)..(304): n is either a, c, g or t
  misc_feature (310)..(310): n is either a, c, g or t
  misc_feature (337)..(337): n is either a, c, g or t
  misc_feature (369)..(369): n is either a, c, g or t
  misc_feature (426)..(426): n is either a, c, g or t
  misc_feature (468)..(468): n is either a, c, g or t
  misc_feature (605)..(605): n is either a, c, g or t
  misc_feature (686)..(686): n is either a, c, g or t
  misc_feature (796)..(796): n is either a, c, g or t
  misc_feature (833)..(833): n is either a, c, g or t
  misc_feature (1106)..(1106): n is either a, c, g or t
aaaaaaaacgaaacaaccgaaaacgaaaaaaaacgaaaaaaaacgaaaacgaaaaaaaaacgaaaancgaaaaaaaaaaaaaccgaaaaacacgaaaaaacgaaacgaaaccgacgaaaanaaaaaaaaaaaaaaaaaaaacgaaaacgaaaaaaaaaacaacgaaaaaacgcgaaacaaaaaaaaaaaaaaaaaaaaaaaaaaaaaaaaaaaaaaaaaaacgaacgacgcgcgaaaaacgccgccaanacgaaaaaaaacgcaaaaaaanaacaaaanaaaaaaaaaaaaaaacgaaccgcgncgaaanacgaaacgaaacgaaaaaaaaaacgcnaaacaaaaaaaacgacgcgacaaacgaaaaanaaaaaaaaaaaaaaaaacgaccgcaaaaaaaacgaaaaaaaaaaacaaaaaaaaaanaaaaaaaaaaaaaaacgaaaaaaaacgaaaaaaaaacgaaanaaaaaaaaaaaaaaaaaaaaaaaaaaacgaacgaacgcgcaaaaaaaaacgaaaaaaacgaaaaaaacgacgaacgaaaaaacgaaaaaaaaaaaaaaacgaaaaaaaaaacgaaaaaaaaaaaacgacaaaaaaanaaaaaaaaaaaaaaaaaaaaaaaaaaaaaaaaaaacgaaacgcgaaaaaaaaaaaacaaaaaaaaaaaaaaaaaaaacgancgaaaaacgcgaaaacacaacgaaaaaaaaaaaaaaaaaaaaaaaaaaaaaaaaaaaaccgaacgacgcgcgaaaaaaaaaaaaaaaaaaaaaaaaaaaaaaaaaaaaanaaaacgaaaaccgaacgaccgcgaacgaaaaaaaaanaaaaaaaaaaaaaaaacgaaaaaaaaaaaaaaaacgaaaaaaaaaacgcacgcgaaaacgaaaacaacgaaaaaacgcgaaaaaaaaacaaaaacgaacgaaccacgaaaaaaaaaaaaacaaaaaaaaaaaaaaaaaaaaaaaaaaaaaaaaacgacgcgaaaaaaaaaaaaaaaaaaaaaaaaaaccgaaaaaaaaaaacgccgcgaaaaaaaaaacgaaaaaaaaaaacgaaaaaaacgaaaaacgacgaaacgaaaaaaaacaaaaaanaaaaaaaaaaacgaaaaccgaaaaaaaaacgaaaaaaaaaaaaaaaaacccgaaaaaaaaaaaaaaaaaaaacgaaaaaaaaaccgcgacgcgc

SEQ ID NO: 25803 - DNA, 1200 bp, Artificial Sequence
  chemically treated genomic DNA (Homo sapiens) CpG-island No: 25803
  misc_feature (67)..(67): n is either a, c, g or t
  misc_feature (121)..(121): n is either a, c, g or t
  misc_feature (249)..(249): n is either a, c, g or t
  misc_feature (271)..(271): n is either a, c, g or t
  misc_feature (279)..(279): n is either a, c, g or t
  misc_feature (304)..(304): n is either a, c, g or t
  misc_feature (310)..(310): n is either a, c, g or t
  misc_feature (337)..(337): n is either a, c, g or t
  misc_feature (369)..(369): n is either a, c, g or t
  misc_feature (426)..(426): n is either a, c, g or t
  misc_feature (468)..(468): n is either a, c, g or t
  misc_feature (605)..(605): n is either a, c, g or t
  misc_feature (686)..(686): n is either a, c, g or t
  misc_feature (796)..(796): n is either a, c, g or t
  misc_feature (833)..(833): n is either a, c, g or t
  misc_feature (1106)..(1106): n is either a, c, g or t
ggaggaggcggggtagtcgagagcgaggagagacgaggaaaagcgaggacgaaaagagagcgaggancgaggaaggagagagtcgagaagtacgggagggcgaagcggagtcggcgggganggaggggggaggagagggggcggagacggagaaggaggtagcggggggacgcggggtagagggggaagggggggggaggagagagaggagagaagagaagcgagcgacgcgcgggaggcgtcgttagngcgagaggggacgtaggagganggtaggangggagagggagggagcgggtcgcgncggagngcggagcgaggcggggaggaaaacgtnaagtagagagggcggcgcggtaggcgggggangggagaaggagggaggacggtcgtagggagggcgagaggggggggtaggaggaaggngggaggaggggagaacggaggggagcggggggggggcggggngagaaaggaggagaggagagagggaggcggacgggcgcgtagagagaggcgggaaggacgaagagaacggcggacggggaggcggaaggggagggggaacggaagggggagcgggggagggggggcggtaggagggnagggggggaaaaaaggagggggagaagaagagaggcggagcgcggggggggagggataagagaggagaggggggggacgancgggaagcgcggggatatagcggaggaagaggaaggagggggagggaggagagagggatcgagcggcgcgcgaggagggggagagaagggggagagggaggagagaaagnagaacggaggtcgagcggtcgcggacgaggggagagnggggggggaggggggacgagaggaagggggggggcgagggagggggcgtacgcggaggcggagataacgagggagcgcggggggggagtagaggcgggcgggttacgaggaggaggggagtagaaagagagaaagggaaggagaagagaaagggcgacgcgggagaggagggggggagaagagagggtcgagaggggagggcgtcgcgggggaggaggcggaggaagggaacgggaggagcggggagcggcggggcggagggaggtaggagangagagggggggcgggggtcgggggggagacggggggggggggggggagttcggggagaaggggaaagaagggcgggggggggatcgcgacgcgt

SEQ ID NO: 25804 - DNA, 1200 bp, Artificial Sequence
  chemically treated genomic DNA (Homo sapiens) CpG-island No: 25804
  misc_feature (95)..(95): n is either a, c, g or t
  misc_feature (368)..(368): n is either a, c, g or t
  misc_feature (405)..(405): n is either a, c, g or t
  misc_feature (515)..(515): n is either a, c, g or t
  misc_feature (596)..(596): n is either a, c, g or t
  misc_feature (733)..(733): n is either a, c, g or t
  misc_feature (775)..(775): n is either a, c, g or t
  misc_feature (832)..(832): n is either a, c, g or t
  misc_feature (864)..(864): n is either a, c, g or t
  misc_feature (891)..(891): n is either a, c, g or t
  misc_feature (897)..(897): n is either a, c, g or t
  misc_feature (922)..(922): n is either a, c, g or t
  misc_feature (930)..(930): n is either a, c, g or t
  misc_feature (952)..(952): n is either a, c, g or t
  misc_feature (1080)..(1080): n is either a, c, g or t
  misc_feature (1134)..(1134): n is either a, c, g or t
acgcgtcgcgatcccccccccgcccttctttccccttctccccgaactccccccccccccccccgtctcccccccgacccccgccccccctctcntctcctacctccctccgccccgccgctccccgctcctcccgttcccttcctccgcctcctcccccgcgacgccctcccctctcgaccctctcttctccccccctcctctcccgcgtcgccctttctcttctccttccctttctctctttctactcccctcctcctcgtaacccgcccgcctctactccccccccgcgctccctcgttatctccgcctccgcgtacgccccctccctcgcccccccccttcctctcgtcccccctccccccccnctctcccctcgtccgcgaccgctcgacctccgttctnctttctctcctccctctcccccttctctccccctcctcgcgcgccgctcgatccctctctcctccctccccctccttcctcttcctccgctatatccccgcgcttcccgntcgtcccccccctctcctctcttatccctccccccccgcgctccgcctctcttcttctccccctccttttttccccccctnccctcctaccgccccccctcccccgctcccccttccgttccccctccccttccgcctccccgtccgccgttctcttcgtccttcccgcctctctctacgcgcccgtccgcctccctctctcctctcctcctttctcnccccgccccccccccgctcccctccgttctcccctcctcccnccttcctcctacccccccctctcgccctccctacgaccgtcctccctccttctcccntcccccgcctaccgcgccgccctctctacttnacgttttcctccccgcctcgctccgcnctccgncgcgacccgctccctccctctcccntcctaccntcctcctacgtcccctctcgcnctaacgacgcctcccgcgcgtcgctcgcttctcttctctcctctctctcctcccccccccttccccctctaccccgcgtccccccgctacctccttctccgtctccgccccctctcctcccccctccntccccgccgactccgcttcgccctcccgtacttctcgactctctccttcctcgntcctcgctctcttttcgtcctcgcttttcctcgtctctcctcgctctcgactaccccgcctcctcc

SEQ ID NO: 25805 - DNA, 526 bp, Artificial Sequence
  chemically treated genomic DNA (Homo sapiens) CpG-island No: 25805
cgggtggcgggggatgtcggtatagagggaggggggggagggttttacgtaggatggaggatggagggcgatgggtaaggttaggaggggcgaagagcgtgatattgtggatcgttcgggggacggaggggtgggtgaggaaggtgtggggtgggcgtaattgaggggaaggaggcgagagtggggttgatgtataggtgacgtgggagtgagatgtatgggtaaggaagggggcgggaggagatttcggagagtgggggtagtgtttgttggaaaaggagaggggggggggggagagggacgaggcggaggatgtgtgagtgtggggtaggcgagaggggggggggatatgatggggagtatggagagagagagggaatcggggggggagtgcggttagtatgtacgtagggggagggggggagggcggatgtaggtaaagggtgggtagagacggcgcggtgtataagagtaggaatagtgagggcggcgggtgtcgtgcgataggtataatggagtggtggcg

SEQ ID NO: 25806 - DNA, 526 bp, Artificial Sequence
  chemically treated genomic DNA (Homo sapiens) CpG-island No: 25806
cgccaccactccattatacctatcgcacgacacccgccgccctcactattcctactcttatacaccgcgccgtctctacccaccctttacctacatccgccctccccccctccccctacgtacatactaaccgcactccccccccgattccctctctctctccatactccccatcatatcccccccccctctcgcctaccccacactcacacatcctccgcctcgtccctctcccccccccccctctccttttccaacaaacactacccccactctccgaaatctcctcccgcccccttccttacccatacatctcactcccacgtcacctatacatcaaccccactctcgcctccttcccctcaattacgcccaccccacaccttcctcacccacccctccgtcccccgaacgatccacaatatcacgctcttcgcccctcctaaccttacccatcgccctccatcctccatcctacgtaaaaccctcccccccctccctctataccgacatcccccgccacccg

SEQ ID NO: 25807 - DNA, 526 bp, Artificial Sequence
  chemically treated genomic DNA (Homo sapiens) CpG-island No: 25807
cgttattattttattatgtttgtcgtacgatattcgtcgtttttattatttttgtttttatatatcgcgtcgtttttgtttattttttatttgtattcgttttttttttttttttttacgtatatattaatcgtatttttttttcggttttttttttttttttatattttttattatattttttttttttttcgtttgttttatatttatatatttttcgtttcgttttttttttttttttttttttttttttttaataaatattatttttatttttcgaagttttttttcgtttttttttttgtttatgtattttatttttacgttatttatgtattagttttattttcgtttttttttttttagttgcgtttattttatattttttttatttattttttcgtttttcgagcgatttataatattacgtttttcgttttttttagttttgtttatcgttttttattttttattttgcgtgaggtttttttttttttttttttatatcggtatttttcgttattcg

SEQ ID NO: 25808 - DNA, 526 bp, Artificial Sequence
  chemically treated genomic DNA (Homo sapiens) CpG-island No: 25808
cgaataacgaaaaataccgatataaaaaaaaaaaaaaaaaaacctcacgcaaaataaaaaataaaaaacgataaacaaaactaaaaaaaacgaaaaacgtaatattataaatcgctcgaaaaacgaaaaaataaataaaaaaaatataaaataaacgcaactaaaaaaaaaaaaacgaaaataaaactaatacataaataacgtaaaaataaaatacataaacaaaaaaaaaaacgaaaaaaaacttcgaaaaataaaaataatatttattaaaaaaaaaaaaaaaaaaaaaaaaaaaaaacgaaacgaaaaatatataaatataaaacaaacgaaaaaaaaaaaaaatataataaaaaatataaaaaaaaaaaaaaaaccgaaaaaaaaatacgattaatatatacgtaaaaaaaaaaaaaaaaaacgaatacaaataaaaaataaacaaaaacgacgcgatatataaaaacaaaaataataaaaacgacgaatatcgtacgacaaacataataaaataataacg

SEQ ID NO: 25809 - DNA, 552 bp, Artificial Sequence
  chemically treated genomic DNA (Homo sapiens) CpG-island No: 25809
  misc_feature (161)..(161): n is either a, c, g or t
  misc_feature (292)..(292): n is either a, c, g or t
  misc_feature (427)..(427): n is either a, c, g or t
agaacgggcgtcgtcgcgtatttcgcgatatcgttatgatatgtatttattatatcgatatttttacgtcgcgaacgcggatggcgtatatttatgaatttttcgtttattttcgttttttgatattatttaatatataatcgttttcgttttattagttngtacgttcgcggttttttttttttttttttttgtaatatattaattgatatattttttttcggtatttcgacgttcggagtttcgtttttcgttatttgttttatttacgttattcgttaattatgtttantttgttatagcgttattttttttttttttttttttcgtttttttaattattatttacgagcggtattcgttcgatcgtgttttggttagtttgcgttttttgttttttattattagttacgttttttattcgcgnttttggtcgtatttcgtatgatatttgtttatagaagtattaaaatttttagtattcgttttttttttttttatcgttcgttttttttcgttttataatgtatttaatagtttgcgttattgtcg

SEQ ID NO: 25810 - DNA, 552 bp, Artificial Sequence
  chemically treated genomic DNA (Homo sapiens) CpG-island No: 25810
  misc_feature (126)..(126): n is either a, c, g or t
  misc_feature (261)..(261): n is either a, c, g or t
  misc_feature (392)..(392): n is either a, c, g or t
cgacaataacgcaaactattaaatacattataaaacgaaaaaaaacgaacgataaaaaaaaaaaaaacgaatactaaaaattttaatacttctataaacaaatatcatacgaaatacgaccaaaancgcgaataaaaaacgtaactaataataaaaaacaaaaaacgcaaactaaccaaaacacgatcgaacgaataccgctcgtaaataataattaaaaaaacgaaaaaaaaaaaaaaaaaaaataacgctataacaaantaaacataattaacgaataacgtaaataaaacaaataacgaaaaacgaaactccgaacgtcgaaataccgaaaaaaaatatatcaattaatatattacaaaaaaaaaaaaaaaaaaaaccgcgaacgtacnaactaataaaacgaaaacgattatatattaaataatatcaaaaaacgaaaataaacgaaaaattcataaatatacgccatccgcgttcgcgacgtaaaaatatcgatataataaatacatatcataacgatatcgcgaaatacgcgacgacgcccgttct

SEQ ID NO: 25811 - DNA, 552 bp, Artificial Sequence
  chemically treated genomic DNA (Homo sapiens) CpG-island No: 25811
  misc_feature (126)..(126): n is either a, c, g or t
  misc_feature (261)..(261): n is either a, c, g or t
  misc_feature (392)..(392): n is either a, c, g or t
cggtagtggcgtaggttgttgagtgtattatggaacgaaagaagacgagcggtgagaggaggagagacgagtgttagaggttttggtgtttttgtgagtaagtgttatgcggggtgcgattagggncgcgagtggggggcgtggttagtggtaggagataggagacgtaggttgattagagtacggtcggacggatgtcgttcgtaagtggtgattaggaaggcggagaggggggggggagggggtagcgttgtgataagntgggtatggttggcgggtagcgtagatggaataggtggcggggggcggggtttcgggcgtcggggtatcggagggaggtgtgttaattggtgtgttgtaaagaaaagaggagagggggtcgcgagcgtatngattggtggggcgggggcgattatgtgttgagtggtattaggaaacgagagtgagcggagagtttatgagtgtgcgttattcgcgttcgcggcgtgagggtgtcggtgtgatggatatatgttatagcgatgtcgcgagatacgcgacggcgttcgtttt

SEQ ID NO: 25812 - DNA, 552 bp, Artificial Sequence
  chemically treated genomic DNA (Homo sapiens) CpG-island No: 25812
  misc_feature (161)..(161): n is either a, c, g or t
  misc_feature (292)..(292): n is either a, c, g or t
  misc_feature (427)..(427): n is either a, c, g or t
aaaacgaacgccgtcgcgtatctcgcgacatcgctataacatatatccatcacaccgacaccctcacgccgcgaacgcgaataacgcacactcataaactctccgctcactctcgtttcctaataccactcaacacataatcgcccccgccccaccaatcnatacgctcgcgaccccctctcctcttttctttacaacacaccaattaacacacctccctccgataccccgacgcccgaaaccccgccccccgccacctattccatctacgctacccgccaaccatacccancttatcacaacgctaccccctcccccccccctctccgccttcctaatcaccacttacgaacgacatccgtccgaccgtactctaatcaacctacgtctcctatctcctaccactaaccacgccccccactcgcgnccctaatcgcaccccgcataacacttactcacaaaaacaccaaaacctctaacactcgtctctcctcctctcaccgctcgtcttctttcgttccataatacactcaacaacctacgccactaccg

SEQ ID NO: 25813 - DNA, 564 bp, Artificial Sequence
  chemically treated genomic DNA (Homo sapiens) CpG-island No: 25813
  misc_feature (218)..(218): n is either a, c, g or t
tcgtattattaatttttatttatttattttggtttattttttatttattttaatcgtttttattaggatttatatgcgtatattttatcgttattttatatacgtatatacgtttagcgttttttttaaattattttatatcgttcgttttcgtcgtcggatagtcgttatttttatttatatttttgttatcgaatatattttagcgaatttttttngtttttcgcgtttatttatatatttttattttttttattttttacgatttttttaatatttttttcgttttttgattttatttttttttattattaatttatatttatttatttttcgtttatttttcgttcgttattttttttataattatagttgtttttttcgtttcgtcgttattatattttatttatatttatgagacgatgtttggttttttcgtttcgttttacgtcgtttcgtttatatttttttacggttattttttttttttttattttgtatttcgtttttttttgttttttttttatttttattttattttttattttttatttttattttttt

SEQ ID NO: 25814 - DNA, 564 bp, Artificial Sequence
  chemically treated genomic DNA (Homo sapiens) CpG-island No: 25814
  misc_feature (347)..(347): n is either a, c, g or t
aaaaaaataaaaataaaaaataaaaaataaaataaaaataaaaaaaaaacaaaaaaaaacgaaatacaaaataaaaaaaaaaaaaataaccgtaaaaaaatataaacgaaacgacgtaaaacgaaacgaaaaaaccaaacatcgtctcataaatataaataaaatataataacgacgaaacgaaaaaaacaactataattataaaaaaaataacgaacgaaaaataaacgaaaaataaataaatataaattaataataaaaaaaaataaaatcaaaaaacgaaaaaaatattaaaaaaatcgtaaaaaataaaaaaaataaaaatatataaataaacgcgaaaaacnaaaaaaattcgctaaaatatattcgataacaaaaatataaataaaaataacgactatccgacgacgaaaacgaacgatataaaataatttaaaaaaaacgctaaacgtatatacgtatataaaataacgataaaatatacgcatataaatcctaataaaaacgattaaaataaataaaaaataaaccaaaataaataaataaaaattaataatacga

SEQ ID NO: 25815 - DNA, 564 bp, Artificial Sequence
  chemically treated genomic DNA (Homo sapiens) CpG-island No: 25815
  misc_feature (347)..(347): n is either a, c, g or t
ggaggggtgggggtggagggtggagagtggggtgggagtaaagagaaggtaggggggggcggagtgtaggatgggagaggggggagtgatcgtaggggggtgtgagcggaacggcgtgaggcggagcgagggggttaagtatcgttttatgagtatgggtggggtgtggtgacggcgggacgagaggggtagttgtgattatggaagaaatgacgaacgggggatggacggggagtgagtgagtataggttggtagtggagaggggtggggttagagggcgggggaggtgttgaagaggtcgtggaggatgagaggggtaggggtatgtaggtgggcgcgaagggtnagagagattcgttagaatgtgttcggtgatagaagtgtaggtagaggtggcggttattcgacgacgggggcgaacggtgtgaagtggtttgaaaggggcgttgagcgtgtatgcgtgtgtgggatggcgatagagtgtgcgtatgtaggttttagtaggggcggttaaagtgggtgggaagtgggttaaggtaagtgggtagaagttagtagtgcgg

SEQ ID NO: 25816 - DNA, 564 bp, Artificial Sequence
  chemically treated genomic DNA (Homo sapiens) CpG-island No: 25816
  misc_feature (218)..(218): n is either a, c, g or t
ccgcactactaacttctacccacttaccttaacccacttcccacccactttaaccgcccctactaaaacctacatacgcacactctatcgccatcccacacacgcatacacgctcaacgcccctttcaaaccacttcacaccgttcgcccccgtcgtcgaataaccgccacctctacctacacttctatcaccgaacacattctaacgaatctctctnacccttcgcgcccacctacatacccctacccctctcatcctccacgacctcttcaacacctcccccgccctctaaccccacccctctccactaccaacctatactcactcactccccgtccatcccccgttcgtcatttcttccataatcacaactacccctctcgtcccgccgtcaccacaccccacccatactcataaaacgatacttaaccccctcgctccgcctcacgccgttccgctcacacccccctacgatcactcccccctctcccatcctacactccgcccccccctaccttctctttactcccaccccactctccaccctccacccccacccctcc

SEQ ID NO: 25817 - DNA, 603 bp, Artificial Sequence
  chemically treated genomic DNA (Homo sapiens) CpG-island No: 25817
tatttcgtttattatttttacgtttattttttatttgtcgcgttttttttttattattttttttttattatattttgtgcgcgtttttgtgttttatttattttttttttttttttttatatttggtacggcgtttttcgcgtttttgtcggattgtttttcgtaatttatagatttgttacgttttttatttcgttttttacgttattattattttttttaattataatcgttttcgattttttttcgttttggttataattgtttatatttttattatttttattagtttttaatgttttttcgcgttcggtttttttattatttattagtaatttcgttcgcgtatttttattatttcgcgttttacgcggttatttatttatagtttcgcgttttaattttttattttttttatcgtttcgcgtggtgttttttacggtatcgttttttttttttagttttttatattttttttatatttattttgtatattttttttttgcgtttttaattatttttttgttagtgaacgtttaattattcgttacgattttcgcgacgtagcgttcgttatttcgttattatttttgcgcgattttt

SEQ ID NO: 25818 - DNA, 603 bp, Artificial Sequence
  chemically treated genomic DNA (Homo sapiens) CpG-island No: 25818
aaaaatcgcgcaaaaataataacgaaataacgaacgctacgtcgcgaaaatcgtaacgaataattaaacgttcactaacaaaaaaataattaaaaacgcaaaaaaaaaatatacaaaataaatataaaaaaaatataaaaaactaaaaaaaaaaaacgataccgtaaaaaacaccacgcgaaacgataaaaaaaataaaaaattaaaacgcgaaactataaataaataaccgcgtaaaacgcgaaataataaaaatacgcgaacgaaattactaataaataataaaaaaaccgaacgcgaaaaaacattaaaaactaataaaaataataaaaatataaacaattataaccaaaacgaaaaaaaatcgaaaacgattataattaaaaaaaataataataacgtaaaaaacgaaataaaaaacgtaacaaatctataaattacgaaaaacaatccgacaaaaacgcgaaaaacgccgtaccaaatataaaaaaaaaaaaaaaaaataaataaaacacaaaaacgcgcacaaaatataataaaaaaaaaataataaaaaaaaaacgcgacaaataaaaaataaacgtaaaaataataaacgaaata

SEQ ID NO: 25819 - DNA, 603 bp, Artificial Sequence
  chemically treated genomic DNA (Homo sapiens) CpG-island No: 25819
gggagtcgcgtagaggtggtggcgaggtagcggacgttacgtcgcggggatcgtagcgggtggttagacgtttattagtaggaggatagttgaggacgtagagggagagtatgtagggtgggtatgagagaagtatgaaaagttgggagggagaagcgatgtcgtgaaggatattacgcggggcggtagaggaaatagagaattgagacgcggagttgtgagtgagtagtcgcgtgaagcgcggggtggtgaagatacgcggacgagattattagtgagtagtaggagggtcgagcgcgaagggatattaggggttggtaaaggtaatgagagtgtaagtagttgtgattagggcgagggagagtcgaaggcggttatgattagagaagatggtggtggcgtggggagcgggatggagggcgtggtaggtttgtgagttgcgagaggtagttcggtagagacgcgaagagcgtcgtgttaaatatagaggaagagagaggaagtagatagagtataagggcgcgtataaggtgtggtgagaagagggtgataagggaaggacgcgataagtggggaatagacgtgaaagtgataggcggggtg

SEQ ID NO: 25820 - DNA, 603 bp, Artificial Sequence
  chemically treated genomic DNA (Homo sapiens) CpG-island No: 25820
caccccgcctatcactttcacgtctattccccacttatcgcgtccttcccttatcaccctcttctcaccacaccttatacgcgcccttatactctatctacttcctctctcttcctctatatttaacacgacgctcttcgcgtctctaccgaactacctctcgcaactcacaaacctaccacgccctccatcccgctccccacgccaccaccatcttctctaatcataaccgccttcgactctccctcgccctaatcacaactacttacactctcattacctttaccaacccctaatatcccttcgcgctcgaccctcctactactcactaataatctcgtccgcgtatcttcaccaccccgcgcttcacgcgactactcactcacaactccgcgtctcaattctctatttcctctaccgccccgcgtaatatccttcacgacatcgcttctccctcccaacttttcatacttctctcatacccaccctacatactctccctctacgtcctcaactatcctcctactaataaacgtctaaccacccgctacgatccccgcgacgtaacgtccgctacctcgccaccacctctacgcgactccc

SEQ ID NO: 25821 - DNA, 844 bp, Artificial Sequence
  chemically treated genomic DNA (Homo sapiens) CpG-island No: 25821
tttcggcgttcgttttttcgtattttttattcggcgcgtcggttagtacgttttttaatttcgttcgcgttcggcggttattttatttcgatattcgtcgtcgtttttttttttaatcgttttattgtatttttcgttttcgtcgcgtcgcgtcgcgtcgtcgacgttcgatcggttaacgttttttttcgttttattacgtcgtcgtttcgatcgttcgttcgttatttcgtttatcggttcgattcggtcgttgcggtcgtgcgttcggttaggtttgtacgtttttttttttaatacgattcgtttgcgcgtagttcgtcgtttatggtacgcgatttatcgcggttttagtatatcgtatacgttaggtcgcgtcgcggtatttaattcgtatttcgttgtcggattgacgttcggttcgcgtcgttttcgttgcgcgttttcgcgtcgcgatttttagttcgttttgtttttttatttttcgtcgttttatttcgtatcgtttcgtttttttttgcgcggttttcgaaataataataaggtattttgggcgtatcgcgtttttttttttttattttaaaattgtttttatttttttttgtattttcgtttttttcgtttattatttgaaaacgaggtcgggttgttcgttcgtcgattataatttttaacgttcgcggtcgtttcggtagttttgttttattttattataatcgttttcgcgggtcgcgcgtttttcgcgtttttattaatatttaacgttttgttcgttttcggttttgcgtttttttttattcgaaattattagtttcgtcgttttcgcgtcgcggtttttataata

SEQ ID NO: 25822 - DNA, 844 bp, Artificial Sequence
  chemically treated genomic DNA (Homo sapiens) CpG-island No: 25822
tattataaaaaccgcgacgcgaaaacgacgaaactaataatttcgaataaaaaaaaacgcaaaaccgaaaacgaacaaaacgttaaatattaataaaaacgcgaaaaacgcgcgacccgcgaaaacgattataataaaataaaacaaaactaccgaaacgaccgcgaacgttaaaaattataatcgacgaacgaacaacccgacctcgttttcaaataataaacgaaaaaaacgaaaatacaaaaaaaaataaaaacaattttaaaataaaaaaaaaaaaacgcgatacgcccaaaataccttattattatttcgaaaaccgcgcaaaaaaaaacgaaacgatacgaaataaaacgacgaaaaataaaaaaacaaaacgaactaaaaatcgcgacgcgaaaacgcgcaacgaaaacgacgcgaaccgaacgtcaatccgacaacgaaatacgaattaaataccgcgacgcgacctaacgtatacgatatactaaaaccgcgataaatcgcgtaccataaacgacgaactacgcgcaaacgaatcgtattaaaaaaaaaaacgtacaaacctaaccgaacgcacgaccgcaacgaccgaatcgaaccgataaacgaaataacgaacgaacgatcgaaacgacgacgtaataaaacgaaaaaaaacgttaaccgatcgaacgtcgacgacgcgacgcgacgcgacgaaaacgaaaaatacaataaaacgattaaaaaaaaaaacgacgacgaatatcgaaataaaataaccgccgaacgcgaacgaaattaaaaaacgtactaaccgacgcgccgaataaaaaatacgaaaaaacgaacgccgaaa

SEQ ID NO: 25823 - DNA, 844 bp, Artificial Sequence
  chemically treated genomic DNA (Homo sapiens) CpG-island No: 25823
tgttataaggatcgcggcgcgggggcggcgagattggtgatttcggatggggaggggcgtaaggtcgggagcgggtagggcgttgggtgttaatgggggcgcgaggggcgcgcggttcgcgggggcggttgtggtgagatagagtagggttgtcggggcgatcgcggacgttggaggttataatcggcgggcgggtagttcggtttcgtttttaggtggtgagcggagagagcgggggtgtaggggggggtaagggtagttttagggtgggagagaaggggcgcggtgcgtttaggatgttttgttgttgtttcgaaggtcgcgtaggggggggcggggcgatgcgaaatagaacggcggggagtgggggggtagggcgggttggaagtcgcggcgcgggggcgcgtagcggaggcggcgcgggtcggacgttagttcgatagcggggtgcggattgagtgtcgcggcgcggtttgacgtgtacggtgtgttagggtcgcgatgggtcgcgtgttatgggcggcggattgcgcgtaggcggatcgtgttaggaaggaggacgtgtaggtttaatcggacgtacgatcgtaacggtcggatcgagtcggtaagcgagatggcgagcggacggtcgaggcggcggcgtgatgagacgagaggaggcgttggtcgatcgggcgtcggcggcgcggcgcggcgcggcgggggcgagggatgtagtagggcggttggggaggggggcggcggcgggtatcggggtggggtggtcgtcgggcgcgggcggggttggggggcgtgttgatcggcgcgtcgggtgggaggtgcgagaaggcgggcgtcgggg

SEQ ID NO: 25824 - DNA, 844 bp, Artificial Sequence
  chemically treated genomic DNA (Homo sapiens) CpG-island No: 25824
ccccgacgcccgccttctcgcacctcccacccgacgcgccgatcaacacgccccccaaccccgcccgcgcccgacgaccaccccaccccgatacccgccgccgcccccctccccaaccgccctactacatccctcgcccccgccgcgccgcgccgcgccgccgacgcccgatcgaccaacgcctcctctcgtctcatcacgccgccgcctcgaccgtccgctcgccatctcgcttaccgactcgatccgaccgttacgatcgtacgtccgattaaacctacacgtcctccttcctaacacgatccgcctacgcgcaatccgccgcccataacacgcgacccatcgcgaccctaacacaccgtacacgtcaaaccgcgccgcgacactcaatccgcaccccgctatcgaactaacgtccgacccgcgccgcctccgctacgcgcccccgcgccgcgacttccaacccgccctacccccccactccccgccgttctatttcgcatcgccccgcccccccctacgcgaccttcgaaacaacaacaaaacatcctaaacgcaccgcgccccttctctcccaccctaaaactacccttacccccccctacacccccgctctctccgctcaccacctaaaaacgaaaccgaactacccgcccgccgattataacctccaacgtccgcgatcgccccgacaaccctactctatctcaccacaaccgcccccgcgaaccgcgcgcccctcgcgcccccattaacacccaacgccctacccgctcccgaccttacgcccctccccatccgaaatcaccaatctcgccgcccccgcgccgcgatccttataaca

SEQ ID NO: 25825 - DNA, 639 bp, Artificial Sequence
  chemically treated genomic DNA (Homo sapiens) CpG-island No: 25825
aaatatataattttttgtttttttttcgttttatttaaataaatcggggcgggcgttattttttttttttattataaatatttatttcgtcgttttttttttatttatattatataattttttttcggggttttttcgtattttaataaatttttgtcgttttttttttttttattattatatcgcgtcgtcgtttcggggtttcgtattttataataatatttttcgttcgcgttttttttttttatatattatattatacgtcgttcgtttttggttttatttttattaattaaaatatgtttcgcgtgtttttttttttttttttatattatatttatattgattttcggttttgcgtttttttttatattatatttattttttttcggtttttttttttttttttagttaatttaatatatcgttggcggcgtttcgcgtcgagtatttttttatataataattttcgtcggttttttttttttttttttatattcgtatttcgaacgttatacggtcgtttcgttttatgttaataatatattttaatttcgcgggtttgtttgaaatttttatattaataataattagttttttcgttttcgttttttttatttttatttataatcgttttcg

SEQ ID NO: 25826 - DNA, 639 bp, Artificial Sequence
  chemically treated genomic DNA (Homo sapiens) CpG-island No: 25826
cgaaaacgattataaataaaaataaaaaaaacgaaaacgaaaaaactaattattattaatataaaaatttcaaacaaacccgcgaaattaaaatatattattaacataaaacgaaacgaccgtataacgttcgaaatacgaatataaaaaaaaaaaaaaaaaaccgacgaaaattattatataaaaaaatactcgacgcgaaacgccgccaacgatatattaaattaactaaaaaaaaaaaaaaaaaccgaaaaaaaataaatataatataaaaaaaaacgcaaaaccgaaaatcaatataaatataatataaaaaaaaaaaaaaaaacacgcgaaacatattttaattaataaaaataaaaccaaaaacgaacgacgtataatataatatataaaaaaaaaaaacgcgaacgaaaaatattattataaaatacgaaaccccgaaacgacgacgcgatataataataaaaaaaaaaaaaacgacaaaaatttattaaaatacgaaaaaaccccgaaaaaaaattatataatataaataaaaaaaaaacgacgaaataaatatttataataaaaaaaaaaaataacgcccgccccgatttatttaaataaaacgaaaaaaaaacaaaaaattatatattt

SEQ ID NO: 25827 - DNA, 639 bp, Artificial Sequence
  chemically treated genomic DNA (Homo sapiens) CpG-island No: 25827
cgggggcggttgtgggtggagatgaggaaagcgagagcgggggggttggttgttattagtatgggagttttaggtaggttcgcggggttgaggtgtattattaatatggggcggggcggtcgtgtggcgttcgggatacggatgtgaggagagggggggagggtcggcgggggttattatatagggaggtgttcgacgcggggcgtcgttagcggtatattgggttggttgaaggaggggggggggatcggggaggggtggatgtggtatgaaggggagcgtagagtcgggaattaatgtgggtgtgatatagaggggagggagaaggtacgcggggtatgttttggttgatgggagtggaattaagggcgggcggcgtgtggtgtgatatgtagaagaaggagacgcgggcggggagtgttgttatgaagtgcggggtttcgaggcgacggcgcggtgtagtggtagagggggaagggacggtaggggtttgttgaaatgcgagggggtttcgagggggagttgtgtaatatagatgaagggggggcgacggagtgggtatttgtaatgaggggggagggtggcgttcgtttcgatttatttgaataaggcgggggggaggtagggggttgtgtgttt

SEQ ID NO: 25828 - DNA, 639 bp, Artificial Sequence
  chemically treated genomic DNA (Homo sapiens) CpG-island No: 25828
aaacacacaaccccctacctcccccccgccttattcaaataaatcgaaacgaacgccaccctcccccctcattacaaatacccactccgtcgcccccccttcatctatattacacaactccccctcgaaaccccctcgcatttcaacaaacccctaccgtcccttccccctctaccactacaccgcgccgtcgcctcgaaaccccgcacttcataacaacactccccgcccgcgtctccttcttctacatatcacaccacacgccgcccgcccttaattccactcccatcaaccaaaacataccccgcgtaccttctccctcccctctatatcacacccacattaattcccgactctacgctccccttcataccacatccacccctccccgatcccccccccctccttcaaccaacccaatataccgctaacgacgccccgcgtcgaacacctccctatataataacccccgccgaccctccccccctctcctcacatccgtatcccgaacgccacacgaccgccccgccccatattaataatacacctcaaccccgcgaacctacctaaaactcccatactaataacaaccaacccccccgctctcgctttcctcatctccacccacaaccgcccccg

SEQ ID NO: 25829 - DNA, 525 bp, Artificial Sequence
  chemically treated genomic DNA (Homo sapiens) CpG-island No: 25829
  misc_feature (445)..(445): n is either a, c, g or t
ttttttttgttttttaagtgagtcgggcgcgcgagaggtaggcggggcggcgcggagcggagtaggtagtttcgcgcgttcgtttatcgttcgtttcgcgtagtttttcgcggtcgttttcgtcgtcgtcgtagcgggcgcgtcggagggagtttagtatggtcgggtcgggttcgtcgcgtcgcgcgtttcggggggtttcggcgtttttcgttgtcgcgtttttttacgtcgcgttgggggacgtggtgcgttcggagtagtagatatcgtttttcgtgtaagtgtcggtttttgcgtcgttcggggaggggattttgtcgtttgcgatttattgtgtttaagtttgggcgtttgtaggtgcggttgggtaggattcgtcgcgggcgtcggtttcgtcgttcgtatttgtttttcgggattcgcgtcgggcggcgaggtcggngtgggatgttttggtttttgttcgtaggttgtcgagtgagatttggagaggtttattttaagtgacggtattaattttgg

SEQ ID NO: 25830 - DNA, 525 bp, Artificial Sequence
  chemically treated genomic DNA (Homo sapiens) CpG-island No: 25830
  misc_feature (81)..(81): n is either a, c, g or t
ccaaaattaataccgtcacttaaaataaacctctccaaatctcactcgacaacctacgaacaaaaaccaaaacatcccacnccgacctcgccgcccgacgcgaatcccgaaaaacaaatacgaacgacgaaaccgacgcccgcgacgaatcctacccaaccgcacctacaaacgcccaaacttaaacacaataaatcgcaaacgacaaaatcccctccccgaacgacgcaaaaaccgacacttacacgaaaaacgatatctactactccgaacgcaccacgtcccccaacgcgacgtaaaaaaacgcgacaacgaaaaacgccgaaaccccccgaaacgcgcgacgcgacgaacccgacccgaccatactaaactccctccgacgcgcccgctacgacgacgacgaaaacgaccgcgaaaaactacgcgaaacgaacgataaacgaacgcgcgaaactacctactccgctccgcgccgccccgcctacctctcgcgcgcccgactcacttaaaaaacaaaaaaaa

SEQ ID NO: 25831 - DNA, 525 bp, Artificial Sequence
  chemically treated genomic DNA (Homo sapiens) CpG-island No: 25831
  misc_feature (81)..(81): n is either a, c, g or t
ttaaagttggtgtcgttatttgaggtgagtttttttagattttattcggtaatttgcgggtaggggttagagtattttatntcggtttcgtcgttcgacgcgggtttcgaaaggtaggtgcgagcggcgaggtcgacgttcgcggcgggttttgtttagtcgtatttgtaggcgtttaaatttgggtatagtgggtcgtaggcggtaaggtttttttttcgggcggcgtaggagtcggtatttatacggagagcggtatttgttgtttcgagcgtattacgttttttagcgcggcgtagagaagcgcggtagcgagaagcgtcgaggtttttcgggacgcgcggcgcggcgagttcggttcggttatgttgggtttttttcgacgcgttcgttgcggcggcgacgagagcggtcgcggggagttgcgcggagcgggcggtgggcgagcgcgcggggttgtttgtttcgtttcgcgtcgtttcgtttgtttttcgcgcgttcggtttatttggggagtagaaaaag

SEQ ID NO: 25832 - DNA, 525 bp, Artificial Sequence
  chemically treated genomic DNA (Homo sapiens) CpG-island No: 25832
  misc_feature (445)..(445): n is either a, c, g or t
ctttttctactccccaaataaaccgaacgcgcgaaaaacaaacgaaacgacgcgaaacgaaacaaacaaccccgcgcgctcgcccaccgcccgctccgcgcaactccccgcgaccgctctcgtcgccgccgcaacgaacgcgtcgaaaaaaacccaacataaccgaaccgaactcgccgcgccgcgcgtcccgaaaaacctcgacgcttctcgctaccgcgcttctctacgccgcgctaaaaaacgtaatacgctcgaaacaacaaataccgctctccgtataaataccgactcctacgccgcccgaaaaaaaaaccttaccgcctacgacccactatacccaaatttaaacgcctacaaatacgactaaacaaaacccgccgcgaacgtcgacctcgccgctcgcacctacctttcgaaacccgcgtcgaacgacgaaaccganataaaatactctaacccctacccgcaaattaccgaataaaatctaaaaaaactcacctcaaataacgacaccaactttaa

SEQ ID NO: 25833 - DNA, 610 bp, Artificial Sequence
  chemically treated genomic DNA (Homo sapiens) CpG-island No: 25833
cgttttattaaagtttttgtatatttttttttacgttgcgtttttgttatttacgtagttgtttttttgagcgtttcgcgtgtataaacgcgttttcggtttttacgcgtcggtggcgttgtttcgttgaggtggcgtcgggggagttcgtagaggcggcgggggagggagtgcggaggagaggattcgtgagttgcggggatttgggttcgtcgagtttttggggaagttgggtttcgtttttttcgggcgtttggggcgcgcgggaaggcgcggaggacgcgtcgtatttattcgttgttgttgtcggttgttgattgttatcgcggcggcggacgcggcgttgtgtcggagttcggtcgtttgtttaggttttaataggtttcgggtgaatttgcgggttcgtttatcggttatcgtcggttacgttaatcgcgtcgcgggttcggggcgcgtttttcgtcggtttttttcgtgttaattttttttatttattcgtcgtttaggaagcggaattcggagtttttttttttttttttttcgtttaattcgtaagaggcgggttttttttttttgtatttttattttttttattttttttttttttttg

SEQ ID NO: 25834 - DNA, 610 bp, Artificial Sequence
  chemically treated genomic DNA (Homo sapiens) CpG-island No: 25834
caaaaaaaaaaaaaaaataaaaaaaataaaaatacaaaaaaaaaaaacccgcctcttacgaattaaacgaaaaaaaaaaaaaaaaaaactccgaattccgcttcctaaacgacgaataaataaaaaaaattaacacgaaaaaaaccgacgaaaaacgcgccccgaacccgcgacgcgattaacgtaaccgacgataaccgataaacgaacccgcaaattcacccgaaacctattaaaacctaaacaaacgaccgaactccgacacaacgccgcgtccgccgccgcgataacaatcaacaaccgacaacaacaacgaataaatacgacgcgtcctccgcgccttcccgcgcgccccaaacgcccgaaaaaaacgaaacccaacttccccaaaaactcgacgaacccaaatccccgcaactcacgaatcctctcctccgcactccctcccccgccgcctctacgaactcccccgacgccacctcaacgaaacaacgccaccgacgcgtaaaaaccgaaaacgcgtttatacacgcgaaacgctcaaaaaaacaactacgtaaataacaaaaacgcaacgtaaaaaaaaatatacaaaaactttaataaaacg

SEQ ID NO: 25835 - DNA, 610 bp, Artificial Sequence
  chemically treated genomic DNA (Homo sapiens) CpG-island No: 25835
tagaggagggaagggggtgggaagagtgggggtgtaagagagaaaaattcgttttttgcgagttgagcgaggaagaggggggggaaggtttcgagtttcgttttttgaacggcgggtggatagagaaggttggtacggggaagatcggcgggaggcgcgtttcgggttcgcggcgcgattggcgtgatcggcgatggtcggtgagcggattcgtaggtttattcggagtttgttgagatttgggtaggcggtcgagtttcggtatagcgtcgcgttcgtcgtcgcggtggtagttagtagtcggtagtagtagcgggtgagtgcggcgcgtttttcgcgttttttcgcgcgttttaggcgttcggggggaacggagtttagtttttttaaaagttcggcgggtttaggttttcgtagtttacgggttttttttttcgtattttttttttcgtcgtttttgcgggttttttcggcgttattttagcgaggtagcgttatcgacgcgtaaggatcgggggcgcgtttgtgtacgcgggacgtttagaggagtagttgcgtgggtagtagaagcgtagcgtgggagaggatgtgtaggggttttaatggggcg

SEQ ID NO: 25836 - DNA, 610 bp, Artificial Sequence
  chemically treated genomic DNA (Homo sapiens) CpG-island No: 25836
cgccccattaaaacccctacacatcctctcccacgctacgcttctactacccacgcaactactcctctaaacgtcccgcgtacacaaacgcgcccccgatccttacgcgtcgataacgctacctcgctaaaataacgccgaaaaaacccgcaaaaacgacgaaaaaaaaaatacgaaaaaaaaaacccgtaaactacgaaaacctaaacccgccgaacttttaaaaaaactaaactccgttccccccgaacgcctaaaacgcgcgaaaaaacgcgaaaaacgcgccgcactcacccgctactactaccgactactaactaccaccgcgacgacgaacgcgacgctataccgaaactcgaccgcctacccaaatctcaacaaactccgaataaacctacgaatccgctcaccgaccatcgccgatcacgccaatcgcgccgcgaacccgaaacgcgcctcccgccgatcttccccgtaccaaccttctctatccacccgccgttcaaaaaacgaaactcgaaaccttcccccccctcttcctcgctcaactcgcaaaaaacgaatttttctctcttacacccccactcttcccacccccttccctcctcta

SEQ ID NO: 25837 - DNA, 1205 bp, Artificial Sequence
  chemically treated genomic DNA (Homo sapiens) CpG-island No: 25837
tttatcgtattttattttgtttcgtttcgtattattttatttttatttgtttcgtttcgtttcgcgtgttacgtttttttcgcgtcgtttcgttttaattattttttttttttcgttttatttttttcgtttgttcggtttcggttcggttttatttatttttttcgtttagttttgttttttttatttgtcgggtttcgttaggacgcgttcgcggtttatttgtaggtttagggcgatacgttgcgtaggttggtgggcggtcggaagcggcggtcggcgggtttgttttttgtcgggtagttcgcgttgcgcgtttgtttacgcggttttagttgtagcgtgtggtggaaggtattgagtacgtcggtcgttaggcgttcgtatagttgttttagtagttttttcggtcggttcgcgtagtttcgcggtcgcgcggggcgtttgttcgttttcggggcgttcgcggtttagttcggcggtagcgttagtaggaagtcggttattagtatttagatttgagggataggttacgtttagcgttcgtacgcgtcggaggagttcgtttgcgtttcgcgttcgtgtttcgttcgcggcgttcggagtcggcgggcgttttttttcgtttcgcggagttagaggtcggttcggaggatgggagtcgcgcgggcgggttttagagcgtttttttcgtttgttcgtcgttcgcggggttttcggggtttagttcggcgtcggttcgcgcgttttcggttttcgtcgtcgtcgtcgtttcgagtcgggggtcgtacggggggcgggtgcggggcgcgcgtgtacgtgtgcgtgtgtttgtcgggttgttgcgtcgcgggttgcgagtgtttgtgattcgtcgtatttttattttcgggcgcgttatttttgtttcgtcgttagcgagggagtttcggagtttaagacgttcggattcgtcgtttcgtagatttatttttgtttttgcgtttcgttattcgttcgttttagttagttcgcgtagggttcgcggttcgttttttcgcgagaagttttttgtggttttttttcgtattcggggattcggatcgagaagtcgattgagcgaggtcgtcgttcggttttacggatatagagcgattttgtatttttcgtttttaggagttgaaaatattttgttatttgtgtagtgtatttattagtgtttttaa

SEQ ID NO: 25838 - DNA, 1205 bp, Artificial Sequence
  chemically treated genomic DNA (Homo sapiens) CpG-island No: 25838
ttaaaaacactaataaatacactacacaaataacaaaatattttcaactcctaaaaacgaaaaatacaaaatcgctctatatccgtaaaaccgaacgacgacctcgctcaatcgacttctcgatccgaatccccgaatacgaaaaaaaaccacaaaaaacttctcgcgaaaaaacgaaccgcgaaccctacgcgaactaactaaaacgaacgaataacgaaacgcaaaaacaaaaataaatctacgaaacgacgaatccgaacgtcttaaactccgaaactccctcgctaacgacgaaacaaaaataacgcgcccgaaaataaaaatacgacgaatcacaaacactcgcaacccgcgacgcaacaacccgacaaacacacgcacacgtacacgcgcgccccgcacccgccccccgtacgacccccgactcgaaacgacgacgacgacgaaaaccgaaaacgcgcgaaccgacgccgaactaaaccccgaaaaccccgcgaacgacgaacaaacgaaaaaaacgctctaaaacccgcccgcgcgactcccatcctccgaaccgacctctaactccgcgaaacgaaaaaaaacgcccgccgactccgaacgccgcgaacgaaacacgaacgcgaaacgcaaacgaactcctccgacgcgtacgaacgctaaacgtaacctatccctcaaatctaaatactaataaccgacttcctactaacgctaccgccgaactaaaccgcgaacgccccgaaaacgaacaaacgccccgcgcgaccgcgaaactacgcgaaccgaccgaaaaaactactaaaacaactatacgaacgcctaacgaccgacgtactcaataccttccaccacacgctacaactaaaaccgcgtaaacaaacgcgcaacgcgaactacccgacaaaaaacaaacccgccgaccgccgcttccgaccgcccaccaacctacgcaacgtatcgccctaaacctacaaataaaccgcgaacgcgtcctaacgaaacccgacaaataaaaaaaacaaaactaaacgaaaaaaataaataaaaccgaaccgaaaccgaacaaacgaaaaaaataaaacgaaaaaaaaaaaataattaaaacgaaacgacgcgaaaaaaacgtaacacgcgaaacgaaacgaaacaaataaaaataaaataatacgaaacgaaacaaaataaaatacgataaa

SEQ ID NO: 25839 - DNA, 1205 bp, Artificial Sequence
  chemically treated genomic DNA (Homo sapiens) CpG-island No: 25839
ttgggggtattggtgagtatattgtataagtgataaaatgtttttagtttttggaggcgaaaggtgtagagtcgttttgtgttcgtgaggtcgggcggcgatttcgtttagtcggtttttcggttcgagttttcgggtacgaggaaagattatagggggtttttcgcggaaaagcgggtcgcggattttgcgcgggttggttggggcgggcggatgacgaggcgtaggggtaagggtgggtttgcgaggcggcgggttcgggcgttttaggtttcggggttttttcgttggcggcggagtagggatggcgcgttcgggggtgagggtgcggcgggttataagtattcgtagttcgcggcgtagtaattcggtaggtatacgtatacgtgtacgcgcgtttcgtattcgtttttcgtgcggttttcggttcggggcggcggcggcggcgggggtcgggggcgcgcgggtcggcgtcgggttgggtttcggggatttcgcgggcggcgggtaggcggggagggcgttttggggttcgttcgcgcggtttttatttttcgggtcggtttttggtttcgcggggcgaggggaggcgttcgtcggtttcgggcgtcgcgggcgggatacgggcgcggggcgtaggcgggttttttcggcgcgtgcggacgttgagcgtggtttgttttttaggtttggatgttggtagtcggttttttgttggcgttgtcgtcgagttgggtcgcgggcgtttcgagggcgggtaggcgtttcgcgcggtcgcggggttgcgcggatcggtcggaggagttattggagtagttgtacgggcgtttggcggtcggcgtgtttagtgttttttattatacgttgtagttggggtcgcgtgagtaggcgcgtaacgcgagttgttcggtagggggtaggttcgtcgatcgtcgttttcggtcgtttattaatttgcgtagcgtgtcgttttgggtttataggtgagtcgcgggcgcgttttggcggggttcggtaggtggggagggtagggttgggcggggagagtgggtggggtcgggtcgaggtcgggtaggcggggagggtggggcggggaaggggaggtggttggggcggggcgacgcggagggggcgtggtacgcggggcgaggcggagtaggtaggggtggggtggtgcggggcgagatagggtagggtacggtagg

SEQ ID NO: 25840 - DNA, 1205 bp, Artificial Sequence
  chemically treated genomic DNA (Homo sapiens) CpG-island No: 25840
cctaccgtaccctaccctatctcgccccgcaccaccccacccctacctactccgcctcgccccgcgtaccacgccccctccgcgtcgccccgccccaaccacctccccttccccgccccaccctccccgcctacccgacctcgacccgaccccacccactctccccgcccaaccctaccctccccacctaccgaaccccgccaaaacgcgcccgcgactcacctataaacccaaaacgacacgctacgcaaattaataaacgaccgaaaacgacgatcgacgaacctaccccctaccgaacaactcgcgttacgcgcctactcacgcgaccccaactacaacgtataataaaaaacactaaacacgccgaccgccaaacgcccgtacaactactccaataactcctccgaccgatccgcgcaaccccgcgaccgcgcgaaacgcctacccgccctcgaaacgcccgcgacccaactcgacgacaacgccaacaaaaaaccgactaccaacatccaaacctaaaaaacaaaccacgctcaacgtccgcacgcgccgaaaaaacccgcctacgccccgcgcccgtatcccgcccgcgacgcccgaaaccgacgaacgcctcccctcgccccgcgaaaccaaaaaccgacccgaaaaataaaaaccgcgcgaacgaaccccaaaacgccctccccgcctacccgccgcccgcgaaatccccgaaacccaacccgacgccgacccgcgcgcccccgacccccgccgccgccgccgccccgaaccgaaaaccgcacgaaaaacgaatacgaaacgcgcgtacacgtatacgtatacctaccgaattactacgccgcgaactacgaatacttataacccgccgcaccctcacccccgaacgcgccatccctactccgccgccaacgaaaaaaccccgaaacctaaaacgcccgaacccgccgcctcgcaaacccacccttacccctacgcctcgtcatccgcccgccccaaccaacccgcgcaaaatccgcgacccgcttttccgcgaaaaaccccctataatctttcctcgtacccgaaaactcgaaccgaaaaaccgactaaacgaaatcgccgcccgacctcacgaacacaaaacgactctacacctttcgcctccaaaaactaaaaacattttatcacttatacaatatactcaccaatacccccaa

SEQ ID NO: 25841 - DNA, 1047 bp, Artificial Sequence
  chemically treated genomic DNA (Homo sapiens) CpG-island No: 25841
tttttttttacgttttttttttttcgtttcggagcgggagcgatggaataggtagggggagtcgcgagggttaggggtggttttttcgttaaatcgttttttttttcgttttttcgaggtttttttttagtcgagggtttttttttaagttcgtaattttcgcggatagtcggagcgagagttatataaatttttttttcggtgtacggagggggcgcgtagatagagcgggcgttcggtcgtcgagggttgcgtttcgggggtcggcgaatttcgagttcgtggggtggatgattagttcgtcggtcgggtcgggtagttgcgggtatgtgggagttttatcgcgcggtttcgggttttgcgtcgtcgtcgttgttttttcggttttttttttttttcgattttttaagagcgagcgaggtattggcgttttttagatacgtatatttatatacgcgtatatacgagcgagtttttgttaaagtaaatcgtgtaattcgcgcgcgcgtatattcgtaggaagaggattaaggtaaaaagagaagaaagaaaggggagggggcgagttataggcggcggtggcggcggtagtagttgtcggagcggaggtaacgagtagttcgagaaaaattagtagtagcggcggcggcggcggcggcggcgtttatttcgattagttgtagtatttgtattttcgtttttgggaattggagcgagcggtgtcgggttagtaggcgaggggggcgacgcgtagatagcgggttagagcgcgggcgcgcggggatcgtgtagtttgcgcgcggggtaggcgtagtcggggtcggagcggaggttagaatgagtagcggtcgggcgggttagcggtaagagtttcgagagtcggggagggggttcgcgttagggaaaggggtggtcggtaaaattcggatatggagtgttcgtgggtttcgcggcgcgggttttatttagtagttcggtaaacgtttggaggtgggaacgggagggttgttattagaggttttttttttagggtttgttagataaagg

SEQ ID NO: 25842 - DNA, 1047 bp, Artificial Sequence
  chemically treated genomic DNA (Homo sapiens) CpG-island No: 25842
cctttatctaacaaaccctaaaaaaaaaacctctaataacaaccctcccgttcccacctccaaacgtttaccgaactactaaataaaacccgcgccgcgaaacccacgaacactccatatccgaattttaccgaccacccctttccctaacgcgaaccccctccccgactctcgaaactcttaccgctaacccgcccgaccgctactcattctaacctccgctccgaccccgactacgcctaccccgcgcgcaaactacacgatccccgcgcgcccgcgctctaacccgctatctacgcgtcgcccccctcgcctactaacccgacaccgctcgctccaattcccaaaaacgaaaatacaaatactacaactaatcgaaataaacgccgccgccgccgccgccgccgctactactaatttttctcgaactactcgttacctccgctccgacaactactaccgccgccaccgccgcctataactcgccccctcccctttctttcttctctttttaccttaatcctcttcctacgaatatacgcgcgcgcgaattacacgatttactttaacaaaaactcgctcgtatatacgcgtatataaatatacgtatctaaaaaacgccaatacctcgctcgctcttaaaaaatcgaaaaaaaaaaaaaaccgaaaaaacaacgacgacgacgcaaaacccgaaaccgcgcgataaaactcccacatacccgcaactacccgacccgaccgacgaactaatcatccaccccacgaactcgaaattcgccgacccccgaaacgcaaccctcgacgaccgaacgcccgctctatctacgcgccccctccgtacaccgaaaaaaaaatttatataactctcgctccgactatccgcgaaaattacgaacttaaaaaaaaaccctcgactaaaaaaaaacctcgaaaaaacgaaaaaaaaaacgatttaacgaaaaaaccacccctaaccctcgcgactccccctacctattccatcgctcccgctccgaaacgaaaaaaaaaaaacgtaaaaaaaaa

SEQ ID NO: 25843 - DNA, 1047 bp, Artificial Sequence
  chemically treated genomic DNA (Homo sapiens) CpG-island No: 25843
tttttgtttgataaattttgaaagggaagtttttagtagtagttttttcgtttttatttttaagcgtttgtcgaattgttaggtggagttcgcgtcgcggagtttacgagtattttatattcgggttttgtcggttatttttttttttggcgcgagtttttttttcggttttcggagtttttgtcgttggttcgttcgatcgttgtttattttggttttcgtttcggtttcggttgcgtttatttcgcgcgtaggttgtacggttttcgcgcgttcgcgttttgattcgttgtttgcgcgtcgtttttttcgtttgttggttcggtatcgttcgttttagtttttaggagcggggatgtagatgttgtagttggtcggggtgggcgtcgtcgtcgtcgtcgtcgtcgttgttgttggtttttttcggattgttcgttgttttcgtttcggtagttgttgtcgtcgttatcgtcgtttgtgattcgttttttttttttttttttttttttttttgttttggttttttttttacgggtgtgcgcgcgcgcgggttgtacggtttgttttggtaggagttcgttcgtgtgtgcgcgtgtgtgagtgtgcgtgtttggagagcgttagtgtttcgttcgtttttggggagtcgaagaagagaaagaatcgaagagatagcggcggcggcgtagagttcggggtcgcgcgatgaagtttttatatgttcgtagttgttcggttcggtcggcgagttaattatttattttacgggttcggggttcgtcggttttcgggacgtagttttcggcggtcgggcgttcgttttgtttgcgcgtttttttcgtgtatcggggaaggagtttgtgtggttttcgtttcggttgttcgcggaggttgcgggtttgagaggggattttcggttgggagagagtttcgggaggacgaagaggaggacggtttggcggagaagttatttttggttttcgcggttttttttatttattttatcgttttcgtttcgaggcggaaaggggaggacgtggaagaaga

SEQ ID NO: 25844 - DNA, 1047 bp, Artificial Sequence
  chemically treated genomic DNA (Homo sapiens) CpG-island No: 25844
tcttcttccacgtcctcccctttccgcctcgaaacgaaaacgataaaataaataaaaaaaaccgcgaaaaccaaaaataacttctccgccaaaccgtcctcctcttcgtcctcccgaaactctctcccaaccgaaaatcccctctcaaacccgcaacctccgcgaacaaccgaaacgaaaaccacacaaactccttccccgatacacgaaaaaaacgcgcaaacaaaacgaacgcccgaccgccgaaaactacgtcccgaaaaccgacgaaccccgaacccgtaaaataaataattaactcgccgaccgaaccgaacaactacgaacatataaaaacttcatcgcgcgaccccgaactctacgccgccgccgctatctcttcgattctttctcttcttcgactccccaaaaacgaacgaaacactaacgctctccaaacacgcacactcacacacgcgcacacacgaacgaactcctaccaaaacaaaccgtacaacccgcgcgcgcgcacacccgtaaaaaaaaaaccaaaacaaaaaaaaaaaaaaaaaaaaaaaaaaaacgaatcacaaacgacgataacgacgacaacaactaccgaaacgaaaacaacgaacaatccgaaaaaaaccaacaacaacgacgacgacgacgacgacgacgcccaccccgaccaactacaacatctacatccccgctcctaaaaactaaaacgaacgataccgaaccaacaaacgaaaaaaacgacgcgcaaacaacgaatcaaaacgcgaacgcgcgaaaaccgtacaacctacgcgcgaaataaacgcaaccgaaaccgaaacgaaaaccaaaataaacaacgatcgaacgaaccaacgacaaaaactccgaaaaccgaaaaaaaaactcgcgccaaaaaaaaaaataaccgacaaaacccgaatataaaatactcgtaaactccgcgacgcgaactccacctaacaattcgacaaacgcttaaaaataaaaacgaaaaaactactactaaaaacttccctttcaaaatttatcaaacaaaaa

SEQ ID NO: 25845 - DNA, 569 bp, Artificial Sequence
  chemically treated genomic DNA (Homo sapiens) CpG-island No: 25845
gtcgtagtttcgttgtttattttttttagcgtcggttgtcgttttcgggtagatatcgtcggttttgattttggggttgatatcgttaaagggtagttagtgttcgtttaggttatttcgggaggtttaggggtacggcgaggggtcggggaaaggcgatcgtttattatagttcgcgcgtttagattgagggaggagtcgggttgtagaatcggcggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggtcgcgagtttcgagcgttaaattttcgcggcgttcgtttagcgcgttgttgtggcgggcgcggagggcgcgcgtcggtagtgggggttgcggcggcggagggtacgggttttcgtttagcgtttttatttttttggtgtagttgtttttcgcgagtcgagatatttttgttagggaagaggagcgtttcggttgtttttttagagttt

SEQ ID NO: 25846 - DNA, 569 bp, Artificial Sequence
  chemically treated genomic DNA (Homo sapiens) CpG-island No: 25846
aaactctaaaaaaacaaccgaaacgctcctcttccctaacaaaaatatctcgactcgcgaaaaacaactacaccaaaaaaataaaaacgctaaacgaaaacccgtaccctccgccgccgcaacccccactaccgacgcgcgccctccgcgcccgccacaacaacgcgctaaacgaacgccgcgaaaatttaacgctcgaaactcgcgacccctaataaaaatcccaaaacacttcccgcccttaacgaccaacgacaacgccgccgcctcccgcaaaacgcccgcttctccgtttctaaaaccttaatctctcctcgaacgacctcgcaacctccctcccgtctccatccgccgccgattctacaacccgactcctccctcaatctaaacgcgcgaactataataaacgatcgcctttccccgacccctcgccgtacccctaaacctcccgaaataacctaaacgaacactaactaccctttaacgatatcaaccccaaaatcaaaaccgacgatatctacccgaaaacgacaaccgacgctaaaaaaaataaacaacgaaactacgac

SEQ ID NO: 25847 - DNA, 569 bp, Artificial Sequence
  chemically treated genomic DNA (Homo sapiens) CpG-island No: 25847
agattttagggggatagtcggggcgttttttttttttgataggagtgtttcggttcgcgggaggtagttgtattaagaaggtgaggacgttgagcgggggttcgtgtttttcgtcgtcgtagtttttattgtcggcgcgcgtttttcgcgttcgttatagtagcgcgttaggcggacgtcgcgggaatttgacgttcgaggttcgcggtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcgtcggttttgtagttcggttttttttttagtttaggcgcgcgggttgtagtgggcgatcgttttttttcgatttttcgtcgtgtttttgggtttttcgaagtggtttgggcgagtattgattgttttttggcggtgttagttttaaagttagggtcggcgatgtttgttcgggagcggtagtcggcgttgaagaaggtaggtagcggggttgcggt

SEQ ID NO: 25848 - DNA, 569 bp, Artificial Sequence
  chemically treated genomic DNA (Homo sapiens) CpG-island No: 25848
accgcaaccccgctacctaccttcttcaacgccgactaccgctcccgaacaaacatcgccgaccctaactttaaaactaacaccgccaaaaaacaatcaatactcgcccaaaccacttcgaaaaacccaaaaacacgacgaaaaatcgaaaaaaaacgatcgcccactacaacccgcgcgcctaaactaaaaaaaaaaccgaactacaaaaccgacgacgaataaaaacgaaaaaaaaactacgaaatcgctcgaaaaaaaactaaaactctaaaaacgaaaaaacgaacgctctacgaaaaacgacgacgctaccgctaaccgtcaaaaacgaaaaatattctaaaactctcattaaaaaccgcgaacctcgaacgtcaaattcccgcgacgtccgcctaacgcgctactataacgaacgcgaaaaacgcgcgccgacaataaaaactacgacgacgaaaaacacgaacccccgctcaacgtcctcaccttcttaatacaactacctcccgcgaaccgaaacactcctatcaaaaaaaaaaaacgccccgactatccccctaaaatct

SEQ ID NO: 25849 - DNA, 614 bp, Artificial Sequence
  chemically treated genomic DNA (Homo sapiens) CpG-island No: 25849
gtcggtcggaggggcgaggacgcgcgggcggaggcgcggttgtcgtgtttaggtagggagtcgagtttcgggtgttcgtcgcgcgtttttcgtcggggttatgtattttcgtttgcgttcgatatcgcgggttggaggcgagtgtagcggcgatagttcgttagcgtcgcggttcgtttcgtttcgggttcgtttttttcgtttcgggcgttttgcgtcggggttcgttttcgtagttttttttagtttttttttagtttgggtttttttagtttcgttttagtttgcggcgcgtttggcgggcgtttttttatatatgttagtatatcggttatcggttgattttttcggtttgtgatttcgcgtgggtgtagttcgtaggagtttatcggtttgtgttacgtacgggggtttttagtgtacggatacgcgtttttttcgttatttgtttatttttattagattttattttttttcgcgtcgtgttcgcggcggaaggcgtttttgtagcgcgtgtattcgcggagcggtggcgattttagtttgagtagaggagttgtagtgatttttgtttcgtttttagcggattgcggagggaattttttattttattt

SEQ ID NO: 25850 - DNA, 614 bp, Artificial Sequence
  chemically treated genomic DNA (Homo sapiens) CpG-island No: 25850
aaataaaataaaaaattccctccgcaatccgctaaaaacgaaacaaaaatcactacaactcctctactcaaactaaaatcgccaccgctccgcgaatacacgcgctacaaaaacgccttccgccgcgaacacgacgcgaaaaaaaataaaatctaataaaaataaacaaataacgaaaaaaacgcgtatccgtacactaaaaacccccgtacgtaacacaaaccgataaactcctacgaactacacccacgcgaaatcacaaaccgaaaaaatcaaccgataaccgatatactaacatatataaaaaaacgcccgccaaacgcgccgcaaactaaaacgaaactaaaaaaacccaaactaaaaaaaaactaaaaaaaactacgaaaacgaaccccgacgcaaaacgcccgaaacgaaaaaaacgaacccgaaacgaaacgaaccgcgacgctaacgaactatcgccgctacactcgcctccaacccgcgatatcgaacgcaaacgaaaatacataaccccgacgaaaaacgcgcgacgaacacccgaaactcgactccctacctaaacacgacaaccgcgcctccgcccgcgcgtcctcgcccctccgaccgac

SEQ ID NO: 25851 - DNA, 614 bp, Artificial Sequence
  chemically treated genomic DNA (Homo sapiens) CpG-island No: 25851
gggtggggtgggggatttttttcgtagttcgttgaaagcgaggtaggaattattgtaatttttttgtttaggttgaggtcgttatcgtttcgcggatgtacgcgttgtaggggcgtttttcgtcgcgggtacggcgcgggaagggatggggtttggtgggagtgggtaggtggcgggagaggcgcgtgttcgtgtattagaggttttcgtgcgtgatataggtcgatgagtttttgcgggttgtatttacgcggagttatagatcgaaaaggttagtcggtggtcggtgtgttaatatatatagagagacgttcgttaggcgcgtcgtaggttgggacgaggttaggagggtttaggttggaggagggttgaggagggttgcgggggcgggtttcggcgtagggcgttcggagcggagggggcgggttcgaggcggggcgggtcgcggcgttgacgggttgtcgtcgttgtattcgtttttagttcgcggtgtcgagcgtaggcggaggtatatggtttcgacgggaggcgcgcggcgagtattcggagttcggttttttgtttgagtacggtagtcgcgttttcgttcgcgcgttttcgttttttcggtcggt

SEQ ID NO: 25852 - DNA, 614 bp, Artificial Sequence
  chemically treated genomic DNA (Homo sapiens) CpG-island No: 25852
accgaccgaaaaaacgaaaacgcgcgaacgaaaacgcgactaccgtactcaaacaaaaaaccgaactccgaatactcgccgcgcgcctcccgtcgaaaccatatacctccgcctacgctcgacaccgcgaactaaaaacgaatacaacgacgacaacccgtcaacgccgcgacccgccccgcctcgaacccgccccctccgctccgaacgccctacgccgaaacccgcccccgcaaccctcctcaaccctcctccaacctaaaccctcctaacctcgtcccaacctacgacgcgcctaacgaacgtctctctatatatattaacacaccgaccaccgactaaccttttcgatctataactccgcgtaaatacaacccgcaaaaactcatcgacctatatcacgcacgaaaacctctaatacacgaacacgcgcctctcccgccacctacccactcccaccaaaccccatcccttcccgcgccgtacccgcgacgaaaaacgcccctacaacgcgtacatccgcgaaacgataacgacctcaacctaaacaaaaaaattacaataattcctacctcgctttcaacgaactacgaaaaaaatcccccaccccaccc

SEQ ID NO: 25853 - DNA, 773 bp, Artificial Sequence
  chemically treated genomic DNA (Homo sapiens) CpG-island No: 25853
cggttcggtcgcggggagtttcgttttattttagtgggttacgtggacgatatttagttcgtgaggttcgatagcgacgtcgcgagttcgagagaggagtcgcgggcgtcgtggatagagtaggaggggtcggagtattgggatcggaatatatagatttataaggtttaggtatagattgatcgagagagtttgcggaatttgcgcggttattataattagagcgaggtcggtgagtgatttcggttcggggcgtaggttacgattttttattttttacgtacggttcgggtcgtttcgagttttcgggttcgagattcgtttttttgaggtcgcgggattcgtttagattttcgatcggcgagagttttaggcgcgtttattcggttttatttttagttgaggttaaaattttcgcgggttggtcggggcggggcggggttcgggggattgggttgatcgcggggtcggggttagggttttatattttttagagtatgtacggttgcgacgtggggtcggacgggcgtttttttcgcgggtatgattagtacgtttacgacggtaaggattatatcgttttgaacgaggatttgcgtttttggatcgtcgcggatacggcggtttagattatttagcgtaagtgggaggcggttcgtgaggcggagtagcggagagtttatttggagggcgagtgcgtggagtggtttcgtagatatttggagaacgggaaggataagttggagcgcgttggtattaggggtagtggggag

SEQ ID NO: 25854 - DNA, 773 bp, Artificial Sequence
  chemically treated genomic DNA (Homo sapiens) CpG-island No: 25854
ctccccactacccctaataccaacgcgctccaacttatccttcccgttctccaaatatctacgaaaccactccacgcactcgccctccaaataaactctccgctactccgcctcacgaaccgcctcccacttacgctaaataatctaaaccgccgtatccgcgacgatccaaaaacgcaaatcctcgttcaaaacgatataatccttaccgtcgtaaacgtactaatcatacccgcgaaaaaaacgcccgtccgaccccacgtcgcaaccgtacatactctaaaaaatataaaaccctaaccccgaccccgcgatcaacccaatcccccgaaccccgccccgccccgaccaacccgcgaaaattttaacctcaactaaaaataaaaccgaataaacgcgcctaaaactctcgccgatcgaaaatctaaacgaatcccgcgacctcaaaaaaacgaatctcgaacccgaaaactcgaaacgacccgaaccgtacgtaaaaaataaaaaatcgtaacctacgccccgaaccgaaatcactcaccgacctcgctctaattataataaccgcgcaaattccgcaaactctctcgatcaatctatacctaaaccttataaatctatatattccgatcccaatactccgacccctcctactctatccacgacgcccgcgactcctctctcgaactcgcgacgtcgctatcgaacctcacgaactaaatatcgtccacgtaacccactaaaataaaacgaaactccccgcgaccgaaccg

SEQ ID NO: 25855 - DNA, 773 bp, Artificial Sequence
  chemically treated genomic DNA (Homo sapiens) CpG-island No: 25855
ttttttattgtttttggtattagcgcgttttagtttgtttttttcgttttttaggtatttgcggagttattttacgtattcgttttttaggtaggtttttcgttgtttcgttttacgggtcgttttttatttgcgttgggtgatttgagtcgtcgtgttcgcggcggtttaggagcgtaggttttcgtttagggcgatgtaatttttgtcgtcgtaggcgtattggttatgttcgcggaggaggcgttcgttcggttttacgtcgtagtcgtatatgttttggagggtgtgagattttggtttcggtttcgcggttagtttagtttttcgagtttcgtttcgtttcgattaattcgcggggattttggttttaattgaaaatgaaatcgggtaaacgcgtttggggttttcgtcggtcgagggtttgggcgggtttcgcggttttagggaggcggatttcggattcggagattcggggcgattcgggtcgtacgtgggggatggggagtcgtgatttgcgtttcgggtcggggttatttatcggtttcgttttggttgtagtagtcgcgtaggtttcgtaggttttttcggttagtttgtgtttgggttttgtagatttgtgtgtttcggttttaatatttcggttttttttgttttatttacggcgttcgcggtttttttttcggattcgcggcgtcgttgtcgaattttacgaattgggtgtcgtttacgtagtttattgagatgaagcggggtttttcgcggtcgggtcg

SEQ ID NO: 25856 - DNA, 773 bp, Artificial Sequence
  chemically treated genomic DNA (Homo sapiens) CpG-island No: 25856
cgacccgaccgcgaaaaaccccgcttcatctcaataaactacgtaaacgacacccaattcgtaaaattcgacaacgacgccgcgaatccgaaaaaaaaaccgcgaacgccgtaaataaaacaaaaaaaaccgaaatattaaaaccgaaacacacaaatctacaaaacccaaacacaaactaaccgaaaaaacctacgaaacctacgcgactactacaaccaaaacgaaaccgataaataaccccgacccgaaacgcaaatcacgactccccatcccccacgtacgacccgaatcgccccgaatctccgaatccgaaatccgcctccctaaaaccgcgaaacccgcccaaaccctcgaccgacgaaaaccccaaacgcgtttacccgatttcattttcaattaaaaccaaaatccccgcgaattaatcgaaacgaaacgaaactcgaaaaactaaactaaccgcgaaaccgaaaccaaaatctcacaccctccaaaacatatacgactacgacgtaaaaccgaacgaacgcctcctccgcgaacataaccaatacgcctacgacgacaaaaattacatcgccctaaacgaaaacctacgctcctaaaccgccgcgaacacgacgactcaaatcacccaacgcaaataaaaaacgacccgtaaaacgaaacaacgaaaaacctacctaaaaaacgaatacgtaaaataactccgcaaatacctaaaaaacgaaaaaaacaaactaaaacgcgctaataccaaaaacaataaaaaa

SEQ ID NO: 25857 - DNA, 594 bp, Artificial Sequence
  chemically treated genomic DNA (Homo sapiens) CpG-island No: 25857
cgcgtattttttcgttcgggtcggttttttttcgtttttagatttttattatttttttattattttatatgtcgggtgtatatggtgcggagagttcgggggaagttagaatacgcggcgggagaggtaggtttagggcggttttagttaagtagttcggtttttcggattttcgtcgcgtataggttcgggtcgtttagggtgggattcgaattcgttttttcgtttcgtttaaggaggttatttttggaggtgtttttagaaggatcggcgggtttttcgcggggcgggggcgcgtagggcgggtgtttggaggttggggattcgtaggagaggtcggtgggtgtcgggttttttgtagggggttgtaggtcgaggggcgcgttacgaatttagcgggaatttttgcgtttttcggtatcgtcgggttgaaatcggggtttttagcgttggcggtttcgggttgggatttttttattttcggggtttcgtagggcgcgtacgtggcgttcgggggttatcgttgtagtcgttttttcgaggaggttcggattgaaaatttttttaaaaaaaaaatttaaaaaaaaaatttcg

SEQ ID NO: 25858 - DNA, 594 bp, Artificial Sequence
  chemically treated genomic DNA (Homo sapiens) CpG-island No: 25858
cgaaattttttttttaaattttttttttaaaaaaattttcaatccgaacctcctcgaaaaaacgactacaacgataacccccgaacgccacgtacgcgccctacgaaaccccgaaaataaaaaaatcccaacccgaaaccgccaacgctaaaaaccccgatttcaacccgacgataccgaaaaacgcaaaaattcccgctaaattcgtaacgcgcccctcgacctacaaccccctacaaaaaacccgacacccaccgacctctcctacgaatccccaacctccaaacacccgccctacgcgcccccgccccgcgaaaaacccgccgatccttctaaaaacacctccaaaaataacctccttaaacgaaacgaaaaaacgaattcgaatcccaccctaaacgacccgaacctatacgcgacgaaaatccgaaaaaccgaactacttaactaaaaccgccctaaacctacctctcccgccgcgtattctaacttcccccgaactctccgcaccatatacacccgacatataaaataataaaaaaataataaaaatctaaaaacgaaaaaaaaccgacccgaacgaaaaaatacgcg

SEQ ID NO: 25859 - DNA, 594 bp, Artificial Sequence
  chemically treated genomic DNA (Homo sapiens) CpG-island No: 25859
cggaattttttttttaagttttttttttaaagaagtttttaattcgggttttttcgggaaagcggttgtaacggtgattttcgagcgttacgtgcgcgttttgcggagtttcgggagtggggaggttttagttcgaggtcgttaacgttaggaatttcgattttagttcgacggtgtcgggaagcgtagggattttcgttgggttcgtggcgcgtttttcggtttgtaattttttgtaggaggttcggtatttatcggttttttttgcgagtttttagtttttaaatattcgttttgcgcgttttcgtttcgcgggaaattcgtcggtttttttaggggtatttttaaagatgatttttttgagcggggcgggaaggcgagttcgggttttattttaggcggttcgagtttgtgcgcggcggggattcggaaagtcgggttgtttagttgaggtcgttttgggtttgtttttttcgtcgcgtgttttaatttttttcgggtttttcgtattatatatattcgatatgtggaatagtaggaggatggtgggagtttgagggcggaggggagtcggttcgggcggaggggtgcgcg

SEQ ID NO: 25860 - DNA, 594 bp, Artificial Sequence
  chemically treated genomic DNA (Homo sapiens) CpG-island No: 25860
cgcgcacccctccgcccgaaccgactcccctccgccctcaaactcccaccatcctcctactattccacatatcgaatatatataatacgaaaaacccgaaaaaaattaaaacacgcgacgaaaaaaacaaacccaaaacgacctcaactaaacaacccgactttccgaatccccgccgcgcacaaactcgaaccgcctaaaataaaacccgaactcgccttcccgccccgctcaaaaaaatcatctttaaaaatacccctaaaaaaaccgacgaatttcccgcgaaacgaaaacgcgcaaaacgaatatttaaaaactaaaaactcgcaaaaaaaaccgataaataccgaacctcctacaaaaaattacaaaccgaaaaacgcgccacgaacccaacgaaaatccctacgcttcccgacaccgtcgaactaaaatcgaaattcctaacgttaacgacctcgaactaaaacctccccactcccgaaactccgcaaaacgcgcacgtaacgctcgaaaatcaccgttacaaccgctttcccgaaaaaacccgaattaaaaacttctttaaaaaaaaaacttaaaaaaaaaattccg

SEQ ID NO: 25861 - DNA, 922 bp, Artificial Sequence
  chemically treated genomic DNA (Homo sapiens) CpG-island No: 25861
ggggcgtgtgttcgttttcgttttttttcggcggtattaggtttatggggggcgtgtgttcgttttcgttttttttcggtcgtattaggtttatggggggcgtgtgttcgttttcgttttttttcggcggtattaggtcgatggggggtatgtgttcgttttcgttttttttcggcggtattaggtcgatggggggcgtgtgttcgttttcgttttttttcggcggtattaggtttatggggggcgtgtgttcgttttcgttttttttcggcggtattaggtcgatggggggcgtgtgttcgttttcgttttttttcggcggtattaggtcgatggggggcgtgtgttcgttttcgttttttttcggcggtattaggtttatggggggcgtgtgttcgttttcgttttttttcggtcgtattaggtttatggggggcgtgtgttcgttttcgttttttttcggcggtattaggtcgatggggggcgtgtgttcgttttcgttttttttcggcggtattaggtcgatggggggcgtgtgttcgttttcgttttttttcggcggtattaggtcgatggggggcgtgtgttcgttttcgttttttttcggtcgtattaggtttatggggggcgtgtgttcgttttcgttttttttcggcggtattaggtttatggggggcgtgtgttcgttttcgttttttttcggttatattaggttgatggggggcgtgtgttcgttttcgttttttttattgtttttcgcggtcgttggttgagattaggtggtagcgagttttttcgagaggaattgaaacgcgtgagtcgacgtttgagttttagttatacgttgtttggcgtataggtttggacgcggtttttggtggtcgttttatttcgggtacgttatagggtgggttttttgagg

SEQ ID NO: 25862 - DNA, 922 bp, Artificial Sequence
  chemically treated genomic DNA (Homo sapiens) CpG-island No: 25862
cctcaaaaaacccaccctataacgtacccgaaataaaacgaccaccaaaaaccgcgtccaaacctatacgccaaacaacgtataactaaaactcaaacgtcgactcacgcgtttcaattcctctcgaaaaaactcgctaccacctaatctcaaccaacgaccgcgaaaaacaataaaaaaaacgaaaacgaacacacgccccccatcaacctaatataaccgaaaaaaaacgaaaacgaacacacgccccccataaacctaataccgccgaaaaaaaacgaaaacgaacacacgccccccataaacctaatacgaccgaaaaaaaacgaaaacgaacacacgccccccatcgacctaataccgccgaaaaaaaacgaaaacgaacacacgccccccatcgacctaataccgccgaaaaaaaacgaaaacgaacacacgccccccatcgacctaataccgccgaaaaaaaacgaaaacgaacacacgccccccataaacctaatacgaccgaaaaaaaacgaaaacgaacacacgccccccataaacctaataccgccgaaaaaaaacgaaaacgaacacacgccccccatcgacctaataccgccgaaaaaaaacgaaaacgaacacacgccccccatcgacctaataccgccgaaaaaaaacgaaaacgaacacacgccccccataaacctaataccgccgaaaaaaaacgaaaacgaacacacgccccccatcgacctaataccgccgaaaaaaaacgaaaacgaacacataccccccatcgacctaataccgccgaaaaaaaacgaaaacgaacacacgccccccataaacctaatacgaccgaaaaaaaacgaaaacgaacacacgccccccataaacctaataccgccgaaaaaaaacgaaaacgaacacacgcccc

SEQ ID NO: 25863 - DNA, 922 bp, Artificial Sequence
  chemically treated genomic DNA (Homo sapiens) CpG-island No: 25863
ttttagggagtttattttgtgacgtgttcgaggtgaggcggttattagaggtcgcgtttaaatttgtgcgttaggtagcgtgtggttgaggtttagacgtcgatttacgcgttttagtttttttcgagaaaattcgttgttatttggttttagttagcgatcgcgagggatagtgagaaaggcgagagcgggtatacgttttttattaatttggtgtggtcgggggaaggcgagagcgggtatacgttttttatgaatttggtatcgtcgggggaaggcgagagcgggtatacgttttttatgaatttggtacggtcgggggaaggcgagagcgggtatacgttttttatcgatttggtatcgtcgggggaaggcgagagcgggtatacgttttttatcgatttggtatcgtcgggggaaggcgagagcgggtatacgttttttatcgatttggtatcgtcgggggaaggcgagagcgggtatacgttttttatgaatttggtgcggtcgggggaaggcgagagcgggtatacgttttttatgaatttggtatcgtcgggggaaggcgagagcgggtatacgttttttatcgatttggtatcgtcgggggaaggcgagagcgggtatacgttttttatcgatttggtatcgtcgggggaaggcgagagcgggtatacgttttttatgaatttggtatcgtcgggggaaggcgagagcgggtatacgttttttatcgatttggtatcgtcgggggaaggcgagagcgggtatatgttttttatcgatttggtatcgtcgggggaaggcgagagcgggtatacgttttttatgaatttggtgcggtcgggggaaggcgagagcgggtatacgttttttatgaatttggtatcgtcgggggaaagcgagagcgggtatacgtttt

SEQ ID NO: 25864 - DNA, 922 bp, Artificial Sequence
  chemically treated genomic DNA (Homo sapiens) CpG-island No: 25864
aaaacgtatacccgctctcgctttcccccgacgataccaaattcataaaaaacgtatacccgctctcgccttcccccgaccgcaccaaattcataaaaaacgtatacccgctctcgccttcccccgacgataccaaatcgataaaaaacatatacccgctctcgccttcccccgacgataccaaatcgataaaaaacgtatacccgctctcgccttcccccgacgataccaaattcataaaaaacgtatacccgctctcgccttcccccgacgataccaaatcgataaaaaacgtatacccgctctcgccttcccccgacgataccaaatcgataaaaaacgtatacccgctctcgccttcccccgacgataccaaattcataaaaaacgtatacccgctctcgccttcccccgaccgcaccaaattcataaaaaacgtatacccgctctcgccttcccccgacgataccaaatcgataaaaaacgtatacccgctctcgccttcccccgacgataccaaatcgataaaaaacgtatacccgctctcgccttcccccgacgataccaaatcgataaaaaacgtatacccgctctcgccttcccccgaccgtaccaaattcataaaaaacgtatacccgctctcgccttcccccgacgataccaaattcataaaaaacgtatacccgctctcgccttcccccgaccacaccaaattaataaaaaacgtatacccgctctcgcctttctcactatccctcgcgatcgctaactaaaaccaaataacaacgaattttctcgaaaaaaactaaaacgcgtaaatcgacgtctaaacctcaaccacacgctacctaacgcacaaatttaaacgcgacctctaataaccgcctcacctcgaacacgtcacaaaataaactccctaaaa

SEQ ID NO: 25865 - DNA, 703 bp, Artificial Sequence
  chemically treated genomic DNA (Homo sapiens) CpG-island No: 25865
tacgttttttttaggtttataacgtcgatagtgagcgcgagaatacgttttttttgtaaagttgatagtgagagaatacgttttttttaggtttacgtcgacggtgagcgtgagaatacgttttttttaggtttataacgtcgatagtgagcgcgagaatacgttttttttaggtttataatgtcgatagtgagcgtgagaatacgttttttttaggtttacgtcgatagtgagcgcgagaatacgttttttttaggtttacgtcgatagtgagtatgagaatacgttttttttaggtttacgtcgatagcgagcgtgagaatacgttttttttaggtttataacgtcgatagcgagcgtgagaatacgttttttttaggtttataacgtcgatagtgagcgtgagaatacgttttttttagtttacgttgatagcgagcgtgagaatacgtttttttttaggtttacgtcgatagtgagtgtgaaaacgttttttttcgtaacgtcgatagtgagcgcgagaatacgtttttttttaggtttataatgtcgatagtgagcgtgagaatacgttttttttataacgtcgatagtgagtgtgagtatacgttttttttaggtttataacgttgatagtgagtgtgagaatatattttttttaggtttacgttaatagtgagcgtgagaatacgttttttttagg

SEQ ID NO: 25866 - DNA, 703 bp, Artificial Sequence
  chemically treated genomic DNA (Homo sapiens) CpG-island No: 25866
cctaaaaaaaacgtattctcacgctcactattaacgtaaacctaaaaaaaatatattctcacactcactatcaacgttataaacctaaaaaaaacgtatactcacactcactatcgacgttataaaaaaaacgtattctcacgctcactatcgacattataaacctaaaaaaaaacgtattctcgcgctcactatcgacgttacgaaaaaaaacgttttcacactcactatcgacgtaaacctaaaaaaaaacgtattctcacgctcgctatcaacgtaaactaaaaaaaacgtattctcacgctcactatcgacgttataaacctaaaaaaaacgtattctcacgctcgctatcgacgttataaacctaaaaaaaacgtattctcacgctcgctatcgacgtaaacctaaaaaaaacgtattctcatactcactatcgacgtaaacctaaaaaaaacgtattctcgcgctcactatcgacgtaaacctaaaaaaaacgtattctcacgctcactatcgacattataaacctaaaaaaaacgtattctcgcgctcactatcgacgttataaacctaaaaaaaacgtattctcacgctcaccgtcgacgtaaacctaaaaaaaacgtattctctcactatcaactttacaaaaaaaacgtattctcgcgctcactatcgacgttataaacctaaaaaaaacgta

SEQ ID NO: 25867 - DNA, 703 bp, Artificial Sequence
  chemically treated genomic DNA (Homo sapiens) CpG-island No: 25867
tttgagggaagcgtgtttttacgtttattgttgacgtaaatttgagggaagtgtgtttttatatttattgttaacgttgtaaatttgagggaagcgtgtgtttatatttattgtcgacgttgtgagggaagcgtgtttttacgtttattgtcgatattgtaaatttgaagggaagcgtgttttcgcgtttattgtcgacgttgcgagggaaggcgtttttatatttattgtcgacgtaaatttgagggaaggcgtgtttttacgttcgttgttaacgtaaattgaggaaagcgtgtttttacgtttattgtcgacgttgtaaatttgagggaagcgtgtttttacgttcgttgtcgacgttgtaaatttgagggaagcgtgtttttacgttcgttgtcgacgtaaatttgagggaagcgtgtttttatgtttattgtcgacgtaaatttgagggaagcgtgttttcgcgtttattgtcgacgtaaatttgagggaagcgtgtttttacgtttattgtcgatattgtaaatttgagggaagcgtgttttcgcgtttattgtcgacgttgtaaatttgagggaagcgtgtttttacgtttatcgtcgacgtaaatttgagggaagcgtgtttttttattgttaattttgtaagggaagcgtgttttcgcgtttattgtcgacgttgtaaatttgagggaagcgtg

SEQ ID NO: 25868 - DNA, 703 bp, Artificial Sequence
  chemically treated genomic DNA (Homo sapiens) CpG-island No: 25868
cacgcttccctcaaatttacaacgtcgacaataaacgcgaaaacacgcttcccttacaaaattaacaataaaaaaacacgcttccctcaaatttacgtcgacgataaacgtaaaaacacgcttccctcaaatttacaacgtcgacaataaacgcgaaaacacgcttccctcaaatttacaatatcgacaataaacgtaaaaacacgcttccctcaaatttacgtcgacaataaacgcgaaaacacgcttccctcaaatttacgtcgacaataaacataaaaacacgcttccctcaaatttacgtcgacaacgaacgtaaaaacacgcttccctcaaatttacaacgtcgacaacgaacgtaaaaacacgcttccctcaaatttacaacgtcgacaataaacgtaaaaacacgctttcctcaatttacgttaacaacgaacgtaaaaacacgccttccctcaaatttacgtcgacaataaatataaaaacgccttccctcgcaacgtcgacaataaacgcgaaaacacgcttcccttcaaatttacaatatcgacaataaacgtaaaaacacgcttccctcacaacgtcgacaataaatataaacacacgcttccctcaaatttacaacgttaacaataaatataaaaacacacttccctcaaatttacgtcaacaataaacgtaaaaacacgcttccctcaaa

SEQ ID NO: 25869 - DNA, 799 bp, Artificial Sequence
  chemically treated genomic DNA (Homo sapiens) CpG-island No: 25869
ttcggtcgggtcgtttcgtgtttatgttcgtttggattttcgtattttttatcgttttttcgttgttttcgtcggggcggtttttgtagtcgcggtagggatggcgggggttgcggtttttttaggtaatggtattcggggtatcgggggcgtcggggataagcggtagttggtgtacgtgtttattacgtggcgttttggttcgtcgtttttcggcgagttatttaattagaatttcgaggtgttttttttttacgagttagtgtggtatgtatggtaaaaattgtattcgggggacgtcgtttttttgtagggggtagcgcgggatatgttgagcgttttttatcgttgcgatttttttgttttttagttgtatagtttcgcgggtagcggggggcgtaattttattacgttgggtattttcggcgtagttattaataaggtggtgtgttcgttattattttgtttcgtttatcgtaaggaggtcgtggggttggtggacgatcgcgtgtgtaagaagtgttcgttatagcgtttggcgcgtttcgaggaggagtgtcgtaagtatcgtatattagttataaagggtgtgcgcgttttcgacgtggaggataaggcgttattgttgcgagattcggttttggattttaaggttatttatttggtgcgtgattttcgcgcggtggcgagtttacggattcgttcgcgttacggttttattcgtgagagtttataggtggtgcgtagtcgagattcgcgagtttattatatgttttttttggaggtcgcgggttataag

SEQ ID NO: 25870 - DNA, 799 bp, Artificial Sequence
  chemically treated genomic DNA (Homo sapiens) CpG-island No: 25870
cttataacccgcgacctccaaaaaaaacatataataaactcgcgaatctcgactacgcaccacctataaactctcacgaataaaaccgtaacgcgaacgaatccgtaaactcgccaccgcgcgaaaatcacgcaccaaataaataaccttaaaatccaaaaccgaatctcgcaacaataacgccttatcctccacgtcgaaaacgcgcacaccctttataactaatatacgatacttacgacactcctcctcgaaacgcgccaaacgctataacgaacacttcttacacacgcgatcgtccaccaaccccacgacctccttacgataaacgaaacaaaataataacgaacacaccaccttattaataactacgccgaaaatacccaacgtaataaaattacgccccccgctacccgcgaaactatacaactaaaaaacaaaaaaatcgcaacgataaaaaacgctcaacatatcccgcgctaccccctacaaaaaaacgacgtcccccgaatacaatttttaccatacataccacactaactcgtaaaaaaaaaacacctcgaaattctaattaaataactcgccgaaaaacgacgaaccaaaacgccacgtaataaacacgtacaccaactaccgcttatccccgacgcccccgataccccgaataccattacctaaaaaaaccgcaacccccgccatccctaccgcgactacaaaaaccgccccgacgaaaacaacgaaaaaacgataaaaaatacgaaaatccaaacgaacataaacacgaaacgacccgaccgaa

SEQ ID NO: 25871 - DNA, 799 bp, Artificial Sequence
  chemically treated genomic DNA (Homo sapiens) CpG-island No: 25871
tttgtggttcgcggtttttaagaagggtatgtggtgagttcgcgggtttcggttgcgtattatttgtaggtttttacggatgaggtcgtggcgcgagcggattcgtgaattcgttatcgcgcggggattacgtattaagtggatgattttgaggtttagggtcgggtttcgtagtagtggcgttttgttttttacgtcgaagacgcgtatattttttatgattagtgtgcggtatttgcggtattttttttcgaaacgcgttaggcgttgtggcgggtattttttgtatacgcggtcgtttattaattttacgatttttttgcggtaggcggggtagagtggtgacgagtatattattttgttggtggttgcgtcgaagatgtttagcgtggtgaggttgcgtttttcgttgttcgcggggttatataattggaagatagagaggtcgtagcggtaaagagcgtttagtatgtttcgcgttgttttttgtagggaaacggcgtttttcggatatagtttttgttatatatgttatattggttcgtagagaaagaatatttcgggattttggttgaatagttcgtcgaagaacgacgagttagagcgttacgtggtgaatacgtatattagttgtcgtttgttttcgacgttttcggtgtttcgagtgttattgtttggaggggtcgtaattttcgttatttttgtcgcggttgtaggagtcgtttcgacggaggtagcgggagggcggtaaggagtgcggaggtttaaacgggtatgagtacggggcggttcggtcgga

SEQ ID NO: 25872 - DNA, 799 bp, Artificial Sequence
  chemically treated genomic DNA (Homo sapiens) CpG-island No: 25872
tccgaccgaaccgccccgtactcatacccgtttaaacctccgcactccttaccgccctcccgctacctccgtcgaaacgactcctacaaccgcgacaaaaataacgaaaattacgacccctccaaacaataacactcgaaacaccgaaaacgtcgaaaacaaacgacaactaatatacgtattcaccacgtaacgctctaactcgtcgttcttcgacgaactattcaaccaaaatcccgaaatattctttctctacgaaccaatataacatatataacaaaaactatatccgaaaaacgccgtttccctacaaaaaacaacgcgaaacatactaaacgctctttaccgctacgacctctctatcttccaattatataaccccgcgaacaacgaaaaacgcaacctcaccacgctaaacatcttcgacgcaaccaccaacaaaataatatactcgtcaccactctaccccgcctaccgcaaaaaaatcgtaaaattaataaacgaccgcgtatacaaaaaatacccgccacaacgcctaacgcgtttcgaaaaaaaataccgcaaataccgcacactaatcataaaaaatatacgcgtcttcgacgtaaaaaacaaaacgccactactacgaaacccgaccctaaacctcaaaatcatccacttaatacgtaatccccgcgcgataacgaattcacgaatccgctcgcgccacgacctcatccgtaaaaacctacaaataatacgcaaccgaaacccgcgaactcaccacatacccttcttaaaaaccgcgaaccacaaa

SEQ ID NO: 25873 - DNA, 558 bp, Artificial Sequence
  chemically treated genomic DNA (Homo sapiens) CpG-island No: 25873
cgttgttagagaggtgggaaaattcgtcgtacggaggtcgaaagcgagaggggttgcgtcgttatgtcgggagttgagttttatataagtcgtttttagttatcgtttttagtcggtttcgtttttttgtgcgagataggaagttgcggtttcgagaaagcggaggagacgtcgttggagtcgggaggcgtcgggttcggcggagcgcggagcggggttttgggtcgcgtgaaagttttttttttcgagtcgtagggcgttcgttgttcggaaattgtttagggataagtcggtcgattttttagatttttcgaaggtgcggggatttttagcggaagcgagagggagcgaaatcgaggaacgagtgatagtcggatagttcgtcgggcggtgattcggggtcgttttcgggcgcgttttcggttttaggtgagcggaggaatcgggtagaatcgagggtgggcgttatttaggaggaggaggttgggagggagattggggcgtattcgtttatttcgttttttttcgtaggttttattcggagtcgttgttatggga

SEQ ID NO: 25874 - DNA, 558 bp, Artificial Sequence
  chemically treated genomic DNA (Homo sapiens) CpG-island No: 25874
tcccataacaacgactccgaataaaacctacgaaaaaaaacgaaataaacgaatacgccccaatctccctcccaacctcctcctcctaaataacgcccaccctcgattctacccgattcctccgctcacctaaaaccgaaaacgcgcccgaaaacgaccccgaatcaccgcccgacgaactatccgactatcactcgttcctcgatttcgctccctctcgcttccgctaaaaatccccgcaccttcgaaaaatctaaaaaatcgaccgacttatccctaaacaatttccgaacaacgaacgccctacgactcgaaaaaaaaaactttcacgcgacccaaaaccccgctccgcgctccgccgaacccgacgcctcccgactccaacgacgtctcctccgctttctcgaaaccgcaacttcctatctcgcacaaaaaaacgaaaccgactaaaaacgataactaaaaacgacttatataaaactcaactcccgacataacgacgcaacccctctcgctttcgacctccgtacgacgaattttcccacctctctaacaacg

SEQ ID NO: 25875 - DNA, 558 bp, Artificial Sequence
  chemically treated genomic DNA (Homo sapiens) CpG-island No: 25875
ttttatggtagcggtttcgggtaggatttgcgaggggaagcggagtgagcggatgcgttttaattttttttttagttttttttttttaagtaacgtttattttcggttttgttcggttttttcgtttatttggagtcgagggcgcgttcgggagcggtttcggattatcgttcggcggattgttcggttgttattcgtttttcgatttcgttttttttcgttttcgttgggggttttcgtattttcgaggggtttggggagtcggtcgatttatttttgggtagttttcgggtagcgggcgttttgcggttcgggaagaaaaatttttacgcggtttagagtttcgtttcgcgtttcgtcgaattcggcgtttttcggttttagcgacgtttttttcgttttttcgggatcgtagttttttgtttcgtataggggaacgaagtcggttgggggcgatggttgggggcggtttatatgggatttagttttcggtatagcggcgtagtttttttcgttttcggttttcgtgcggcgaatttttttatttttttggtagcg

SEQ ID NO: 25876 - DNA, 558 bp, Artificial Sequence
  chemically treated genomic DNA (Homo sapiens) CpG-island No: 25876
cgctaccaaaaaaataaaaaaattcgccgcacgaaaaccgaaaacgaaaaaaactacgccgctataccgaaaactaaatcccatataaaccgcccccaaccatcgcccccaaccgacttcgttcccctatacgaaacaaaaaactacgatcccgaaaaaacgaaaaaaacgtcgctaaaaccgaaaaacgccgaattcgacgaaacgcgaaacgaaactctaaaccgcgtaaaaatttttcttcccgaaccgcaaaacgcccgctacccgaaaactacccaaaaataaatcgaccgactccccaaacccctcgaaaatacgaaaacccccaacgaaaacgaaaaaaaacgaaatcgaaaaacgaataacaaccgaacaatccgccgaacgataatccgaaaccgctcccgaacgcgccctcgactccaaataaacgaaaaaaccgaacaaaaccgaaaataaacgttacttaaaaaaaaaaaactaaaaaaaaaattaaaacgcatccgctcactccgcttcccctcgcaaatcctacccgaaaccgctaccataaaa

SEQ ID NO: 25877 - DNA, 641 bp, Artificial Sequence
  chemically treated genomic DNA (Homo sapiens) CpG-island No: 25877
atacgttttaggttgaggattatgggcgaggaacgaaatcgttttaataagaacgtcgttgaacggacgacgttattaatgattattgattaatagttttttcggacggcgcgtaacggttttgtattacgcgcgcgtaatggagcgggtggtagagcgcgaggtttttgcgtgttagattttacgggggttttcgacgaagtgggtcgtatcgaatttcgttttcgcgagtgtgtggtttcgagtatttttttgcgaaaatattttcgtatataaggtaagttcgtttaaaatattacgtgcgtcgcgatggtttcgtaaacgcgttattcgttcgtttttaggggttagggcggtacgtttgtttttagtttaggagttatagggttaggttgggtttcgagggcgaattcgagtattgcgtaaaacgatagaaaatgattcgggtaagagggttttagttgggatttcgggtggtggtaattgatgtacggagaatcgattgatttgggacgtgaagggtagttagatttgagatagttcggcgatattggagttcggtaataagagggaggtttttcgttagatgataaggtatattatttagcgttttagatcgtaggattagtaaagtttatgaa

SEQ ID NO: 25878 - DNA, 641 bp, Artificial Sequence
  chemically treated genomic DNA (Homo sapiens) CpG-island No: 25878
ttcataaactttactaatcctacgatctaaaacgctaaataatataccttatcatctaacgaaaaacctccctcttattaccgaactccaatatcgccgaactatctcaaatctaactacccttcacgtcccaaatcaatcgattctccgtacatcaattaccaccacccgaaatcccaactaaaaccctcttacccgaatcattttctatcgttttacgcaatactcgaattcgccctcgaaacccaacctaaccctataactcctaaactaaaaacaaacgtaccgccctaacccctaaaaacgaacgaataacgcgtttacgaaaccatcgcgacgcacgtaatattttaaacgaacttaccttatatacgaaaatattttcgcaaaaaaatactcgaaaccacacactcgcgaaaacgaaattcgatacgacccacttcgtcgaaaacccccgtaaaatctaacacgcaaaaacctcgcgctctaccacccgctccattacgcgcgcgtaatacaaaaccgttacgcgccgtccgaaaaaactattaatcaataatcattaataacgtcgtccgttcaacgacgttcttattaaaacgatttcgttcctcgcccataatcctcaacctaaaacgtat

SEQ ID NO: 25879 - DNA, 641 bp, Artificial Sequence
  chemically treated genomic DNA (Homo sapiens) CpG-island No: 25879
tttataagttttattagttttacggtttgagacgttggatggtatgttttgttatttagcgaggagttttttttttgttatcgagttttagtgtcgtcgaattattttaagtttagttattttttacgttttaggttaatcgatttttcgtgtattagttattattattcgggattttagttggaatttttttgttcgggttattttttgtcgttttacgtaatgttcgggttcgttttcggggtttaatttgattttgtaatttttgggttgaaagtaggcgtgtcgttttagtttttaaaagcgggcgaataacgcgtttgcgagattatcgcggcgtacgtggtgttttgaacgggtttgttttgtgtgcggaaatattttcgtaggagaatattcggggttatatattcgcggggacggaattcggtgcggtttatttcgtcggaaattttcgtggggtttggtacgtaggggtttcgcgttttgttattcgttttattgcgcgcgcgtggtgtaggatcgttgcgcgtcgttcggaggggttgttggttagtgattattggtagcgtcgttcgtttagcggcgtttttattagagcgatttcgtttttcgtttatgatttttagtttggggcgtgt

SEQ ID NO: 25880 - DNA, 641 bp, Artificial Sequence
  chemically treated genomic DNA (Homo sapiens) CpG-island No: 25880
acacgccccaaactaaaaatcataaacgaaaaacgaaatcgctctaataaaaacgccgctaaacgaacgacgctaccaataatcactaaccaacaacccctccgaacgacgcgcaacgatcctacaccacgcgcgcgcaataaaacgaataacaaaacgcgaaacccctacgtaccaaaccccacgaaaatttccgacgaaataaaccgcaccgaattccgtccccgcgaatatataaccccgaatattctcctacgaaaatatttccgcacacaaaacaaacccgttcaaaacaccacgtacgccgcgataatctcgcaaacgcgttattcgcccgcttttaaaaactaaaacgacacgcctactttcaacccaaaaattacaaaatcaaattaaaccccgaaaacgaacccgaacattacgtaaaacgacaaaaaataacccgaacaaaaaaattccaactaaaatcccgaataataataactaatacacgaaaaatcgattaacctaaaacgtaaaaaataactaaacttaaaataattcgacgacactaaaactcgataacaaaaaaaaaactcctcgctaaataacaaaacataccatccaacgtctcaaaccgtaaaactaataaaacttataaa

SEQ ID NO: 25881 - DNA, 556 bp, Artificial Sequence
  chemically treated genomic DNA (Homo sapiens) CpG-island No: 25881
  misc_feature (91)..(91): n is either a, c, g or t
ttcggtagtagtatgcggttgagttagttgtggattacgtcgtcgttcgggcgtagcgagacgtcgttattggtggagatgaatttcggtngggtgtggtgggttttgacgtttatcggttttcggtaggtcgcggtgaggtagaataattagtattattacgtcggtcgataagtttaagtaggttagggtttttagttcgttacgggttattagatcggtggtgttttgcgagtttattaaggttattttcggttcgtagtaagtgttcgggcgtatgtttttggttttcgttaggttataggcgtaggttattattttttgtgttagcgagtagtttttggtcggattcggtcggttgtatttggtaggtcggaataagtcggtgatcggtaagtttaaggttttacgtttttttgcggttaagttacggtcgatgattagcggaatgcggtcgttcgggcgtatttttgtagaatagttcgtaagattttattttcgaatttcgggattattatttcggatatttatcggttttgttttaatacgggatcgt

SEQ ID NO: 25882 - DNA, 556 bp, Artificial Sequence
  chemically treated genomic DNA (Homo sapiens) CpG-island No: 25882
  misc_feature (466)..(466): n is either a, c, g or t
acgatcccgtattaaaacaaaaccgataaatatccgaaataataatcccgaaattcgaaaataaaatcttacgaactattctacaaaaatacgcccgaacgaccgcattccgctaatcatcgaccgtaacttaaccgcaaaaaaacgtaaaaccttaaacttaccgatcaccgacttattccgacctaccaaatacaaccgaccgaatccgaccaaaaactactcgctaacacaaaaaataataacctacgcctataacctaacgaaaaccaaaaacatacgcccgaacacttactacgaaccgaaaataaccttaataaactcgcaaaacaccaccgatctaataacccgtaacgaactaaaaaccctaacctacttaaacttatcgaccgacgtaataatactaattattctacctcaccgcgacctaccgaaaaccgataaacgtcaaaacccaccacacccnaccgaaattcatctccaccaataacgacgtctcgctacgcccgaacgacgacgtaatccacaactaactcaaccgcatactactaccgaa

SEQ ID NO: 25883 - DNA, 556 bp, Artificial Sequence
  chemically treated genomic DNA (Homo sapiens) CpG-island No: 25883
  misc_feature (466)..(466): n is either a, c, g or t
gcggtttcgtattaaggtaaggtcggtaaatattcgggatagtgatttcgaagttcgaaagtaaagttttacgagttgttttatagaagtgcgttcgggcggtcgtatttcgttgattatcggtcgtggtttgatcgtaaaggagcgtgaagttttgggtttgtcggttatcgatttgtttcgatttgttaggtgtagtcggtcgaattcggttaagggttattcgttggtatagaagatggtggtttgcgtttgtggtttggcggaagttaagggtatgcgttcgggtatttattgcgagtcgaagatgattttggtgggttcgtaggatattatcggtttgatgattcgtgacgagttgaaggttttggtttgtttgggtttatcggtcgacgtggtgatgttagttgttttgttttatcgcggtttatcggaagtcggtggacgttaagatttattatatttngtcggagtttatttttattagtggcggcgtttcgttgcgttcgggcgacggcgtgatttatagttggtttaatcgtatgttgttgtcgga

SEQ ID NO: 25884 - DNA, 556 bp, Artificial Sequence
  chemically treated genomic DNA (Homo sapiens) CpG-island No: 25884
  misc_feature (91)..(91): n is either a, c, g or t
tccgacaacaacatacgattaaaccaactataaatcacgccgtcgcccgaacgcaacgaaacgccgccactaataaaaataaactccgacnaaatataataaatcttaacgtccaccgacttccgataaaccgcgataaaacaaaacaactaacatcaccacgtcgaccgataaacccaaacaaaccaaaaccttcaactcgtcacgaatcatcaaaccgataatatcctacgaacccaccaaaatcatcttcgactcgcaataaatacccgaacgcatacccttaacttccgccaaaccacaaacgcaaaccaccatcttctataccaacgaataacccttaaccgaattcgaccgactacacctaacaaatcgaaacaaatcgataaccgacaaacccaaaacttcacgctcctttacgatcaaaccacgaccgataatcaacgaaatacgaccgcccgaacgcacttctataaaacaactcgtaaaactttactttcgaacttcgaaatcactatcccgaatatttaccgaccttaccttaatacgaaaccgc

SEQ ID NO: 25885 - DNA, 573 bp, Artificial Sequence
  chemically treated genomic DNA (Homo sapiens) CpG-island No: 25885
gggcggtttttaggagtcgggttagcgagtttgggttttgagcgagcggcgtcggttcggtttttttttcggcgggtcggtcgagatttcgtttcggaggcggaggcggagttaggggagggggtcgggggtcggttggtttcgtttttcgcgttttcgtttcgtttcgcgcgtatatagttaggggtcgttcgggttttcgacgcgtcgacggtcgggcggacggacggacggacgtcgagcgtagtgtttcgcggtgagtgtacgcggtttttttcgttcggatttattttcgtcggttcgcgtttcgtagtttaggattcgggggcgttcggacgtatcgacggttcggcggattttcggacgcgtttcgcgggttgttcgcgtttttattcgcgtcgtcggttcgatcgggtttcgttttttcggttttagcgcggggacggttcgcgagcgtcgcgatttagtgtatagatgcgggtatagaggtcggcgcggggtggggggttaggggttcgcgggcgggtttttttattttaggttcgtagtttttttcgttttgggttttatttt

SEQ ID NO: 25886 - DNA, 573 bp, Artificial Sequence
  chemically treated genomic DNA (Homo sapiens) CpG-island No: 25886
aaaataaaacccaaaacgaaaaaaactacgaacctaaaataaaaaaacccgcccgcgaacccctaaccccccaccccgcgccgacctctatacccgcatctatacactaaatcgcgacgctcgcgaaccgtccccgcgctaaaaccgaaaaaacgaaacccgatcgaaccgacgacgcgaataaaaacgcgaacaacccgcgaaacgcgtccgaaaatccgccgaaccgtcgatacgtccgaacgcccccgaatcctaaactacgaaacgcgaaccgacgaaaataaatccgaacgaaaaaaaccgcgtacactcaccgcgaaacactacgctcgacgtccgtccgtccgtccgcccgaccgtcgacgcgtcgaaaacccgaacgacccctaactatatacgcgcgaaacgaaacgaaaacgcgaaaaacgaaaccaaccgacccccgaccccctcccctaactccgcctccgcctccgaaacgaaatctcgaccgacccgccgaaaaaaaaaccgaaccgacgccgctcgctcaaaacccaaactcgctaacccgactcctaaaaaccgccc

SEQ ID NO: 25887 - DNA, 573 bp, Artificial Sequence
  chemically treated genomic DNA (Homo sapiens) CpG-island No: 25887
gaagtgaaatttagagcggaggaagttgcggatttggggtgggggaattcgttcgcggatttttggttttttatttcgcgtcggtttttgtgttcgtatttgtatattgggtcgcggcgttcgcgggtcgttttcgcgttgggatcgggagagcgagattcggtcggatcggcggcgcgggtggaggcgcgggtagttcgcgaggcgcgttcgagggttcgtcgagtcgtcggtgcgttcgagcgttttcgagttttgagttgcgaggcgcggatcgacggggatgagttcgggcgggaggggtcgcgtgtatttatcgcggggtattgcgttcggcgttcgttcgttcgttcgttcggtcgtcggcgcgtcgagagttcgggcggtttttggttgtgtgcgcgcggggcggggcggaggcgcgagaggcgggattagtcggttttcggtttttttttttgatttcgttttcgttttcggggcggggtttcggtcggttcgtcggagagggggtcgggtcggcgtcgttcgtttagagtttagattcgttgattcggtttttagaggtcgttt

SEQ ID NO: 25888 - DNA, 573 bp, Artificial Sequence
  chemically treated genomic DNA (Homo sapiens) CpG-island No: 25888
aaacgacctctaaaaaccgaatcaacgaatctaaactctaaacgaacgacgccgacccgaccccctctccgacgaaccgaccgaaaccccgccccgaaaacgaaaacgaaatcaaaaaaaaaaaccgaaaaccgactaatcccgcctctcgcgcctccgccccgccccgcgcgcacacaaccaaaaaccgcccgaactctcgacgcgccgacgaccgaacgaacgaacgaacgaacgccgaacgcaataccccgcgataaatacacgcgacccctcccgcccgaactcatccccgtcgatccgcgcctcgcaactcaaaactcgaaaacgctcgaacgcaccgacgactcgacgaaccctcgaacgcgcctcgcgaactacccgcgcctccacccgcgccgccgatccgaccgaatctcgctctcccgatcccaacgcgaaaacgacccgcgaacgccgcgacccaatatacaaatacgaacacaaaaaccgacgcgaaataaaaaaccaaaaatccgcgaacgaattcccccaccccaaatccgcaacttcctccgctctaaatttcacttc

SEQ ID NO: 25889 - DNA, 503 bp, Artificial Sequence
  chemically treated genomic DNA (Homo sapiens) CpG-island No: 25889
tcgtttttcgcggttcggttttattagtcgtagtatttttacgtggttttttatattgaagtagaaggggcgatgttttattttcggttgtacgttatttatcgcgtttgtagatttagtagtagtatttttttttaattttttttagttggttgtttgagtaggttttgcgaagcgatagtaatcgttatcgcggcggagtatcgtttttttttatttttcgtttagttcggtttttcgtttttttgcgcgtatgcgtacggcgtcgcgttcgttttcgcgtatgcgttttaacgggatttcgcggtcgttcgttttggtttgtgttgttttttagttatcgcgtagtatattagcggatttagagttgggtatatattagcggatttagaggtgggtacgtaggttagcgttttgttagttcgtcgtgttttggtttggcgttaatgacggtagtattttagtttttttgaggagtttttttgtcgggaaatttttttagg

SEQ ID NO: 25890 - DNA, 503 bp, Artificial Sequence
  chemically treated genomic DNA (Homo sapiens) CpG-island No: 25890
cctaaaaaaatttcccgacaaaaaaactcctcaaaaaaactaaaatactaccgtcattaacgccaaaccaaaacacgacgaactaacaaaacgctaacctacgtacccacctctaaatccgctaatatatacccaactctaaatccgctaatatactacgcgataactaaaaaacaacacaaaccaaaacgaacgaccgcgaaatcccgttaaaacgcatacgcgaaaacgaacgcgacgccgtacgcatacgcgcaaaaaaacgaaaaaccgaactaaacgaaaaataaaaaaaaacgatactccgccgcgataacgattactatcgcttcgcaaaacctactcaaacaaccaactaaaaaaaattaaaaaaaaatactactactaaatctacaaacgcgataaataacgtacaaccgaaaataaaacatcgccccttctacttcaatataaaaaaccacgtaaaaatactacgactaataaaaccgaaccgcgaaaaacga

SEQ ID NO: 25891 - DNA, 503 bp, Artificial Sequence
  chemically treated genomic DNA (Homo sapiens) CpG-island No: 25891
tttgggaggatttttcgataggaagattttttaggagagttggagtgttgtcgttattaacgttaggttagaatacggcgggttaatagggcgttggtttgcgtgtttatttttaggttcgttaatatgtgtttagttttaggttcgttaatgtgttacgcgataattgaaagatagtataagttagagcggacggtcgcgggatttcgttggggcgtatgcgcgagagcgaacgcggcgtcgtgcgtatgcgcgtaagagagcgggaagtcgagttgggcgagaagtaggggagggcggtgtttcgtcgcggtggcggttgttatcgtttcgtagaatttatttaggtagttagttgagaagagttgagggaaagtgttgttgttgggtttgtagacgcgatggataacgtgtagtcgaaaataaaatatcgttttttttgttttagtgtgaaaggttacgtgaagatgttgcggttggtgaggtcgggtcgcggagggcgg

SEQ ID NO: 25892 - DNA, 503 bp, Artificial Sequence
  chemically treated genomic DNA (Homo sapiens) CpG-island No: 25892
ccgccctccgcgacccgacctcaccaaccgcaacatcttcacgtaacctttcacactaaaacaaaaaaaacgatattttattttcgactacacgttatccatcgcgtctacaaacccaacaacaacactttccctcaactcttctcaactaactacctaaataaattctacgaaacgataacaaccgccaccgcgacgaaacaccgccctcccctacttctcgcccaactcgacttcccgctctcttacgcgcatacgcacgacgccgcgttcgctctcgcgcatacgccccaacgaaatcccgcgaccgtccgctctaacttatactatctttcaattatcgcgtaacacattaacgaacctaaaactaaacacatattaacgaacctaaaaataaacacgcaaaccaacgccctattaacccgccgtattctaacctaacgttaataacgacaacactccaactctcctaaaaaatcttcctatcgaaaaatcctcccaaa

SEQ ID NO: 25893 - DNA, 836 bp, Artificial Sequence
  chemically treated genomic DNA (Homo sapiens) CpG-island No: 25893
gcgtgtcgggatcgttagcgtttattagcggttttcgtttcggttttaggcgtaggtgggggcggggttagggcggggtttgaggagtcggcgtttcgtttcgtttcgttttttttcgaggttcgcggcgtcgtcgtttttatttcgttcgagtcgcggagcgttttcgagcggtcggttgcggtttggtttcgtttttttcggttcggcgcgttcgttttcgttttttttttttttttggtttttattttttttttttttcgttgtcgaggcggcgggagtcgagttcgagcggatcgagtcgtagtcgtagtcgggcggcgggcgagaggcggcggcggcgggcgggtcgcgggtagttagtcgggcggcggcggcggcggcggcggcgatgcggcggtttcgttgagttcgttcgtttttggcgtcgggagttagtcgcgcgaggcggttcgggtcgggcggtagtatgcggagcggcgaggagttggacggtttcgagggcgaggtttcgagtatttttatgatttcgggcgttagtagttcgtattagtttattatcgagtcggtgagttagcgtcgcgggttggtcggtttgcgttgcgatttcgattatttgcgcggcgcgttcggtcgttttaaggtcgtttaagtggtaggtgtcgggcggggttttaggtgttcgagggcggtttagtcgtacgttttttttttcgtttcgttgcggggttttcgtcgcgtattcgtttgtttaggtcggagttcgttgttcgcgttttttttgtttggtgggggtttcgggattattttgtagttttgtttggggattttcgttt

SEQ ID NO: 25894 - DNA, 836 bp, Artificial Sequence
  chemically treated genomic DNA (Homo sapiens) CpG-island No: 25894
aaacgaaaatccccaaacaaaactacaaaataatcccgaaacccccaccaaacaaaaaaaacgcgaacaacgaactccgacctaaacaaacgaatacgcgacgaaaaccccgcaacgaaacgaaaaaaaaaacgtacgactaaaccgccctcgaacacctaaaaccccgcccgacacctaccacttaaacgaccttaaaacgaccgaacgcgccgcgcaaataatcgaaatcgcaacgcaaaccgaccaacccgcgacgctaactcaccgactcgataataaactaatacgaactactaacgcccgaaatcataaaaatactcgaaacctcgccctcgaaaccgtccaactcctcgccgctccgcatactaccgcccgacccgaaccgcctcgcgcgactaactcccgacgccaaaaacgaacgaactcaacgaaaccgccgcatcgccgccgccgccgccgccgccgcccgactaactacccgcgacccgcccgccgccgccgcctctcgcccgccgcccgactacgactacgactcgatccgctcgaactcgactcccgccgcctcgacaacgaaaaaaaaaaaaaataaaaaccaaaaaaaaaaaaaaaacgaaaacgaacgcgccgaaccgaaaaaaacgaaaccaaaccgcaaccgaccgctcgaaaacgctccgcgactcgaacgaaataaaaacgacgacgccgcgaacctcgaaaaaaaacgaaacgaaacgaaacgccgactcctcaaaccccgccctaaccccgcccccacctacgcctaaaaccgaaacgaaaaccgctaataaacgctaacgatcccgacacgc

SEQ ID NO: 25895 - DNA, 836 bp, Artificial Sequence
  chemically treated genomic DNA (Homo sapiens) CpG-island No: 25895
aagcgggggtttttagataaggttgtagagtggtttcgggatttttattaggtagagggggcgcgagtagcgggtttcggtttgggtaagcgggtacgcggcggaggtttcgtagcggggcggggaggaaggcgtgcggttaggtcgttttcgggtatttggggtttcgttcggtatttattatttgggcgattttgaggcggtcgagcgcgtcgcgtaggtagtcggggtcgtagcgtaggtcggttagttcgcggcgttggtttatcggttcggtggtgggttggtacgggttgttggcgttcgagattatggaggtgttcgaggtttcgttttcgaagtcgtttagtttttcgtcgtttcgtatgttgtcgttcggttcgggtcgtttcgcgcggttggttttcggcgttaggagcgggcggatttagcggggtcgtcgtatcgtcgtcgtcgtcgtcgtcgtcgttcgattgattgttcgcggttcgttcgtcgtcgtcgtttttcgttcgtcgttcggttgcggttgcggttcggttcgttcgggttcggttttcgtcgtttcggtagcggaaagggagggaggtgggagttaggagagggaaggaggcgggagcgggcgcgtcgggtcgggagaggcggagttaggtcgtagtcggtcgttcggaggcgtttcgcggttcgagcgaggtggaggcggcggcgtcgcgggtttcggggaggggcggggcgaggcggggcgtcggttttttaggtttcgttttggtttcgtttttatttgcgtttagagtcggggcgggagtcgttggtgggcgttggcgatttcggtacgt

SEQ ID NO: 25896 - DNA, 836 bp, Artificial Sequence
  chemically treated genomic DNA (Homo sapiens) CpG-island No: 25896
acgtaccgaaatcgccaacgcccaccaacgactcccgccccgactctaaacgcaaataaaaacgaaaccaaaacgaaacctaaaaaaccgacgccccgcctcgccccgcccctccccgaaacccgcgacgccgccgcctccacctcgctcgaaccgcgaaacgcctccgaacgaccgactacgacctaactccgcctctcccgacccgacgcgcccgctcccgcctccttccctctcctaactcccacctccctccctttccgctaccgaaacgacgaaaaccgaacccgaacgaaccgaaccgcaaccgcaaccgaacgacgaacgaaaaacgacgacgacgaacgaaccgcgaacaatcaatcgaacgacgacgacgacgacgacgacgatacgacgaccccgctaaatccgcccgctcctaacgccgaaaaccaaccgcgcgaaacgacccgaaccgaacgacaacatacgaaacgacgaaaaactaaacgacttcgaaaacgaaacctcgaacacctccataatctcgaacgccaacaacccgtaccaacccaccaccgaaccgataaaccaacgccgcgaactaaccgacctacgctacgaccccgactacctacgcgacgcgctcgaccgcctcaaaatcgcccaaataataaataccgaacgaaaccccaaatacccgaaaacgacctaaccgcacgccttcctccccgccccgctacgaaacctccgccgcgtacccgcttacccaaaccgaaacccgctactcgcgccccctctacctaataaaaatcccgaaaccactctacaaccttatctaaaaacccccgctt

SEQ ID NO: 25897 - DNA, 567 bp, Artificial Sequence
  chemically treated genomic DNA (Homo sapiens) CpG-island No: 25897
gagcgatgcgagttttgggagatagcgacgtcgtttttcgttagagatttgtttttcggttcggttttttgtttaattttgtttagcgcgcgggggtcggcgaaggcgtcgcggacgtatcgacggttgaagagcggcgatgtatatgtattagtagtattttttaatttattttttttatatttcgcgtcgtcgtcgtcgttttttttattttttttttcgtcgtcgtcgtttttttttttttcggtagtcgcggtagtaggatttattttgttttttattttattttttgtcggtttcggttgcggttttagtttcgattattattttatttattttgggtcgtgtataagttttagtgtttgtagttcgcgttttttcggttcgcgggcgtttttttttttggtttcggagttttagatttcggttattttcgattcgataattttagatttttgttagttgtcgcgagttttcgttgttggaattttgttagcggttgtttttttggagggttttggtttttcgatatttttgtttttagtttaggagaggatatcgtgattt

SEQ ID NO: 25898 - DNA, 567 bp, Artificial Sequence
  chemically treated genomic DNA (Homo sapiens) CpG-island No: 25898
aaatcacgatatcctctcctaaactaaaaacaaaaatatcgaaaaaccaaaaccctccaaaaaaacaaccgctaacaaaattccaacaacgaaaactcgcgacaactaacaaaaatctaaaattatcgaatcgaaaataaccgaaatctaaaactccgaaaccaaaaaaaaaaacgcccgcgaaccgaaaaaacgcgaactacaaacactaaaacttatacacgacccaaaataaataaaataataatcgaaactaaaaccgcaaccgaaaccgacaaaaaataaaataaaaaacaaaataaatcctactaccgcgactaccgaaaaaaaaaaaaacgacgacgacgaaaaaaaaaataaaaaaaacgacgacgacgacgcgaaatataaaaaaaataaattaaaaaatactactaatacatatacatcgccgctcttcaaccgtcgatacgtccgcgacgccttcgccgacccccgcgcgctaaacaaaattaaacaaaaaaccgaaccgaaaaacaaatctctaacgaaaaacgacgtcgctatctcccaaaactcgcatcgctc

SEQ ID NO: 25899 - DNA, 567 bp, Artificial Sequence
  chemically treated genomic DNA (Homo sapiens) CpG-island No: 25899
aaattacgatatttttttttgggttggaaataaaaatgtcgggaaattagaattttttaaaaagatagtcgttaataagattttagtagcggagattcgcggtagttggtaggggtttggggttgtcgaatcgagggtggtcggggtttggggtttcggagttaagggaggaggcgttcgcgggtcgaggaggcgcggattgtaggtattgaggtttgtgtacgatttaaaataaataaaataatagtcgaggttggagtcgtagtcggagtcgatagagggtggggtagggggtagggtgggttttgttgtcgcggttgtcggaggaggaggaggcggcggcggcggaggaggaggtggaggaggcggcggcggcggcgcgggatgtggagggagtgagttagggggtgttgttagtgtatgtgtatcgtcgttttttagtcgtcggtgcgttcgcggcgttttcgtcgattttcgcgcgttgggtagggttgggtagggggtcgggtcgaggggtaggtttttagcgggaggcggcgtcgttgttttttagagttcgtatcgttt

SEQ ID NO: 25900 - DNA, 567 bp, Artificial Sequence
  chemically treated genomic DNA (Homo sapiens) CpG-island No: 25900
aaacgatacgaactctaaaaaacaacgacgccgcctcccgctaaaaacctacccctcgacccgaccccctacccaaccctacccaacgcgcgaaaatcgacgaaaacgccgcgaacgcaccgacgactaaaaaacgacgatacacatacactaacaacaccccctaactcactccctccacatcccgcgccgccgccgccgcctcctccacctcctcctccgccgccgccgcctcctcctcctccgacaaccgcgacaacaaaacccaccctaccccctaccccaccctctatcgactccgactacgactccaacctcgactattattttatttattttaaatcgtacacaaacctcaatacctacaatccgcgcctcctcgacccgcgaacgcctcctcccttaactccgaaaccccaaaccccgaccaccctcgattcgacaaccccaaacccctaccaactaccgcgaatctccgctactaaaatcttattaacgactatctttttaaaaaattctaatttcccgacatttttatttccaacccaaaaaaaaatatcgtaattt

SEQ ID NO: 25901 - DNA, 588 bp, Artificial Sequence
  chemically treated genomic DNA (Homo sapiens) CpG-island No: 25901
ggtttgacgagagttatgaaggcggggtttcgggcgggagtggtttagtgttcgtcgggtcgaggttaggggtgataggttcggttatcggttaaattttttttatcgtttgttcggagttttatatttattaagattcgtttgaagagcgtattttttttgggcgggaggtttacggtcggtatcgtttcggttgttttcgttgttttcgttattattcggttcggttagttagtttgttcgatcgtcgtcgttgtcgtttcgtagttgttttagttttgaatatttcgattcgtcgttattattaggtttcgggtgtcgtcgcgttgttttattcggatatttttttttttttcgttgttttttttttttttttatttaacgttgtcgtcgttttttttattacgggttttcgtcggcggtttacgtggtaattgaatagatcgatagaggtagttaaaatggcggacgcggagggtttttttattcgggttacgttttttaatacgtaggcgcggtgattttttttttttattttttttgggtttcggagtttgtcgggaaatttggaggttggtttgtttgtgg

SEQ ID NO: 25902 - DNA, 588 bp, Artificial Sequence
  chemically treated genomic DNA (Homo sapiens) CpG-island No: 25902
ccacaaacaaaccaacctccaaatttcccgacaaactccgaaacccaaaaaaaataaaaaaaaaaaatcaccgcgcctacgtattaaaaaacgtaacccgaataaaaaaaccctccgcgtccgccattttaactacctctatcgatctattcaattaccacgtaaaccgccgacgaaaacccgtaataaaaaaaacgacgacaacgttaaataaaaaaaaaaaaaaaacaacgaaaaaaaaaaaaatatccgaataaaacaacgcgacgacacccgaaacctaataataacgacgaatcgaaatattcaaaactaaaacaactacgaaacgacaacgacgacgatcgaacaaactaactaaccgaaccgaataataacgaaaacaacgaaaacaaccgaaacgataccgaccgtaaacctcccgcccaaaaaaaatacgctcttcaaacgaatcttaataaatataaaactccgaacaaacgataaaaaaaatttaaccgataaccgaacctatcacccctaacctcgacccgacgaacactaaaccactcccgcccgaaaccccgccttcataactctcgtcaaacc

SEQ ID NO: 25903 - DNA, 588 bp, Artificial Sequence
  chemically treated genomic DNA (Homo sapiens) CpG-island No: 25903
ttataggtaggttagtttttaggtttttcggtaagtttcgaaatttagaggaggtggggaaaggaggttatcgcgtttgcgtgttaggaagcgtgattcgggtgggaaaatttttcgcgttcgttattttggttgtttttgtcggtttgtttagttattacgtgaatcgtcgacggagattcgtagtgggggaggcggcggtagcgttaagtgagaaaggaaaaaagataacgaggaaaaaggaggtgttcgggtagggtaacgcggcgatattcgaggtttggtggtggcggcggatcgagatatttaaggttgaagtagttacggaacggtagcggcggcggtcggataaattgattgatcgagtcgggtggtggcgggagtagcgggagtagtcggaacgatgtcggtcgtgagtttttcgtttaaggagaatgcgttttttaagcggattttggtaagtgtgaggtttcgggtaagcggtggggaggatttagtcggtaatcgggtttgttatttttaatttcggttcggcgggtattgagttattttcgttcgggatttcgtttttatagttttcgttaggtt

SEQ ID NO: 25904 - DNA, 588 bp, Artificial Sequence
  chemically treated genomic DNA (Homo sapiens) CpG-island No: 25904
aacctaacgaaaactataaaaacgaaatcccgaacgaaaataactcaatacccgccgaaccgaaattaaaaataacaaacccgattaccgactaaatcctccccaccgcttacccgaaacctcacacttaccaaaatccgcttaaaaaacgcattctccttaaacgaaaaactcacgaccgacatcgttccgactactcccgctactcccgccaccacccgactcgatcaatcaatttatccgaccgccgccgctaccgttccgtaactacttcaaccttaaatatctcgatccgccgccaccaccaaacctcgaatatcgccgcgttaccctacccgaacacctcctttttcctcgttatcttttttcctttctcacttaacgctaccgccgcctcccccactacgaatctccgtcgacgattcacgtaataactaaacaaaccgacaaaaacaaccaaaataacgaacgcgaaaaattttcccacccgaatcacgcttcctaacacgcaaacgcgataacctcctttccccacctcctctaaatttcgaaacttaccgaaaaacctaaaaactaacctacctataa

SEQ ID NO: 25905 - DNA, 793 bp, Artificial Sequence
  chemically treated genomic DNA (Homo sapiens) CpG-island No: 25905
tcggtcgagtttagagatagttagtttttttttcgtcgcgtcgggtcgcgttgtcgttcgtttttcggtcgtggcgttttcgggttagacgcgttgtagtttttagttcgcggtaagcggggcggtcgcgttattttcggtttcgcgttagtagtttttcgtcgcgcgtttagcgttttcggttagtagtttttttatacgtaggttttgttgggtcgtttcgtcgcgttttttattttgaatttaagttatcgtggagtttcgtcgtttcgaaatttttatcgcgagcgggtgagttttttgcgcgagtttaggggtgggcgcgggtacgcgggtagtgggtgtaggggtcgcggttgtgttattagtcggagtttcgggcgtagggtagattcggggtcgggggtatcggcgcggttcgcggcggttttttggtcgtatcgtttttgggtttcggcggcgaaggtttttagatgtttttagtcgacgggtgatcgggttcgggggagttagggcgcggggattgaggtttcgtaggtgttcgtcgcggagtcgcgtaggggagcggtgggaggtgcgggcgcgggggcgggtttatcgcgtgtttttttcggtgagggttcgagggtcggttgttgtttttgtttcggtcgtttttcgtatatagtggggaagtcgttgtttttgcggagcgggcgcgcggcggggatattggagaggatttttcggattgtgtaatttgattttttttttggattttgggttttttggtagtgggagatggggttcggtt

SEQ ID NO: 25906 - DNA, 793 bp, Artificial Sequence
  chemically treated genomic DNA (Homo sapiens) CpG-island No: 25906
aaccgaaccccatctcccactaccaaaaaacccaaaatccaaaaaaaaaatcaaattacacaatccgaaaaatcctctccaatatccccgccgcgcgcccgctccgcaaaaacaacgacttccccactatatacgaaaaacgaccgaaacaaaaacaacaaccgaccctcgaaccctcaccgaaaaaaacacgcgataaacccgcccccgcgcccgcacctcccaccgctcccctacgcgactccgcgacgaacacctacgaaacctcaatccccgcgccctaactcccccgaacccgatcacccgtcgactaaaaacatctaaaaaccttcgccgccgaaacccaaaaacgatacgaccaaaaaaccgccgcgaaccgcgccgatacccccgaccccgaatctaccctacgcccgaaactccgactaataacacaaccgcgacccctacacccactacccgcgtacccgcgcccacccctaaactcgcgcaaaaaactcacccgctcgcgataaaaatttcgaaacgacgaaactccacgataacttaaattcaaaataaaaaacgcgacgaaacgacccaacaaaacctacgtataaaaaaactactaaccgaaaacgctaaacgcgcgacgaaaaactactaacgcgaaaccgaaaataacgcgaccgccccgcttaccgcgaactaaaaactacaacgcgtctaacccgaaaacgccacgaccgaaaaacgaacgacaacgcgacccgacgcgacgaaaaaaaaactaactatctctaaactcgaccga

SEQ ID NO: 25907 - DNA, 793 bp, Artificial Sequence
  chemically treated genomic DNA (Homo sapiens) CpG-island No: 25907
ggtcgagttttattttttattgttaggagatttagggtttagaggggagattagattgtataattcgaggagttttttttagtattttcgtcgcgcgttcgtttcgtaagggtagcggtttttttattgtgtgcgagaagcggtcggagtagggatagtagtcggttttcgggtttttatcgggaaggatacgcggtgagttcgttttcgcgttcgtattttttatcgtttttttgcgcggtttcgcggcggatatttgcggagttttagttttcgcgttttggttttttcgggttcggttattcgtcggttgaagatatttaagagttttcgtcgtcggagtttagaggcggtgcggttaggaagtcgtcgcgggtcgcgtcgatgttttcggtttcgagtttattttgcgttcgggatttcggttggtggtatagtcgcggtttttgtatttattgttcgcgtgttcgcgtttatttttgggttcgcgtagaggatttattcgttcgcggtgaaagtttcggggcggcggagttttacggtgatttgagtttagagtggggggcgcgacggggcggtttagtaggatttgcgtatggggaggttgttggtcgggaacgttggacgcgcggcgaggggttgttggcgcggggtcgggggtggcgcggtcgtttcgtttgtcgcgggttggaggttgtagcgcgtttggttcggaggcgttacggtcggggagcgagcggtagcgcggttcggcgcggcgggagaggaattggttgtttttgggttcggtcga

SEQ ID NO: 25908 - DNA, 793 bp, Artificial Sequence
  chemically treated genomic DNA (Homo sapiens) CpG-island No: 25908
tcgaccgaacccaaaaacaaccaattcctctcccgccgcgccgaaccgcgctaccgctcgctccccgaccgtaacgcctccgaaccaaacgcgctacaacctccaacccgcgacaaacgaaacgaccgcgccacccccgaccccgcgccaacaacccctcgccgcgcgtccaacgttcccgaccaacaacctccccatacgcaaatcctactaaaccgccccgtcgcgccccccactctaaactcaaatcaccgtaaaactccgccgccccgaaactttcaccgcgaacgaataaatcctctacgcgaacccaaaaataaacgcgaacacgcgaacaataaatacaaaaaccgcgactataccaccaaccgaaatcccgaacgcaaaataaactcgaaaccgaaaacatcgacgcgacccgcgacgacttcctaaccgcaccgcctctaaactccgacgacgaaaactcttaaatatcttcaaccgacgaataaccgaacccgaaaaaaccaaaacgcgaaaactaaaactccgcaaatatccgccgcgaaaccgcgcaaaaaaacgataaaaaatacgaacgcgaaaacgaactcaccgcgtatccttcccgataaaaacccgaaaaccgactactatccctactccgaccgcttctcgcacacaataaaaaaaccgctacccttacgaaacgaacgcgcgacgaaaatactaaaaaaaactcctcgaattatacaatctaatctcccctctaaaccctaaatctcctaacaataaaaaataaaactcgacc

SEQ ID NO: 25909 - DNA, 707 bp, Artificial Sequence
  chemically treated genomic DNA (Homo sapiens) CpG-island No: 25909
attttgtgcggtttcggtttgggaggcgttaattaaattattgtcgatgaatagttgtaaacgttcggttttgagggttagtaggtgagttgggaaatcgcgtatcgttggtagtttgaatttaatgcgaaattggttagcgttacgtcggatgtgttgcggtaaattaaaacgttagaggaggtggagaaaattcgtttcgtttgtgggattgttgatcgcggtgtagagtatattcgtcgttttatttaggcggggatgagcgagcgcgagatagtcgttgaattggagtggtttatgcgttatatgggttatgaaaaagttttttttgatattattgtcgttagtggttggcgtggggcgttgtcgtacggtaaagttagcgataagattgttgtagcgggcgagtttgttattttcgatttcggtgcgttgtattagggttattgttttgatatgacgcgtattttgttggtgaatggcgaaggggtgagcgtcgaattttatttgttgtttaacgtttattaaattgttttgtaggtatagttcgtagtaattttcgcgattcgtttcggcgtgcgttgttagtaggttgacgatgtcgcgcgtcgggttattatagaagtaggttatggcgattatttcggttataatatcggttacgttatcggtattgaagtttatgaagattcgcgttttttatcgcg

SEQ ID NO: 25910 - DNA, 707 bp, Artificial Sequence
  chemically treated genomic DNA (Homo sapiens) CpG-island No: 25910
cgcgataaaaaacgcgaatcttcataaacttcaataccgataacgtaaccgatattataaccgaaataatcgccataacctacttctataataacccgacgcgcgacatcgtcaacctactaacaacgcacgccgaaacgaatcgcgaaaattactacgaactatacctacaaaacaatttaataaacgttaaacaacaaataaaattcgacgctcaccccttcgccattcaccaacaaaatacgcgtcatatcaaaacaataaccctaatacaacgcaccgaaatcgaaaataacaaactcgcccgctacaacaatcttatcgctaactttaccgtacgacaacgccccacgccaaccactaacgacaataatatcaaaaaaaactttttcataacccatataacgcataaaccactccaattcaacgactatctcgcgctcgctcatccccgcctaaataaaacgacgaatatactctacaccgcgatcaacaatcccacaaacgaaacgaattttctccacctcctctaacgttttaatttaccgcaacacatccgacgtaacgctaaccaatttcgcattaaattcaaactaccaacgatacgcgatttcccaactcacctactaaccctcaaaaccgaacgtttacaactattcatcgacaataatttaattaacgcctcccaaaccgaaaccgcacaaaat

SEQ ID NO: 25911 - DNA, 707 bp, Artificial Sequence
  chemically treated genomic DNA (Homo sapiens) CpG-island No: 25911
cgcggtgaaaaacgcggatttttatgaattttaatgtcgatagcgtgatcggtgttatgatcgaaatagtcgttataatttgtttttgtaatgattcggcgcgcggtatcgttaatttgttggtagcgtacgtcggggcgaatcgcggagattgttgcgagttgtgtttgtaggataatttgatagacgttaaatagtaggtgagattcggcgtttattttttcgttatttattagtaaggtgcgcgttatattagagtagtagttttgatatagcgtatcgaaatcgagagtgataaattcgttcgttgtaataattttgtcgttggttttgtcgtgcggtagcgttttacgttagttattggcgataatggtgttaaaagaggtttttttatggtttatgtggcgtataaattattttagtttagcggttatttcgcgttcgtttattttcgtttgaataaagcggcgaatatgttttgtatcgcgattagtaattttataggcgaggcggattttttttattttttttggcgttttgatttgtcgtagtatattcggcgtggcgttaattagtttcgtattgagtttagattgttagcggtgcgcggttttttaatttatttgttggtttttaaaatcgagcgtttgtaattgtttatcggtaatgatttgattgacgttttttagatcgaaatcgtataaaat

SEQ ID NO: 25912 - DNA, 707 bp, Artificial Sequence
  chemically treated genomic DNA (Homo sapiens) CpG-island No: 25912
attttatacgatttcgatctaaaaaacgtcaatcaaatcattaccgataaacaattacaaacgctcgattttaaaaaccaacaaataaattaaaaaaccgcgcaccgctaacaatctaaactcaatacgaaactaattaacgccacgccgaatatactacgacaaatcaaaacgccaaaaaaaataaaaaaaatccgcctcgcctataaaattactaatcgcgatacaaaacatattcgccgctttattcaaacgaaaataaacgaacgcgaaataaccgctaaactaaaataatttatacgccacataaaccataaaaaaacctcttttaacaccattatcgccaataactaacgtaaaacgctaccgcacgacaaaaccaacgacaaaattattacaacgaacgaatttatcactctcgatttcgatacgctatatcaaaactactactctaatataacgcgcaccttactaataaataacgaaaaaataaacgccgaatctcacctactatttaacgtctatcaaattatcctacaaacacaactcgcaacaatctccgcgattcgccccgacgtacgctaccaacaaattaacgataccgcgcgccgaatcattacaaaaacaaattataacgactatttcgatcataacaccgatcacgctatcgacattaaaattcataaaaatccgcgtttttcaccgcg

SEQ ID NO: 25913 - DNA, 661 bp, Artificial Sequence
  chemically treated genomic DNA (Homo sapiens) CpG-island No: 25913
ggttttggtttcggcgtaggtggtgttttaatttttggtttaggcggttttatcggtttcggtttcggtggggcgatcggtgtaggtttcggtttaaattcggtgttattggttgtaatagtggtcggatcgagttttggtgttgcggtattatttgttcgtatttttttcgttgcgtttttcggcggttgcgtcggtaacgtttgggtggcggttggtattatattaggtttattacgatcgttcgttttcggtattagcgggatagtcgcgaatttattttgataatgttttttttgttcgtttagtagttttggaagtataattatttttagcgttattagtacgatcgtgtttattaatcgattttgaaatttatttgttatcgttttttttcgcgttaattatttttatgatatgtgcgatcgtgtggaaagaatatatattagtacggtgtttttcgttttagcgttcgttattgcggtattttatgtttgcgtaacggtattaaatgatttgtcgttatttaaaatttttagtagttgttttttcgtggtacgcgcggtttttttagttgcggatatattagttataattacgttttttaataaggtagagttcgggaatatttttattatggagtatatcgtaatcggtagaa

SEQ ID NO: 25914 - DNA, 661 bp, Artificial Sequence
  chemically treated genomic DNA (Homo sapiens) CpG-island No: 25914
ttctaccgattacgatatactccataataaaaatattcccgaactctaccttattaaaaaacgtaattataactaatatatccgcaactaaaaaaaccgcgcgtaccacgaaaaaacaactactaaaaattttaaataacgacaaatcatttaataccgttacgcaaacataaaataccgcaataacgaacgctaaaacgaaaaacaccgtactaatatatattctttccacacgatcgcacatatcataaaaataattaacgcgaaaaaaaacgataacaaataaatttcaaaatcgattaataaacacgatcgtactaataacgctaaaaataattatacttccaaaactactaaacgaacaaaaaaaacattatcaaaataaattcgcgactatcccgctaataccgaaaacgaacgatcgtaataaacctaatataataccaaccgccacccaaacgttaccgacgcaaccgccgaaaaacgcaacgaaaaaaatacgaacaaataataccgcaacaccaaaactcgatccgaccactattacaaccaataacaccgaatttaaaccgaaacctacaccgatcgccccaccgaaaccgaaaccgataaaaccgcctaaaccaaaaattaaaacaccacctacgccgaaaccaaaacc

SEQ ID NO: 25915 - DNA, 661 bp, Artificial Sequence
  chemically treated genomic DNA (Homo sapiens) CpG-island No: 25915
ttttgtcggttacggtatgttttatgataaagatattttcgaattttgttttgttgaaaagcgtggttatgattggtatgttcgtaattggaagggtcgcgcgtgttacggaagaataattgttgaagattttgggtaacggtaaattatttgatatcgttgcgtaggtatgggatgtcgtaatggcggacgttaaagcggaagatatcgtgttggtgtgtgttttttttatacggtcgtatatgttatggaagtgattgacgcgaggagaagcggtggtaagtaagttttagaatcggttagtgggtacgatcgtgttggtggcgttgggggtgattgtatttttagggttgttggacgggtagaaaaaatattattaggatgagttcgcggttatttcgttggtgtcgaaagcgggcgatcgtgatgagtttgatatgatgttagtcgttatttaggcgttatcgacgtagtcgtcggaaggcgtagcggaagaggtgcgggtaggtgatgtcgtagtattaaagttcgattcggttattattgtagttaataatatcgagtttgaatcggaatttgtatcggtcgttttatcgaagtcgaaatcggtggagtcgtttaaattaaaggttgaagtattatttgcgtcgaagttagaatt

SEQ ID NO: 25916 - DNA, 661 bp, Artificial Sequence
  chemically treated genomic DNA (Homo sapiens) CpG-island No: 25916
aattctaacttcgacgcaaataatacttcaacctttaatttaaacgactccaccgatttcgacttcgataaaacgaccgatacaaattccgattcaaactcgatattattaactacaataataaccgaatcgaactttaatactacgacatcacctacccgcacctcttccgctacgccttccgacgactacgtcgataacgcctaaataacgactaacatcatatcaaactcatcacgatcgcccgctttcgacaccaacgaaataaccgcgaactcatcctaataatattttttctacccgtccaacaaccctaaaaatacaatcacccccaacgccaccaacacgatcgtacccactaaccgattctaaaacttacttaccaccgcttctcctcgcgtcaatcacttccataacatatacgaccgtataaaaaaaacacacaccaacacgatatcttccgctttaacgtccgccattacgacatcccatacctacgcaacgatatcaaataatttaccgttacccaaaatcttcaacaattattcttccgtaacacgcgcgacccttccaattacgaacataccaatcataaccacgcttttcaacaaaacaaaattcgaaaatatctttatcataaaacataccgtaaccgacaaaa

SEQ ID NO: 25917 - DNA, 756 bp, Artificial Sequence
  chemically treated genomic DNA (Homo sapiens) CpG-island No: 25917
  misc_feature (708)..(708): n is either a, c, g or t
cgtcgttattgtttcggacggtagtagaaacgggatatagtacgatgcgtggggaaaggtcgttcgtattacgtagggcgggttgacgcgtagtatggaatacgatgttgtcggacgggttattcgtttgattagtgaaaacggtagttatattatttttcgttacgatgtatttgatcggttgatataggaaatcggttttgacggtcgtatatagcgttattattacgatttgatcggtaaatttattcgtagcgaggatgagggtttggttatttattggtattatgacgaagtagatcgttttacgtatcgtatcgtgaagggtgaaacgtagagcggtggtagtatgacgaacgtggttggttgatagatattagttatattagtgaaggttatcgcgtgtcggtttattacggttatgacgataaaggtcggttgatcggtgagcgttagacggtgtattattcgtagacggaagtattgttttggtattatgagatcggatatgcgtataacgaataggggttggtaaatcgcgttacgtcggatagtttgttcgtcggtggagtggttgatttacggtagcggttattttgcgggtatgaaattcggcgatatatcgttgttggagtttacgcgcgatcgtttgtatcgtgagacggtgcgtattttcggtagtatggtaggtagtaatgtcgtatatanattgattagtatatatattttcgtaagttagttatagagttagtattt

SEQ ID NO: 25918 - DNA, 756 bp, Artificial Sequence
  chemically treated genomic DNA (Homo sapiens) CpG-island No: 25918
  misc_feature (49)..(49): n is either a, c, g or t
aaatactaactctataactaacttacgaaaatatatatactaatcaatntatatacgacattactacctaccatactaccgaaaatacgcaccgtctcacgatacaaacgatcgcgcgtaaactccaacaacgatatatcgccgaatttcatacccgcaaaataaccgctaccgtaaatcaaccactccaccgacgaacaaactatccgacgtaacgcgatttaccaacccctattcgttatacgcatatccgatctcataataccaaaacaatacttccgtctacgaataatacaccgtctaacgctcaccgatcaaccgacctttatcgtcataaccgtaataaaccgacacgcgataaccttcactaatataactaatatctatcaaccaaccacgttcgtcatactaccaccgctctacgtttcacccttcacgatacgatacgtaaaacgatctacttcgtcataataccaataaataaccaaaccctcatcctcgctacgaataaatttaccgatcaaatcgtaataataacgctatatacgaccgtcaaaaccgatttcctatatcaaccgatcaaatacatcgtaacgaaaaataatataactaccgttttcactaatcaaacgaataacccgtccgacaacatcgtattccatactacgcgtcaacccgccctacgtaatacgaacgacctttccccacgcatcgtactatatcccgtttctactaccgtccgaaacaataacgacg

SEQ ID NO: 25919 - DNA, 756 bp, Artificial Sequence
  chemically treated genomic DNA (Homo sapiens) CpG-island No: 25919
  misc_feature (49)..(49): n is either a, c, g or t
aggtgttggttttgtaattggtttgcgggggtgtatgtgttggttagtntatatgcggtattattgtttgttatgttgtcgaaagtgcgtatcgttttacggtgtaggcggtcgcgcgtgaattttagtagcggtgtgtcgtcgagttttatgttcgtaagatagtcgttgtcgtaggttagttattttatcggcgggtagattgttcggcgtgacgcggtttgttagtttttgttcgttgtacgtatgttcggttttatggtgttagagtagtgttttcgtttgcgggtgatgtatcgtttgacgtttatcggttagtcggtttttatcgttatagtcgtagtggatcgatacgcggtggtttttattggtatggttgatgtttgttagttagttacgttcgttatattgttatcgttttgcgttttattttttacggtgcggtgcgtgaggcggtttgtttcgttatagtgttagtgggtgattagatttttattttcgttgcggataagtttgtcggttaggtcgtggtgataacgttgtgtgcggtcgttaaagtcggttttttgtattagtcggttaagtatatcgtaacggaaggtggtgtggttgtcgtttttattggttaggcggatgattcgttcggtagtatcgtattttatattgcgcgttagttcgttttgcgtggtacggacggtttttttttacgtatcgtattgtgtttcgtttttgttgtcgttcggggtaatgacggcg

SEQ ID NO: 25920 - DNA, 756 bp, Artificial Sequence
  chemically treated genomic DNA (Homo sapiens) CpG-island No: 25920
  misc_feature (708)..(708): n is either a, c, g or t
cgccgtcattaccccgaacgacaacaaaaacgaaacacaatacgatacgtaaaaaaaaaccgtccgtaccacgcaaaacgaactaacgcgcaatataaaatacgatactaccgaacgaatcatccgcctaaccaataaaaacgacaaccacaccaccttccgttacgatatacttaaccgactaatacaaaaaaccgactttaacgaccgcacacaacgttatcaccacgacctaaccgacaaacttatccgcaacgaaaataaaaatctaatcacccactaacactataacgaaacaaaccgcctcacgcaccgcaccgtaaaaaataaaacgcaaaacgataacaatataacgaacgtaactaactaacaaacatcaaccataccaataaaaaccaccgcgtatcgatccactacgactataacgataaaaaccgactaaccgataaacgtcaaacgatacatcacccgcaaacgaaaacactactctaacaccataaaaccgaacatacgtacaacgaacaaaaactaacaaaccgcgtcacgccgaacaatctacccgccgataaaataactaacctacgacaacgactatcttacgaacataaaactcgacgacacaccgctactaaaattcacgcgcgaccgcctacaccgtaaaacgatacgcactttcgacaacataacaaacaataataccgcatatanactaaccaacacatacacccccgcaaaccaattacaaaaccaacacct

SEQ ID NO: 25921 - DNA, 522 bp, Artificial Sequence
  chemically treated genomic DNA (Homo sapiens) CpG-island No: 25921
cgcggaatgtttttttagaagtcgtcgtcggttaggtgcgtaatggtatgtatatcgatttttttaattaattttagtattgattttacgtaaatgcgggtcggtgttagtagatgatcggttaatggtttattattaagttcggtggtttgcggattataatcgttgattttaagaattttgcgtattagcgaatagtcgttcgagtgtggatcgttggaatcgagtgtaattagtatatcgtcgtcgttgattttagagtcgtcgatgatttttgatttttttattacgttaacgtagaaattcgcgatatcgtaatttttatcgtgatatattttcggtatttttgtcgtttcgttatttattagtgaatagtttgattgtagataatttttcgtaatgtcgttgattatcgttgaagcggtattaatatttagtttttcggttgcgtaatagtcgaggaaaaatagcggttttgtattttgtattattaggttattaacgtatatggcgattagatta

SEQ ID NO: 25922 - DNA, 522 bp, Artificial Sequence
  chemically treated genomic DNA (Homo sapiens) CpG-island No: 25922
taatctaatcgccatatacgttaataacctaataatacaaaatacaaaaccgctatttttcctcgactattacgcaaccgaaaaactaaatattaataccgcttcaacgataatcaacgacattacgaaaaattatctacaatcaaactattcactaataaataacgaaacgacaaaaataccgaaaatatatcacgataaaaattacgatatcgcgaatttctacgttaacgtaataaaaaaatcaaaaatcatcgacgactctaaaatcaacgacgacgatatactaattacactcgattccaacgatccacactcgaacgactattcgctaatacgcaaaattcttaaaatcaacgattataatccgcaaaccaccgaacttaataataaaccattaaccgatcatctactaacaccgacccgcatttacgtaaaatcaatactaaaattaattaaaaaaatcgatatacataccattacgcacctaaccgacgacgacttctaaaaaaacattccgcg

SEQ ID NO: 25923 - DNA, 522 bp, Artificial Sequence
  chemically treated genomic DNA (Homo sapiens) CpG-island No: 25923
tgatttggtcgttatgtgcgttaatgatttggtggtgtaaggtgtagagtcgttgttttttttcgattattacgtaatcggaaaattggatgttgatatcgttttagcggtgattagcggtattgcggaaggttgtttgtaattaggttgtttattggtgggtggcgaaacggtagaaatgtcggggatgtattacggtgaggattacgatgtcgcgggtttttgcgttggcgtggtagaaaaattagaaattatcgacggttttaaagttagcgacggcgatgtgttgattgtattcggttttagcggtttatattcgaacggttattcgttggtgcgtaaaatttttgaagttagcggttgtgattcgtaaattatcgaatttgatggtaagttattagtcgattatttgttggtatcgattcgtatttacgtgaagttagtgttggagttgattgaaaaggtcgatgtgtatgttattgcgtatttgatcggcggcggtttttgggaaaatatttcgcg

SEQ ID NO: 25924 - DNA, 522 bp, Artificial Sequence
  chemically treated genomic DNA (Homo sapiens) CpG-island No: 25924
cgcgaaatattttcccaaaaaccgccgccgatcaaatacgcaataacatacacatcgaccttttcaatcaactccaacactaacttcacgtaaatacgaatcgataccaacaaataatcgactaataacttaccatcaaattcgataatttacgaatcacaaccgctaacttcaaaaattttacgcaccaacgaataaccgttcgaatataaaccgctaaaaccgaatacaatcaacacatcgccgtcgctaactttaaaaccgtcgataatttctaatttttctaccacgccaacgcaaaaacccgcgacatcgtaatcctcaccgtaatacatccccgacatttctaccgtttcgccacccaccaataaacaacctaattacaaacaaccttccgcaataccgctaatcaccgctaaaacgatatcaacatccaattttccgattacgtaataatcgaaaaaaaacaacgactctacaccttacaccaccaaatcattaacgcacataacgaccaaatca

SEQ ID NO: 25925 - DNA, 678 bp, Artificial Sequence
  chemically treated genomic DNA (Homo sapiens) CpG-island No: 25925
tgaatggttttcgtcgcgtacgtcgttttttgcgttatcgtttgcggtaatgttattttcgtagattagtcgtaaaggaattcggtaatgaacgaattttcggtatttatggtgtcgataatcgttatcggtttaggagtttgacgttagaattgcgcgttattttaggtaatgttgtcgtttttatttagcgtgataattattgtttttgcgttacgggtaataatcgtttttatttttagacgtagcgtttcgtttttttgcggtgcggaggtaaaggtaaaatcgagatgcggtattagtgtttgttagagcgggttgttttatttgtcggagaagtcgaaagcggtaagtttgttcgtagcgtgtagttgtgggaatgcgtttttcgtatgtttttagattgtcgcgtgtataatgttatattgcgttatttagatacgtattcgggatattagtacgtgaaagattcggttaatcgcgagaaattcgttaaagtttggggcgtggaaagtttgttagcgtatatcggttatcgtattagcgagttgtcgtatcgcgtagttatggcgaagtgcgtgtcgcgtatattatgggcgaagattcgttataaattgacgcggagttgtcggtagtacgtaaagtttttgaagatttggaattggttatcgtttagga

SEQ ID NO: 25926 - DNA, 678 bp, Artificial Sequence
  chemically treated genomic DNA (Homo sapiens) CpG-island No: 25926
tcctaaacgataaccaattccaaatcttcaaaaactttacgtactaccgacaactccgcgtcaatttataacgaatcttcgcccataatatacgcgacacgcacttcgccataactacgcgatacgacaactcgctaatacgataaccgatatacgctaacaaactttccacgccccaaactttaacgaatttctcgcgattaaccgaatctttcacgtactaatatcccgaatacgtatctaaataacgcaatataacattatacacgcgacaatctaaaaacatacgaaaaacgcattcccacaactacacgctacgaacaaacttaccgctttcgacttctccgacaaataaaacaacccgctctaacaaacactaataccgcatctcgattttacctttacctccgcaccgcaaaaaaacgaaacgctacgtctaaaaataaaaacgattattacccgtaacgcaaaaacaataattatcacgctaaataaaaacgacaacattacctaaaataacgcgcaattctaacgtcaaactcctaaaccgataacgattatcgacaccataaataccgaaaattcgttcattaccgaattcctttacgactaatctacgaaaataacattaccgcaaacgataacgcaaaaaacgacgtacgcgacgaaaaccattca

SEQ ID NO: 25927 - DNA, 678 bp, Artificial Sequence
  chemically treated genomic DNA (Homo sapiens) CpG-island No: 25927
ttttgaacgataattagttttagatttttaaaggttttacgtattgtcgatagtttcgcgttagtttgtagcggattttcgtttataatgtacgcggtacgtatttcgttatgattgcgcggtgcggtagttcgttgatgcgatagtcggtatgcgttggtaggttttttacgttttaggttttggcgaatttttcgcggttagtcggattttttacgtattggtatttcggatacgtatttgagtggcgtagtatgatattgtgtacgcggtaatttggggatatgcggaagacgtatttttatagttgtacgttgcgggtaaatttatcgttttcgattttttcgataagtgggatagttcgttttggtagatattggtgtcgtatttcgattttgtttttgttttcgtatcgtaagaagacgaaacgttgcgtttgaagatgaaagcgattgttgttcgtggcgtaggaatagtgattgttacgttgagtgaaaacggtagtattgtttgggatggcgcgtagttttggcgttaggtttttgaatcggtgacggttatcgatattatgggtgtcggagattcgtttattgtcggatttttttgcggttggtttgcggggatgatattatcgtaggcgatagcgtagggaacggcgtgcgcggcgaaaattattta

SEQ ID NO: 25928 - DNA, 678 bp, Artificial Sequence
  chemically treated genomic DNA (Homo sapiens) CpG-island No: 25928
taaataattttcgccgcgcacgccgttccctacgctatcgcctacgataatatcatccccgcaaaccaaccgcaaaaaaatccgacaataaacgaatctccgacacccataatatcgataaccgtcaccgattcaaaaacctaacgccaaaactacgcgccatcccaaacaatactaccgttttcactcaacgtaacaatcactattcctacgccacgaacaacaatcgctttcatcttcaaacgcaacgtttcgtcttcttacgatacgaaaacaaaaacaaaatcgaaatacgacaccaatatctaccaaaacgaactatcccacttatcgaaaaaatcgaaaacgataaatttacccgcaacgtacaactataaaaatacgtcttccgcatatccccaaattaccgcgtacacaatatcatactacgccactcaaatacgtatccgaaataccaatacgtaaaaaatccgactaaccgcgaaaaattcgccaaaacctaaaacgtaaaaaacctaccaacgcataccgactatcgcatcaacgaactaccgcaccgcgcaatcataacgaaatacgtaccgcgtacattataaacgaaaatccgctacaaactaacgcgaaactatcgacaatacgtaaaacctttaaaaatctaaaactaattatcgttcaaaa

SEQ ID NO: 25929 - DNA, 820 bp, Artificial Sequence
  chemically treated genomic DNA (Homo sapiens) CpG-island No: 25929
  misc_feature (567)..(567): n is either a, c, g or t
atattgtttagggtttagtcggggtacgtatcggtgtttttatcggcgtggtttgttcggtgtgtttcggcggggtgacgttcggttattcggttaattcgttgttcggtgtaaaggtttttttcggtgaaatcgatatcgttttgttcggttcgttgtcgtttattttttttcgtatttatagtagttatcggataaaaacgttcgcgtcggtggggagtttcggtttcggttggaaaatgtttgcggatattcgtttatagttgcgcgataatatattgatatttagtgataacggcggtagaagtttgtattttgagtatttgtttttcggtgaggacggttatagtcgtagcgagttattgtggttggtgcgcggcggcgtggcgaaattggatgaaggttatcggttggtcgtattttggtaggcgttgtcggaagaatttcgtttaagttcgtatcgttatttggcgataaatagttcgtagggtcgtggtggttgttcggttggtgtgagcgggtgtcggaagcggatgaggtgttgtttgcggcgttgtcgtcgtattnggtattgattcgggttgtggatcgttttcggcgtatatagacgtttttacgcgaaacgttcggtgaatttagcggcgaaatttacggcgtgacggaatgtttcggcgttatttcggtttgtattgaatagtaagcgtacgggtagaagaagcgggtagtaagtatttttggcgggacgaatcgttcgtttttttgatatttgtaggttaaacgaatattgtcgggataacgaatcgtttttttttttgtgcgt

SEQ ID NO: 25930 - DNA, 820 bp, Artificial Sequence
  chemically treated genomic DNA (Homo sapiens) CpG-island No: 25930
  misc_feature (254)..(254): n is either a, c, g or t
acgcacaaaaaaaaaaacgattcgttatcccgacaatattcgtttaacctacaaatatcaaaaaaacgaacgattcgtcccgccaaaaatacttactacccgcttcttctacccgtacgcttactattcaatacaaaccgaaataacgccgaaacattccgtcacgccgtaaatttcgccgctaaattcaccgaacgtttcgcgtaaaaacgtctatatacgccgaaaacgatccacaacccgaatcaataccnaatacgacgacaacgccgcaaacaacacctcatccgcttccgacacccgctcacaccaaccgaacaaccaccacgaccctacgaactatttatcgccaaataacgatacgaacttaaacgaaattcttccgacaacgcctaccaaaatacgaccaaccgataaccttcatccaatttcgccacgccgccgcgcaccaaccacaataactcgctacgactataaccgtcctcaccgaaaaacaaatactcaaaatacaaacttctaccgccgttatcactaaatatcaatatattatcgcgcaactataaacgaatatccgcaaacattttccaaccgaaaccgaaactccccaccgacgcgaacgtttttatccgataactactataaatacgaaaaaaaataaacgacaacgaaccgaacaaaacgatatcgatttcaccgaaaaaaacctttacaccgaacaacgaattaaccgaataaccgaacgtcaccccgccgaaacacaccgaacaaaccacgccgataaaaacaccgatacgtaccccgactaaaccctaaacaatat

SEQ ID NO: 25931 - DNA, 820 bp, Artificial Sequence
  chemically treated genomic DNA (Homo sapiens) CpG-island No: 25931
  misc_feature (254)..(254): n is either a, c, g or t
acgtatagggagaaagacgattcgttgtttcggtaatattcgtttaatttgtaggtattagaaaaacggacggttcgtttcgttagaaatgtttgttgttcgttttttttgttcgtgcgtttgttgtttagtataagtcgaagtgacgtcgggatatttcgttacgtcgtgaatttcgtcgttgaatttatcgggcgtttcgcgtggaaacgtttgtgtgcgtcgaaagcggtttatagttcgggttagtattnggtacggcggtagcgtcgtaggtagtattttattcgttttcggtattcgtttatattagtcgagtagttattacggttttgcggattgtttgtcgttagataacgatgcggatttaagcggagttttttcggtagcgtttgttagagtgcggttagtcggtgatttttatttagtttcgttacgtcgtcgcgtattagttatagtgattcgttgcggttgtaatcgtttttatcgggaaataggtgtttaaaatataggtttttgtcgtcgttattattgagtattagtgtgttatcgcgtagttgtaagcggatattcgtaggtattttttagtcggggtcgaggttttttatcggcgcgggcgtttttgttcggtaattgttgtaggtgcgggagagaatgaacggtagcgggtcgggtagggcgatgtcggttttatcgggaaggatttttgtatcgagtagcggattgatcggatggtcggacgttatttcgtcggggtatatcgaataggttacgtcggtgggggtatcgatgcgtatttcggttgaattttggataatgt

SEQ ID NO: 25932 - DNA, 820 bp, Artificial Sequence
  chemically treated genomic DNA (Homo sapiens) CpG-island No: 25932
  misc_feature (567)..(567): n is either a, c, g or t
acattatccaaaattcaaccgaaatacgcatcgatacccccaccgacgtaacctattcgatataccccgacgaaataacgtccgaccatccgatcaatccgctactcgatacaaaaatccttcccgataaaaccgacatcgccctacccgacccgctaccgttcattctctcccgcacctacaacaattaccgaacaaaaacgcccgcgccgataaaaaacctcgaccccgactaaaaaatacctacgaatatccgcttacaactacgcgataacacactaatactcaataataacgacgacaaaaacctatattttaaacacctatttcccgataaaaacgattacaaccgcaacgaatcactataactaatacgcgacgacgtaacgaaactaaataaaaatcaccgactaaccgcactctaacaaacgctaccgaaaaaactccgcttaaatccgcatcgttatctaacgacaaacaatccgcaaaaccgtaataactactcgactaatataaacgaataccgaaaacgaataaaatactacctacgacgctaccgccgtaccnaatactaacccgaactataaaccgctttcgacgcacacaaacgtttccacgcgaaacgcccgataaattcaacgacgaaattcacgacgtaacgaaatatcccgacgtcacttcgacttatactaaacaacaaacgcacgaacaaaaaaaacgaacaacaaacatttctaacgaaacgaaccgtccgtttttctaatacctacaaattaaacgaatattaccgaaacaacgaatcgtctttctccctatacgt

SEQ ID NO: 25933 - DNA, 860 bp, Artificial Sequence
  chemically treated genomic DNA (Homo sapiens) CpG-island No: 25933
  misc_feature (722)..(722): n is either a, c, g or t
cggttgtcgttggagaacgatattattaaagatgggcggattgttgatgcgtatagttggttaaaacgttgttatcgtggagtcgcgaattgtcgtagcgttattatattatgttggcgtttttcgttagtcgtatattatagcggttattttcgcgttcgtcgatgttttttggtgagcgggagtaaacggtttggttgttagggacgatggttcgcgagttggatatggattcggattttttgcgtttcgattatagcgaagatttatttagtttcgtttataacgtgattgtcgcgtaaagtaaagagttggtaacgttgtttattttggtagaaaggttgcgtgtttatgtgagcgcgattatttcggatgttagtgtattatagcgatttttgttttttttatttttttattagtaatgtttggtttggcgtgataacgaatagtggttgtgggcgacgcgttatagttgggggcgtaaattggcggtggggatgattagcgcgaaggagttggcggtagcgttattcgttgatttcgaaagcgtcgcgatatgtggcgaaggcggatttgattttggtgagcgtttttgttcgttagtagcgttattgtcgttagtggagattttgtatcgcgttgggttttgcgtttggaagcgattgatgatttgtaattaatttgattcgtggcgatataacgtcggatcgtttttttgcgtntttggttgtttgatgtcgttgcgtttttgcgcgtagaattttagcgcgagtacgtacgtttttggtgtttgatcgagttttggtgagttgtttaacgtgcgttattttttgcgagttggcgtttatttgagtcgtcgt

SEQ ID NO: 25934 - DNA, 860 bp, Artificial Sequence
  chemically treated genomic DNA (Homo sapiens) CpG-island No: 25934
  misc_feature (139)..(139): n is either a, c, g or t
acgacgactcaaataaacgccaactcgcaaaaaataacgcacgttaaacaactcaccaaaactcgatcaaacaccaaaaacgtacgtactcgcgctaaaattctacgcgcaaaaacgcaacgacatcaaacaaccaaanacgcaaaaaaacgatccgacgttatatcgccacgaatcaaattaattacaaatcatcaatcgcttccaaacgcaaaacccaacgcgatacaaaatctccactaacgacaataacgctactaacgaacaaaaacgctcaccaaaatcaaatccgccttcgccacatatcgcgacgctttcgaaatcaacgaataacgctaccgccaactccttcgcgctaatcatccccaccgccaatttacgcccccaactataacgcgtcgcccacaaccactattcgttatcacgccaaaccaaacattactaataaaaaaataaaaaaaacaaaaatcgctataatacactaacatccgaaataatcgcgctcacataaacacgcaacctttctaccaaaataaacaacgttaccaactctttactttacgcgacaatcacgttataaacgaaactaaataaatcttcgctataatcgaaacgcaaaaaatccgaatccatatccaactcgcgaaccatcgtccctaacaaccaaaccgtttactcccgctcaccaaaaaacatcgacgaacgcgaaaataaccgctataatatacgactaacgaaaaacgccaacataatataataacgctacgacaattcgcgactccacgataacaacgttttaaccaactatacgcatcaacaatccgcccatctttaataatatcgttctccaacgacaaccg

SEQ ID NO: 25935 - DNA, 860 bp, Artificial Sequence
  chemically treated genomic DNA (Homo sapiens) CpG-island No: 25935
  misc_feature (139)..(139): n is either a, c, g or t
acgacgatttagataagcgttaattcgtaaaaaatagcgtacgttaaataatttattaaggttcgattaagtattagagacgtacgtattcgcgttgaggttttgcgcgtagaggcgtaacgatattaagtaattaganacgtagaaaagcggttcggcgttgtgtcgttacggattaaattaattgtaggttattagtcgtttttaagcgtaaagtttagcgcgatgtaaagtttttattggcgatagtagcgttgttgacgaatagaaacgtttattaggattaaattcgttttcgttatatatcgcgacgttttcgggattaacggataacgttgtcgttagttttttcgcgttagttatttttatcgttagtttgcgtttttagttatagcgcgtcgtttatagttattgttcgttattacgttaggttagatattgttgatgagaaggtaaaaaaggtaggaatcgttgtaatgtattggtattcggggtgatcgcgtttatatgaatacgtaatttttttgttagagtaagtagcgttgttagttttttgttttgcgcggtagttacgttataggcgggattgagtgagttttcgttgtaatcgaagcgtagggagttcggatttatatttagttcgcgggttatcgtttttgatagttaggtcgtttgttttcgtttattaagggatatcgacgggcgcggaaatgatcgttgtaatgtgcgattggcgggaaacgttaatataatgtgatgacgttgcggtagttcgcgattttacggtaataacgttttagttagttgtgcgtattaataattcgtttatttttgataatgtcgttttttagcggtaatcg

SEQ ID NO: 25936 - DNA, 860 bp, Artificial Sequence
  chemically treated genomic DNA (Homo sapiens) CpG-island No: 25936
  misc_feature (722)..(722): n is either a, c, g or t
cgattaccgctaaaaaacgacattatcaaaaataaacgaattattaatacgcacaactaactaaaacgttattaccgtaaaatcgcgaactaccgcaacgtcatcacattatattaacgtttcccgccaatcgcacattacaacgatcatttccgcgcccgtcgatatcccttaataaacgaaaacaaacgacctaactatcaaaaacgataacccgcgaactaaatataaatccgaactccctacgcttcgattacaacgaaaactcactcaatcccgcctataacgtaactaccgcgcaaaacaaaaaactaacaacgctacttactctaacaaaaaaattacgtattcatataaacgcgatcaccccgaataccaatacattacaacgattcctaccttttttaccttctcatcaacaatatctaacctaacgtaataacgaacaataactataaacgacgcgctataactaaaaacgcaaactaacgataaaaataactaacgcgaaaaaactaacgacaacgttatccgttaatcccgaaaacgtcgcgatatataacgaaaacgaatttaatcctaataaacgtttctattcgtcaacaacgctactatcgccaataaaaactttacatcgcgctaaactttacgcttaaaaacgactaataacctacaattaatttaatccgtaacgacacaacgccgaaccgcttttctacgtntctaattacttaatatcgttacgcctctacgcgcaaaacctcaacgcgaatacgtacgtctctaatacttaatcgaaccttaataaattatttaacgtacgctattttttacgaattaacgcttatctaaatcgtcgt

SEQ ID NO: 25937 - DNA, 620 bp, Artificial Sequence
  chemically treated genomic DNA (Homo sapiens) CpG-island No: 25937
tattgcgcgtgggtgattatatcgtagcgattggtaattcgtttggtttgggcgagacggtaattttcgggattgtttttgcgttggggcgtacggtttgaatgtcgaaaattacgaaaattttatttagatcgatgtagcgattaatcgtggtaatttcggtggtgcgttggttaatttgaacggcgaattgatcggtattaatatcgcgattttcgtatcggacggcggtaatatcggtatcggttttgttatttcgagtaatatggtgaaaaatttgatttcgtagatggtggaatacggttaggtgaaacgcggtgagttgggtattatggggattgagttgaatttcgaattggcgaaagcgatgaaagttgacgtttagcgcggtgttttcgtaagttaggttttgtttaattttttcgttgtaaaagcgggtattaaagcgggtgatgtgattattttattgaacggtaagtcgattagtagttttgtcgtattgcgtgtttagtgtgggtattatgtcggtagtaggtaaattgattttgggtttattgcgcgacggtaagtaggttaacgtgaatttggaattgtagtagagtagttagaattaggttgat

SEQ ID NO: 25938 - DNA, 620 bp, Artificial Sequence
  chemically treated genomic DNA (Homo sapiens) CpG-island No: 25938
atcaacctaattctaactactctactacaattccaaattcacgttaacctacttaccgtcgcgcaataaacccaaaatcaatttacctactaccgacataatacccacactaaacacgcaatacgacaaaactactaatcgacttaccgttcaataaaataatcacatcacccgctttaatacccgcttttacaacgaaaaaattaaacaaaacctaacttacgaaaacaccgcgctaaacgtcaactttcatcgctttcgccaattcgaaattcaactcaatccccataatacccaactcaccgcgtttcacctaaccgtattccaccatctacgaaatcaaatttttcaccatattactcgaaataacaaaaccgataccgatattaccgccgtccgatacgaaaatcgcgatattaataccgatcaattcgccgttcaaattaaccaacgcaccaccgaaattaccacgattaatcgctacatcgatctaaataaaattttcgtaattttcgacattcaaaccgtacgccccaacgcaaaaacaatcccgaaaattaccgtctcgcccaaaccaaacgaattaccaatcgctacgatataatcacccacgcgcaata

SEQ ID NO: 25939 - DNA, 620 bp, Artificial Sequence
  chemically treated genomic DNA (Homo sapiens) CpG-island No: 25939
attaatttgattttggttgttttgttgtagttttaggtttacgttaatttgtttatcgtcgcgtagtaagtttagggttagtttgtttgttatcggtatagtatttatattgagtacgtagtgcggtaaagttgttgatcggtttatcgtttagtgaggtgattatattattcgttttaatgttcgtttttgtagcggaggaattaggtagaatttggtttacgaaagtatcgcgttgggcgttaatttttatcgttttcgttagttcggagtttagtttagtttttataatatttagtttatcgcgttttatttggtcgtattttattatttgcgaggttaggttttttattatgttattcgggatagtaaaatcgatatcgatgttgtcgtcgttcggtgcgaggatcgcggtgttgatatcgattagttcgtcgtttaggttaattagcgtattatcggagttattacggttgatcgttgtatcggtttggatgaagttttcgtagttttcggtatttaggtcgtacgttttagcgtagagataatttcggaagttatcgtttcgtttagattaaacgggttattaatcgttacggtgtaattatttacgcgtagtg

SEQ ID NO: 25940 - DNA, 620 bp, Artificial Sequence
  chemically treated genomic DNA (Homo sapiens) CpG-island No: 25940
cactacgcgtaaataattacaccgtaacgattaataacccgtttaatctaaacgaaacgataacttccgaaattatctctacgctaaaacgtacgacctaaataccgaaaactacgaaaacttcatccaaaccgatacaacgatcaaccgtaataactccgataatacgctaattaacctaaacgacgaactaatcgatatcaacaccgcgatcctcgcaccgaacgacgacaacatcgatatcgattttactatcccgaataacataataaaaaacctaacctcgcaaataataaaatacgaccaaataaaacgcgataaactaaatattataaaaactaaactaaactccgaactaacgaaaacgataaaaattaacgcccaacgcgatactttcgtaaaccaaattctacctaattcctccgctacaaaaacgaacattaaaacgaataatataatcacctcactaaacgataaaccgatcaacaactttaccgcactacgtactcaatataaatactataccgataacaaacaaactaaccctaaacttactacgcgacgataaacaaattaacgtaaacctaaaactacaacaaaacaaccaaaatcaaattaat

SEQ ID NO: 25941 - DNA, 546 bp, Artificial Sequence
  chemically treated genomic DNA (Homo sapiens) CpG-island No: 25941
tgttcgtcgcgcggcgattatttcgtcgttggttggtagggtagaatgtatcgatgttttttcgcgacgcgttggtgaggatttggtaggaagtaggcgtggcgcgggaagatgttttattttgtttacgtttgggcgcgtttgaaattcgacgttattagtcgtaattgtggtggattaaattcgttatcgggtaaagcgaaaatattgtgtcgtggtagacgtggttttaatcgttggaattatcggcggggttgggaagtgtatagtttaatgcgggaggcgatattcgtttttcgcgtgtagacgaagcggttagcgtgcgttttaaagcgttaggattgttgtatattgtcgggcgtaacggcggacgtaagttaaagaaaatttggtaagagttgggcgtgtcgtcgtggttacgtgatattacgttattgttgttttatggcgaaacgttgattgcggcggtaggggtatttgtgacgtaagaaggtgtggttgaaggtgagaatggcgtaagttttgtttggtagaaaacgtttagtt

SEQ ID NO: 25942 - DNA, 546 bp, Artificial Sequence
  chemically treated genomic DNA (Homo sapiens) CpG-island No: 25942
aactaaacgttttctaccaaacaaaacttacgccattctcaccttcaaccacaccttcttacgtcacaaatacccctaccgccgcaatcaacgtttcgccataaaacaacaataacgtaatatcacgtaaccacgacgacacgcccaactcttaccaaattttctttaacttacgtccgccgttacgcccgacaatatacaacaatcctaacgctttaaaacgcacgctaaccgcttcgtctacacgcgaaaaacgaatatcgcctcccgcattaaactatacacttcccaaccccgccgataattccaacgattaaaaccacgtctaccacgacacaatattttcgctttacccgataacgaatttaatccaccacaattacgactaataacgtcgaatttcaaacgcgcccaaacgtaaacaaaataaaacatcttcccgcgccacgcctacttcctaccaaatcctcaccaacgcgtcgcgaaaaaacatcgatacattctaccctaccaaccaacgacgaaataatcgccgcgcgacgaaca

SEQ ID NO: 25943 - DNA, 546 bp, Artificial Sequence
  chemically treated genomic DNA (Homo sapiens) CpG-island No: 25943
aattaagcgttttttgttagataaaatttacgttatttttatttttagttatatttttttgcgttataaatatttttgtcgtcgtaattagcgtttcgttataaaatagtagtggcgtggtgttacgtagttacggcggtacgtttagtttttgttagattttttttagtttacgttcgtcgttacgttcgataatatgtagtaattttggcgttttgaaacgtacgttgatcgtttcgtttgtacgcggagggcgaatatcgtttttcgtattaagttgtatattttttagtttcgtcggtaattttagcggttgaagttacgtttgttacggtataatgttttcgttttgttcggtgacggatttaatttattatagttgcgattgatagcgtcggattttaaacgcgtttaaacgtaaatagggtgaggtattttttcgcgttacgtttattttttgttagatttttattaacgcgtcgcgggaaggtatcggtgtattttgttttgttagttagcggcgggataatcgtcgcgcggcgggta

SEQ ID NO: 25944 - DNA, 546 bp, Artificial Sequence
  chemically treated genomic DNA (Homo sapiens) CpG-island No: 25944
tacccgccgcgcgacgattatcccgccgctaactaacaaaacaaaatacaccgataccttcccgcgacgcgttaataaaaatctaacaaaaaataaacgtaacgcgaaaaaatacctcaccctatttacgtttaaacgcgtttaaaatccgacgctatcaatcgcaactataataaattaaatccgtcaccgaacaaaacgaaaacattataccgtaacaaacgtaacttcaaccgctaaaattaccgacgaaactaaaaaatatacaacttaatacgaaaaacgatattcgccctccgcgtacaaacgaaacgatcaacgtacgtttcaaaacgccaaaattactacatattatcgaacgtaacgacgaacgtaaactaaaaaaaatctaacaaaaactaaacgtaccgccgtaactacgtaacaccacgccactactattttataacgaaacgctaattacgacgacaaaaatatttataacgcaaaaaaatataactaaaaataaaaataacgtaaattttatctaacaaaaaacgcttaatt

SEQ ID NO: 25945 - DNA, 743 bp, Artificial Sequence
  chemically treated genomic DNA (Homo sapiens) CpG-island No: 25945
agcgaaggcgtagagatttatttttttgcggatagtcgtttgacgttttttgttcgggagttgttggaaagtcgttatttgcgtattaagtttattgacgagtagggtcgtttgtttgttgacgatgaatagtagtagtcgtagttcgtttatgggttgattagtagcgatgaatattcgtaggcgtgttgcgaattgtgtcgttagtcggtggtaaaaaagtcggatacgttgatttatttgtcggcggaaaaaatggtcgttaaaagcgattcgcgtttgggttttcgcgcggttttcgatagtattattgcgttggtagtgtggttgtaaattgaattggcggaatcgtggtagtcgtggttggcggatattcgttcgcgttttggtaatattatgtcgtcgatgcgttgggggaatcgttgggttgttaggcgattgtcgggttttttgacgaagatttgtatcggtttttttattatgattgcgttatttcgattacgattatttggtgtcggaagttagttacgggcgcgatgttgcgttgtttagatttcgtattattaaagtgcgggaaatcgaaatcgtagcggcgtaggtttttattattcgtagcgtagaagttttcgcgtattaggatagttttcggcggtgtggtgagagaagtaagacgagaggtgtacgcggttataagcgatgcgcggttttttatagaaaacggtaatattaaagttggtcgtatt

SEQ ID NO: 25946 - DNA, 743 bp, Artificial Sequence
  chemically treated genomic DNA (Homo sapiens) CpG-island No: 25946
aatacgaccaactttaatattaccgttttctataaaaaaccgcgcatcgcttataaccgcgtacacctctcgtcttacttctctcaccacaccgccgaaaactatcctaatacgcgaaaacttctacgctacgaataataaaaacctacgccgctacgatttcgatttcccgcactttaataatacgaaatctaaacaacgcaacatcgcgcccgtaactaacttccgacaccaaataatcgtaatcgaaataacgcaatcataataaaaaaaccgatacaaatcttcgtcaaaaaacccgacaatcgcctaacaacccaacgattcccccaacgcatcgacgacataatattaccaaaacgcgaacgaatatccgccaaccacgactaccacgattccgccaattcaatttacaaccacactaccaacgcaataatactatcgaaaaccgcgcgaaaacccaaacgcgaatcgcttttaacgaccattttttccgccgacaaataaatcaacgtatccgacttttttaccaccgactaacgacacaattcgcaacacgcctacgaatattcatcgctactaatcaacccataaacgaactacgactactactattcatcgtcaacaaacaaacgaccctactcgtcaataaacttaatacgcaaataacgactttccaacaactcccgaacaaaaaacgtcaaacgactatccgcaaaaaaataaatctctacgccttcgct

SEQ ID NO: 25947 - DNA, 743 bp, Artificial Sequence
  chemically treated genomic DNA (Homo sapiens) CpG-island No: 25947
gatgcggttaattttgatattatcgttttttgtgaagaatcgcgtatcgtttatgatcgcgtatatttttcgttttattttttttattatatcgtcgaagattgttttggtgcgcgaaggtttttacgttgcgggtgataaagatttgcgtcgttacggtttcggtttttcgtattttggtggtacgagatttgagtaacgtagtatcgcgttcgtggttggttttcggtattagatgatcgtggtcgagatagcgtagttatgatgagaaagtcgatgtagattttcgttagaaagttcgataatcgtttggtagtttagcggtttttttagcgtatcggcggtataatgttgttaagacgcgaacggatattcgttagttacggttgttacggtttcgttagtttaatttgtagttatattgttagcgtaatggtgttgtcgagaatcgcgcgaaaatttagacgcggatcgtttttggcgattatttttttcgtcgataggtgagttagcgtattcggtttttttgttatcggttggcgatatagttcgtagtacgtttgcggatgtttatcgttattggttagtttatgaacgggttgcggttgttgttgtttatcgttaataaataggcggttttgttcgttaataaatttgatgcgtagatggcggttttttagtaattttcgggtagagggcgttaggcgattgttcgtagggagatggatttttgcgttttcgtt

SEQ ID NO: 25948 - DNA, 743 bp, Artificial Sequence
  chemically treated genomic DNA (Homo sapiens) CpG-island No: 25948
aacgaaaacgcaaaaatccatctccctacgaacaatcgcctaacgccctctacccgaaaattactaaaaaaccgccatctacgcatcaaatttattaacgaacaaaaccgcctatttattaacgataaacaacaacaaccgcaacccgttcataaactaaccaataacgataaacatccgcaaacgtactacgaactatatcgccaaccgataacaaaaaaaccgaatacgctaactcacctatcgacgaaaaaaataatcgccaaaaacgatccgcgtctaaattttcgcgcgattctcgacaacaccattacgctaacaatataactacaaattaaactaacgaaaccgtaacaaccgtaactaacgaatatccgttcgcgtcttaacaacattataccgccgatacgctaaaaaaaccgctaaactaccaaacgattatcgaactttctaacgaaaatctacatcgactttctcatcataactacgctatctcgaccacgatcatctaataccgaaaaccaaccacgaacgcgatactacgttactcaaatctcgtaccaccaaaatacgaaaaaccgaaaccgtaacgacgcaaatctttatcacccgcaacgtaaaaaccttcgcgcaccaaaacaatcttcgacgatataataaaaaaaataaaacgaaaaatatacgcgatcataaacgatacgcgattcttcacaaaaaacgataatatcaaaattaaccgcatc

SEQ ID NO: 25949 - DNA, 581 bp, Artificial Sequence
  chemically treated genomic DNA (Homo sapiens) CpG-island No: 25949
ggcgtattacgttgttgtgaatttagtgggcgttgttgtattttttttttaaatatttggcgttgttttggtgatgcggattgaatattttacgcgttgcgattttttcgttgttggttttgcgggttagtttgtattttttcgcgaatcgtttggcgttgtttaggcgaggcggattgaaatttttacgcgttgttttttttcgttgttggattttcgggttagtttgtattttttcgcgaattgtttggcgttgtttaggcgaggcggattgataacgttgacgagcggcgtttttttgttgttgggttagtggttggcgacggttgaagtcgtggaagtcgttatagtttttatagtgtttagttttattaaatcgttgtgtcgttgtttgacgttgggtatttcgtgtaatgattggtgcggcgtgtgttcgttgttgaaattgatttgttgtcgtttgacgttggttgtcgcgcgttggggtaggtaattgcgtggcgtttatttcgtcgttgatatcggtttgatgaaatcgttttgttatattttgattatgatagggtatattattacggtag

SEQ ID NO: 25950 - DNA, 581 bp, Artificial Sequence
  chemically treated genomic DNA (Homo sapiens) CpG-island No: 25950
ctaccgtaataatataccctatcataatcaaaatataacaaaacgatttcatcaaaccgatatcaacgacgaaataaacgccacgcaattacctaccccaacgcgcgacaaccaacgtcaaacgacaacaaatcaatttcaacaacgaacacacgccgcaccaatcattacacgaaatacccaacgtcaaacaacgacacaacgatttaataaaactaaacactataaaaactataacgacttccacgacttcaaccgtcgccaaccactaacccaacaacaaaaaaacgccgctcgtcaacgttatcaatccgcctcgcctaaacaacgccaaacaattcgcgaaaaaatacaaactaacccgaaaatccaacaacgaaaaaaaacaacgcgtaaaaatttcaatccgcctcgcctaaacaacgccaaacgattcgcgaaaaaatacaaactaacccgcaaaaccaacaacgaaaaaatcgcaacgcgtaaaatattcaatccgcatcaccaaaacaacgccaaatatttaaaaaaaaaatacaacaacgcccactaaattcacaacaacgtaatacgcc

SEQ ID NO: 25951 - DNA, 581 bp, Artificial Sequence
  chemically treated genomic DNA (Homo sapiens) CpG-island No: 25951
ttatcgtaatggtgtgttttattatgattaggatatggtaaagcggttttattaaatcgatgttaacggcggaatgagcgttacgtaattatttgttttaacgcgcgatagttagcgttaggcggtagtaaattagttttagtaacgaatatacgtcgtattagttattatacgagatatttaacgttaggtagcggtatagcggtttaatgaagttgaatattatgggagttatgacgatttttacgattttagtcgtcgttaattattgatttagtaataaaaggacgtcgttcgttagcgttattagttcgtttcgtttgagtagcgttaggtagttcgcgagagaatgtagattaattcgaagatttagtagcgaagagaggtagcgcgtgaggattttagttcgtttcgtttgagtagcgttaggcggttcgcgagaaaatgtagattaattcgtagaattagtagcgaagagatcgtagcgcgtgaggtatttagttcgtattattagagtagcgttaggtgtttaaggaaaaagtatagtagcgtttattgaatttatagtaacgtgatacgtt

SEQ ID NO: 25952 - DNA, 581 bp, Artificial Sequence
  chemically treated genomic DNA (Homo sapiens) CpG-island No: 25952
aacgtatcacgttactataaattcaataaacgctactatactttttccttaaacacctaacgctactctaataatacgaactaaatacctcacgcgctacgatctcttcgctactaattctacgaattaatctacattttctcgcgaaccgcctaacgctactcaaacgaaacgaactaaaatcctcacgcgctacctctcttcgctactaaatcttcgaattaatctacattctctcgcgaactacctaacgctactcaaacgaaacgaactaataacgctaacgaacgacgtccttttattactaaatcaataattaacgacgactaaaatcgtaaaaatcgtcataactcccataatattcaacttcattaaaccgctataccgctacctaacgttaaatatctcgtataataactaatacgacgtatattcgttactaaaactaatttactaccgcctaacgctaactatcgcgcgttaaaacaaataattacgtaacgctcattccgccgttaacatcgatttaataaaaccgctttaccatatcctaatcataataaaacacaccattacgataa

SEQ ID NO: 25953 - DNA, 723 bp, Artificial Sequence
  chemically treated genomic DNA (Homo sapiens) CpG-island No: 25953
  misc_feature (721)..(721): n is either a, c, g or t
tgatcgttttgtagaatatgttagattttggtgtaggttagacgcgcgtgagagtttattatcgtttcgtagaatttgtagttcgttagcggtttttcgacgaaatcgttatttcgtatattatatataggcggtttatttgcgggttgagcgaatataggtcgttagagagtattttcggtagtatcgggataatttgcgaagggaagtatatcgacgtgttacggttacgcgtttttttgtttagcggcgttgacggacgtatatagtagttgacgtcggtaatcgcgatttataaacgttagtcgtcgtcgcgttttttttcgtagtaaattgtatcgttaaagttacgggcgttttcgttattaatggtgattagcggtaaatcgcgtagattaatacggttcgtttttgtttttttcggtatttttttttttagttcggtaatttgttgtttaatagtttgcggttagatgtacggaattttatgggtacgtagagcgatattaatcgttatgtcggtgtttatattgtcgtttagtatttcgacgattttatttatcgttttggtgcggcgagtcggacgttgagttagttcgattacgattataaagtttattcgcgcgtttatgatttgatcgggcgggattaaaatatcgaaatttagacggttgtcgttaggaaatataaaattcgaggtcgtttcgggtaaagtagtagnta

SEQ ID NO: 25954 - DNA, 723 bp, Artificial Sequence
  chemically treated genomic DNA (Homo sapiens) CpG-island No: 25954
  misc_feature (3)..(3): n is either a, c, g or t
tanctactactttacccgaaacgacctcgaattttatatttcctaacgacaaccgtctaaatttcgatattttaatcccgcccgatcaaatcataaacgcgcgaataaactttataatcgtaatcgaactaactcaacgtccgactcgccgcaccaaaacgataaataaaatcgtcgaaatactaaacgacaatataaacaccgacataacgattaatatcgctctacgtacccataaaattccgtacatctaaccgcaaactattaaacaacaaattaccgaactaaaaaaaaaaataccgaaaaaaacaaaaacgaaccgtattaatctacgcgatttaccgctaatcaccattaataacgaaaacgcccgtaactttaacgatacaatttactacgaaaaaaaacgcgacgacgactaacgtttataaatcgcgattaccgacgtcaactactatatacgtccgtcaacgccgctaaacaaaaaaacgcgtaaccgtaacacgtcgatatacttcccttcgcaaattatcccgatactaccgaaaatactctctaacgacctatattcgctcaacccgcaaataaaccgcctatatataatatacgaaataacgatttcgtcgaaaaaccgctaacgaactacaaattctacgaaacgataataaactctcacgcgcgtctaacctacaccaaaatctaacatattctacaaaacgatca

SEQ ID NO: 25955 - DNA, 723 bp, Artificial Sequence
  chemically treated genomic DNA (Homo sapiens) CpG-island No: 25955
  misc_feature (3)..(3): n is either a, c, g or t
tgnttgttattttattcgaagcggtttcgggttttgtgttttttgacgatagtcgtttgagtttcgatattttaatttcgttcgattagattatgagcgcgcggatgggttttgtggtcgtagtcgaattgatttagcgttcgattcgtcgtattaaagcggtgggtaaaatcgtcgaagtgttgggcgataatatgggtatcggtatggcggttgatatcgttttgcgtatttatgaaatttcgtatatttggtcgtaggttgttgagtaataggttgtcgggttgaaagaagaagtgtcggaagaagtaaaagcgggtcgtgttgatttgcgcgatttatcgttggttattattgatggcgaagacgttcgtgattttgacgatgtagtttattgcgagaaaaaacgcggcggcggttggcgtttatgggtcgcgattgtcgacgttagttattatgtgcgttcgttaacgtcgttggatagagaagcgcgtaatcgtggtacgtcggtgtattttttttcgtaggttatttcgatgttgtcggaagtgttttttaacggtttgtgttcgtttaattcgtaggtagatcgtttgtgtatggtgtgcgagatgacggtttcgtcgaaaggtcgttgacgggttataaattttacgaagcggtgatgagtttttacgcgcgtttgatttatattaaagtttggtatattttgtagggcgatta

SEQ ID NO: 25956 - DNA, 723 bp, Artificial Sequence
  chemically treated genomic DNA (Homo sapiens) CpG-island No: 25956
  misc_feature (721)..(721): n is either a, c, g or t
taatcgccctacaaaatataccaaactttaatataaatcaaacgcgcgtaaaaactcatcaccgcttcgtaaaatttataacccgtcaacgacctttcgacgaaaccgtcatctcgcacaccatacacaaacgatctacctacgaattaaacgaacacaaaccgttaaaaaacacttccgacaacatcgaaataacctacgaaaaaaaatacaccgacgtaccacgattacgcgcttctctatccaacgacgttaacgaacgcacataataactaacgtcgacaatcgcgacccataaacgccaaccgccgccgcgttttttctcgcaataaactacatcgtcaaaatcacgaacgtcttcgccatcaataataaccaacgataaatcgcgcaaatcaacacgacccgcttttacttcttccgacacttcttctttcaacccgacaacctattactcaacaacctacgaccaaatatacgaaatttcataaatacgcaaaacgatatcaaccgccataccgatacccatattatcgcccaacacttcgacgattttacccaccgctttaatacgacgaatcgaacgctaaatcaattcgactacgaccacaaaacccatccgcgcgctcataatctaatcgaacgaaattaaaatatcgaaactcaaacgactatcgtcaaaaaacacaaaacccgaaaccgcttcgaataaaataacaanca

SEQ ID NO: 25957 - DNA, 630 bp, Artificial Sequence
  chemically treated genomic DNA (Homo sapiens) CpG-island No: 25957
tcgatacggcgttggtggtgttattcgcgttttggttaattatttttagtacgtcgttttcgttaattacgttggcggtaagttgaatgtcgtcggttttttagtcgtacggatcggtatttcgcgttcgttaaacggtatttgataatcggggatcgttatcgtttttaagatggcgcggcggattatgcgtttggtttgttcgtcgaggtaggtaaagttgtagtcgtttagattagttatggttttgtttttgttgtagacgtttgagtagttttagttcggtttggaaatcgacgtagtgggggagtttgaggtgtgagataaagtttgcggtttcgacgttgtcggtatgtgttagtacgaattttttattttgcgtcgggtttgtcgcgtgttcgtcgtatttcggggtttgtagagcgcggtcgattagcgttatcgttatcgttttgcgttcgtttatgtcgaatattagttcgtagtcgcgcgtgaagtgcggcggtttattcggcgggtcgataaaatcgttaattattttatatttagttattagtagttcgtcgacgtttatcgtaaattatagttttttcggtataatcgatacgttagtttgaataaatacggaga

SEQ ID NO: 25958 - DNA, 630 bp, Artificial Sequence
  chemically treated genomic DNA (Homo sapiens) CpG-island No: 25958
tctccgtatttattcaaactaacgtatcgattataccgaaaaaactataatttacgataaacgtcgacgaactactaataactaaatataaaataattaacgattttatcgacccgccgaataaaccgccgcacttcacgcgcgactacgaactaatattcgacataaacgaacgcaaaacgataacgataacgctaatcgaccgcgctctacaaaccccgaaatacgacgaacacgcgacaaacccgacgcaaaataaaaaattcgtactaacacataccgacaacgtcgaaaccgcaaactttatctcacacctcaaactcccccactacgtcgatttccaaaccgaactaaaactactcaaacgtctacaacaaaaacaaaaccataactaatctaaacgactacaactttacctacctcgacgaacaaaccaaacgcataatccgccgcgccatcttaaaaacgataacgatccccgattatcaaataccgtttaacgaacgcgaaataccgatccgtacgactaaaaaaccgacgacattcaacttaccgccaacgtaattaacgaaaacgacgtactaaaaataattaaccaaaacgcgaataacaccaccaacgccgtatcga

SEQ ID NO: 25959 - DNA, 630 bp, Artificial Sequence
  chemically treated genomic DNA (Homo sapiens) CpG-island No: 25959
ttttcgtatttatttaggttggcgtgtcgattgtgtcggaagagttgtgatttgcggtgaacgtcggcgaattgttgatgattgagtgtgaaatggttaacggttttatcgattcgtcgggtgagtcgtcgtattttacgcgcggttacgggttggtgttcggtatgagcgagcgtaaagcgatggcgatggcgttggtcgatcgcgttttgtaagtttcggagtacggcgagtacgcgataggttcggcgtaggatgaagagttcgtgttggtatatgtcgataacgtcgaagtcgtaggttttgttttatattttaaatttttttattacgtcgatttttaggtcgaattggagttatttaaacgtttgtaataggagtagaattatggttaatttgagcggttataattttgtttatttcgacgagtagattaaacgtatgattcgtcgcgttattttaaaagcggtggcgattttcggttattaggtgtcgtttggcgggcgcgagatgtcgattcgtacggttggggaatcggcggtatttagtttatcgttagcgtgattggcgaaagcgacgtgttgaaggtgattgattagggcgcggatgatattattaacgtcgtgtcga

SEQ ID NO: 25960 - DNA, 630 bp, Artificial Sequence
  chemically treated genomic DNA (Homo sapiens) CpG-island No: 25960
tcgacacgacgttaataatatcatccgcgccctaatcaatcaccttcaacacgtcgctttcgccaatcacgctaacgataaactaaataccgccgattccccaaccgtacgaatcgacatctcgcgcccgccaaacgacacctaataaccgaaaatcgccaccgcttttaaaataacgcgacgaatcatacgtttaatctactcgtcgaaataaacaaaattataaccgctcaaattaaccataattctactcctattacaaacgtttaaataactccaattcgacctaaaaatcgacgtaataaaaaaatttaaaatataaaacaaaacctacgacttcgacgttatcgacatataccaacacgaactcttcatcctacgccgaacctatcgcgtactcgccgtactccgaaacttacaaaacgcgatcgaccaacgccatcgccatcgctttacgctcgctcataccgaacaccaacccgtaaccgcgcgtaaaatacgacgactcacccgacgaatcgataaaaccgttaaccatttcacactcaatcatcaacaattcgccgacgttcaccgcaaatcacaactcttccgacacaatcgacacgccaacctaaataaatacgaaaa

SEQ ID NO: 25961 - DNA, 618 bp, Artificial Sequence
  chemically treated genomic DNA (Homo sapiens) CpG-island No: 25961
tgttggcgttgtcgttgtcgtagtaacgtttggttggacgtgaaggttcggttcgtgtgttggtagtgggtggtttttagggcgtacgtatttttaattagataatgtcgtaggttgttgcgaaattgggtgatttagttattatttggtattagagcggtaaaggttcgtaataattcgttgaataggcgtatgtcgaagcggggtaatcgtagtataaagtgacggaatttattgatgatatggcggcggcgtatgcgtgggcggatgtcgtcgtttgtcgtttcggtgcgttaacggtgagtgaaatcgtcgcggtaggattatcggcgttgtttgtgtcgttttaatataaagatcgttagtaatattggaatgcgttatcgttggaaaaagcgggcgtagttaaaattatcgagtagttatagtttagcgtggatgttgtcgttaatattttggtcgggtggtcgcgagaaattttattaattatggtagaacgcgttcgcgttgtatttatttcggatgttatcgagcgagtggtaaatgaagtgagtcgggttgttcgggcgtaattgtagcgatgttttttgtatcgtatgaatttaagaagttaatggt

SEQ ID NO: 25962 - DNA, 618 bp, Artificial Sequence
  chemically treated genomic DNA (Homo sapiens) CpG-island No: 25962
accattaacttcttaaattcatacgatacaaaaaacatcgctacaattacgcccgaacaacccgactcacttcatttaccactcgctcgataacatccgaaataaatacaacgcgaacgcgttctaccataattaataaaatttctcgcgaccacccgaccaaaatattaacgacaacatccacgctaaactataactactcgataattttaactacgcccgctttttccaacgataacgcattccaatattactaacgatctttatattaaaacgacacaaacaacgccgataatcctaccgcgacgatttcactcaccgttaacgcaccgaaacgacaaacgacgacatccgcccacgcatacgccgccgccatatcatcaataaattccgtcactttatactacgattaccccgcttcgacatacgcctattcaacgaattattacgaacctttaccgctctaataccaaataataactaaatcacccaatttcgcaacaacctacgacattatctaattaaaaatacgtacgccctaaaaaccacccactaccaacacacgaaccgaaccttcacgtccaaccaaacgttactacgacaacgacaacgccaaca

SEQ ID NO: 25963 - DNA, 618 bp, Artificial Sequence
  chemically treated genomic DNA (Homo sapiens) CpG-island No: 25963
gttattaattttttaaatttatacgatgtaaaaggtatcgttataattacgttcgggtaattcggtttattttatttgttattcgttcggtggtattcggaatggatgtagcgcgggcgcgttttgttatggttaataaggtttttcgcgattattcggttagggtgttggcgatagtatttacgttaagttgtggttgttcgataattttggttgcgttcgttttttttagcggtagcgtattttagtattgttggcggtttttatgttgaaacggtataaataacgtcggtagttttgtcgcggcgattttatttatcgttaacgtatcggagcggtaaacgacgatattcgtttacgtatacgtcgtcgttatattattaataaatttcgttattttatgttgcggttgtttcgtttcggtatacgtttgtttaacggattgttgcgaatttttgtcgttttgatgttagatagtgattgaattatttagtttcgtagtaatttgcggtattgtttggttaagaatgcgtgcgttttgagaattatttattattagtatacgaatcggatttttacgtttagttaaacgttgttgcggtaacggtagcgttaata

SEQ ID NO: 25964 - DNA, 618 bp, Artificial Sequence
  chemically treated genomic DNA (Homo sapiens) CpG-island No: 25964
tattaacgctaccgttaccgcaacaacgtttaactaaacgtaaaaatccgattcgtatactaataataaataattctcaaaacgcacgcattcttaaccaaacaataccgcaaattactacgaaactaaataattcaatcactatctaacatcaaaacgacaaaaattcgcaacaatccgttaaacaaacgtataccgaaacgaaacaaccgcaacataaaataacgaaatttattaataatataacgacgacgtatacgtaaacgaatatcgtcgtttaccgctccgatacgttaacgataaataaaatcgccgcgacaaaactaccgacgttatttataccgtttcaacataaaaaccgccaacaatactaaaatacgctaccgctaaaaaaaacgaacgcaaccaaaattatcgaacaaccacaacttaacgtaaatactatcgccaacaccctaaccgaataatcgcgaaaaaccttattaaccataacaaaacgcgcccgcgctacatccattccgaataccaccgaacgaataacaaataaaataaaccgaattacccgaacgtaattataacgataccttttacatcgtataaatttaaaaaattaataac

SEQ ID NO: 25965 - DNA, 506 bp, Artificial Sequence
  chemically treated genomic DNA (Homo sapiens) CpG-island No: 25965
  misc_feature (52)..(52): n is either a, c, g or t
  misc_feature (198)..(198): n is either a, c, g or t
taaattgtcgtgaagtgcggtatttcgtaggttagataaggcggttacgcgntattcgatatttaacgttcgagtcggttgtttgatgcgacgttggcgcgttttattaggtttatatcgttgtgaagtgcggtatttcgtaggttagataaggcggttacgcgtaattcgatatttaacgcgcgagtcggttgtttnattcgacgttggcgcgttttattagggttatatcgttgtgaggttttttaatcggtagtttggattaagcgggtaagcgtaattcggatattaaaggtttagtcggttgtttaatgtatagttgcgcgttttattaagtttatacggttttaaaagttttatttcgtaggttggataagtcggttatcgttattcggatatttaaagttcgattcggttgtttatatcgagcgtggcggtttttattaggtttaattcgttgtaaagtcgtttattcgttaagtttgagtaagttgtttattttaatt

SEQ ID NO: 25966 - DNA, 506 bp, Artificial Sequence
  chemically treated genomic DNA (Homo sapiens) CpG-island No: 25966
  misc_feature (309)..(309): n is either a, c, g or t
  misc_feature (455)..(455): n is either a, c, g or t
aattaaaataaacaacttactcaaacttaacgaataaacgactttacaacgaattaaacctaataaaaaccgccacgctcgatataaacaaccgaatcgaactttaaatatccgaataacgataaccgacttatccaacctacgaaataaaacttttaaaaccgtataaacttaataaaacgcgcaactatacattaaacaaccgactaaacctttaatatccgaattacgcttacccgcttaatccaaactaccgattaaaaaacctcacaacgatataaccctaataaaacgcgccaacgtcgaatnaaacaaccgactcgcgcgttaaatatcgaattacgcgtaaccgccttatctaacctacgaaataccgcacttcacaacgatataaacctaataaaacgcgccaacgtcgcatcaaacaaccgactcgaacgttaaatatcgaatancgcgtaaccgccttatctaacctacgaaataccgcacttcacgacaattta

SEQ ID NO: 25967 - DNA, 506 bp, Artificial Sequence
  chemically treated genomic DNA (Homo sapiens) CpG-island No: 25967
  misc_feature (309)..(309): n is either a, c, g or t
  misc_feature (455)..(455): n is either a, c, g or t
gattggggtaaataatttatttaggtttaacgggtagacgattttatagcgggttaggtttgataagaatcgttacgttcgatataagtaatcgggtcggattttgaatgttcgaatggcggtaatcggtttatttaatttacggggtgagatttttaaagtcgtgtaggtttgataagacgcgtagttgtgtattaggtaatcggttgggtttttgatgttcggattgcgtttattcgtttaatttagattatcggttggagaattttatagcggtgtagttttgataagacgcgttagcgtcgaatnaggtaatcggttcgcgcgttagatgtcggattgcgcgtgatcgttttgtttgatttacggggtgtcgtattttatagcggtgtaggtttgataagacgcgttagcgtcgtattaggtaatcggttcgggcgttggatgtcggatgncgcgtgatcgttttgtttgatttacggggtgtcgtattttacggtagttta

SEQ ID NO: 25968 - DNA, 506 bp, Artificial Sequence
  chemically treated genomic DNA (Homo sapiens) CpG-island No: 25968
  misc_feature (52)..(52): n is either a, c, g or t
  misc_feature (198)..(198): n is either a, c, g or t
taaactaccgtaaaatacgacaccccgtaaatcaaacaaaacgatcacgcgncatccgacatccaacgcccgaaccgattacctaatacgacgctaacgcgtcttatcaaacctacaccgctataaaatacgacaccccgtaaatcaaacaaaacgatcacgcgcaatccgacatctaacgcgcgaaccgattacctnattcgacgctaacgcgtcttatcaaaactacaccgctataaaattctccaaccgataatctaaattaaacgaataaacgcaatccgaacatcaaaaacccaaccgattacctaatacacaactacgcgtcttatcaaacctacacgactttaaaaatctcaccccgtaaattaaataaaccgattaccgccattcgaacattcaaaatccgacccgattacttatatcgaacgtaacgattcttatcaaacctaacccgctataaaatcgtctacccgttaaacctaaataaattatttaccccaatc

SEQ ID NO: 25969 - DNA, 586 bp, Artificial Sequence
  chemically treated genomic DNA (Homo sapiens) CpG-island No: 25969
  misc_feature (253)..(253): n is either a, c, g or t
tatttttttcgtttttttttcgatttttattttattcgttttaattcgttcgttcgggttttcgttattttatcgggttttttttttcgtattcgttacgtttcgttttaattattttgttttttcgatgtttcgttcgttttaaattttatttttttattttcgtattattttttttcggtcgtttattttttttttttttattttgtcggattttttttcgtatcgtatttttaacgttgttatttatttntttttacgtttttcgttttatttacgttttatttatttttgttttttttcgtggttcgtatttattttcgttttattcgttttgtttcgtattttgtttttcggtttttttcgttttattttttcggcgttttcgttttatataacgcgtcgcgtttatatttttcgtatcgtatttatcgtatttttcgtggttattcgtttttttatttcgcgtagcgtcgttttatttttttcgttgtttcgttgttcgcgaagtattattttttgaacggatcgaagttaaggttagtattggttagtttgtcgatggagaaacgtggttcgattttta

SEQ ID NO: 25970 - DNA, 586 bp, Artificial Sequence
  chemically treated genomic DNA (Homo sapiens) CpG-island No: 25970
  misc_feature (334)..(334): n is either a, c, g or t
taaaaatcgaaccacgtttctccatcgacaaactaaccaatactaaccttaacttcgatccgttcaaaaaataatacttcgcgaacaacgaaacaacgaaaaaaataaaacgacgctacgcgaaataaaaaaacgaataaccacgaaaaatacgataaatacgatacgaaaaatataaacgcgacgcgttatataaaacgaaaacgccgaaaaaataaaacgaaaaaaaccgaaaaacaaaatacgaaacaaaacgaataaaacgaaaataaatacgaaccacgaaaaaaaacaaaaataaataaaacgtaaataaaacgaaaaacgtaaaaanaaataaataacaacgttaaaaatacgatacgaaaaaaaatccgacaaaataaaaaaaaaaaaaataaacgaccgaaaaaaaataatacgaaaataaaaaaataaaatttaaaacgaacgaaacatcgaaaaaacaaaataattaaaacgaaacgtaacgaatacgaaaaaaaaaacccgataaaataacgaaaacccgaacgaacgaattaaaacgaataaaataaaaatcgaaaaaaaaacgaaaaaaata

SEQ ID NO: 25971 - DNA, 586 bp, Artificial Sequence
  chemically treated genomic DNA (Homo sapiens) CpG-island No: 25971
  misc_feature (334)..(334): n is either a, c, g or t
tggaaatcgaattacgtttttttatcgataagttgattaatattgattttagtttcggttcgtttaaagagtggtatttcgcgaataacggggtagcgaggaaggtggagcgacgttgcgcgagatggggaggcgggtggttacgaaaagtacggtaagtgcggtacggagggtgtgagcgcggcgcgttatatgaagcgggaacgtcggagagataaagcgagaggggtcgaggaatagagtacgaggtagagcgagtgaaacgagaataagtgcgggttacggagggggataagggtggatggagcgtggatgaagcgagaggcgtaggagngggtgggtagtagcgttgaaagtgcggtgcgaaggggagttcggtaaggtggggaagaggaaagtaggcggtcggggaagagtgatgcgggggtaggaaggtgggatttgaagcgggcgaagtatcgggggagtaaagtagttgaggcgaagcgtggcgggtgcggagagaggaattcgatgaagtagcgggagttcgaacgggcgagttggagcgggtgaaatggaagtcgagagaagggcgaggaaggtg

SEQ ID NO: 25972 - DNA, 586 bp, Artificial Sequence
  chemically treated genomic DNA (Homo sapiens) CpG-island No: 25972
  misc_feature (253)..(253): n is either a, c, g or t
caccttcctcgcccttctctcgacttccatttcacccgctccaactcgcccgttcgaactcccgctacttcatcgaattcctctctccgcacccgccacgcttcgcctcaactactttactcccccgatacttcgcccgcttcaaatcccaccttcctacccccgcatcactcttccccgaccgcctactttcctcttccccaccttaccgaactccccttcgcaccgcactttcaacgctactacccacccnctcctacgcctctcgcttcatccacgctccatccacccttatccccctccgtaacccgcacttattctcgtttcactcgctctacctcgtactctattcctcgacccctctcgctttatctctccgacgttcccgcttcatataacgcgccgcgctcacaccctccgtaccgcacttaccgtacttttcgtaaccacccgcctccccatctcgcgcaacgtcgctccaccttcctcgctaccccgttattcgcgaaataccactctttaaacgaaccgaaactaaaatcaatattaatcaacttatcgataaaaaaacgtaattcgatttcca

SEQ ID NO: 25973 - DNA, 550 bp, Artificial Sequence
  chemically treated genomic DNA (Homo sapiens) CpG-island No: 25973
  misc_feature (357)..(357): n is either a, c, g or t
cgtttcggcgtttttggtttgttatttggcgaacgataaagcgttgttcggtatttagtcgggtcgaggatttttcggcgcggtggtgttggggttggcgattggttatttcgttttttggtttcgtaaagtgcgttttggtaaagtattataatcgttgttcggtttaatgttgatttcgttcgttattttgttggttttcggcgtgtttatttattacgttatcgggtcggtgatgttcgattttatgggcgggttgttttattttttgaatattatttttttattaatgaagtttgcggtacgttttttggtcggtgcgatgttggcgttcgataatgggcggtttattaatanaattcgttggtttttttgttttttattgttggaaaaatatatgtatgattggtacgttatcgtcggcgttgtcgcgttgatgtagttcgtcgtagcgggttttgcgacgtttatttgcgtttaaattgtttatttgattagaaaataaggaatagttatattagcgacgttttagcgttgttgtagattggta

SEQ ID NO: 25974 - DNA, 550 bp, Artificial Sequence
  chemically treated genomic DNA (Homo sapiens) CpG-island No: 25974
  misc_feature (194)..(194): n is either a, c, g or t
taccaatctacaacaacgctaaaacgtcgctaatataactattccttattttctaatcaaataaacaatttaaacgcaaataaacgtcgcaaaacccgctacgacgaactacatcaacgcgacaacgccgacgataacgtaccaatcatacatatatttttccaacaataaaaaacaaaaaaaccaacgaattntattaataaaccgcccattatcgaacgccaacatcgcaccgaccaaaaaacgtaccgcaaacttcattaataaaaaaataatattcaaaaaataaaacaacccgcccataaaatcgaacatcaccgacccgataacgtaataaataaacacgccgaaaaccaacaaaataacgaacgaaatcaacattaaaccgaacaacgattataatactttaccaaaacgcactttacgaaaccaaaaaacgaaataaccaatcgccaaccccaacaccaccgcgccgaaaaatcctcgacccgactaaataccgaacaacgctttatcgttcgccaaataacaaaccaaaaacgccgaaacg

SEQ ID NO: 25975 - DNA, 550 bp, Artificial Sequence
  chemically treated genomic DNA (Homo sapiens) CpG-island No: 25975
  misc_feature (194)..(194): n is either a, c, g or t
tgttagtttgtaataacgttggagcgtcgttgatatggttgttttttattttttggttaggtaaatagtttgggcgtaaatgaacgtcgtaagattcgttgcgacgggttgtattagcgcgataacgtcgacgatggcgtattagttatatatgtgtttttttagtagtgagaagtagaagaattagcgggttntattgatgggtcgtttattatcgaacgttagtatcgtatcgattagaaaacgtgtcgtaaattttattgatggaggaatggtatttaggaagtggagtagttcgtttatgaggtcggatattatcggttcgataacgtagtaagtgagtacgtcgaaaattagtagagtaacgaacgggattagtattgaatcgagtagcggttgtaatgttttgttaaggcgtattttgcggaattagaagacgaaatagttaatcgttagttttagtattatcgcgtcgaggaattttcgattcgattgggtgtcgagtagcgttttgtcgttcgttagatagtaaattagaaacgtcggagcg

SEQ ID NO: 25976 - DNA, 550 bp, Artificial Sequence
  chemically treated genomic DNA (Homo sapiens) CpG-island No: 25976
  misc_feature (357)..(357): n is either a, c, g or t
cgctccgacgtttctaatttactatctaacgaacgacaaaacgctactcgacacccaatcgaatcgaaaattcctcgacgcgataatactaaaactaacgattaactatttcgtcttctaattccgcaaaatacgccttaacaaaacattacaaccgctactcgattcaatactaatcccgttcgttactctactaattttcgacgtactcacttactacgttatcgaaccgataatatccgacctcataaacgaactactccacttcctaaataccattcctccatcaataaaatttacgacacgttttctaatcgatacgatactaacgttcgataataaacgacccatcaatanaacccgctaattcttctacttctcactactaaaaaaacacatatataactaatacgccatcgtcgacgttatcgcgctaatacaacccgtcgcaacgaatcttacgacgttcatttacgcccaaactatttacctaaccaaaaaataaaaaacaaccatatcaacgacgctccaacgttattacaaactaaca

SEQ ID NO: 25977 - DNA, 509 bp, Artificial Sequence
  chemically treated genomic DNA (Homo sapiens) CpG-island No: 25977
tagtgcggcgtttttttttggttcgagaataattgagtcgattacgttcgtgtttattatcgttgaatttttatcgttggtaatgatgtgtatattgtcgtcgttgttggtaattttggcgtttgcgttaaagttggcgatttgtattaggttattattattggcgatatgatatcgtttatttaatgtataaacgcgtattcgtatttcggtattcgtaattcgattgttatttttagcgttgtttattcgcgaagaattatcggttatagtaattcgtgcgcgtttatcggagttgttaatgtgattgttaaagtcgatatttttaattcgtacgttataatttatattggtaatttgcgcggtatatttagcggttgcgattttggcgttatttacggataatgttgcggttagttattggagtttattttaagagacgtttagcgattcgaatatcgttatcgtattaatagtaataatgatgtagttaaggatggtagtaatgg

SEQ ID NO: 25978 - DNA, 509 bp, Artificial Sequence
  chemically treated genomic DNA (Homo sapiens) CpG-island No: 25978
ccattactaccatccttaactacatcattattactattaatacgataacgatattcgaatcgctaaacgtctcttaaaataaactccaataactaaccgcaacattatccgtaaataacgccaaaatcgcaaccgctaaatataccgcgcaaattaccaatataaattataacgtacgaattaaaaatatcgactttaacaatcacattaacaactccgataaacgcgcacgaattactataaccgataattcttcgcgaataaacaacgctaaaaataacaatcgaattacgaataccgaaatacgaatacgcgtttatacattaaataaacgatatcatatcgccaataataataacctaatacaaatcgccaactttaacgcaaacgccaaaattaccaacaacgacgacaatatacacatcattaccaacgataaaaattcaacgataataaacacgaacgtaatcgactcaattattctcgaaccaaaaaaaaacgccgcacta

SEQ ID NO: 25979 - DNA, 509 bp, Artificial Sequence
  chemically treated genomic DNA (Homo sapiens) CpG-island No: 25979
ttattattattatttttaattatattattattgttgttggtgcgatgacggtgttcggatcgttgggcgttttttgggataaattttagtggttggtcgtagtattattcgtagataacgttagaatcgtaatcgttgggtatgtcgcgtaaattgttagtatgggttatagcgtgcggattggaagtgtcggttttaatagttatattggtagtttcggtgaacgcgtacgggttgttgtaatcggtaatttttcgcggataagtagcgttggagatagtagtcggattgcgaatatcggaatgcgagtacgcgtttgtatattgggtgaacggtgttatgtcgttagtaatggtgatttggtgtaaatcgttagttttggcgtaaacgttagaattgttaatagcggcgataatgtatatattattgttagcggtgaaaatttaacggtagtgagtacgggcgtggtcgatttaattattttcgggttaggaggaagcgtcgtattg

SEQ ID NO: 25980 - DNA, 509 bp, Artificial Sequence
  chemically treated genomic DNA (Homo sapiens) CpG-island No: 25980
caatacgacgcttcctcctaacccgaaaataattaaatcgaccacgcccgtactcactaccgttaaattttcaccgctaacaataatatatacattatcgccgctattaacaattctaacgtttacgccaaaactaacgatttacaccaaatcaccattactaacgacataacaccgttcacccaatatacaaacgcgtactcgcattccgatattcgcaatccgactactatctccaacgctacttatccgcgaaaaattaccgattacaacaacccgtacgcgttcaccgaaactaccaatataactattaaaaccgacacttccaatccgcacgctataacccatactaacaatttacgcgacatacccaacgattacgattctaacgttatctacgaataatactacgaccaaccactaaaatttatcccaaaaaacgcccaacgatccgaacaccgtcatcgcaccaacaacaataataatataattaaaaataataataataa

SEQ ID NO: 25981 - DNA, 1096 bp, Artificial Sequence
  chemically treated genomic DNA (Homo sapiens) CpG-island No: 25981
  misc_feature (749)..(749): n is either a, c, g or t
atcgttattttttttggagtgaaatttacgaaacggtgttggcgtggtatatcgtattatcgacgttggtggcgttgattaattcgtataaaggtaaatttaacgttatcgttaaaggtggattggtggaagaagagtacgtcgattgggtgatttcgcggttttatattttttttgttttgtttaatttggtgggcgttgcggtaggtatttggcgttatttttatggttcgttaatcgagatgtttatcgtggtcgttagtatggtgtgggtgttttataatttgattgtttttggcggcgtagttgcggtatcggtagaaagtaaataggtacgtcgatcgtatcgcgtggagatgacgatgttcgcggtaattgttcgcgaagatggttattttttttcgtgtatcgtttaggattttttcgacggtggtttggggattaagattaacggttaggcgtagattttggaagggtagaaagtgaatttgttgtttaaacgcggttagtaggaatacgttttttcgatttaggtggcgcgcgtgatgggtaatgaagttgggttgaaattaatgtcgtttattatttagtaatatatcgattttgtgtagtgtacgtttgttcgtgcggatatatgggcgttttggtaggatagttattcggaagataagtcgttggaaagtttgttggatattttgaagttcggttttcgtggttaacgttatttggtcgagtttgcgttttttttngtgaaggtatatttcgtgtgttgaatttttttggtttttgggttgtatcgttatttcgttcgtttttcggtacgttgatgttggtaagttgtatcgagatggtgatttttcgcgttttgtatttggcgcgtcgtattattacgtcgttggtttttggcgttgtggtgatgattatcggtttgtcgttaatttaggttgggttaacgtttattggcggcggttattagttatgagcgataatattttcggcgtatcgaaaaatttgttgttggtaggcgtggttttagttttaattattttgtttaatcgttaacgtaatttttatttacgcgtggttttattggtaa

SEQ ID NO: 25982 - DNA, 1096 bp, Artificial Sequence
  chemically treated genomic DNA (Homo sapiens) CpG-island No: 25982
  misc_feature (348)..(348): n is either a, c, g or t
ttaccaataaaaccacgcgtaaataaaaattacgttaacgattaaacaaaataattaaaactaaaaccacgcctaccaacaacaaatttttcgatacgccgaaaatattatcgctcataactaataaccgccgccaataaacgttaacccaacctaaattaacgacaaaccgataatcatcaccacaacgccaaaaaccaacgacgtaataatacgacgcgccaaatacaaaacgcgaaaaatcaccatctcgatacaacttaccaacatcaacgtaccgaaaaacgaacgaaataacgatacaacccaaaaaccaaaaaaattcaacacacgaaatataccttcacnaaaaaaaacgcaaactcgaccaaataacgttaaccacgaaaaccgaacttcaaaatatccaacaaactttccaacgacttatcttccgaataactatcctaccaaaacgcccatatatccgcacgaacaaacgtacactacacaaaatcgatatattactaaataataaacgacattaatttcaacccaacttcattacccatcacgcgcgccacctaaatcgaaaaaacgtattcctactaaccgcgtttaaacaacaaattcactttctacccttccaaaatctacgcctaaccgttaatcttaatccccaaaccaccgtcgaaaaaatcctaaacgatacacgaaaaaaaataaccatcttcgcgaacaattaccgcgaacatcgtcatctccacgcgatacgatcgacgtacctatttactttctaccgataccgcaactacgccgccaaaaacaatcaaattataaaacacccacaccatactaacgaccacgataaacatctcgattaacgaaccataaaaataacgccaaatacctaccgcaacgcccaccaaattaaacaaaacaaaaaaaatataaaaccgcgaaatcacccaatcgacgtactcttcttccaccaatccacctttaacgataacgttaaatttacctttatacgaattaatcaacgccaccaacgtcgataatacgatataccacgccaacaccgtttcgtaaatttcactccaaaaaaaataacgat

SEQ ID NO: 25983 - DNA, 1096 bp, Artificial Sequence
  chemically treated genomic DNA (Homo sapiens) CpG-island No: 25983
  misc_feature (348)..(348): n is either a, c, g or t
ttattagtgaggttacgcgtaagtaagggttacgttgacggttaagtaggataattaaggttaagattacgtttgttagtagtagatttttcggtgcgtcgaaggtgttatcgtttatggttggtaatcgtcgttaatggacgttaatttaatttgaattagcgataggtcgataattattattataacgttagaaattagcggcgtaataatgcggcgcgttagatgtagaacgcgggagattattatttcggtgtaatttgttagtattaacgtgtcgaaaggcgggcggaataacgatataatttaagaattagaagaatttagtatacggaatatgtttttatngaagaaggcgtaaattcggttagatggcgttagttacggaagtcgagttttagaatatttagtagattttttagcggtttatttttcgggtagttgttttgttagagcgtttatgtattcgtacgggtaaacgtatattgtataaaatcgatatgttgttgggtggtgagcggtattaattttagtttaattttattatttattacgcgcgttatttgggtcgggaagacgtatttttgttgatcgcgtttaagtaatagatttattttttgtttttttagaatttgcgtttgatcgttgattttgatttttaaattatcgtcggagaaattttgaacggtatacgagaagaggtgattattttcgcgggtaattgtcgcgggtatcgttatttttacgcggtgcgatcggcgtatttgtttgttttttatcgatatcgtaattgcgtcgttaagaataattaggttgtagaatatttatattatattgacgattacggtgagtatttcggttggcgggttatagaagtagcgttagatgtttatcgtaacgtttattaggttgagtaggataaggaagatgtagggtcgcgagattatttagtcgacgtattttttttttattagtttatttttggcggtgacgttaaatttgtttttgtgcgggttaattagcgttattagcgtcggtggtgcgatatattacgttagtatcgtttcgtagattttattttagaaagagtggcgat

SEQ ID NO: 25984 - DNA, 1096 bp, Artificial Sequence
  chemically treated genomic DNA (Homo sapiens) CpG-island No: 25984
  misc_feature (749)..(749): n is either a, c, g or t
atcgccactctttctaaaataaaatctacgaaacgatactaacgtaatatatcgcaccaccgacgctaataacgctaattaacccgcacaaaaacaaatttaacgtcaccgccaaaaataaactaataaaaaaaaaatacgtcgactaaataatctcgcgaccctacatcttccttatcctactcaacctaataaacgttacgataaacatctaacgctacttctataacccgccaaccgaaatactcaccgtaatcgtcaatataatataaatattctacaacctaattattcttaacgacgcaattacgatatcgataaaaaacaaacaaatacgccgatcgcaccgcgtaaaaataacgatacccgcgacaattacccgcgaaaataatcacctcttctcgtataccgttcaaaatttctccgacgataatttaaaaatcaaaatcaacgatcaaacgcaaattctaaaaaaacaaaaaataaatctattacttaaacgcgatcaacaaaaatacgtcttcccgacccaaataacgcgcgtaataaataataaaattaaactaaaattaataccgctcaccacccaacaacatatcgattttatacaatatacgtttacccgtacgaatacataaacgctctaacaaaacaactacccgaaaaataaaccgctaaaaaatctactaaatattctaaaactcgacttccgtaactaacgccatctaaccgaatttacgccttcttcnataaaaacatattccgtatactaaattcttctaattcttaaattatatcgttattccgcccgcctttcgacacgttaatactaacaaattacaccgaaataataatctcccgcgttctacatctaacgcgccgcattattacgccgctaatttctaacgttataataataattatcgacctatcgctaattcaaattaaattaacgtccattaacgacgattaccaaccataaacgataacaccttcgacgcaccgaaaaatctactactaacaaacgtaatcttaaccttaattatcctacttaaccgtcaacgtaacccttacttacgcgtaacctcactaataa

SEQ ID NO: 25985 - DNA, 611 bp, Artificial Sequence
  chemically treated genomic DNA (Homo sapiens) CpG-island No: 25985
gttgaatcggaagcgtatcgcgattcgttcgttatgtagtaattttttgtcgaatatggcgtaacgattacgtattttgttcgtcgatgttggcggtatttgttgtttcgttgacgtcgtaaatcgttcgttagagttgcgcgacgttgaaataggttttttgtagtggtgaggttttatcggttgatttatgtcgcgaatggtaatagttaattggcgcgtcgttgtataatttatatggttcgacggaagcggcggtagatgttagttggtattcggtttttggcgaggaattggtataggtgcgcggtagtagtgtgtcgattggttattcggtatggaatacgggtttgcgtatttttgatgcgatgatgtattcggtgtcgtcgggtgtggcgggtgatttttattttattggtatttaattggcgtagggttatttcggacgtttcgatttgatcgttagtcgttttattgtcgatttttttgttttaggtgaacggatgtatcgtatcggagacgttgttcgttggttggataacggcgcggtggagtatttcgggcgtagtgatgattagttaaaaattcgcgggtaggtttttttttgtatt

SEQ ID NO: 25986 - DNA, 611 bp, Artificial Sequence
  chemically treated genomic DNA (Homo sapiens) CpG-island No: 25986
aatacaaaaaaaaacctacccgcgaatttttaactaatcatcactacgcccgaaatactccaccgcgccgttatccaaccaacgaacaacgtctccgatacgatacatccgttcacctaaaacaaaaaaatcgacaataaaacgactaacgatcaaatcgaaacgtccgaaataaccctacgccaattaaataccaataaaataaaaatcacccgccacacccgacgacaccgaatacatcatcgcatcaaaaatacgcaaacccgtattccataccgaataaccaatcgacacactactaccgcgcacctataccaattcctcgccaaaaaccgaataccaactaacatctaccgccgcttccgtcgaaccatataaattatacaacgacgcgccaattaactattaccattcgcgacataaatcaaccgataaaacctcaccactacaaaaaacctatttcaacgtcgcgcaactctaacgaacgatttacgacgtcaacgaaacaacaaataccgccaacatcgacgaacaaaatacgtaatcgttacgccatattcgacaaaaaattactacataacgaacgaatcgcgatacgcttccgattcaac

SEQ ID NO: 25987 - DNA, 611 bp, Artificial Sequence
  chemically treated genomic DNA (Homo sapiens) CpG-island No: 25987
aatataaaaaagaatttgttcgcgaatttttagttgattattattgcgttcgaggtattttatcgcgtcgttatttagttagcgggtaacgttttcggtacggtatattcgtttatttggggtaaaaggatcggtaataaagcggttggcggttagatcggggcgttcgagatagttttgcgttagttgaatgttagtgagatagagattattcgttatattcggcggtatcggatgtattatcgtattaagaatacgtagattcgtattttatatcggataattaatcggtatattgttgtcgcgtatttgtgttagtttttcgttaaaagtcggatattagttgatatttatcgtcgttttcgtcgggttatatagattatgtaacggcgcgttagttaattgttgttattcgcggtataaattagtcggtaaggttttattattatagaaaatttgttttaacgtcgcgtaattttggcgagcggtttgcggcgttagcgaggtaataaatgtcgttagtatcgacggataaagtgcgtggtcgttacgttatattcggtaaagaattgttgtatagcgagcgggtcgcggtgcgttttcggtttagt

SEQ ID NO: 25988 - DNA, 611 bp, Artificial Sequence
  chemically treated genomic DNA (Homo sapiens) CpG-island No: 25988
actaaaccgaaaacgcaccgcgacccgctcgctatacaacaattctttaccgaatataacgtaacgaccacgcactttatccgtcgatactaacgacatttattacctcgctaacgccgcaaaccgctcgccaaaattacgcgacgttaaaacaaattttctataataataaaaccttaccgactaatttataccgcgaataacaacaattaactaacgcgccgttacataatctatataacccgacgaaaacgacgataaatatcaactaatatccgacttttaacgaaaaactaacacaaatacgcgacaacaatataccgattaattatccgatataaaatacgaatctacgtattcttaatacgataatacatccgataccgccgaatataacgaataatctctatctcactaacattcaactaacgcaaaactatctcgaacgccccgatctaaccgccaaccgctttattaccgatccttttaccccaaataaacgaatataccgtaccgaaaacgttacccgctaactaaataacgacgcgataaaatacctcgaacgcaataataatcaactaaaaattcgcgaacaaattcttttttatatt

SEQ ID NO: 25989 - DNA, 630 bp, Artificial Sequence
  chemically treated genomic DNA (Homo sapiens) CpG-island No: 25989
tgaatttgtatcggtagaagaagtgaaattagcgtcggaataattagtcgagttataatagtttgtttttatagtgttttcggtgtcgacgatttcgtagtagttaggtttaattgagtacgaagattaaattgtatcgtttgcgtcgtatattcgttattatgattggaatggcgtaatgtagtcgatggttagtaagatgtttggggttgacggggtgattgcgggtagcgttttgttggttgatagcgttaataatcgtattaacggttcgttgaatgtcgtagaagcgatcgaaacgttgcgaaatgcgttggttaataacgggaaatttattttggttttcgtttagtaattgtcgatggcgaataatagttaggtttgtcgtcgtaggatagtttaggtattcgtagtaaagttataggtattgttcgtaatgtcggcgtttattacgtgttgtatttacgttggcgtatgattggttagaacgttttgcggatttaaaggtgttgtttttggtaatttttcgtattcgtggtaatttttagatcggtacgtttgttatcgatttggatgatgattattttgatatgttgtaggaggagttttgtagcgttgtggaggttttcg

SEQ ID NO: 25990 - DNA, 630 bp, Artificial Sequence
  chemically treated genomic DNA (Homo sapiens) CpG-island No: 25990
cgaaaacctccacaacgctacaaaactcctcctacaacatatcaaaataatcatcatccaaatcgataacaaacgtaccgatctaaaaattaccacgaatacgaaaaattaccaaaaacaacacctttaaatccgcaaaacgttctaaccaatcatacgccaacgtaaatacaacacgtaataaacgccgacattacgaacaatacctataactttactacgaatacctaaactatcctacgacgacaaacctaactattattcgccatcgacaattactaaacgaaaaccaaaataaatttcccgttattaaccaacgcatttcgcaacgtttcgatcgcttctacgacattcaacgaaccgttaatacgattattaacgctatcaaccaacaaaacgctacccgcaatcaccccgtcaaccccaaacatcttactaaccatcgactacattacgccattccaatcataataacgaatatacgacgcaaacgatacaatttaatcttcgtactcaattaaacctaactactacgaaatcgtcgacaccgaaaacactataaaaacaaactattataactcgactaattattccgacgctaatttcacttcttctaccgatacaaattca

SEQ ID NO: 25991 - DNA, 630 bp, Artificial Sequence
  chemically treated genomic DNA (Homo sapiens) CpG-island No: 25991
cggaggtttttataacgttgtaaagttttttttgtaatatgttaaagtagttattatttagatcggtggtaggcgtgtcggtttgggggttattacgggtacgggggattattaaaggtagtatttttaagttcgtaagacgttttgattagttatgcgttagcgtgagtatagtacgtaatgagcgtcgatattgcgggtaatgtttatggttttattacgggtgtttaaattgttttgcggcgataaatttaattgttgttcgttatcgatagttgttgggcggaaattagggtaaatttttcgttattagttagcgtatttcgtagcgtttcggtcgtttttgcggtatttagcgaatcgttagtacggttgttaacgttattaattagtaggacgttattcgtagttatttcgttagttttaagtattttattgattatcggttgtattgcgttattttagttataatggcgaatatgcggcgtaggcggtgtagtttgattttcgtgtttaattgggtttggttgttgcgggatcgtcggtatcgagggtattgtggggataggttgttgtggttcggttggttgtttcggcgttggttttattttttttatcggtgtaggttta

SEQ ID NO: 25992 - DNA, 630 bp, Artificial Sequence
  chemically treated genomic DNA (Homo sapiens) CpG-island No: 25992
taaacctacaccgataaaaaaaataaaaccaacgccgaaacaaccaaccgaaccacaacaacctatccccacaataccctcgataccgacgatcccgcaacaaccaaacccaattaaacacgaaaatcaaactacaccgcctacgccgcatattcgccattataactaaaataacgcaatacaaccgataatcaataaaatacttaaaactaacgaaataactacgaataacgtcctactaattaataacgttaacaaccgtactaacgattcgctaaataccgcaaaaacgaccgaaacgctacgaaatacgctaactaataacgaaaaatttaccctaatttccgcccaacaactatcgataacgaacaacaattaaatttatcgccgcaaaacaatttaaacacccgtaataaaaccataaacattacccgcaatatcgacgctcattacgtactatactcacgctaacgcataactaatcaaaacgtcttacgaacttaaaaatactacctttaataatcccccgtacccgtaataacccccaaaccgacacgcctaccaccgatctaaataataactactttaacatattacaaaaaaaactttacaacgttataaaaacctccg

SEQ ID NO: 25993 - DNA, 757 bp, Artificial Sequence
  chemically treated genomic DNA (Homo sapiens) CpG-island No: 25993
gtattttgtgcgtttgtattagatttagcgtgttaagttttggaatgtagattagcgttaattaggcggtaattcgcgttagttgcgttaagtataagttcgatttaatggaagaattgattatcgtcgttagttttaagcgcgtgcgtcgtttgtatttgttcgcgtattttttttagattgttcgtgagcgtgggtttgataattatcgcgcgtacgttttttttagttataaaggtaaaattcggatcgcgtaggtttttattttaggtaatggtaatgtcggttttacgggtaaacgttcgcgaattatcgcgggttttgtacggtttttcgagaaacgcgatgcggtcgcgataattcgggttaacgtatttggtaaattgttgattttttagcggtgtttaggcgcgatttgcgttaagacgtaaatgtagattcggaattgtttttagtaatagatttattattatgtcgtcgcgtatcgtttcgtataattttattttgattttcgttattttttcgtttggtatatttgtaagtttgaggattagatcgttcggatcgttattatatagcggtgtcgtacggtagttggttgtttgcggtaacgtatttgttagttttgttaatgtatagtttacgttaaaggttacggaaggtatttgcggtagttcgtaatcgtttgttagttagttatttatttaggtaagtagtatattttgcgtttttttttaggttttttgattgaagttcg

SEQ ID NO: 25994 - DNA, 757 bp, Artificial Sequence
  chemically treated genomic DNA (Homo sapiens) CpG-island No: 25994
cgaacttcaatcaaaaaacctaaaaaaaaacgcaaaatatactacttacctaaataaataactaactaacaaacgattacgaactaccgcaaataccttccgtaacctttaacgtaaactatacattaacaaaactaacaaatacgttaccgcaaacaaccaactaccgtacgacaccgctatataataacgatccgaacgatctaatcctcaaacttacaaatataccaaacgaaaaaataacgaaaatcaaaataaaattatacgaaacgatacgcgacgacataataataaatctattactaaaaacaattccgaatctacatttacgtcttaacgcaaatcgcgcctaaacaccgctaaaaaatcaacaatttaccaaatacgttaacccgaattatcgcgaccgcatcgcgtttctcgaaaaaccgtacaaaacccgcgataattcgcgaacgtttacccgtaaaaccgacattaccattacctaaaataaaaacctacgcgatccgaattttacctttataactaaaaaaaacgtacgcgcgataattatcaaacccacgctcacgaacaatctaaaaaaaatacgcgaacaaatacaaacgacgcacgcgcttaaaactaacgacgataatcaattcttccattaaatcgaacttatacttaacgcaactaacgcgaattaccgcctaattaacgctaatctacattccaaaacttaacacgctaaatctaatacaaacgcacaaaatac

SEQ ID NO: 25995 - DNA, 757 bp, Artificial Sequence
  chemically treated genomic DNA (Homo sapiens) CpG-island No: 25995
cgggttttagttaggaaatttgggaagaggcgtaaagtgtgttgtttgtttgggtaaataattggttggtaggcgattgcgagttatcgtagatgtttttcgtggtttttggcgtaagttgtgtattggtagaattgatagatacgttgtcgtaagtagttaattatcgtgcggtatcgttgtgtaatggcgattcggacgatttgatttttaaatttgtagatatgttaggcgagaaagtggcgaaggttaaagtgggattgtacgaagcggtgcgcgacggtatggtggtgaatttgttgttggaggtaatttcggatttgtatttgcgttttgacgtaaatcgcgtttggatatcgttgaaaggttagtagtttgttaaatacgttaattcggattatcgcgatcgtatcgcgtttttcgaagagtcgtgtaaaattcgcgatgattcgcgagcgtttgttcgtgaaatcggtattgttattgtttgggatgaaagtttgcgcgattcggattttgtttttgtggttgaagagggcgtgcgcgcggtagttattaaatttacgtttacgggtagtttggaaaaagtacgcgagtaggtataggcggcgtacgcgtttggggttgacggcggtgattagtttttttattgaatcgagtttatgtttaacgtaattggcgcggattgtcgtttggttaacgttggtttatattttagggtttgatacgttggatttgatgtaggcgtataaggtat

SEQ ID NO: 25996 - DNA, 757 bp, Artificial Sequence
  chemically treated genomic DNA (Homo sapiens) CpG-island No: 25996
ataccttatacgcctacatcaaatccaacgtatcaaaccctaaaatataaaccaacgttaaccaaacgacaatccgcgccaattacgttaaacataaactcgattcaataaaaaaactaatcaccgccgtcaaccccaaacgcgtacgccgcctatacctactcgcgtactttttccaaactacccgtaaacgtaaatttaataactaccgcgcgcacgccctcttcaaccacaaaaacaaaatccgaatcgcgcaaactttcatcccaaacaataacaataccgatttcacgaacaaacgctcgcgaatcatcgcgaattttacacgactcttcgaaaaacgcgatacgatcgcgataatccgaattaacgtatttaacaaactactaacctttcaacgatatccaaacgcgatttacgtcaaaacgcaaatacaaatccgaaattacctccaacaacaaattcaccaccataccgtcgcgcaccgcttcgtacaatcccactttaaccttcgccactttctcgcctaacatatctacaaatttaaaaatcaaatcgtccgaatcgccattacacaacgataccgcacgataattaactacttacgacaacgtatctatcaattctaccaatacacaacttacgccaaaaaccacgaaaaacatctacgataactcgcaatcgcctaccaaccaattatttacccaaacaaacaacacactttacgcctcttcccaaatttcctaactaaaacccg

SEQ ID NO: 25997 - DNA, 837 bp, Artificial Sequence
  chemically treated genomic DNA (Homo sapiens) CpG-island No: 25997
  misc_feature (369)..(369): n is either a, c, g or t
  misc_feature (487)..(489): n is either a, c, g or t
  misc_feature (547)..(547): n is either a, c, g or t
  misc_feature (549)..(549): n is either a, c, g or t
gcgtgatcggttttcgttagggtaaagttcgtcgtcgatatttgtttacggaattgacgcgcgttcgtttatagacggttacgtagttcgttgttcgtttcgattatttttagtattttgatggacgcggtaataatcgtttggatcgggtttggaatttttgagcggtcgcgagtttttcgcgttagggataaatcgcgaatcgcgtatattttgcgcgtcgtcgtttgcggagtttttcgcgttattgataaatcgttagttttataaattcggagatacggaaattagagtttttcgcgttagtaggataaatcggatttatttcgaaagagattgttagttagtttgagtttttcgcgttagganttaaatcgttgttggagttggttgtaaggtaagtcgtttagagtttttcgcgttacgggataaatcggggggcgtatgatcgtaaatattatttttcgggagtttttcgcgttaggannntaaatcgggagtttagatataggtggaatgatggattacgagtttttcgcgttaggantnataatcgttcggtagttaggtttgtaacgtttgaatcgagagtttttcgcgttataggggataaatcggtaacgacggtgagattttacgtttgacgttggtgtttttcgtattagcgggagtaaatcgggcgtattggatgcgatgatggatattatttggagttttttcgtttttgcggtagaatttttagtttttatttttaaatttattaagacgttttcgttaatttttttattagaggtagtattattcgtataacgttacggtagcgacgttttatttttt

SEQ ID NO: 25998 - DNA, 837 bp, Artificial Sequence
  chemically treated genomic DNA (Homo sapiens) CpG-island No: 25998
  misc_feature (289)..(289): n is either a, c, g or t
  misc_feature (291)..(291): n is either a, c, g or t
  misc_feature (349)..(351): n is either a, c, g or t
  misc_feature (469)..(469): n is either a, c, g or t
aaaaaataaaacgtcgctaccgtaacgttatacgaataatactacctctaataaaaaaattaacgaaaacgtcttaataaatttaaaaataaaaactaaaaattctaccgcaaaaacgaaaaaactccaaataatatccatcatcgcatccaatacgcccgatttactcccgctaatacgaaaaacaccaacgtcaaacgtaaaatctcaccgtcgttaccgatttatcccctataacgcgaaaaactctcgattcaaacgttacaaacctaactaccgaacgattatnantcctaacgcgaaaaactcgtaatccatcattccacctatatctaaactcccgatttannntcctaacgcgaaaaactcccgaaaaataatatttacgatcatacgccccccgatttatcccgtaacgcgaaaaactctaaacgacttaccttacaaccaactccaacaacgatttaantcctaacgcgaaaaactcaaactaactaacaatctctttcgaaataaatccgatttatcctactaacgcgaaaaactctaatttccgtatctccgaatttataaaactaacgatttatcaataacgcgaaaaactccgcaaacgacgacgcgcaaaatatacgcgattcgcgatttatccctaacgcgaaaaactcgcgaccgctcaaaaattccaaacccgatccaaacgattattaccgcgtccatcaaaatactaaaaataatcgaaacgaacaacgaactacgtaaccgtctataaacgaacgcgcgtcaattccgtaaacaaatatcgacgacgaactttaccctaacgaaaaccgatcacgc

SEQ ID NO: 25999 - DNA, 837 bp, Artificial Sequence
  chemically treated genomic DNA (Homo sapiens) CpG-island No: 25999
  misc_feature (289)..(289): n is either a, c, g or t
  misc_feature (291)..(291): n is either a, c, g or t
  misc_feature (349)..(351): n is either a, c, g or t
  misc_feature (469)..(469): n is either a, c, g or t
aaagaatagaacgtcgttgtcgtgacgttatgcggataatgttatttttggtgaaggagttggcgaaggcgttttgatgggtttgaaaatgggagttgggagttttatcgtagaggcgggggaattttaagtgatatttattatcgtatttagtgcgttcggtttattttcgttgatgcggggaatattagcgttaggcgtgaaattttatcgtcgttgtcggtttattttttgtggcgcggggaattttcggtttaggcgttgtaaatttggttatcgggcggttatnanttttaacgcggggaattcgtagtttattattttatttatgtttgaattttcggtttannnttttggcgcggggaattttcgggggataatgtttacggttatgcgtttttcggtttatttcgtggcgcggggaattttgggcggtttgttttgtagttagttttagtagcggtttganttttggcgcggggaatttaagttggttggtaatttttttcggggtgagttcggtttattttattggcgcggggaattttagttttcgtattttcggatttataaagttgacggtttattagtggcgcggggaatttcgtaggcggcgacgcgtagggtatgcgcgattcgcggtttatttttggcgcggggaattcgcgatcgtttagaaattttagattcgatttaaacggttattatcgcgtttattaaagtattggagatggtcgaagcgggtagcgaattgcgtgatcgtttgtgggcgaacgcgcgttagtttcgtgagtaaatgtcggcggcgggttttattttggcgggagtcgattacgt

SEQ ID NO: 26000 - DNA, 837 bp, Artificial Sequence
  chemically treated genomic DNA (Homo sapiens) CpG-island No: 26000
  misc_feature (369)..(369): n is either a, c, g or t
  misc_feature (487)..(489): n is either a, c, g or t
  misc_feature (547)..(547): n is either a, c, g or t
  misc_feature (549)..(549): n is either a, c, g or t
acgtaatcgactcccgccaaaataaaacccgccgccgacatttactcacgaaactaacgcgcgttcgcccacaaacgatcacgcaattcgctacccgcttcgaccatctccaatactttaataaacgcgataataaccgtttaaatcgaatctaaaatttctaaacgatcgcgaattccccgcgccaaaaataaaccgcgaatcgcgcataccctacgcgtcgccgcctacgaaattccccgcgccactaataaaccgtcaactttataaatccgaaaatacgaaaactaaaattccccgcgccaataaaataaaccgaactcaccccgaaaaaaattaccaaccaacttaaattccccgcgccaaaantcaaaccgctactaaaactaactacaaaacaaaccgcccaaaattccccgcgccacgaaataaaccgaaaaacgcataaccgtaaacattatcccccgaaaattccccgcgccaaaannntaaaccgaaaattcaaacataaataaaataataaactacgaattccccgcgttaaaantnataaccgcccgataaccaaatttacaacgcctaaaccgaaaattccccgcgccacaaaaaataaaccgacaacgacgataaaatttcacgcctaacgctaatattccccgcatcaacgaaaataaaccgaacgcactaaatacgataataaatatcacttaaaattcccccgcctctacgataaaactcccaactcccattttcaaacccatcaaaacgccttcgccaactccttcaccaaaaataacattatccgcataacgtcacgacaacgacgttctattcttt

SEQ ID NO: 26001 - DNA, 557 bp, Artificial Sequence
  chemically treated genomic DNA (Homo sapiens) CpG-island No: 26001
cgtacgcgtatttttttagatagcgtcgatttgcgtatggaaatcgttagttatttgcgtcggatttgtcgcgtttgttagtgttcgttcggtaataaacgtttttacgcggatatttttaaatagcggtaggttagtaggggtaatttcgttagtaatggaaagtttaaggtcgatatttgaaagcgtttttatgcgtgttagatcggtttcgttttattgttgttcgttggtttgtgtattacgatcgcgatgataaatggtttgtcgtacgttaatacgatgttagtcgcgggcgtcgtttagcgtttagttatcgaatagttttatttgaattttattttcgtagcgttgtgttattgcgtggtttttttttatcgtcgcgagcggcgcggcgtagatgatggttatttagttagcgtttgcgttaaacgtatgttgcgcgagcgttttattagcgtcggcgattttttagttagtaacgatgattttgttcgggtattgttcgcgtaaggtttttaggtagtttaagaaggaattgaatatgttattatcga

SEQ ID NO: 26002 - DNA, 557 bp, Artificial Sequence
  chemically treated genomic DNA (Homo sapiens) CpG-island No: 26002
tcgataataacatattcaattccttcttaaactacctaaaaaccttacgcgaacaatacccgaacaaaatcatcgttactaactaaaaaatcgccgacgctaataaaacgctcgcgcaacatacgtttaacgcaaacgctaactaaataaccatcatctacgccgcgccgctcgcgacgataaaaaaaaaccacgcaataacacaacgctacgaaaataaaattcaaataaaactattcgataactaaacgctaaacgacgcccgcgactaacatcgtattaacgtacgacaaaccatttatcatcgcgatcgtaatacacaaaccaacgaacaacaataaaacgaaaccgatctaacacgcataaaaacgctttcaaatatcgaccttaaactttccattactaacgaaattacccctactaacctaccgctatttaaaaatatccgcgtaaaaacgtttattaccgaacgaacactaacaaacgcgacaaatccgacgcaaataactaacgatttccatacgcaaatcgacgctatctaaaaaaatacgcgtacg

SEQ ID NO: 26003 - DNA, 557 bp, Artificial Sequence
  chemically treated genomic DNA (Homo sapiens) CpG-island No: 26003
tcggtaatgatatgtttaatttttttttaagttgtttgaaagttttgcgcgaatagtgttcggataaaattatcgttgttgattggaaggtcgtcgacgttggtgaaacgttcgcgtaatatgcgtttggcgtaggcgttaattggatgattattatttgcgtcgcgtcgttcgcgacggtagaaaaaggttacgtaatggtataacgttgcgggggtgaaatttagatagagttgttcggtaattggacgttggacgacgttcgcgattggtatcgtattggcgtgcggtaggttatttattatcgcggtcgtgatgtataggttagcgggtaatagtggggcgaagtcgatttggtacgtatgaaggcgtttttagatatcggttttgagttttttattattggcgggattatttttgttgatttgtcgttgtttaaagatattcgcgtgaaagcgtttattgtcgggcgggtattggtaggcgcggtaaattcggcgtaagtggttggcgatttttatgcgtaaatcgacgttatttggggaggtgcgcgtgcg

SEQ ID NO: 26004 - DNA, 557 bp, Artificial Sequence
  chemically treated genomic DNA (Homo sapiens) CpG-island No: 26004
cgcacgcgcacctccccaaataacgtcgatttacgcataaaaatcgccaaccacttacgccgaatttaccgcgcctaccaatacccgcccgacaataaacgctttcacgcgaatatctttaaacaacgacaaatcaacaaaaataatcccgccaataataaaaaactcaaaaccgatatctaaaaacgccttcatacgtaccaaatcgacttcgccccactattacccgctaacctatacatcacgaccgcgataataaataacctaccgcacgccaatacgataccaatcgcgaacgtcgtccaacgtccaattaccgaacaactctatctaaatttcacccccgcaacgttataccattacgtaacctttttctaccgtcgcgaacgacgcgacgcaaataataatcatccaattaacgcctacgccaaacgcatattacgcgaacgtttcaccaacgtcgacgaccttccaatcaacaacgataattttatccgaacactattcgcgcaaaactttcaaacaacttaaaaaaaaattaaacatatcattaccga

SEQ ID NO: 26005 - DNA, 600 bp, Artificial Sequence
  chemically treated genomic DNA (Homo sapiens) CpG-island No: 26005
cgaagtgggtattattttgtgcgtgggcgaaggcgtgcgtgcggttcgtgatttgaaagcgttttattcgtataaaatcgtattggtagacgttaaaattgtcgatgtaggtaaaattttttcgcgtatgtgtttcgaagttaacgttgattgggtgacggtaatttgttgtgcggatattaatatcgttaaaggcgcgttggacgtggtaaaagagtttaacggcgacgtgtagatcgaattgatcggttattggatttgggaataggcgtaatagtggcgcgatgtaggtattgggtaggtggtttattatcgtagtcgtgacgcgtaggtcgtacggtgagcgtggggcgaacgggatattatcgcgattaaacgttttttcgatatgggttttaaagttatcgttatcggaggtttggcgttggaagatttgtcgttgtttaagggtatttcgatttacgtttttatcgcgggtcgtagtattcgtgatgtcgtttttttcggtggaagtcgtacgttagtttaaacgttttatcgttgaattgtggggttaaagagcggatatgttgtttaaaataaatttcgtttggtatttat

SEQ ID NO: 26006 - DNA, 600 bp, Artificial Sequence
  chemically treated genomic DNA (Homo sapiens) CpG-island No: 26006
ataaataccaaacgaaatttattttaaacaacatatccgctctttaaccccacaattcaacgataaaacgtttaaactaacgtacgacttccaccgaaaaaaacgacatcacgaatactacgacccgcgataaaaacgtaaatcgaaatacccttaaacaacgacaaatcttccaacgccaaacctccgataacgataactttaaaacccatatcgaaaaaacgtttaatcgcgataatatcccgttcgccccacgctcaccgtacgacctacgcgtcacgactacgataataaaccacctacccaatacctacatcgcgccactattacgcctattcccaaatccaataaccgatcaattcgatctacacgtcgccgttaaactcttttaccacgtccaacgcgcctttaacgatattaatatccgcacaacaaattaccgtcacccaatcaacgttaacttcgaaacacatacgcgaaaaaattttacctacatcgacaattttaacgtctaccaatacgattttatacgaataaaacgctttcaaatcacgaaccgcacgcacgccttcgcccacgcacaaaataatacccacttcg

SEQ ID NO: 26007 - DNA, 600 bp, Artificial Sequence
  chemically treated genomic DNA (Homo sapiens) CpG-island No: 26007
atagatgttaagcgggatttgttttggataatatattcgttttttagttttatagtttagcgatggaacgtttgaattgacgtgcggtttttatcgggagaagcggtattacggatattacggttcgcgataaagacgtgaatcggaatatttttgaatagcggtagattttttagcgttaggttttcggtgacggtgattttgaagtttatatcggaaagacgtttgatcgcggtgatgtttcgttcgttttacgtttatcgtgcggtttgcgcgttacggttgcggtgataaattatttgtttaatgtttgtatcgcgttattgttgcgtttgtttttaggtttagtaatcggttagttcgatttgtacgtcgtcgttaaatttttttgttacgtttagcgcgtttttggcggtgttgatattcgtatagtaaattatcgttatttagttagcgttggtttcgaagtatatacgcgaaaggattttgtttgtatcggtaattttggcgtttgttagtacgattttgtgcgggtagagcgtttttaggttacgaatcgtacgtacgttttcgtttacgtatagaatggtgtttatttcg

SEQ ID NO: 26008 - DNA, 600 bp, Artificial Sequence
  chemically treated genomic DNA (Homo sapiens) CpG-island No: 26008
cgaaataaacaccattctatacgtaaacgaaaacgtacgtacgattcgtaacctaaaaacgctctacccgcacaaaatcgtactaacaaacgccaaaattaccgatacaaacaaaatcctttcgcgtatatacttcgaaaccaacgctaactaaataacgataatttactatacgaatatcaacaccgccaaaaacgcgctaaacgtaacaaaaaaatttaacgacgacgtacaaatcgaactaaccgattactaaacctaaaaacaaacgcaacaataacgcgatacaaacattaaacaaataatttatcaccgcaaccgtaacgcgcaaaccgcacgataaacgtaaaacgaacgaaacatcaccgcgatcaaacgtctttccgatataaacttcaaaatcaccgtcaccgaaaacctaacgctaaaaaatctaccgctattcaaaaatattccgattcacgtctttatcgcgaaccgtaatatccgtaataccgcttctcccgataaaaaccgcacgtcaattcaaacgttccatcgctaaactataaaactaaaaaacgaatatattatccaaaacaaatcccgcttaacatctat

SEQ ID NO: 26009 - DNA, 524 bp, Artificial Sequence
  chemically treated genomic DNA (Homo sapiens) CpG-island No: 26009
atcgtcgggattacgtttggcgattcgatggcgtatttggtggtatcgtcgttggaagcgatttatggtattgatgtagttttgaagtttgtcgacgtatagttggcgatttatgtttcgttatcgtttgaaattaattattcggtagtatttttaatcggtagttaggtagcgtgtaaagtagtttgtaacgtttttatcgatgtagtgttggaaatcgcgcgtaatttaatttagcgtgcgtaacggaggttgtcgatgattaatgtattgggattgttggaagtggacggtatggtcgtcgcgatagatgtagcggatgttatgtttaaagtagttaagagattaaaaagggatgtttaacgagttggatgaagaatcgttatcgcgtcgtcgtattcgtcgtttacgtaaacgcgtattacgtcgtgagggtatcgtatgatagtggcgtatattgttataggtagtaatttggttttttcgttggagtaggttaatgttgttttgaaagtattaggcga

SEQ ID NO: 26010 - DNA, 524 bp, Artificial Sequence
  chemically treated genomic DNA (Homo sapiens) CpG-island No: 26010
tcgcctaatactttcaaaacaacattaacctactccaacgaaaaaaccaaattactacctataacaatatacgccactatcatacgataccctcacgacgtaatacgcgtttacgtaaacgacgaatacgacgacgcgataacgattcttcatccaactcgttaaacatccctttttaatctcttaactactttaaacataacatccgctacatctatcgcgacgaccataccgtccacttccaacaatcccaatacattaatcatcgacaacctccgttacgcacgctaaattaaattacgcgcgatttccaacactacatcgataaaaacgttacaaactactttacacgctacctaactaccgattaaaaatactaccgaataattaatttcaaacgataacgaaacataaatcgccaactatacgtcgacaaacttcaaaactacatcaataccataaatcgcttccaacgacgataccaccaaatacgccatcgaatcgccaaacgtaatcccgacgat

SEQ ID NO: 26011 - DNA, 524 bp, Artificial Sequence
  chemically treated genomic DNA (Homo sapiens) CpG-island No: 26011
tcgtttaatgtttttagggtagtattgatttgttttagcggagaggttagattgttgtttatggtaatatacgttattgttatgcggtatttttacgacgtggtgcgcgtttgcgtggacgacgagtacgacgacgcggtgacggttttttatttagttcgttgagtatttttttttggttttttagttgttttgagtatggtattcgttgtatttatcgcggcgattatgtcgtttatttttagtaattttagtgtattgattatcggtaattttcgttacgtacgttggattggattacgcgcgatttttagtattgtatcggtaaaggcgttataggttgttttatacgttgtttggttatcggttaaaaatgttgtcgagtagttggttttagacggtggcgggatataggtcgttagttgtacgtcggtagattttagggttgtattaatgttataggtcgtttttagcggcggtgttattagatacgttatcggatcgttaagcgtgatttcggcggt

SEQ ID NO: 26012 - DNA, 524 bp, Artificial Sequence
  chemically treated genomic DNA (Homo sapiens) CpG-island No: 26012
accgccgaaatcacgcttaacgatccgataacgtatctaataacaccgccgctaaaaacgacctataacattaatacaaccctaaaatctaccgacgtacaactaacgacctatatcccgccaccgtctaaaaccaactactcgacaacatttttaaccgataaccaaacaacgtataaaacaacctataacgcctttaccgatacaatactaaaaatcgcgcgtaatccaatccaacgtacgtaacgaaaattaccgataatcaatacactaaaattactaaaaataaacgacataatcgccgcgataaatacaacgaataccatactcaaaacaactaaaaaaccaaaaaaaaatactcaacgaactaaataaaaaaccgtcaccgcgtcgtcgtactcgtcgtccacgcaaacgcgcaccacgtcgtaaaaataccgcataacaataacgtatattaccataaacaacaatctaacctctccgctaaaacaaatcaatactaccctaaaaacattaaacga

SEQ ID NO: 26013 - DNA, 807 bp, Artificial Sequence
  chemically treated genomic DNA (Homo sapiens) CpG-island No: 26013
tagtcgcgtattggtaggcgaatcgcgtatcgacggtcgtgaaaaagatatgattcgtggtttggatgtgcgtattggcgtgtgtcgcgtatttacggttttgcgttgtttattcgtggtgaaacgtaggcgttggttatcgtaacgttgggtattgttcgtgacgcgtaggtttttgatgaattgatgggcgaacgtatcgatatttttttgttttattataattttttttcgtatttcgtaggcgaaatcggtatggtcggtttttcgaagcgtcgtgaaattgggtacggtcgtttggcgaagcgcggcgtgttggtagttatgtcggatatggataaattttcgtatatcgtacgttttgtgtttgatattattgaatttaacggttttttttttatggttttcgtgtgtagcgcgtttttggcgttgatggacgtaggtgtgtcgattaaagttgtcgttattggtatcgtaatgggtttggtgaaacgaggcgataattacgatgtacggtttgatattttgggcgatgaagattatttgggcgatatggagtttatagtggtaggttttcgcgacggtatcgttgtattgtagatggatatcgaaatggtaggtattattaaagagattatgtaggttgcgttgaattaggttaaaggtgcgcgtttgtatattttgggcgtaatggaataggcgattaacgcgtcgcgtggcgatatttttgagttcgtatcgcgtatttatattattaagattaattcggataagattaaagatgttatcggtaaaggcggttttgta

SEQ ID NO: 26014 - DNA, 807 bp, Artificial Sequence
  chemically treated genomic DNA (Homo sapiens) CpG-island No: 26014
tacaaaaccgcctttaccgataacatctttaatcttatccgaattaatcttaataatataaatacgcgatacgaactcaaaaatatcgccacgcgacgcgttaatcgcctattccattacgcccaaaatatacaaacgcgcacctttaacctaattcaacgcaacctacataatctctttaataatacctaccatttcgatatccatctacaatacaacgataccgtcgcgaaaacctaccactataaactccatatcgcccaaataatcttcatcgcccaaaatatcaaaccgtacatcgtaattatcgcctcgtttcaccaaacccattacgataccaataacgacaactttaatcgacacacctacgtccatcaacgccaaaaacgcgctacacacgaaaaccataaaaaaaaaaccgttaaattcaataatatcaaacacaaaacgtacgatatacgaaaatttatccatatccgacataactaccaacacgccgcgcttcgccaaacgaccgtacccaatttcacgacgcttcgaaaaaccgaccataccgatttcgcctacgaaatacgaaaaaaaattataataaaacaaaaaaatatcgatacgttcgcccatcaattcatcaaaaacctacgcgtcacgaacaatacccaacgttacgataaccaacgcctacgtttcaccacgaataaacaacgcaaaaccgtaaatacgcgacacacgccaatacgcacatccaaaccacgaatcatatctttttcacgaccgtcgatacgcgattcgcctaccaatacgcgacta

SEQ ID NO: 26015 - DNA, 807 bp, Artificial Sequence
  chemically treated genomic DNA (Homo sapiens) CpG-island No: 26015
tatagaatcgtttttatcgataatatttttgattttgttcgggttgattttgatggtatggatacgcggtgcgaatttagagatatcgttacgcggcgcgttgatcgtttgttttattacgtttaggatatgtagacgcgtatttttagtttggtttagcgtaatttgtatgatttttttggtgatatttattatttcgatatttatttgtagtgtagcgatatcgtcgcgggaatttgttattgtgaattttatatcgtttaggtgatttttatcgtttaaaatgttagatcgtatatcgtagttgtcgtttcgttttattagatttattgcgatattagtaacggtagttttgatcggtatatttgcgtttattagcgttagagacgcgttgtatacggaagttatagaagaggaatcgttggatttagtgatattagatataagacgtacggtgtacgggaatttgtttatattcggtatgattgttagtacgtcgcgtttcgttagacgatcgtgtttaattttacgacgtttcggagaatcgattatgtcggtttcgtttacggagtacggagggaagttgtagtggaataggaaggtatcggtacgttcgtttattagtttattaagaatttgcgcgttacgagtagtatttagcgttgcggtaattagcgtttgcgttttattacgggtgaatagcgtagaatcgtgagtacgcggtatacgttagtacgtatatttagattacggattatattttttttacgatcgtcgatacgcggttcgtttgttagtacgcggtta

SEQ ID NO: 26016 - DNA, 807 bp, Artificial Sequence
  chemically treated genomic DNA (Homo sapiens) CpG-island No: 26016
taaccgcgtactaacaaacgaaccgcgtatcgacgatcgtaaaaaaaatataatccgtaatctaaatatacgtactaacgtataccgcgtactcacgattctacgctattcacccgtaataaaacgcaaacgctaattaccgcaacgctaaatactactcgtaacgcgcaaattcttaataaactaataaacgaacgtaccgataccttcctattccactacaacttccctccgtactccgtaaacgaaaccgacataatcgattctccgaaacgtcgtaaaattaaacacgatcgtctaacgaaacgcgacgtactaacaatcataccgaatataaacaaattcccgtacaccgtacgtcttatatctaatatcactaaatccaacgattcctcttctataacttccgtatacaacgcgtctctaacgctaataaacgcaaatataccgatcaaaactaccgttactaatatcgcaataaatctaataaaacgaaacgacaactacgatatacgatctaacattttaaacgataaaaatcacctaaacgatataaaattcacaataacaaattcccgcgacgatatcgctacactacaaataaatatcgaaataataaatatcaccaaaaaaatcatacaaattacgctaaaccaaactaaaaatacgcgtctacatatcctaaacgtaataaaacaaacgatcaacgcgccgcgtaacgatatctctaaattcgcaccgcgtatccataccatcaaaatcaacccgaacaaaatcaaaaatattatcgataaaaacgattctata

SEQ ID NO: 26017 - DNA, 591 bp, Artificial Sequence
  chemically treated genomic DNA (Homo sapiens) CpG-island No: 26017
  misc_feature (119)..(119): n is either a, c, g or t
  misc_feature (461)..(461): n is either a, c, g or t
gtttttgaggaattaggtttttaggcgcgggcgttgggggtcgatgtcgtcgtcggtattgatatcgattacgaaacggtcgggtaaaacggtagtatgttgatggttagcgttacggntacggcggtgaaaacgcgtcgatgagaagatttttttggttggtcgttgtcgttttgttattggtagggtgtgtaggcgaaaaaggtattgtcgagaaagagggatattagtttgatattcgacgttaggcgtaggcggcgtattcgcgtattaaagtgttggtgatttattatatcgtagatgattttgatagttcgttggcgatattgatcgataagtaggttagttcgtattatttggtttttgcggtattatcgcgatataacggtaaatcgcgtatttggtaattggtgtcggaataagaattggtttggtatgcggggattagcgtttggcgcggnggtaacgcgttttaacgatatttttattggtattgagttggaaaatcgtggttggtaaaaatcggtcggagtgaaatattttgtttcgtttgaatcggtatagatttaggcgtttattttattggcgaaa

SEQ ID NO: 26018 - DNA, 591 bp, Artificial Sequence
  chemically treated genomic DNA (Homo sapiens) CpG-island No: 26018
  misc_feature (131)..(131): n is either a, c, g or t
  misc_feature (473)..(473): n is either a, c, g or t
tttcgccaataaaataaacgcctaaatctataccgattcaaacgaaacaaaatatttcactccgaccgatttttaccaaccacgattttccaactcaataccaataaaaatatcgttaaaacgcgttaccnccgcgccaaacgctaatccccgcataccaaaccaattcttattccgacaccaattaccaaatacgcgatttaccgttatatcgcgataataccgcaaaaaccaaataatacgaactaacctacttatcgatcaatatcgccaacgaactatcaaaatcatctacgatataataaatcaccaacactttaatacgcgaatacgccgcctacgcctaacgtcgaatatcaaactaatatccctctttctcgacaatacctttttcgcctacacaccctaccaataacaaaacgacaacgaccaaccaaaaaaatcttctcatcgacgcgttttcaccgccgtanccgtaacgctaaccatcaacatactaccgttttacccgaccgtttcgtaatcgatatcaataccgacgacgacatcgacccccaacgcccgcgcctaaaaacctaattcctcaaaaac

SEQ ID NO: 26019 - DNA, 591 bp, Artificial Sequence
  chemically treated genomic DNA (Homo sapiens) CpG-island No: 26019
  misc_feature (131)..(131): n is either a, c, g or t
  misc_feature (473)..(473): n is either a, c, g or t
tttcgttagtggaataagcgtttgaatttgtgtcggtttaaacggggtaaaatattttatttcggtcgatttttgttagttacggttttttagtttaatgttaatagaggtgtcgttaaggcgcgttgttntcgcgttaggcgttaattttcgtatgttaggttagtttttgtttcggtattagttgttagatgcgcggtttatcgttgtatcgcggtggtatcgtagggattagataatgcgagttgatttgtttatcggttagtgtcgttagcgagttattaaaattatttgcggtgtagtggattattagtattttaatgcgcggatacgtcgtttgcgtttggcgtcgggtattaagttgatatttttttttttcgataatgtttttttcgtttgtatattttgttaataatagagcggtagcgattagttagaagaatttttttatcgacgcgtttttatcgtcgtantcgtgacgttaattattagtatattgtcgttttgttcgatcgtttcgtagtcgatattaatatcgacgacggtatcggtttttagcgttcgcgtttgggagtttaattttttaaaggt

SEQ ID NO: 26020 - DNA, 591 bp, Artificial Sequence
  chemically treated genomic DNA (Homo sapiens) CpG-island No: 26020
  misc_feature (119)..(119): n is either a, c, g or t
  misc_feature (461)..(461): n is either a, c, g or t
acctttaaaaaattaaactcccaaacgcgaacgctaaaaaccgataccgtcgtcgatattaatatcgactacgaaacgatcgaacaaaacgacaatatactaataattaacgtcacgantacgacgataaaaacgcgtcgataaaaaaattcttctaactaatcgctaccgctctattattaacaaaatatacaaacgaaaaaaacattatcgaaaaaaaaaaatatcaacttaatacccgacgccaaacgcaaacgacgtatccgcgcattaaaatactaataatccactacaccgcaaataattttaataactcgctaacgacactaaccgataaacaaatcaactcgcattatctaatccctacgataccaccgcgatacaacgataaaccgcgcatctaacaactaataccgaaacaaaaactaacctaacatacgaaaattaacgcctaacgcganaacaacgcgccttaacgacacctctattaacattaaactaaaaaaccgtaactaacaaaaatcgaccgaaataaaatattttaccccgtttaaaccgacacaaattcaaacgcttattccactaacgaaa

SEQ ID NO: 26021 - DNA, 564 bp, Artificial Sequence
  chemically treated genomic DNA (Homo sapiens) CpG-island No: 26021
ggtttcgaggtgcgttattgtattatcgaaacgtttacgcgtggcgttaagttgtgcgcgtagggtttttgttaaacgatattttagttgttgaatgcgcgtttgcgcgcgatgaattttcggttgtggattttgttgatttagtcgttgtgttaatcgttgttgttgttgttcggtacgtttaagttgattttttagcgtaaagtttattcgtttttgtaggcgtttaagtatggtttgttggcgtgttagtcggagttgcggatgttgttgttgtaatcggtgatgaatttgcgtaaagcgacgtgtgcggttggcgagataataatttatcgttatttttagtcgttgacgggtcgattgtatttggcgtagtaatttttgttgattacggtttattattttagcggcggtagacggcgttggcgtacgtagatcggtaataaaatcggtaatggttatattcgttttatgttcgacggcgttgataatcggaatgcggttggtaaaaatcgttcgtgacgcgttcgtcgttaaaattttataaattttttagatgtttaa

SEQ ID NO: 26022 - DNA, 564 bp, Artificial Sequence
  chemically treated genomic DNA (Homo sapiens) CpG-island No: 26022
ttaaacatctaaaaaatttataaaattttaacgacgaacgcgtcacgaacgatttttaccaaccgcattccgattatcaacgccgtcgaacataaaacgaatataaccattaccgattttattaccgatctacgtacgccaacgccgtctaccgccgctaaaataataaaccgtaatcaacaaaaattactacgccaaatacaatcgacccgtcaacgactaaaaataacgataaattattatctcgccaaccgcacacgtcgctttacgcaaattcatcaccgattacaacaacaacatccgcaactccgactaacacgccaacaaaccatacttaaacgcctacaaaaacgaataaactttacgctaaaaaatcaacttaaacgtaccgaacaacaacaacaacgattaacacaacgactaaatcaacaaaatccacaaccgaaaattcatcgcgcgcaaacgcgcattcaacaactaaaatatcgtttaacaaaaaccctacgcgcacaacttaacgccacgcgtaaacgtttcgataatacaataacgcacctcgaaacc

SEQ ID NO: 26023 - DNA, 564 bp, Artificial Sequence
  chemically treated genomic DNA (Homo sapiens) CpG-island No: 26023
ttaaatatttggaagatttatggagttttaacgacgaacgcgttacgggcgatttttattagtcgtatttcggttgttagcgtcgtcgggtatgagacggatgtgattattgtcgattttgttgtcgatttgcgtgcgttaacgtcgtttgtcgtcgttgaagtagtgagtcgtaattagtaagagttattgcgttaggtgtaatcgattcgttaacggttggagatggcgatggattattatttcgttaatcgtatacgtcgttttacgtaaatttattatcgattatagtaatagtattcgtagtttcggttggtacgttagtaaattatgtttgagcgtttgtaaaagcgaatgagttttgcgttggaaaattaatttaagcgtatcgggtaatagtagtagcggttaatatagcggttgaattagtaaaatttatagtcgaagatttatcgcgcgtaaacgcgtatttagtaattggaatatcgtttagtagaaattttgcgcgtatagtttagcgttacgcgtgaacgtttcggtaatgtagtaacgtatttcgaagtt

SEQ ID NO: 26024 - DNA, 564 bp, Artificial Sequence
  chemically treated genomic DNA (Homo sapiens) CpG-island No: 26024
aacttcgaaatacgttactacattaccgaaacgttcacgcgtaacgctaaactatacgcgcaaaatttctactaaacgatattccaattactaaatacgcgtttacgcgcgataaatcttcgactataaattttactaattcaaccgctatattaaccgctactactattacccgatacgcttaaattaattttccaacgcaaaactcattcgcttttacaaacgctcaaacataatttactaacgtaccaaccgaaactacgaatactattactataatcgataataaatttacgtaaaacgacgtatacgattaacgaaataataatccatcgccatctccaaccgttaacgaatcgattacacctaacgcaataactcttactaattacgactcactacttcaacgacgacaaacgacgttaacgcacgcaaatcgacaacaaaatcgacaataatcacatccgtctcatacccgacgacgctaacaaccgaaatacgactaataaaaatcgcccgtaacgcgttcgtcgttaaaactccataaatcttccaaatatttaa

SEQ ID NO: 26025 - DNA, 603 bp, Artificial Sequence
  chemically treated genomic DNA (Homo sapiens) CpG-island No: 26025
aatacggttgtttagttcgcgtttaaagtcgtttatcgcgtttaagtcgacgattaatatcgttacgtcgagggtaatgttaatggtagaaataacggagattagcgatattatgtcgtcgcgtcgtcgttcgcgattaaaacgtaggttaattaataacgataaaggtatcgttattatttcgtttttattaggtttagtttcgtcgttagacgattattacgtatttttaattggcggtttatacgtttcgttagttgtaggtcgtgagtaattattaggaaggcggtgttttgtaagcgatttaattttttaagtaattggaagatgttgtcggcgttacgcgtatcgaggttatcggtaggtttattcgttagtattaggcgcgggttatttattagcgtacgggtaatcgttatacgttggcgttcgtcgttagaaagtttagatgggcggtgattcgtacgatgatttagttttatcgtttttaatattttaagtgtacggttgttgattttagcgggtttttttttgttaattagtagcggtatagttacgttttttagggcggtaaaattcggtagtaggtggtgaaattgataa

SEQ ID NO: 26026 - DNA, 603 bp, Artificial Sequence
  chemically treated genomic DNA (Homo sapiens) CpG-island No: 26026
ttatcaatttcaccacctactaccgaattttaccgccctaaaaaacgtaactataccgctactaattaacaaaaaaaaacccgctaaaatcaacaaccgtacacttaaaatattaaaaacgataaaactaaatcatcgtacgaatcaccgcccatctaaactttctaacgacgaacgccaacgtataacgattacccgtacgctaataaataacccgcgcctaatactaacgaataaacctaccgataacctcgatacgcgtaacgccgacaacatcttccaattacttaaaaaattaaatcgcttacaaaacaccgccttcctaataattactcacgacctacaactaacgaaacgtataaaccgccaattaaaaatacgtaataatcgtctaacgacgaaactaaacctaataaaaacgaaataataacgatacctttatcgttattaattaacctacgttttaatcgcgaacgacgacgcgacgacataatatcgctaatctccgttatttctaccattaacattaccctcgacgtaacgatattaatcgtcgacttaaacgcgataaacgactttaaacgcgaactaaacaaccgtatt

SEQ ID NO: 26027 - DNA, 603 bp, Artificial Sequence
  chemically treated genomic DNA (Homo sapiens) CpG-island No: 26027
ttattagttttattatttgttgtcggattttatcgttttggaaaacgtggttatgtcgttgttgattggtaagaaaaagttcgttgaaattaatagtcgtgtatttgagatgttaaaagcggtggggttggattatcgtgcgaattatcgtttatttgaattttttggcggcgaacgttagcgtgtggcgattgttcgtgcgttggtgaataattcgcgtttggtattggcggatgaatttatcggtaatttcgatgcgcgtaacgtcgatagtattttttagttgtttggggaattgaatcgtttgtagggtatcgtttttttggtggttatttacgatttgtaattggcgaaacgtatgagtcgttagttagaaatgcgtgatggtcgtttgacggcggaattgagtttgatgggggcggagtaatggcgatgtttttatcgttattaattggtttgcgttttagtcgcggacggcggcgcggcggtatggtgtcgttgattttcgttatttttattattggtattgttttcggcgtggcggtattgatcgtcggtttaagcgcgatgaacggttttgaacgcgaattgaataatcgtatt

SEQ ID NO: 26028 - DNA, 603 bp, Artificial Sequence
  chemically treated genomic DNA (Homo sapiens) CpG-island No: 26028
aatacgattattcaattcgcgttcaaaaccgttcatcgcgcttaaaccgacgatcaataccgccacgccgaaaacaataccaataataaaaataacgaaaatcaacgacaccataccgccgcgccgccgtccgcgactaaaacgcaaaccaattaataacgataaaaacatcgccattactccgcccccatcaaactcaattccgccgtcaaacgaccatcacgcatttctaactaacgactcatacgtttcgccaattacaaatcgtaaataaccaccaaaaaaacgataccctacaaacgattcaattccccaaacaactaaaaaatactatcgacgttacgcgcatcgaaattaccgataaattcatccgccaataccaaacgcgaattattcaccaacgcacgaacaatcgccacacgctaacgttcgccgccaaaaaattcaaataaacgataattcgcacgataatccaaccccaccgcttttaacatctcaaatacacgactattaatttcaacgaactttttcttaccaatcaacaacgacataaccacgttttccaaaacgataaaatccgacaacaaataataaaactaataa

SEQ ID NO: 26029 - DNA, 555 bp, Artificial Sequence
  chemically treated genomic DNA (Homo sapiens) CpG-island No: 26029
taaggtttgttatcgtcgtatttgttcggtaacgtgtcgggtattgttattgtaaaatcgtattattatgatatttacgtttaatagataattttttattttacgttagattttggtggtttttagcggcgggtttgattttatcgttttgttgtattagttggtgtagtggcggacggaaaattcgggtgtcgttttgcgcgttatttatgtgtattacggtttaagtgttaatgtcgatgtttggggtacgtattgcgaaaacgttttttatcgtggagaatttcgttcgtttgatcgatatagttttcgtaagtttcgataatcgtttgatgttcgaggtaaatgttaataatgggtagtttgttacgtaagcggcgtgaggagtttcggtatataatcggtttcgttcggtatatcggggttaggagaaagtattagtatcggattgtttatggtcgttaggcgtttaattaaggtttgcgtcggaatatggttgcggtaaattattacgttatgtttattgttgcgtaattgatttgttaggttgtacgt

SEQ ID NO: 26030 - DNA, 555 bp, Artificial Sequence
  chemically treated genomic DNA (Homo sapiens) CpG-island No: 26030
acgtacaacctaacaaatcaattacgcaacaataaacataacgtaataatttaccgcaaccatattccgacgcaaaccttaattaaacgcctaacgaccataaacaatccgatactaatactttctcctaaccccgatataccgaacgaaaccgattatataccgaaactcctcacgccgcttacgtaacaaactacccattattaacatttacctcgaacatcaaacgattatcgaaacttacgaaaactatatcgatcaaacgaacgaaattctccacgataaaaaacgttttcgcaatacgtaccccaaacatcgacattaacacttaaaccgtaatacacataaataacgcgcaaaacgacacccgaattttccgtccgccactacaccaactaatacaacaaaacgataaaatcaaacccgccgctaaaaaccaccaaaatctaacgtaaaataaaaaattatctattaaacgtaaatatcataataatacgattttacaataacaatacccgacacgttaccgaacaaatacgacgataacaaacctta

SEQ ID NO: 26031 - DNA, 555 bp, Artificial Sequence
  chemically treated genomic DNA (Homo sapiens) CpG-island No: 26031
acgtataatttggtagattagttgcgtagtaatgggtataacgtggtgatttatcgtaattatatttcggcgtaaattttaattgaacgtttggcgattatgagtaattcggtgttgatgtttttttttggtttcggtgtgtcgagcgaagtcggttgtatgtcggaattttttacgtcgtttgcgtggtaagttgtttattattggtatttgtttcggatattaggcgattgtcgaagtttacgggggttatgtcggttaggcgggcgaaattttttacggtaaaggacgttttcgtaatgcgtattttaggtatcggtattggtatttaaatcgtgatgtatatgaatagcgcgtagagcgatattcggatttttcgttcgttattgtattaattgatgtagtagaacggtggagttaagttcgtcgttaaaggttattagaatttggcgtgaggtgagaagttgtttattgagcgtgagtgttatgatggtgcgattttatagtagtaatgttcggtacgttatcgggtaaatgcggcgatgataagtttta

SEQ ID NO: 26032 - DNA, 555 bp, Artificial Sequence
  chemically treated genomic DNA (Homo sapiens) CpG-island No: 26032
taaaacttatcatcgccgcatttacccgataacgtaccgaacattactactataaaatcgcaccatcataacactcacgctcaataaacaacttctcacctcacgccaaattctaataacctttaacgacgaacttaactccaccgttctactacatcaattaatacaataacgaacgaaaaatccgaatatcgctctacgcgctattcatatacatcacgatttaaataccaataccgatacctaaaatacgcattacgaaaacgtcctttaccgtaaaaaatttcgcccgcctaaccgacataacccccgtaaacttcgacaatcgcctaatatccgaaacaaataccaataataaacaacttaccacgcaaacgacgtaaaaaattccgacatacaaccgacttcgctcgacacaccgaaaccaaaaaaaaacatcaacaccgaattactcataatcgccaaacgttcaattaaaatttacgccgaaatataattacgataaatcaccacgttatacccattactacgcaactaatctaccaaattatacgt

SEQ ID NO: 26033 - DNA, 585 bp, Artificial Sequence
  chemically treated genomic DNA (Homo sapiens) CpG-island No: 26033
gggacggcggtattgcgttagttcgagatgttggggagttattcgtttaatgagtcggtcgttattgttcgggcgcgtgataaattgcgttttatgtaattgttggcgcgttagggtatcgatttgtttgttacgggtattgcgtattcgtcggatgatattagcgatttaatcgatatggtcggtggtgcgtcgttggtggttaagttggttgaaggtacgtagggaattggcgtcgtgttggcggagacgcgttaggcggcggaaagcgtgattgacgttttcgcggtttgaacgcgtatattttggtgtaggagtatattaaagaggcgtaagggtgcgatattcgttgtttggttgttggcgatgaagtggtcgttgcgattgtacggcgggcgatagagggcgattttcgttttatttgtatcgtgtcgcgcggtatcgtcgtagtgattatatattagagcgtgaatcgcgataatagcgcgcgaacgaatgttttggacgttgttgttgtggatatttttcgtgttattgtcggttcgtgtgtgatagtacgtgaatttgtggttgcggtttgagaga

SEQ ID NO: 26034 - DNA, 585 bp, Artificial Sequence
  chemically treated genomic DNA (Homo sapiens) CpG-island No: 26034
tctctcaaaccgcaaccacaaattcacgtactatcacacacgaaccgacaataacacgaaaaatatccacaacaacaacgtccaaaacattcgttcgcgcgctattatcgcgattcacgctctaatatataatcactacgacgataccgcgcgacacgatacaaataaaacgaaaatcgccctctatcgcccgccgtacaatcgcaacgaccacttcatcgccaacaaccaaacaacgaatatcgcacccttacgcctctttaatatactcctacaccaaaatatacgcgttcaaaccgcgaaaacgtcaatcacgctttccgccgcctaacgcgtctccgccaacacgacgccaattccctacgtaccttcaaccaacttaaccaccaacgacgcaccaccgaccatatcgattaaatcgctaatatcatccgacgaatacgcaatacccgtaacaaacaaatcgataccctaacgcgccaacaattacataaaacgcaatttatcacgcgcccgaacaataacgaccgactcattaaacgaataactccccaacatctcgaactaacgcaataccgccgtccc

SEQ ID NO: 26035 - DNA, 585 bp, Artificial Sequence
  chemically treated genomic DNA (Homo sapiens) CpG-island No: 26035
ttttttaagtcgtagttatagatttacgtgttattatatacggatcgataatagtacgaagaatatttataatagtaacgtttagagtattcgttcgcgcgttattatcgcgatttacgttttgatgtgtgattattgcgacgatgtcgcgcgatacgatgtaaatggaacgaaaatcgttttttatcgttcgtcgtataatcgtagcgattattttatcgttaataattagatagcggatatcgtatttttgcgtttttttgatatatttttgtattagaatatgcgcgtttagatcgcgaaagcgttaattacgtttttcgtcgtttgacgcgttttcgttagtacgacgttaattttttgcgtgtttttaattaatttgattattagcggcgtattatcgattatgtcgattaaatcgttggtattattcggcgaatgcgtaatgttcgtgataggtaggtcgatgttttgacgcgttagtagttgtatggaacgtaatttgttacgcgttcgggtaatggcgatcgatttattgagcggatagttttttagtatttcgaattggcgtagtgtcgtcgtttt

SEQ ID NO: 26036 - DNA, 585 bp, Artificial Sequence
  chemically treated genomic DNA (Homo sapiens) CpG-island No: 26036
aaaacgacgacactacgccaattcgaaatactaaaaaactatccgctcaataaatcgatcgccattacccgaacgcgtaacaaattacgttccatacaactactaacgcgtcaaaacatcgacctacctatcacgaacattacgcattcgccgaataataccaacgatttaatcgacataatcgataatacgccgctaataatcaaattaattaaaaacacgcaaaaaattaacgtcgtactaacgaaaacgcgtcaaacgacgaaaaacgtaattaacgctttcgcgatctaaacgcgcatattctaatacaaaaatatatcaaaaaaacgcaaaaatacgatatccgctatctaattattaacgataaaataatcgctacgattatacgacgaacgataaaaaacgattttcgttccatttacatcgtatcgcgcgacatcgtcgcaataatcacacatcaaaacgtaaatcgcgataataacgcgcgaacgaatactctaaacgttactattataaatattcttcgtactattatcgatccgtatataataacacgtaaatctataactacgacttaaaaaa

SEQ ID NO: 26037 - DNA, 1108 bp, Artificial Sequence
  chemically treated genomic DNA (Homo sapiens) CpG-island No: 26037
ggttagcgcgtagagtatattttttttttgttagatacgtatattatttaggcggttagtgcgatgttgggtacgtttgacgacgattaggcgttgtcgttggttgaagcgatggtcgaggttaacggcgagcgcgtaatggcgttgattaatgaagtcgttgttcgtggtatcgagtgggaagcgttgttggtggaaatgttcggtttgttgtatcgtattgcgatggtataattttcgtttgttgtatttggtaacgatatggtcgttatcgagttgcggatgcgtgaattggcgcgtattatatcgtcgacggatatttagttttattattagacgttgttgattggtcgtaaagaattatcgtatgcgtcggatcgtcgtatgggcgttgagatgacgttgttgcgcgcgttggtattttattcgcgtatgtcgttgtttgagttagaagtgttacgatagttttttgtattcgtcgcgttaacggtagtaatgacgttaatttaggtgtcgtcgtaatcgtaattagcgtcgtagtaggtatcgattgtatcgttttcggaaattattagttaggtgttggcggcgcgttagtagttgtagcgcgtgtagggagtaattaaagtaaaaaagagtgaatcggtagtcgttattcgcgcgcggtcggtgaataacgttgcgttggaaagattggtttcggttatcgatcgcgtttaggcgcgttcggtgttatcggcgttggaaaaagcgttagttaaaaaagaagcgtatcgttggaaggcgattatttcggtgatgtagtaaaaagaagtggtcgttacgtcgaacgtatgaaaaaagcgttggaatatgaaaaaacgtcggaattggcggcgaattgagcggtagaagttattgagcgcgattcgtgggcggtataggtgagttaattttcgttattaaaattggtcgaataggtggcgttaaatgtttggaaagaggagagcgataacgtagtatgtttgtatttgcgttttttttagcggtatttgaataatcgcggtgtatagtaaaaattggttgaagcgttgagtatgttaaataggttaacggttgaattgattat

SEQ ID NO: 26038 - DNA, 1108 bp, Artificial Sequence
  chemically treated genomic DNA (Homo sapiens) CpG-island No: 26038
ataatcaattcaaccgttaacctatttaacatactcaacgcttcaaccaatttttactatacaccgcgattattcaaataccgctaaaaaaaacgcaaatacaaacatactacgttatcgctctcctctttccaaacatttaacgccacctattcgaccaattttaataacgaaaattaactcacctataccgcccacgaatcgcgctcaataacttctaccgctcaattcgccgccaattccgacgttttttcatattccaacgcttttttcatacgttcgacgtaacgaccacttctttttactacatcaccgaaataatcgccttccaacgatacgcttcttttttaactaacgctttttccaacgccgataacaccgaacgcgcctaaacgcgatcgataaccgaaaccaatctttccaacgcaacgttattcaccgaccgcgcgcgaataacgactaccgattcactcttttttactttaattactccctacacgcgctacaactactaacgcgccgccaacacctaactaataatttccgaaaacgatacaatcgatacctactacgacgctaattacgattacgacgacacctaaattaacgtcattactaccgttaacgcgacgaatacaaaaaactatcgtaacacttctaactcaaacaacgacatacgcgaataaaataccaacgcgcgcaacaacgtcatctcaacgcccatacgacgatccgacgcatacgataattctttacgaccaatcaacaacgtctaataataaaactaaatatccgtcgacgatataatacgcgccaattcacgcatccgcaactcgataacgaccatatcgttaccaaatacaacaaacgaaaattataccatcgcaatacgatacaacaaaccgaacatttccaccaacaacgcttcccactcgataccacgaacaacgacttcattaatcaacgccattacgcgctcgccgttaacctcgaccatcgcttcaaccaacgacaacgcctaatcgtcgtcaaacgtacccaacatcgcactaaccgcctaaataatatacgtatctaacaaaaaaaaaatatactctacgcgctaacc

SEQ ID NO: 26039 - DNA, 1108 bp, Artificial Sequence
  chemically treated genomic DNA (Homo sapiens) CpG-island No: 26039
atagttagtttaatcgttgatttgtttaatatgtttaacgttttagttagtttttgttgtgtatcgcggttgtttaaatgtcgttgagaggagcgtaaatgtagatatattgcgttgtcgtttttttttttttaggtatttaacgttatttgttcgattagttttggtagcgaaagttggtttatttgtgtcgtttacgggtcgcgtttaatggtttttgtcgtttagttcgtcgttagtttcggcgtttttttatgttttagcgttttttttatgcgttcggcgtggcgattatttttttttgttgtattatcggagtggtcgttttttagcgatacgttttttttttggttggcgttttttttagcgtcgatggtatcggacgcgtttgaacgcgatcggtgatcgaagttagtttttttagcgtagcgttatttatcggtcgcgcgcgggtagcggttgtcggtttatttttttttgttttggttgttttttgtacgcgttgtaattgttggcgcgtcgttagtatttggttggtggttttcgggagcggtatagtcggtgtttgttgcggcgttgattgcggttgcggcggtatttgggttggcgttattattgtcgttggcgcgacgggtgtaaaggattgtcgtggtatttttggtttaggtagcggtatacgcggatggaatgttagcgcgcgtagtagcgttattttaacgtttatgcgacggttcggcgtatacggtaattttttgcgattaattaatagcgtttgatagtaaagttgaatattcgtcggcggtatggtgcgcgttagtttacgtattcgtagttcgatggcggttatgtcgttgttaagtgtagtaggcgaaagttgtattatcgtaatacgatgtaataggtcgagtatttttattagtaacgttttttattcgatattacgggtagcggttttattaattagcgttattacgcgttcgtcgttggtttcgattatcgttttaattagcgatagcgtttgatcgtcgttaagcgtatttagtatcgtattgatcgtttggatgatatacgtgtttggtaggaagaagatgtgttttacgcgttgatt

SEQ ID NO: 26040 - DNA, 1108 bp, Artificial Sequence
  chemically treated genomic DNA (Homo sapiens) CpG-island No: 26040
aatcaacgcgtaaaacacatcttcttcctaccaaacacgtatatcatccaaacgatcaatacgatactaaatacgcttaacgacgatcaaacgctatcgctaattaaaacgataatcgaaaccaacgacgaacgcgtaataacgctaattaataaaaccgctacccgtaatatcgaataaaaaacgttactaataaaaatactcgacctattacatcgtattacgataatacaactttcgcctactacacttaacaacgacataaccgccatcgaactacgaatacgtaaactaacgcgcaccataccgccgacgaatattcaactttactatcaaacgctattaattaatcgcaaaaaattaccgtatacgccgaaccgtcgcataaacgttaaaataacgctactacgcgcgctaacattccatccgcgtataccgctacctaaaccaaaaataccacgacaatcctttacacccgtcgcgccaacgacaataataacgccaacccaaataccgccgcaaccgcaatcaacgccgcaacaaacaccgactataccgctcccgaaaaccaccaaccaaatactaacgacgcgccaacaattacaacgcgtacaaaaaacaaccaaaacaaaaaaaaataaaccgacaaccgctacccgcgcgcgaccgataaataacgctacgctaaaaaaactaacttcgatcaccgatcgcgttcaaacgcgtccgataccatcgacgctaaaaaaaacgccaaccaaaaaaaaaacgtatcgctaaaaaacgaccactccgataatacaacaaaaaaaaataatcgccacgccgaacgcataaaaaaaacgctaaaacataaaaaaacgccgaaactaacgacgaactaaacgacaaaaaccattaaacgcgacccgtaaacgacacaaataaaccaactttcgctaccaaaactaatcgaacaaataacgttaaatacctaaaaaaaaaaaaacgacaacgcaatatatctacatttacgctcctctcaacgacatttaaacaaccgcgatacacaacaaaaactaactaaaacgttaaacatattaaacaaatcaacgattaaactaactat

SEQ ID NO: 26041 - DNA, 1296 bp, Artificial Sequence
  chemically treated genomic DNA (Homo sapiens) CpG-island No: 26041
atttgcgtcgtggcgataaagtgaaagtggtttttcgtcgtggcgaagtgatttcgattgttgaaacgcgcggtcgtaatcgttcgttatagggtttggtgtatatgtcgtttttcgacgtcgtatagttggttaataaattgacgttggatgcgatcgattcgttttcgaaagagacggattttaagaagtgcgcggttaaattggagaaggtgtaagttattatgtttcggttagcgaaattttaaaatggtcgtcgtcgttttttgcgcgatgtcgttcgtatagtaggcgggttggttgtcgtgggtgtggcgttggggttataatagtaaatcgtacgcgtatttggcgtgcggttgcgttcgttcggagttataaacgagaacgtttttgttagtgtttgtgtgcgttgcggttagtgtgtttaggtttgtttttacgatattttaaaattggcgacgttggtttttggtttgtcggcgggtacgttatattttgtcgtacgggatattttttgcgaaatgtgtgaggatatttcgtgcgttaaagtgtgtttaagcggtgcgttggatcgtgagattgaatcgatcgacgacgcgcggattgggttggcggtattggtggattagggaaaattgttttaattttttaggggttgcgttgcgatgtttgtatcgcgaatgttcgaaaattgatgaggttattattttggagttggagcgtaatacgcgtatcggtaagtacgttcgttttttgtcgacggtttatagcgacgtttgtatcggttgcggtaagtgcgaaaaagtatgcgtgttggaataatcggtaattaaggtgttatcgttgttattggcgaaaggggagttaggttattattatcgtttcggttggttggaggggaataatggtaaatcgtaaacgtgacgtcgggcgcgaggcgttggagaaaaaaggttggtggcgtagttatcgttggttggtgttacgtcgtttttgttagtttttcgtgttggggatgtttttgagcggtttatggtttggtgtgtggattttgtacggtaattatagtagtagtttgttattcgatatcgtttcgttgatcgattcgttgatgacgttgtaaagttttgttagtggttatttgtttgttacggtggcgttgatcggtgcggtgattattatcgtgttttacgttttggcgggaaagcgattattttgtagttgttacgtttggaaatgtagatgcgcggtatcggtgattatattatttagatcgaaaattattttttgtag

SEQ ID NO: 26042 - DNA, 1296 bp, Artificial Sequence
  chemically treated genomic DNA (Homo sapiens) CpG-island No: 26042
ctacaaaaaataattttcgatctaaataatataatcaccgataccgcgcatctacatttccaaacgtaacaactacaaaataatcgctttcccgccaaaacgtaaaacacgataataatcaccgcaccgatcaacgccaccgtaacaaacaaataaccactaacaaaactttacaacgtcatcaacgaatcgatcaacgaaacgatatcgaataacaaactactactataattaccgtacaaaatccacacaccaaaccataaaccgctcaaaaacatccccaacacgaaaaactaacaaaaacgacgtaacaccaaccaacgataactacgccaccaaccttttttctccaacgcctcgcgcccgacgtcacgtttacgatttaccattattcccctccaaccaaccgaaacgataataataacctaactcccctttcgccaataacaacgataacaccttaattaccgattattccaacacgcatactttttcgcacttaccgcaaccgatacaaacgtcgctataaaccgtcgacaaaaaacgaacgtacttaccgatacgcgtattacgctccaactccaaaataataacctcatcaattttcgaacattcgcgatacaaacatcgcaacgcaacccctaaaaaattaaaacaattttccctaatccaccaataccgccaacccaatccgcgcgtcgtcgatcgattcaatctcacgatccaacgcaccgcttaaacacactttaacgcacgaaatatcctcacacatttcgcaaaaaatatcccgtacgacaaaatataacgtacccgccgacaaaccaaaaaccaacgtcgccaattttaaaatatcgtaaaaacaaacctaaacacactaaccgcaacgcacacaaacactaacaaaaacgttctcgtttataactccgaacgaacgcaaccgcacgccaaatacgcgtacgatttactattataaccccaacgccacacccacgacaaccaacccgcctactatacgaacgacatcgcgcaaaaaacgacgacgaccattttaaaatttcgctaaccgaaacataataacttacaccttctccaatttaaccgcgcacttcttaaaatccgtctctttcgaaaacgaatcgatcgcatccaacgtcaatttattaaccaactatacgacgtcgaaaaacgacatatacaccaaaccctataacgaacgattacgaccgcgcgtttcaacaatcgaaatcacttcgccacgacgaaaaaccactttcactttatcgccacgacgcaaat

SEQ ID NO: 26043 - DNA, 1296 bp, Artificial Sequence
  chemically treated genomic DNA (Homo sapiens) CpG-island No: 26043
ttgtaaggggtaattttcgatttggatggtgtaattatcgatatcgcgtatttgtatttttaggcgtggtagttgtaaaataatcgttttttcgttaggacgtagagtacggtgataattatcgtatcggttaacgttatcgtggtaggtagatgattattggtaagattttgtagcgttattagcggatcggttagcggaacggtgtcgaataataggttattgttgtagttgtcgtgtaagatttatatattaaattatggatcgtttaaaaatatttttagtacgaagaattgataaaggcgacgtaatattagttaacggtgattgcgttattagttttttttttttagcgtttcgcgttcggcgttacgtttacgatttgttattgtttttttttagttagtcgaagcggtaatggtgatttaatttttttttcgttagtgatagcggtaatattttgattgtcggttgttttagtacgtatattttttcgtatttatcgtaatcggtataggcgtcgttgtgaatcgtcggtagaaagcgggcgtgtttatcggtacgcgtgttgcgttttagttttagggtgatggttttattaattttcgggtattcgcgatataaatatcgtagcgtagtttttgaaaagttgagatagttttttttggtttattagtatcgttagtttaattcgcgcgtcgtcgatcgatttaattttacgatttagcgtatcgtttgggtatattttggcgtacggaatgtttttatatatttcgtaaggaatatttcgtgcgataaaatatggcgtgttcgtcgatagattagaggttagcgtcgttagttttaaggtgtcgtaagggtaagtttgaatatattgatcgtaacgtatataggtattggtaaaggcgttttcgtttatggtttcgggcgggcgtaatcgtacgttagatgcgcgtgcggtttgttgttgtaattttagcgttatatttacggtagttagttcgtttgttgtgcgaacgatatcgcgtagaaagcggcggcgattattttgaggtttcgttgatcgggatataatggtttatattttttttagtttgatcgcgtattttttgaagttcgtttttttcgagagcggatcggtcgtatttagcgttagtttgttaattaattgtgcggcgtcgaagaacggtatgtatattaggttttgtggcggacggttacgatcgcgcgttttaataatcgagattatttcgttacggcgagaaattatttttattttgtcgttacggcgtagat

SEQ ID NO: 26044 - DNA, 1296 bp, Artificial Sequence
  chemically treated genomic DNA (Homo sapiens) CpG-island No: 26044
atctacgccgtaacgacaaaataaaaataatttctcgccgtaacgaaataatctcgattattaaaacgcgcgatcgtaaccgtccgccacaaaacctaatatacataccgttcttcgacgccgcacaattaattaacaaactaacgctaaatacgaccgatccgctctcgaaaaaaacgaacttcaaaaaatacgcgatcaaactaaaaaaaatataaaccattatatcccgatcaacgaaacctcaaaataatcgccgccgctttctacgcgatatcgttcgcacaacaaacgaactaactaccgtaaatataacgctaaaattacaacaacaaaccgcacgcgcatctaacgtacgattacgcccgcccgaaaccataaacgaaaacgcctttaccaatacctatatacgttacgatcaatatattcaaacttacccttacgacaccttaaaactaacgacgctaacctctaatctatcgacgaacacgccatattttatcgcacgaaatattccttacgaaatatataaaaacattccgtacgccaaaatatacccaaacgatacgctaaatcgtaaaattaaatcgatcgacgacgcgcgaattaaactaacgatactaataaaccaaaaaaaactatctcaacttttcaaaaactacgctacgatatttatatcgcgaatacccgaaaattaataaaaccatcaccctaaaactaaaacgcaacacgcgtaccgataaacacgcccgctttctaccgacgattcacaacgacgcctataccgattacgataaatacgaaaaaatatacgtactaaaacaaccgacaatcaaaatattaccgctatcactaacgaaaaaaaaattaaatcaccattaccgcttcgactaactaaaaaaaaacaataacaaatcgtaaacgtaacgccgaacgcgaaacgctaaaaaaaaaaaactaataacgcaatcaccgttaactaatattacgtcgcctttatcaattcttcgtactaaaaatatttttaaacgatccataatttaatatataaatcttacacgacaactacaacaataacctattattcgacaccgttccgctaaccgatccgctaataacgctacaaaatcttaccaataatcatctacctaccacgataacgttaaccgatacgataattatcaccgtactctacgtcctaacgaaaaaacgattattttacaactaccacgcctaaaaatacaaatacgcgatatcgataattacaccatccaaatcgaaaattaccccttacaa

SEQ ID NO: 26045 - DNA, 816 bp, Artificial Sequence
  chemically treated genomic DNA (Homo sapiens) CpG-island No: 26045
  misc_feature (682)..(682): n is either a, c, g or t
taggcgttggaaagtgcggttaataacgcgttaatttggtttgttacgttttcggttgaacgcgtagtattttgtatcgcgttgtcgtgttgatggaaagttagatgtagtaattgattggtattttggtgcgtgaggtcggaaaaatttttagtaacgttattgtcgaagtgcgcgaagggtcgattttttttattattacgtcggataggtgcgggatgatttcgttaacgaaatttatcgtttattagggtttgtggtgtgtattagttcgtggaatttttcgttggttatttttatcgggtagatcgtcgtcgtattggcggtaggtaatagcgtgttggtaaaatcggtagaataaacgtcgttgattgtcgcgtaagggatcgttattttgttggaagcgggtgtatcgttaggcgtggtgtaattgttgttaggtcggggtgaaatcgtgggcgcgtaattgacgggtgatgatcgcgtgcgcggggtgatgtttatcggtttaatcgaagtcgttacgttattgtagcgtaatatcgttagtcgtttggacgtttagggtcgttttatttcgtttatcgttgaaatcggcggtatgaacgcgatgattgtcgattttttagtattgatcgaataggtcgtcgtggatgtaattggtttcggcgttcgagagttncggttagcgttgtttcgcgttgcgcgttttgtgtttgtaagatgagattgtcgattatacgttgaaaatgttgcgcgtgtttttaatatgaataaatcgggtgcgttgcgtcgtgtggtaatgggtgaaaaaga

SEQ ID NO: 26046 - DNA, 816 bp, Artificial Sequence
  chemically treated genomic DNA (Homo sapiens) CpG-island No: 26046
  misc_feature (135)..(135): n is either a, c, g or t
tctttttcacccattaccacacgacgcaacgcacccgatttattcatattaaaaacacgcgcaacattttcaacgtataatcgacaatctcatcttacaaacacaaaacgcgcaacgcgaaacaacgctaaccgnaactctcgaacgccgaaaccaattacatccacgacgacctattcgatcaatactaaaaaatcgacaatcatcgcgttcataccgccgatttcaacgataaacgaaataaaacgaccctaaacgtccaaacgactaacgatattacgctacaataacgtaacgacttcgattaaaccgataaacatcaccccgcgcacgcgatcatcacccgtcaattacgcgcccacgatttcaccccgacctaacaacaattacaccacgcctaacgatacacccgcttccaacaaaataacgatcccttacgcgacaatcaacgacgtttattctaccgattttaccaacacgctattacctaccgccaatacgacgacgatctacccgataaaaataaccaacgaaaaattccacgaactaatacacaccacaaaccctaataaacgataaatttcgttaacgaaatcatcccgcacctatccgacgtaataataaaaaaaatcgacccttcgcgcacttcgacaataacgttactaaaaatttttccgacctcacgcaccaaaataccaatcaattactacatctaactttccatcaacacgacaacgcgatacaaaatactacgcgttcaaccgaaaacgtaacaaaccaaattaacgcgttattaaccgcactttccaacgccta

SEQ ID NO: 26047 - DNA, 816 bp, Artificial Sequence
  chemically treated genomic DNA (Homo sapiens) CpG-island No: 26047
  misc_feature (135)..(135): n is either a, c, g or t
ttttttttatttattattatacggcgtagcgtattcggtttgtttatattgaaaatacgcgtagtatttttaacgtgtggtcggtaattttattttgtaggtatagaacgcgtagcgcgaaataacgttgatcgnaattttcgaacgtcgaggttagttatatttacgacgatttgttcggttagtgttgaagaatcgataattatcgcgtttatgtcgtcggttttagcgatgagcggaatagggcgattttgagcgtttaggcggttggcgatattgcgttgtagtaacgtagcgatttcggttgaatcggtaaatattatttcgcgtacgcgattattattcgttagttgcgcgtttacggttttatttcgatttggtagtaattgtattacgtttggcggtatattcgtttttagtaaaatggcgattttttgcgcggtaattagcggcgtttgttttgtcggttttgttagtacgttgttatttgtcgttagtgcggcggcgatttgttcggtgaaaatagttagcgggaagttttacggattgatatatattataggttttaatggacggtgggtttcgttagcgaaattatttcgtatttgttcggcgtagtagtggagaaaatcgatttttcgcgtatttcggtaatggcgttattgaaggttttttcggttttacgtattagaatattaattagttgttgtatttggttttttattagtacggtagcgcggtgtaaaatgttgcgcgtttagtcggaggcgtggtaaattagattggcgcgttattaatcgtattttttagcgtttg

SEQ ID NO: 26048 - DNA, 816 bp, Artificial Sequence
  chemically treated genomic DNA (Homo sapiens) CpG-island No: 26048
  misc_feature (682)..(682): n is either a, c, g or t
caaacgctaaaaaatacgattaataacgcgccaatctaatttaccacgcctccgactaaacgcgcaacattttacaccgcgctaccgtactaataaaaaaccaaatacaacaactaattaatattctaatacgtaaaaccgaaaaaaccttcaataacgccattaccgaaatacgcgaaaaatcgattttctccactactacgccgaacaaatacgaaataatttcgctaacgaaacccaccgtccattaaaacctataatatatatcaatccgtaaaacttcccgctaactattttcaccgaacaaatcgccgccgcactaacgacaaataacaacgtactaacaaaaccgacaaaacaaacgccgctaattaccgcgcaaaaaatcgccattttactaaaaacgaatataccgccaaacgtaatacaattactaccaaatcgaaataaaaccgtaaacgcgcaactaacgaataataatcgcgtacgcgaaataatatttaccgattcaaccgaaatcgctacgttactacaacgcaatatcgccaaccgcctaaacgctcaaaatcgccctattccgctcatcgctaaaaccgacgacataaacgcgataattatcgattcttcaacactaaccgaacaaatcgtcgtaaatataactaacctcgacgttcgaaaattncgatcaacgttatttcgcgctacgcgttctatacctacaaaataaaattaccgaccacacgttaaaaatactacgcgtattttcaatataaacaaaccgaatacgctacgccgtataataataaataaaaaaaa

SEQ ID NO: 26049 - DNA, 1576 bp, Artificial Sequence
  chemically treated genomic DNA (Homo sapiens) CpG-island No: 26049
  misc_feature (1497)..(1497): n is either a, c, g or t
agtcgagcgtggtcgttcgtagttcggttatattgtcgatgacgttcgttttttttttggttttgttttgatcgcgatgattacgttaattattaatagcgcgatatcgtttagcgttattagcggcggtatttgttggcggagtaaaaaggtgtatagtaaatttgttagcgtttcgaaaataattagcggttcgagaattattgtcggtaatagttggttggcgacgttttagtagagtgcgttaatttatgagtaaagtacggttatcgtaattattagattaataaatattagcggacgggggttaaagggtagggagaagttcggcgtttgcgtatttagttagtaataagcgacgagatagtcgataagtgaaatcggtagtgtgattagcgtttgcgttgttgtttatattatcggatgtttgtcgggattttttcgtagttagcgggcgttgcgtagggtatattacgtttagtagattacggaaattaacgttagtacgatgttagaggtataacgtgtttagttaaaatcggggagttcgtggtttaatttagtaatatttatatacgttaggtcgatgttaatataaattagtgttggggcgagttttttttacgcgagtttgtcgtcgcgttggttataaagtagattggtaaagataggaatgattatcggtagggtgtcgataattatcgtggaaataggcgcgttagtacgttgaatggtattggtaaggtagaagtaatagatgaggttgtttattatagtgagtattaaggcggtaagttagtcgcgacgcgttaattgacgtagacgtacgcgttttagttaggtaatgggtagcgtaattaattttaacgttagataacgttttatcgattgtaatatttgcgtattttatttacgatgataaatatcggggtcggatcggtggcgtatcgttatacgggtcgatcggaaatttgttatcgttacgatagcgacgggcgggtgatagaatagttaaattcggtaggtttaagttatacgtattagtatgagaaggatcgtattattattatcgatagtttgaatcgtcgtgaagttttgtatacgtagggtgaaggcgggttgaagcgggtggtgaaaaaggaatacgcggacggtagcgttacgtagagttagtttgacgcggtgggtaggtttagggtatagacggatgtcgtagtaggataatagaatatagttcggatgtggtgacgggttttattacgcgtattattacgtcggatggtagggtatcggcgttttattataattattatagttagttaacgttagttatcgggtttgacgggttggaaatacgtcgggaatatgatgaatggggtcgtttgatttaggaaattgtttttgacggcgatattattcgttatcgttatgataatttatatagtgatttattttgcgtaacggaagatgttatcggtagtcggaaaattatgacgntgagtcgttacggttagttgttgagttttattgattgtttcggttatgtaatcgttatgattatgatcgtttttgttat

SEQ ID NO: 26050 - DNA, 1576 bp, Artificial Sequence
  chemically treated genomic DNA (Homo sapiens) CpG-island No: 26050
  misc_feature (80)..(80): n is either a, c, g or t
ataacaaaaacgatcataatcataacgattacataaccgaaacaatcaataaaactcaacaactaaccgtaacgactcancgtcataattttccgactaccgataacatcttccgttacgcaaaataaatcactatataaattatcataacgataacgaataatatcgccgtcaaaaacaatttcctaaatcaaacgaccccattcatcatattcccgacgtatttccaacccgtcaaacccgataactaacgttaactaactataataattataataaaacgccgataccctaccatccgacgtaataatacgcgtaataaaacccgtcaccacatccgaactatattctattatcctactacgacatccgtctataccctaaacctacccaccgcgtcaaactaactctacgtaacgctaccgtccgcgtattcctttttcaccacccgcttcaacccgccttcaccctacgtatacaaaacttcacgacgattcaaactatcgataataataatacgatccttctcatactaatacgtataacttaaacctaccgaatttaactattctatcacccgcccgtcgctatcgtaacgataacaaatttccgatcgacccgtataacgatacgccaccgatccgaccccgatatttatcatcgtaaataaaatacgcaaatattacaatcgataaaacgttatctaacgttaaaattaattacgctacccattacctaactaaaacgcgtacgtctacgtcaattaacgcgtcgcgactaacttaccgccttaatactcactataataaacaacctcatctattacttctaccttaccaataccattcaacgtactaacgcgcctatttccacgataattatcgacaccctaccgataatcattcctatctttaccaatctactttataaccaacgcgacgacaaactcgcgtaaaaaaaactcgccccaacactaatttatattaacatcgacctaacgtatataaatattactaaattaaaccacgaactccccgattttaactaaacacgttatacctctaacatcgtactaacgttaatttccgtaatctactaaacgtaatataccctacgcaacgcccgctaactacgaaaaaatcccgacaaacatccgataatataaacaacaacgcaaacgctaatcacactaccgatttcacttatcgactatctcgtcgcttattactaactaaatacgcaaacgccgaacttctccctaccctttaacccccgtccgctaatatttattaatctaataattacgataaccgtactttactcataaattaacgcactctactaaaacgtcgccaaccaactattaccgacaataattctcgaaccgctaattattttcgaaacgctaacaaatttactatacacctttttactccgccaacaaataccgccgctaataacgctaaacgatatcgcgctattaataattaacgtaatcatcgcgatcaaaacaaaaccaaaaaaaaaacgaacgtcatcgacaatataaccgaactacgaacgaccacgctcgact

SEQ ID NO: 26051 - DNA, 1576 bp, Artificial Sequence
  chemically treated genomic DNA (Homo sapiens) CpG-island No: 26051
  misc_feature (80)..(80): n is either a, c, g or t
gtgataaaaacggttatggttatagcggttatataatcggaatagttagtgaagtttagtaattgatcgtaacggtttancgttatggtttttcggttgtcggtggtatttttcgttgcgtagggtaagttattgtgtggattattataacggtagcgggtgatatcgtcgttaggggtagttttttgaattagacggttttatttattatattttcggcgtatttttagttcgttaggttcggtggttgacgttaattggttgtggtggttatagtaaaacgtcgatgttttgttattcggcgtggtgatgcgcgtgatgaggttcgttattatattcggattgtattttgttgttttgttgcggtattcgtttgtgttttgagtttgtttatcgcgttaaattgattttgcgtgacgttgtcgttcgcgtgttttttttttattattcgttttagttcgtttttattttgcgtgtgtaggattttacggcggtttaggttgtcggtgatggtgatgcggttttttttatattgatacgtgtaatttaagtttgtcgggtttagttgttttgttattcgttcgtcgttgtcgtaacggtaatagattttcggtcggttcgtgtgacggtgcgttatcgattcggtttcggtatttattatcgtaagtaaagtgcgtagatgttgtagtcgatggggcgttatttggcgttagggttaattgcgttgtttattgtttggttgggacgcgtgcgtttgcgttagttggcgcgtcgcgattggtttatcgttttgatgtttattatgatgggtaattttatttattatttttgttttgttagtgttatttaacgtattggcgcgtttgtttttacgatgattatcggtattttgtcggtggttatttttgtttttgttaatttgttttatagttagcgcgacggtaaattcgcgtggggaaaattcgttttagtattgatttgtattggtatcggtttggcgtgtgtgaatattgttgagttaaattacggatttttcgattttgattgggtacgttatatttttggtatcgtgttggcgttagttttcgtggtttgttgggcgtggtatgttttgcgtaacgttcgttggttgcgggaaaatttcgataaatattcgatgatgtgggtaatagcgtaggcgttggttatattgtcggttttatttatcggttatttcgtcgtttgttattggttgaatacgtaaacgtcggatttttttttattttttggttttcgttcgttggtgtttattagtttgatggttgcgatagtcgtgttttgtttatgggttggcgtattttgttggaacgtcgttagttagttattatcgatagtgattttcgggtcgttgattgttttcgaaacgttggtaggtttgttgtatatttttttatttcgttagtaaatgtcgtcgttaatgacgttgagcggtatcgcgttgttagtgattggcgtggttatcgcggttagagtaaaattagaaaaaaaacgggcgttatcggtaatatggtcgagttgcgggcgattacgttcgatt

SEQ ID NO: 26052 - DNA, 1576 bp, Artificial Sequence
  chemically treated genomic DNA (Homo sapiens) CpG-island No: 26052
  misc_feature (1497)..(1497): n is either a, c, g or t
aatcgaacgtaatcgcccgcaactcgaccatattaccgataacgcccgttttttttctaattttactctaaccgcgataaccacgccaatcactaacaacgcgataccgctcaacgtcattaacgacgacatttactaacgaaataaaaaaatatacaacaaacctaccaacgtttcgaaaacaatcaacgacccgaaaatcactatcgataataactaactaacgacgttccaacaaaatacgccaacccataaacaaaacacgactatcgcaaccatcaaactaataaacaccaacgaacgaaaaccaaaaaataaaaaaaaatccgacgtttacgtattcaaccaataacaaacgacgaaataaccgataaataaaaccgacaatataaccaacgcctacgctattacccacatcatcgaatatttatcgaaattttcccgcaaccaacgaacgttacgcaaaacataccacgcccaacaaaccacgaaaactaacgccaacacgataccaaaaatataacgtacccaatcaaaatcgaaaaatccgtaatttaactcaacaatattcacacacgccaaaccgataccaatacaaatcaatactaaaacgaattttccccacgcgaatttaccgtcgcgctaactataaaacaaattaacaaaaacaaaaataaccaccgacaaaataccgataatcatcgtaaaaacaaacgcgccaatacgttaaataacactaacaaaacaaaaataataaataaaattacccatcataataaacatcaaaacgataaaccaatcgcgacgcgccaactaacgcaaacgcacgcgtcccaaccaaacaataaacaacgcaattaaccctaacgccaaataacgccccatcgactacaacatctacgcactttacttacgataataaataccgaaaccgaatcgataacgcaccgtcacacgaaccgaccgaaaatctattaccgttacgacaacgacgaacgaataacaaaacaactaaacccgacaaacttaaattacacgtatcaatataaaaaaaaccgcatcaccatcaccgacaacctaaaccgccgtaaaatcctacacacgcaaaataaaaacgaactaaaacgaataataaaaaaaaaacacgcgaacgacaacgtcacgcaaaatcaatttaacgcgataaacaaactcaaaacacaaacgaataccgcaacaaaacaacaaaatacaatccgaatataataacgaacctcatcacgcgcatcaccacgccgaataacaaaacatcgacgttttactataaccaccacaaccaattaacgtcaaccaccgaacctaacgaactaaaaatacgccgaaaatataataaataaaaccgtctaattcaaaaaactacccctaacgacgatatcacccgctaccgttataataatccacacaataacttaccctacgcaacgaaaaataccaccgacaaccgaaaaaccataacgntaaaccgttacgatcaattactaaacttcactaactattccgattatataaccgctataaccataaccgtttttatcac

SEQ ID NO: 26053 - DNA, 665 bp, Artificial Sequence
  chemically treated genomic DNA (Homo sapiens) CpG-island No: 26053
  misc_feature (539)..(539): n is either a, c, g or t
atcggtagatggcgcgatcgttgtcgtattggttatttatattggcgaacgggaattgacgttggaaagttagtgcggtgtttggcgtgtaattttttttagtatttgtttatcgttattattgaattttaattgacgtagtatcggaataaacggacgttcgtgcggcgggattacggtttgggggaatttcgtatcggtaagggtttttatttttagtaagttttgtttcgtcgttagtcgcgggttagatatttgaaaacggtgacgggtagaggttttattattaaacgataggttcgcgtaatgatgcgttagtttattagttcgtcgaaattgattttttaggcgtttatcgtattattttatcggaaaaatttagttcggggttaagcgtggcgtgtaatgttaacgagttcgattttaggttcgttatcggttatgcgtagtaatttgcggtatattaggcgttggggcgatggttattggaagtattaatgtcgtcgaatgcgttggtattggtagtatcggtaagcggnttgttttagtaaatattttcgttcgcgtttttagtaatagttgatcgaatttttttcgttcgggggtaattagattgtaagagagttcgaacgagtgtaatttgttatcgaatcgttttatcgaaa

SEQ ID NO: 26054 - DNA, 665 bp, Artificial Sequence
  chemically treated genomic DNA (Homo sapiens) CpG-island No: 26054
  misc_feature (127)..(127): n is either a, c, g or t
tttcgataaaacgattcgataacaaattacactcgttcgaactctcttacaatctaattacccccgaacgaaaaaaattcgatcaactattactaaaaacgcgaacgaaaatatttactaaaacaanccgcttaccgatactaccaataccaacgcattcgacgacattaatacttccaataaccatcgccccaacgcctaatataccgcaaattactacgcataaccgataacgaacctaaaatcgaactcgttaacattacacgccacgcttaaccccgaactaaatttttccgataaaataatacgataaacgcctaaaaaatcaatttcgacgaactaataaactaacgcatcattacgcgaacctatcgtttaataataaaacctctacccgtcaccgttttcaaatatctaacccgcgactaacgacgaaacaaaacttactaaaaataaaaacccttaccgatacgaaattcccccaaaccgtaatcccgccgcacgaacgtccgtttattccgatactacgtcaattaaaattcaataataacgataaacaaatactaaaaaaaattacacgccaaacaccgcactaactttccaacgtcaattcccgttcgccaatataaataaccaatacgacaacgatcgcgccatctaccgat

SEQ ID NO: 26055 - DNA, 665 bp, Artificial Sequence
  chemically treated genomic DNA (Homo sapiens) CpG-island No: 26055
  misc_feature (127)..(127): n is either a, c, g or t
tttcgatgaagcgattcgatggtagattatattcgttcggatttttttgtagtttggttattttcgagcgggaaaagttcgattaattgttgttggaggcgcgggcggggatgtttattggaataantcgtttatcggtgttgttagtattagcgtattcggcggtattggtgtttttagtaattatcgttttagcgtttggtatgtcgtagattattgcgtatggtcgatggcgagtttggagtcggattcgttaatattgtacgttacgtttaatttcgggttggattttttcgatgaggtggtgcgatgaacgtttgggaagttaatttcgacgggttggtaggttgacgtattattacgcgggtttgtcgtttggtaatgaagtttttattcgttatcgtttttaggtgtttaattcgcgattggcggcgaagtagggtttattgaaaatgaaagtttttgtcgatgcgggatttttttaggtcgtgatttcgtcgtacgagcgttcgtttatttcggtgttgcgttagttgggatttagtggtagcgatgagtaggtattggaaaaagttgtacgttaggtatcgtattggttttttagcgttagttttcgttcgttaatgtgggtagttaatgcggtaacgatcgcgttatttgtcgat

SEQ ID NO: 26056 - DNA, 665 bp, Artificial Sequence
  chemically treated genomic DNA (Homo sapiens) CpG-island No: 26056
  misc_feature (539)..(539): n is either a, c, g or t
atcgacaaataacgcgatcgttaccgcattaactacccacattaacgaacgaaaactaacgctaaaaaaccaatacgatacctaacgtacaactttttccaatacctactcatcgctaccactaaatcccaactaacgcaacaccgaaataaacgaacgctcgtacgacgaaatcacgacctaaaaaaatcccgcatcgacaaaaactttcattttcaataaaccctacttcgccgccaatcgcgaattaaacacctaaaaacgataacgaataaaaacttcattaccaaacgacaaacccgcgtaataatacgtcaacctaccaacccgtcgaaattaacttcccaaacgttcatcgcaccacctcatcgaaaaaatccaacccgaaattaaacgtaacgtacaatattaacgaatccgactccaaactcgccatcgaccatacgcaataatctacgacataccaaacgctaaaacgataattactaaaaacaccaataccgccgaatacgctaatactaacaacaccgataaacganttattccaataaacatccccgcccgcgcctccaacaacaattaatcgaacttttcccgctcgaaaataaccaaactacaaaaaaatccgaacgaatataatctaccatcgaatcgcttcatcgaaa

SEQ ID NO: 26057 - DNA, 500 bp, Artificial Sequence
  chemically treated genomic DNA (Homo sapiens) CpG-island No: 26057
tgttcggtcgtttatgtataaaaaacgtaaagtgcgtcgggtacgtttttatcggatgttcgtaatgagaaatagtcgttttatggtgagtattaggtagggattttgacgttataataggtcgtaatgatgttggtggcgtttgatgtgtttgttagcgataaagtcgattttgagcggttgtttcgtttgttgatttagcgttttgtttttttgatttagggcggatagtattagaaacgttaaattagcgttttgttatattcgatttcggtatttttggcggttatattgcgttcgataattttattattacgtttatcggtgggtatttattgtttgatgagcgtttttgttttgcgtatagatgttagaaagttgtagaagatgacgcgtttttttacgattcgtttgatgcggcgttatgttatggtgatgtgttgttatagaattgcgttaatatttaggatacggttatttagcggtttgcgatattatta

SEQ ID NO: 26058 - DNA, 500 bp, Artificial Sequence
  chemically treated genomic DNA (Homo sapiens) CpG-island No: 26058
taataatatcgcaaaccgctaaataaccgtatcctaaatattaacgcaattctataacaacacatcaccataacataacgccgcatcaaacgaatcgtaaaaaaacgcgtcatcttctacaactttctaacatctatacgcaaaacaaaaacgctcatcaaacaataaatacccaccgataaacgtaataataaaattatcgaacgcaatataaccgccaaaaataccgaaatcgaatataacaaaacgctaatttaacgtttctaatactatccgccctaaatcaaaaaaacaaaacgctaaatcaacaaacgaaacaaccgctcaaaatcgactttatcgctaacaaacacatcaaacgccaccaacatcattacgacctattataacgtcaaaatccctacctaatactcaccataaaacgactatttctcattacgaacatccgataaaaacgtacccgacgcactttacgttttttatacataaacgaccgaaca

SEQ ID NO: 26059 - DNA, 500 bp, Artificial Sequence
  chemically treated genomic DNA (Homo sapiens) CpG-island No: 26059
tgatgatatcgtaagtcgttggataatcgtgttttaggtgttggcgtaattttgtagtaatatattattatgatataacgtcgtattaagcgagtcgtggggaaacgcgttattttttgtagttttttggtatttgtgcgtaaggtaaaagcgtttattaaataatgagtgtttatcgataaacgtgatggtgagattatcgggcgtaatgtagtcgttaagaatgtcggaatcgagtgtagtagggcgttgatttggcgtttttggtgttgttcgttttgagttagaaaagtaaaacgttgagttaataagcgaaataatcgtttaagatcggttttatcgttggtaagtatattaaacgttattagtattattgcggtttgttgtggcgttaggatttttgtttgatgtttattataaaacggttgttttttattgcgagtattcggtgaaagcgtattcggcgtattttgcgttttttgtgtatgagcgatcggata

SEQ ID NO: 26060 - DNA, 500 bp, Artificial Sequence
  chemically treated genomic DNA (Homo sapiens) CpG-island No: 26060
tatccgatcgctcatacacaaaaaacgcaaaatacgccgaatacgctttcaccgaatactcgcaataaaaaacaaccgttttataataaacatcaaacaaaaatcctaacgccacaacaaaccgcaataatactaataacgtttaatatacttaccaacgataaaaccgatcttaaacgattatttcgcttattaactcaacgttttacttttctaactcaaaacgaacaacaccaaaaacgccaaatcaacgccctactacactcgattccgacattcttaacgactacattacgcccgataatctcaccatcacgtttatcgataaacactcattatttaataaacgcttttaccttacgcacaaataccaaaaaactacaaaaaataacgcgtttccccacgactcgcttaatacgacgttatatcataataatatattactacaaaattacgccaacacctaaaacacgattatccaacgacttacgatatcatca

SEQ ID NO: 26061 - DNA, 707 bp, Artificial Sequence
  chemically treated genomic DNA (Homo sapiens) CpG-island No: 26061
acgttggttttagaaaattcggatgaagtcgggcgttatagtatggacgttgagtacggttagtatagcgttattttgttggtggaaggattttcgtcgttatatgtcgggattattatcgtgtatgaagatttttaattcggtacgttgaatgattttttcggtgttatgacggaggatgatgttcgttcggaggtattgcgtcgttttgaattgatggtggaagaggtggcgcgtaacgcgttcgcggtggtatagaatacggtagtcgcgaagaagttagttagtgatgttagtatattagttcgtgaggcggtaatttatgcggttgatgttgcggatttagtacgcgtagttagtacgttagtcggataggtcgcggtcgtcggtttagttagcgttttttagcgtaggaacggtattaataaaggttattgaagtattaaaaagtgttgtcgttgtagagtttttaaaaagcgcggcggcgattattgcgggttcggcgaaaacgttagaaacgaatgttttagcgttattataattagtagttatatttggatttaacgcgattacgaaggtattagaaatttcgaatttcgttcgggattcgggggtttaaaaagatagcggtaaattattagaaacggacgtattttttaatttttagtaagtgggattttttcgggtacgggcgtaagaaatttcgt

SEQ ID NO: 26062 - DNA, 707 bp, Artificial Sequence
  chemically treated genomic DNA (Homo sapiens) CpG-island No: 26062
acgaaatttcttacgcccgtacccgaaaaaatcccacttactaaaaattaaaaaatacgtccgtttctaataatttaccgctatctttttaaacccccgaatcccgaacgaaattcgaaatttctaataccttcgtaatcgcgttaaatccaaatataactactaattataataacgctaaaacattcgtttctaacgttttcgccgaacccgcaataatcgccgccgcgctttttaaaaactctacaacgacaacactttttaatacttcaataacctttattaataccgttcctacgctaaaaaacgctaactaaaccgacgaccgcgacctatccgactaacgtactaactacgcgtactaaatccgcaacatcaaccgcataaattaccgcctcacgaactaatatactaacatcactaactaacttcttcgcgactaccgtattctataccaccgcgaacgcgttacgcgccacctcttccaccatcaattcaaaacgacgcaatacctccgaacgaacatcatcctccgtcataacaccgaaaaaatcattcaacgtaccgaattaaaaatcttcatacacgataataatcccgacatataacgacgaaaatccttccaccaacaaaataacgctatactaaccgtactcaacgtccatactataacgcccgacttcatccgaattttctaaaaccaacgt

SEQ ID NO: 26063 - DNA, 707 bp, Artificial Sequence
  chemically treated genomic DNA (Homo sapiens) CpG-island No: 26063
acgaaattttttgcgttcgtgttcgaggaagttttatttattagggattgaaagatgcgttcgtttttgatgatttgtcgttgtttttttaggttttcgaatttcgggcggagttcgaagtttttgatgttttcgtggtcgcgttggatttagatgtggttgttgattgtagtgacgttaaagtattcgtttttgacgttttcgtcggattcgtaatggtcgtcgtcgcgttttttgaggattttgtagcggtagtattttttgatgttttagtggtttttgttgatgtcgtttttgcgttggaagacgttgattgagtcgacgatcgcggtttgttcggttgacgtgttggttgcgcgtgttgagttcgtagtattagtcgtatgggttgtcgttttacgggttgatgtgttggtattattggttgattttttcgcggttgtcgtgttttgtgttatcgcggacgcgttacgcgttattttttttattattagtttaaaacggcgtagtgttttcggacgggtattatttttcgttatggtatcgagaaaattatttagcgtatcgggttgagaatttttatatacggtaatggtttcggtatgtgacggcgggaatttttttattaatagaataacgttgtattgatcgtatttaacgtttatgttgtaacgttcggttttattcggattttttgaggttagcgt

SEQ ID NO: 26064 - DNA, 707 bp, Artificial Sequence
  chemically treated genomic DNA (Homo sapiens) CpG-island No: 26064
acgctaacctcaaaaaatccgaataaaaccgaacgttacaacataaacgttaaatacgatcaatacaacgttattctattaataaaaaaattcccgccgtcacataccgaaaccattaccgtatataaaaattctcaacccgatacgctaaataattttctcgataccataacgaaaaataatacccgtccgaaaacactacgccgttttaaactaataataaaaaaaataacgcgtaacgcgtccgcgataacacaaaacacgacaaccgcgaaaaaatcaaccaataataccaacacatcaacccgtaaaacgacaacccatacgactaatactacgaactcaacacgcgcaaccaacacgtcaaccgaacaaaccgcgatcgtcgactcaatcaacgtcttccaacgcaaaaacgacatcaacaaaaaccactaaaacatcaaaaaatactaccgctacaaaatcctcaaaaaacgcgacgacgaccattacgaatccgacgaaaacgtcaaaaacgaatactttaacgtcactacaatcaacaaccacatctaaatccaacgcgaccacgaaaacatcaaaaacttcgaactccgcccgaaattcgaaaacctaaaaaaacaacgacaaatcatcaaaaacgaacgcatctttcaatccctaataaataaaacttcctcgaacacgaacgcaaaaaatttcgt

SEQ ID NO: 26065 - DNA, 541 bp, Artificial Sequence
  chemically treated genomic DNA (Homo sapiens) CpG-island No: 26065
gttttcgtcgttttgataacggtcgattagtatttcgtttaggcgggattttagtttttgcggcgtttgttgttagcgtacgaaacgggtcggagaatacgcgtttatggtgttgggcgatttattcgttagatacgacgatagatagtaacgatttttcgatataatgtataggttgtcgaaagtaaagatttttagtggtataggtgtgattcgtgttagttgttttatttgatgaatcgataatacgcgcggtagtattacgcgagtaacgttaaaatggcgatgataaaagttaatcgtttttttattggtcgtcgaagtttgtatcgatacgtggcgtttaatatgcggataacgttcggcggcgtattttagtatggcgaggtcggcgaggattagcgcgtcggtatttagttgcgtcgttatatttacggcgcgttgttaacgggcgtaatcgttcggatgcgtaaaagtgttaatcgcgatgtgaagtttgcggcgatgttgatggataaaatttatcgttttttgtaatttt

SEQ ID NO: 26066 - DNA, 541 bp, Artificial Sequence
  chemically treated genomic DNA (Homo sapiens) CpG-island No: 26066
aaaattacaaaaaacgataaattttatccatcaacatcgccgcaaacttcacatcgcgattaacacttttacgcatccgaacgattacgcccgttaacaacgcgccgtaaatataacgacgcaactaaataccgacgcgctaatcctcgccgacctcgccatactaaaatacgccgccgaacgttatccgcatattaaacgccacgtatcgatacaaacttcgacgaccaataaaaaaacgattaacttttatcatcgccattttaacgttactcgcgtaatactaccgcgcgtattatcgattcatcaaataaaacaactaacacgaatcacacctataccactaaaaatctttactttcgacaacctatacattatatcgaaaaatcgttactatctatcgtcgtatctaacgaataaatcgcccaacaccataaacgcgtattctccgacccgtttcgtacgctaacaacaaacgccgcaaaaactaaaatcccgcctaaacgaaatactaatcgaccgttatcaaaacgacgaaaac

SEQ ID NO: 26067 - DNA, 541 bp, Artificial Sequence
  chemically treated genomic DNA (Homo sapiens) CpG-island No: 26067
aaaattgtaggaagcggtgagttttgtttattaatatcgtcgtaaattttatatcgcgattaatatttttgcgtattcggacggttacgttcgttggtagcgcgtcgtggatatggcggcgtagttgggtgtcgacgcgttgattttcgtcgatttcgttatgttggagtacgtcgtcgagcgttattcgtatattgagcgttacgtatcggtgtaggtttcggcgattaatgaagaggcgattaatttttattatcgttattttgacgttgttcgcgtggtgttgtcgcgcgtgttgtcgatttattaggtgaaataattggtacgggttatatttgtattattggaagtttttgttttcggtagtttgtgtattatgtcggaaggtcgttgttatttgtcgtcgtatttgacgggtgagtcgtttaatattataggcgcgtgtttttcggttcgtttcgtgcgttggtaataaacgtcgtaggggttggaatttcgtttgaacgaagtgttgatcgatcgttattaggacggcgaaaat

SEQ ID NO: 26068 - DNA, 541 bp, Artificial Sequence
  chemically treated genomic DNA (Homo sapiens) CpG-island No: 26068
attttcgccgtcctaataacgatcgatcaacacttcgttcaaacgaaattccaacccctacgacgtttattaccaacgcacgaaacgaaccgaaaaacacgcgcctataatattaaacgactcacccgtcaaatacgacgacaaataacaacgaccttccgacataatacacaaactaccgaaaacaaaaacttccaataatacaaatataacccgtaccaattatttcacctaataaatcgacaacacgcgcgacaacaccacgcgaacaacgtcaaaataacgataataaaaattaatcgcctcttcattaatcgccgaaacctacaccgatacgtaacgctcaatatacgaataacgctcgacgacgtactccaacataacgaaatcgacgaaaatcaacgcgtcgacacccaactacgccgccatatccacgacgcgctaccaacgaacgtaaccgtccgaatacgcaaaaatattaatcgcgatataaaatttacgacgatattaataaacaaaactcaccgcttcctacaatttt

SEQ ID NO: 26069 - DNA, 567 bp, Artificial Sequence
  chemically treated genomic DNA (Homo sapiens) CpG-island No: 26069
gcgttgattagcgaggttgacgtgcgcggtagaatcggttttgaattagcggattattcgtaaggtcgttggttgcgcgaacgttgggaagtggcgtagttagtgtcgataaaagtcgtcgttgaagcgggatttaaaggtgtggagattcgcgaggagttgattcggcggcggattgcggcggtagtagttggaaggaataacgttgtttaaagtttgaatgagtattgggtattttgtcggatgcggcgtaaacgttttattcggtttatattcgtgttttcgtaggtatgataagacgcgttagcgtcgtattaggtaaagataaatttcgtttgatttattttttttttttttttagtaaattttttaatatttcgcgtataatttgattcgttatttggcgagcggcgtttttggttattgtttgtattatattattttttttttcgtcgcgtggttcggtagtgtcgaataaaatattttttaatttattaagaatgtcgttatttatcgttatttttttttttttcgcgggaggattattttgttgttcggtattggttt

SEQ ID NO: 26070 - DNA, 567 bp, Artificial Sequence
  chemically treated genomic DNA (Homo sapiens) CpG-island No: 26070
aaaccaataccgaacaacaaaataatcctcccgcgaaaaaaaaaaaaataacgataaataacgacattcttaataaattaaaaaatattttattcgacactaccgaaccacgcgacgaaaaaaaaaataatataatacaaacaataaccaaaaacgccgctcgccaaataacgaatcaaattatacgcgaaatattaaaaaatttactaaaaaaaaaaaaaaaataaatcaaacgaaatttatctttacctaatacgacgctaacgcgtcttatcatacctacgaaaacacgaatataaaccgaataaaacgtttacgccgcatccgacaaaatacccaatactcattcaaactttaaacaacgttattccttccaactactaccgccgcaatccgccgccgaatcaactcctcgcgaatctccacacctttaaatcccgcttcaacgacgacttttatcgacactaactacgccacttcccaacgttcgcgcaaccaacgaccttacgaataatccgctaattcaaaaccgattctaccgcgcacgtcaacctcgctaatcaacgc

SEQ ID NO: 26071 - DNA, 567 bp, Artificial Sequence
  chemically treated genomic DNA (Homo sapiens) CpG-island No: 26071
aggttagtatcgagtagtaaaataattttttcgcgaaagggaaagaggtagcggtggatgacggtatttttggtggattgaaggatattttgttcggtattatcggattacgcggcgggaagaaagatggtgtggtgtaaataatggttaaaagcgtcgttcgttaagtgacgaattagattgtacgcgggatgttggggagtttgttgggggggagaagaaggtaagttaggcgagatttgtttttgtttgatgcgacgttggcgcgttttattatgtttacgggagtacgaatgtaggtcggataaagcgtttacgtcgtattcggtaaaatgtttaatatttatttaggttttgggtaacgttgttttttttagttgttatcgtcgtaattcgtcgtcgggttagtttttcgcgaatttttatatttttaaatttcgttttaacgacggtttttgtcggtattgattgcgttattttttagcgttcgcgtaattagcggttttgcgggtagttcgttgatttaaaatcggttttgtcgcgtacgttagtttcgttggttagcgt

SEQ ID NO: 26072 - DNA, 567 bp, Artificial Sequence
  chemically treated genomic DNA (Homo sapiens) CpG-island No: 26072
acgctaaccaacgaaactaacgtacgcgacaaaaccgattttaaatcaacgaactacccgcaaaaccgctaattacgcgaacgctaaaaaataacgcaatcaataccgacaaaaaccgtcgttaaaacgaaatttaaaaatataaaaattcgcgaaaaactaacccgacgacgaattacgacgataacaactaaaaaaaacaacgttacccaaaacctaaataaatattaaacattttaccgaatacgacgtaaacgctttatccgacctacattcgtactcccgtaaacataataaaacgcgccaacgtcgcatcaaacaaaaacaaatctcgcctaacttaccttcttctcccccccaacaaactccccaacatcccgcgtacaatctaattcgtcacttaacgaacgacgcttttaaccattatttacaccacaccatctttcttcccgccgcgtaatccgataataccgaacaaaatatccttcaatccaccaaaaataccgtcatccaccgctacctctttccctttcgcgaaaaaattattttactactcgatactaacct

SEQ ID NO: 26073 - DNA, 512 bp, Artificial Sequence
  chemically treated genomic DNA (Homo sapiens) CpG-island No: 26073
tatttggcgttgggcgtgcgcggcgcgttttgcgaggcggtgcgtatttttatgtgtcggtatatgttttggaatattacgcggatgtttaattatttgtattatagtacgtaggagaacgttattttggttatcgagtagtacgaggagttggtggacgtgaattgtagcgtcgtgttgcgtttttttttttgtgttatgtacgcgtttatttgtattttggagtttttgtacgattttattaagtcgtgtaagtcggtgtgttaacgcgcgcgcgacgattgcgagttttttatgaagatgtataattatagttggttcgaaagtttggtttgcgacgagttgtttgtttatgatcgtggcgtgtgtatttcgtttgaagttatcgttacggatttttcggagggtgaggtcgtaggaaggatggagggaggcgaggaggcgttcggggttgtggttgttaatcgagaattgggcggttatatttaaggttgttaggggcgtttgaggtt

SEQ ID NO: 26074 - DNA, 512 bp, Artificial Sequence
  chemically treated genomic DNA (Homo sapiens) CpG-island No: 26074
aacctcaaacgcccctaacaaccttaaatataaccgcccaattctcgattaacaaccacaaccccgaacgcctcctcgcctccctccatccttcctacgacctcaccctccgaaaaatccgtaacgataacttcaaacgaaatacacacgccacgatcataaacaaacaactcgtcgcaaaccaaactttcgaaccaactataattatacatcttcataaaaaactcgcaatcgtcgcgcgcgcgttaacacaccgacttacacgacttaataaaatcgtacaaaaactccaaaatacaaataaacgcgtacataacacaaaaaaaaaaacgcaacacgacgctacaattcacgtccaccaactcctcgtactactcgataaccaaaataacgttctcctacgtactataatacaaataattaaacatccgcgtaatattccaaaacatataccgacacataaaaatacgcaccgcctcgcaaaacgcgccgcgcacgcccaacgccaaata

SEQ ID NO: 26075 - DNA, 512 bp, Artificial Sequence
  chemically treated genomic DNA (Homo sapiens) CpG-island No: 26075
agttttagacgtttttggtagttttaggtgtggtcgtttagttttcgattggtagttatagtttcgggcgttttttcgtttttttttattttttttacggttttatttttcgggaggttcgtgacgatggttttaggcgagatgtatacgttacggttatagataggtagttcgtcgtaggttaggttttcgggttagttgtggttgtatatttttatgaggggttcgtagtcgtcgcgcgcgcgttggtatatcgatttgtacggtttgatagggtcgtgtaggaattttagggtgtaaatgggcgcgtatatggtatagaggaagaagcgtagtacggcgttgtagtttacgtttattagtttttcgtattgttcgatggttaggatggcgtttttttgcgtgttgtggtgtaggtggttgggtattcgcgtgatgttttagggtatgtgtcggtatatagggatgcgtatcgtttcgtagggcgcgtcgcgtacgtttagcgttaggtg

SEQ ID NO: 26076 - DNA, 512 bp, Artificial Sequence
  chemically treated genomic DNA (Homo sapiens) CpG-island No: 26076
cacctaacgctaaacgtacgcgacgcgccctacgaaacgatacgcatccctatataccgacacataccctaaaacatcacgcgaatacccaaccacctacaccacaacacgcaaaaaaacgccatcctaaccatcgaacaatacgaaaaactaataaacgtaaactacaacgccgtactacgcttcttcctctataccatatacgcgcccatttacaccctaaaattcctacacgaccctatcaaaccgtacaaatcgatataccaacgcgcgcgcgacgactacgaacccctcataaaaatatacaaccacaactaacccgaaaacctaacctacgacgaactacctatctataaccgtaacgtatacatctcgcctaaaaccatcgtcacgaacctcccgaaaaataaaaccgtaaaaaaaataaaaaaaaacgaaaaaacgcccgaaactataactaccaatcgaaaactaaacgaccacacctaaaactaccaaaaacgtctaaaact

SEQ ID NO: 26077 - DNA, 712 bp, Artificial Sequence
  chemically treated genomic DNA (Homo sapiens) CpG-island No: 26077
ttgcgggttattgagttgtttttattattgcgtttgtcgttagtcggagttggtaagatgaatatcgtcggttagtttgatttgtttcggtttgagttgttgatgaggtgtagaatttttacgtattagggtatagtcggaaattagcgtcgtgttgtcgagaatgttgtataatagtagacgtgaaagtcgacgattgattattgcgtggttttttgtgtttgtttcgtggcgggcgttaatgtcggggttgtttagtttggtaagcgggcgaaaagttggtagacgtgttgtttttgttttaataaggtgggtaggatggtttgagaggcgggtgtttttttaagcgttatttgaggagaacggttgagtgcggttgttagatcggtagcgtatttttttagggcgtcggtaaattgatttgttttgttcggttgtagtgcgttatttagcgtttgcgtcgagttttaggtggtattttacgcgtgaagaatatcgcggttttgacgaataatcgtttgcgtacgtttaattagtaatgcgcgtttttcgttgtttagttgacgttttacgttatgtattgtcgatgttaggtgcgattttcgaggattttttcggtacgattaggtaaaattatagtaaaattataattaaaggaatcgagcggaatacgttaacgtaggttttggtaaattacgttacgggcgtaaag

SEQ ID NO: 26078 - DNA, 712 bp, Artificial Sequence
  chemically treated genomic DNA (Homo sapiens) CpG-island No: 26078
ctttacgcccgtaacgtaatttaccaaaacctacgttaacgtattccgctcgattcctttaattataattttactataattttacctaatcgtaccgaaaaaatcctcgaaaatcgcacctaacatcgacaatacataacgtaaaacgtcaactaaacaacgaaaaacgcgcattactaattaaacgtacgcaaacgattattcgtcaaaaccgcgatattcttcacgcgtaaaataccacctaaaactcgacgcaaacgctaaataacgcactacaaccgaacaaaacaaatcaatttaccgacgccctaaaaaaatacgctaccgatctaacaaccgcactcaaccgttctcctcaaataacgcttaaaaaaacacccgcctctcaaaccatcctacccaccttattaaaacaaaaacaacacgtctaccaacttttcgcccgcttaccaaactaaacaaccccgacattaacgcccgccacgaaacaaacacaaaaaaccacgcaataatcaatcgtcgactttcacgtctactattatacaacattctcgacaacacgacgctaatttccgactataccctaatacgtaaaaattctacacctcatcaacaactcaaaccgaaacaaatcaaactaaccgacgatattcatcttaccaactccgactaacgacaaacgcaataataaaaacaactcaataacccgcaa

SEQ ID NO: 26079 - DNA, 712 bp, Artificial Sequence
  chemically treated genomic DNA (Homo sapiens) CpG-island No: 26079
ttttgcgttcgtggcgtggtttgttaaagtttacgttaacgtatttcgttcgatttttttagttatggttttgttgtggttttatttgatcgtgtcggggggattttcgagagtcgtatttggtatcggtagtgtatagcgtggagcgttaattggatagcgaagaacgcgtattattgattgaacgtgcgtaaacggttattcgttagggtcgcgatattttttacgcgtgggatgttatttggaattcggcgtaggcgttggataacgtattatagtcggatagagtaggttagtttgtcgacgttttggagaaatacgttgtcggtttggtaatcgtatttagtcgttttttttaaataacgtttgaagagatattcgttttttaggttattttgtttattttattaaaataggagtaatacgtttgttagtttttcgttcgtttgttagattggatagtttcggtattaacgttcgttacggaataggtataaggagttacgtaatgattaatcgtcgatttttacgtttgttgttgtgtagtattttcggtagtacgacgttgattttcggttgtgttttggtacgtaaggattttgtattttattaatagtttaaatcggaataaattaaattggtcgacgatatttattttgttagtttcggttggcggtaggcgtagtggtggaaataatttaatgattcgtag

SEQ ID NO: 26080 - DNA, 712 bp, Artificial Sequence
  chemically treated genomic DNA (Homo sapiens) CpG-island No: 26080
ctacgaatcattaaattatttccaccactacgcctaccgccaaccgaaactaacaaaataaatatcgtcgaccaatttaatttattccgatttaaactattaataaaatacaaaatccttacgtaccaaaacacaaccgaaaatcaacgtcgtactaccgaaaatactacacaacaacaaacgtaaaaatcgacgattaatcattacgtaactccttatacctattccgtaacgaacgttaataccgaaactatccaatctaacaaacgaacgaaaaactaacaaacgtattactcctattttaataaaataaacaaaataacctaaaaaacgaatatctcttcaaacgttatttaaaaaaaacgactaaatacgattaccaaaccgacaacgtatttctccaaaacgtcgacaaactaacctactctatccgactataatacgttatccaacgcctacgccgaattccaaataacatcccacgcgtaaaaaatatcgcgaccctaacgaataaccgtttacgcacgttcaatcaataatacgcgttcttcgctatccaattaacgctccacgctatacactaccgataccaaatacgactctcgaaaatccccccgacacgatcaaataaaaccacaacaaaaccataactaaaaaaatcgaacgaaatacgttaacgtaaactttaacaaaccacgccacgaacgcaaaa

SEQ ID NO: 26081 - DNA, 969 bp, Artificial Sequence
  chemically treated genomic DNA (Homo sapiens) CpG-island No: 26081
gttttattagtatttttattcgtatttttattcgttttattagtatttttatttttattttcgttcgttttattagtatttttatttttatttttattcgttttattagtatttttatttttatttttattcgtttcgttaatatttttatttttatttttatttttattcgttttattagtatttttattcgtatttttattcgttttattagtatttttattcgtatttttattcgttttattagtatttttatttttattttcgttcgttttattagtatttttatttgtattcgtattcgtattcgttttattagtatttttattcgtatttttattcgttttattagtatttttatttttattttcgttcgttttattagtatttttatttgtattcgtattcgtattcgttttattagtatttttattcgtatttttattcgttttattagtatttttattcgtatttttattcgtttcgttaatatttttatttttattcgttttattagtatttttatttttatttttatttttattcgttttattagtatttttattcgtatttttattcgttttattagtatttttattcgtatttttattcgttttattagtatttttattcgtttttttattcgttttattagtatttttattcgtttttttattcgttttattagtatttttattcgtatttttattcgttttattagtatttttattcgtatttttattcgttttattagtatttttattcgtatttttattcgttttattagtatttttatttttatttttattcgttttattagtatttttattcgtatttttattcgttttattagtatttttattcgtatttttattcgttttattagtatttttattcgtatttatattcgtattcgttttattagtaattttagtaagaataattcgtgttagtgttagggttttagag

SEQ ID NO: 26082 - DNA, 969 bp, Artificial Sequence
  chemically treated genomic DNA (Homo sapiens) CpG-island No: 26082
ctctaaaaccctaacactaacacgaattattcttactaaaattactaataaaacgaatacgaatataaatacgaataaaaatactaataaaacgaataaaaatacgaataaaaatactaataaaacgaataaaaatacgaataaaaatactaataaaacgaataaaaataaaaataaaaatactaataaaacgaataaaaatacgaataaaaatactaataaaacgaataaaaatacgaataaaaatactaataaaacgaataaaaatacgaataaaaatactaataaaacgaataaaaaaacgaataaaaatactaataaaacgaataaaaaaacgaataaaaatactaataaaacgaataaaaatacgaataaaaatactaataaaacgaataaaaatacgaataaaaatactaataaaacgaataaaaataaaaataaaaataaaaatactaataaaacgaataaaaataaaaatattaacgaaacgaataaaaatacgaataaaaatactaataaaacgaataaaaatacgaataaaaatactaataaaacgaatacgaatacgaatacaaataaaaatactaataaaacgaacgaaaataaaaataaaaatactaataaaacgaataaaaatacgaataaaaatactaataaaacgaatacgaatacgaatacaaataaaaatactaataaaacgaacgaaaataaaaataaaaatactaataaaacgaataaaaatacgaataaaaatactaataaaacgaataaaaatacgaataaaaatactaataaaacgaataaaaataaaaataaaaataaaaatattaacgaaacgaataaaaataaaaataaaaatactaataaaacgaataaaaataaaaataaaaatactaataaaacgaacgaaaataaaaataaaaatactaataaaacgaataaaaatacgaataaaaatactaataaaac

SEQ ID NO: 26083 - DNA, 969 bp, Artificial Sequence
  chemically treated genomic DNA (Homo sapiens) CpG-island No: 26083
ttttaaagttttgatattgatacgggttgtttttgttggggttgttaatggagcgggtgcgggtgtgggtgcgggtgagggtgttgatggagcgggtgagggtgcgggtgagggtgttggtggagcgggtgagggtgcgggtgagggtgttggtggagcgggtgagggtgagggtgagggtgttggtggagcgggtgagggtgcgggtgagggtgttggtggagcgggtgagggtgcgggtgagggtgttggtggagcgggtgagggtgcgggtgagggtgttggtggagcgggtgagggagcgggtgagggtgttggtggagcgggtgagggagcgggtgagggtgttggtggagcgggtgagggtgcgggtgagggtgttggtggagcgggtgagggtgcgggtgagggtgttgatggagcgggtgagggtgagggtgagggtgagggtgttgatggagcgggtgagggtgagggtgttgacggagcgggtgagggtgcgggtgagggtgttgatggagcgggtgagggtgcgggtgagggtgttggtggagcgggtgcgggtgcgggtgtaggtgagggtgttgatggagcgggcgagggtgagggtgagggtgttgatggagcgggtgagggtgcgggtgagggtgttggtggagcgggtgcgggtgcgggtgtaggtgagggtgttgatggagcgggcgagggtgagggtgagggtgttgatggagcgggtgagggtgcgggtgagggtgttgatggagcgggtgagggtgcgggtgagggtgttgatggagcgggtgagggtgagggtgagggtgagggtgttgacggagcgggtgagggtgagggtgagggtgttgatggagcgggtgagggtgagggtgagggtgttgatggagcgggcgagggtgagggtgagggtgttgatggagcgggtgagggtgcgggtgagggtgttggtggagt

SEQ ID NO: 26084 - DNA, 969 bp, Artificial Sequence
  chemically treated genomic DNA (Homo sapiens) CpG-island No: 26084
actccaccaacaccctcacccgcaccctcacccgctccatcaacaccctcaccctcaccctcgcccgctccatcaacaccctcaccctcaccctcacccgctccatcaacaccctcaccctcaccctcacccgctccgtcaacaccctcaccctcaccctcaccctcacccgctccatcaacaccctcacccgcaccctcacccgctccatcaacaccctcacccgcaccctcacccgctccatcaacaccctcaccctcaccctcgcccgctccatcaacaccctcacctacacccgcacccgcacccgctccaccaacaccctcacccgcaccctcacccgctccatcaacaccctcaccctcaccctcgcccgctccatcaacaccctcacctacacccgcacccgcacccgctccaccaacaccctcacccgcaccctcacccgctccatcaacaccctcacccgcaccctcacccgctccgtcaacaccctcaccctcacccgctccatcaacaccctcaccctcaccctcaccctcacccgctccatcaacaccctcacccgcaccctcacccgctccaccaacaccctcacccgcaccctcacccgctccaccaacaccctcacccgctccctcacccgctccaccaacaccctcacccgctccctcacccgctccaccaacaccctcacccgcaccctcacccgctccaccaacaccctcacccgcaccctcacccgctccaccaacaccctcacccgcaccctcacccgctccaccaacaccctcaccctcaccctcacccgctccaccaacaccctcacccgcaccctcacccgctccaccaacaccctcacccgcaccctcacccgctccatcaacaccctcacccgcacccacacccgcacccgctccattaacaaccccaacaaaaacaacccgtatcaatatcaaaactttaaaa

SEQ ID NO: 26085 - DNA, 728 bp, Artificial Sequence
  chemically treated genomic DNA (Homo sapiens) CpG-island No: 26085
gtgttcgtagttcgagtttttcggagcgatttcggttagcgttttttttcggtatttcgttttcgcgtacgtttatcgttcggttttcgttaggcgttcgcgtatttatcgcgcgttaggtttaggatcgcggcgagtagtaggtagacgtagcggcggaggttcggggcggttcgtatggtgttcgggagttggcggcggtggcggggcggcgggggtggaggcggtggcggcgggttttttcgttatgggtttagacgcgtttttgttttcggttattggtaggcgggtgcgcggcgtaggcggagaatcgcgggacgtttttatgtcgtcgcggtaaggtagttcgggcgttcggttcgattcggtttcggttttgcgaggcgtagagattttcgcgttttgggcgttttcggggttcgtcgcggtttttcggttttttagttgcgcgcggtgtttatcgcggtttagagttcgatcggttgtagcgtcggagtttggagtcgaatcgcgttttttgtttcgcgttcgtttttttcggcggcgagagtattttttttttttcgtttttttttcgttttttttttttttttcgttttttcgttttttttgtttttttttcgtcgcgtttttcgcgtattatatagatttttttttaattttttttgggttgttcggttttcgttcgttaagtcgatttattgtagggagaaggagagtttattttt

SEQ ID NO: 26086 - DNA, 728 bp, Artificial Sequence
  chemically treated genomic DNA (Homo sapiens) CpG-island No: 26086
aaaaataaactctccttctccctacaataaatcgacttaacgaacgaaaaccgaacaacccaaaaaaaattaaaaaaaaatctatataatacgcgaaaaacgcgacgaaaaaaaaacaaaaaaaacgaaaaaacgaaaaaaaaaaaaaaaacgaaaaaaaaacgaaaaaaaaaaaatactctcgccgccgaaaaaaacgaacgcgaaacaaaaaacgcgattcgactccaaactccgacgctacaaccgatcgaactctaaaccgcgataaacaccgcgcgcaactaaaaaaccgaaaaaccgcgacgaaccccgaaaacgcccaaaacgcgaaaatctctacgcctcgcaaaaccgaaaccgaatcgaaccgaacgcccgaactaccttaccgcgacgacataaaaacgtcccgcgattctccgcctacgccgcgcacccgcctaccaataaccgaaaacaaaaacgcgtctaaacccataacgaaaaaacccgccgccaccgcctccacccccgccgccccgccaccgccgccaactcccgaacaccatacgaaccgccccgaacctccgccgctacgtctacctactactcgccgcgatcctaaacctaacgcgcgataaatacgcgaacgcctaacgaaaaccgaacgataaacgtacgcgaaaacgaaataccgaaaaaaaacgctaaccgaaatcgctccgaaaaactcgaactacgaacac

SEQ ID NO: 26087 - DNA, 728 bp, Artificial Sequence
  chemically treated genomic DNA (Homo sapiens) CpG-island No: 26087
gggggtgagttttttttttttttgtaataaatcggtttagcggacgagagtcgaatagtttagaaaggattaaagaaaagtttgtataatacgcggagagcgcggcgaggggagggtaaggagggcgggggggcggggagagggggagggacggagggagggcgagaggaggggggtgttttcgtcgtcgggagaggcgagcgcgaggtagagagcgcgattcggttttaaatttcggcgttgtagtcgatcggattttgggtcgcggtgggtatcgcgcgtagttagggagtcgagaagtcgcggcgagtttcgaggacgtttagagcgcgagggtttttgcgtttcgtagagtcggagtcgagtcgagtcgggcgttcgggttgttttgtcgcggcggtatgggggcgtttcgcggtttttcgtttgcgtcgcgtattcgtttgttagtagtcggaggtaggagcgcgtttgagtttatggcgaggggattcgtcgttatcgtttttattttcgtcgtttcgttatcgtcgttagttttcgggtattatgcgaatcgtttcgagttttcgtcgttgcgtttgtttgttgttcgtcgcgattttggatttggcgcgcggtgagtgcgcgggcgtttggcgggagtcgagcggtgaacgtgcgcggggacggggtgtcgggggagggcgttggtcggggtcgtttcgagaggttcgggttacgagtat

SEQ ID NO: 26088 - DNA, 728 bp, Artificial Sequence
  chemically treated genomic DNA (Homo sapiens) CpG-island No: 26088
atactcgtaacccgaacctctcgaaacgaccccgaccaacgccctcccccgacaccccgtccccgcgcacgttcaccgctcgactcccgccaaacgcccgcgcactcaccgcgcgccaaatccaaaatcgcgacgaacaacaaacaaacgcaacgacgaaaactcgaaacgattcgcataatacccgaaaactaacgacgataacgaaacgacgaaaataaaaacgataacgacgaatcccctcgccataaactcaaacgcgctcctacctccgactactaacaaacgaatacgcgacgcaaacgaaaaaccgcgaaacgcccccataccgccgcgacaaaacaacccgaacgcccgactcgactcgactccgactctacgaaacgcaaaaaccctcgcgctctaaacgtcctcgaaactcgccgcgacttctcgactccctaactacgcgcgatacccaccgcgacccaaaatccgatcgactacaacgccgaaatttaaaaccgaatcgcgctctctacctcgcgctcgcctctcccgacgacgaaaacacccccctcctctcgccctccctccgtccctccccctctccccgcccccccgccctccttaccctcccctcgccgcgctctccgcgtattatacaaacttttctttaatcctttctaaactattcgactctcgtccgctaaaccgatttattacaaaaaaaaaaaaaactcaccccc

SEQ ID NO: 26089 - DNA, 885 bp, Artificial Sequence
  chemically treated genomic DNA (Homo sapiens) CpG-island No: 26089
cgtcgggggttttgcgggggacggcgcggagttgattgaagggtcgttgcggtagcgtagggcgtaggagttgtttcgtttcggagcgtcgggaaggttggcgttggtagtttttagtttttgttagtcgggcgagagtaggcggagaaggaggatgtatcgttatttatggttcgtttttatcggtcggtacgtaaggtgagttttgcgtgcgttcggcgggatagtgaggtaaaagggcgggagcgcgggagaggattcgtggtttcggtttagttcgtattttttttttttgggatttcgaatcgcgggttgcgtggtgggttaggagaggtgtagagtaggcggggcgtcgcggttagttcggagcgtaaattttttttggcgattgtagcgttgaatttgggcgtaggagagcgcggggttcgggttgtttagttttgttcggcggggtatttgggcgtagcgtatatgggttagtcggtaggaattgcgggatgggggatatttagcgttatcgtcgggagtcgtaggagcgagatggattatttggaaggttcgggttagtttttgggttttgaggtacgcggcgtttcggcgttggtggtagggtggattcggatttcgcgagggtgtcgcgttagtcgcgggggttgtttgaggtcgggggatttcgagtcgtcgttgtattattcgtttttagtttaggaggaaggcgtcggttggcgttgcgttttgttcggatttagggtaggagcgggggaggtttgcgaaagtcgggagcgagtcggggagggttcgcgaattggagaggtttagcgcgttgttgcggacgcggcggatggtcgattacgggtgttaggggaggtttacgttgcggcgtcg

SEQ ID NO: 26090 - DNA, 885 bp, Artificial Sequence
  chemically treated genomic DNA (Homo sapiens) CpG-island No: 26090
cgacgccgcaacgtaaacctcccctaacacccgtaatcgaccatccgccgcgtccgcaacaacgcgctaaacctctccaattcgcgaaccctccccgactcgctcccgactttcgcaaacctcccccgctcctaccctaaatccgaacaaaacgcaacgccaaccgacgccttcctcctaaactaaaaacgaataatacaacgacgactcgaaatcccccgacctcaaacaacccccgcgactaacgcgacaccctcgcgaaatccgaatccaccctaccaccaacgccgaaacgccgcgtacctcaaaacccaaaaactaacccgaaccttccaaataatccatctcgctcctacgactcccgacgataacgctaaatatcccccatcccgcaattcctaccgactaacccatatacgctacgcccaaataccccgccgaacaaaactaaacaacccgaaccccgcgctctcctacgcccaaattcaacgctacaatcgccaaaaaaaatttacgctccgaactaaccgcgacgccccgcctactctacacctctcctaacccaccacgcaacccgcgattcgaaatcccaaaaaaaaaaaatacgaactaaaccgaaaccacgaatcctctcccgcgctcccgcccttttacctcactatcccgccgaacgcacgcaaaactcaccttacgtaccgaccgataaaaacgaaccataaataacgatacatcctccttctccgcctactctcgcccgactaacaaaaactaaaaactaccaacgccaaccttcccgacgctccgaaacgaaacaactcctacgccctacgctaccgcaacgacccttcaatcaactccgcgccgtcccccgcaaaacccccgacg

SEQ ID NO: 26091 - DNA, 885 bp, Artificial Sequence
  chemically treated genomic DNA (Homo sapiens) CpG-island No: 26091
cggcgtcgtagcgtgggttttttttggtattcgtggtcggttattcgtcgcgttcgtagtagcgcgttgagtttttttagttcgcgggtttttttcggttcgttttcggttttcgtagatttttttcgtttttgttttgagttcgagtagagcgtaacgttagtcggcgttttttttttgggttgggagcgagtggtgtagcggcggttcgaagtttttcggttttaagtagttttcgcgattagcgcgatattttcgcgggattcgagtttattttgttattagcgtcgggacgtcgcgtgttttagagtttaagggttgattcgggttttttaggtggtttatttcgtttttacggttttcgacggtggcgttgggtgttttttatttcgtaatttttatcggttgatttatgtgcgttgcgtttaggtatttcgtcgggtagggttgagtagttcggatttcgcgtttttttgcgtttagatttagcgttgtagtcgttagggaaagtttgcgtttcggattggtcgcggcgtttcgtttgttttgtattttttttggtttattacgtagttcgcgattcgggattttagaggagaggggtgcgggttgagtcggggttacgagttttttttcgcgttttcgtttttttattttattgtttcgtcgggcgtacgtagagtttattttgcgtgtcggtcggtggaggcgagttataggtgacggtgtatttttttttttcgtttgttttcgttcggttggtaggggttggaggttgttagcgttaattttttcggcgtttcggggcggagtagtttttgcgttttgcgttatcgtagcggttttttagttagtttcgcgtcgtttttcgtagagttttcggcg

SEQ ID NO: 26092 - DNA, 885 bp, Artificial Sequence
  chemically treated genomic DNA (Homo sapiens) CpG-island No: 26092
cgccgaaaactctacgaaaaacgacgcgaaactaactaaaaaaccgctacgataacgcaaaacgcaaaaactactccgccccgaaacgccgaaaaaattaacgctaacaacctccaacccctaccaaccgaacgaaaacaaacgaaaaaaaaaaatacaccgtcacctataactcgcctccaccgaccgacacgcaaaataaactctacgtacgcccgacgaaacaataaaataaaaaaacgaaaacgcgaaaaaaaactcgtaaccccgactcaacccgcacccctctcctctaaaatcccgaatcgcgaactacgtaataaaccaaaaaaaatacaaaacaaacgaaacgccgcgaccaatccgaaacgcaaactttccctaacgactacaacgctaaatctaaacgcaaaaaaacgcgaaatccgaactactcaaccctacccgacgaaatacctaaacgcaacgcacataaatcaaccgataaaaattacgaaataaaaaacacccaacgccaccgtcgaaaaccgtaaaaacgaaataaaccacctaaaaaacccgaatcaacccttaaactctaaaacacgcgacgtcccgacgctaataacaaaataaactcgaatcccgcgaaaatatcgcgctaatcgcgaaaactacttaaaaccgaaaaacttcgaaccgccgctacaccactcgctcccaacccaaaaaaaaaacgccgactaacgttacgctctactcgaactcaaaacaaaaacgaaaaaaatctacgaaaaccgaaaacgaaccgaaaaaaacccgcgaactaaaaaaactcaacgcgctactacgaacgcgacgaataaccgaccacgaataccaaaaaaaacccacgctacgacgccg

SEQ ID NO: 26093 - DNA, 976 bp, Artificial Sequence
  chemically treated genomic DNA (Homo sapiens) CpG-island No: 26093
  misc_feature (746)..(746): n is either a, c, g or t
tcggttttttattcgggttcgattttttggaaggggtttggtttagcgcgtatttgtatacgtgcgtcgggaggcgggaggtcgtttcgcggtttagttggtttgtttttaataatacggttaaagttatacgtttatcgttatttacgtcgttagttagcgtcggtatttcggagggaggaaggaagtatttaaggcgttgggggcggaaacgttgaggaggaggggtgcgttttaggcgagagttggtcggcgtcgattcggtttggggtagcggtcgtagtttttcgttcgggatcgcgtaaaaaggtttaaggtttcgggtcgtatttatcgaagtttaggaattgttttatggagagcggggacggcgagaagcgcgcgtagaagtttatttggttcggaacgtcgcgttcggacgtcgggttggagttcgagttcgagttgaagttgcggttgaagtcggcggcgcgtagtttcgggttcgggtcggttaaggcggtttcgcgaagtagtcgcgttagttttatgtcgagtttcgttagagaagttatagttagtacgttaggttttttcgcgtttttgtcgagtggtacgtgagggacgtggcgggtagtaggggcggggatcggttgttatcggcgcggtttttatttttttagtcggagttcggttttttgcgtcgttgggcgggacgcggagcgggaaggaggcggggagagaaaaggggcgggcgtttgcggggntcgtttttttcgtcggagtttcgtttagtttttcgaggaaggagatgcggagcgcgcgttaggtcgtagtcgtcgtttagatttcgttttagtcggcgaggtgtggggtgagcgtgtcggtcgttttcgtatacgtcgggtgatgggattggggatattaagaggcgaggcggtatggagcgtttttttttcgtatttttttgaaataaattttatttttttgttttttt

SEQ ID NO: 26094 - DNA, 976 bp, Artificial Sequence
  chemically treated genomic DNA (Homo sapiens) CpG-island No: 26094
  misc_feature (231)..(231): n is either a, c, g or t
aaaaaaacaaaaaaataaaatttatttcaaaaaaatacgaaaaaaaaacgctccataccgcctcgcctcttaatatccccaatcccatcacccgacgtatacgaaaacgaccgacacgctcaccccacacctcgccgactaaaacgaaatctaaacgacgactacgacctaacgcgcgctccgcatctccttcctcgaaaaactaaacgaaactccgacgaaaaaaacganccccgcaaacgcccgccccttttctctccccgcctccttcccgctccgcgtcccgcccaacgacgcaaaaaaccgaactccgactaaaaaaataaaaaccgcgccgataacaaccgatccccgcccctactacccgccacgtccctcacgtaccactcgacaaaaacgcgaaaaaacctaacgtactaactataacttctctaacgaaactcgacataaaactaacgcgactacttcgcgaaaccgccttaaccgacccgaacccgaaactacgcgccgccgacttcaaccgcaacttcaactcgaactcgaactccaacccgacgtccgaacgcgacgttccgaaccaaataaacttctacgcgcgcttctcgccgtccccgctctccataaaacaattcctaaacttcgataaatacgacccgaaaccttaaacctttttacgcgatcccgaacgaaaaactacgaccgctaccccaaaccgaatcgacgccgaccaactctcgcctaaaacgcacccctcctcctcaacgtttccgcccccaacgccttaaatacttccttcctccctccgaaataccgacgctaactaacgacgtaaataacgataaacgtataactttaaccgtattattaaaaacaaaccaactaaaccgcgaaacgacctcccgcctcccgacgcacgtatacaaatacgcgctaaaccaaaccccttccaaaaaatcgaacccgaataaaaaaccga

SEQ ID NO: 26095 - DNA, 976 bp, Artificial Sequence
  chemically treated genomic DNA (Homo sapiens) CpG-island No: 26095
  misc_feature (231)..(231): n is either a, c, g or t
gaggaagtaggaaggtgggatttgttttaaaagggtgcgggaaggggacgttttatatcgtttcgttttttagtgtttttagttttattattcgacgtgtacggggacggtcgatacgtttattttatatttcgtcggttggggcgggatttgggcggcggttgcggtttggcgcgcgtttcgtattttttttttcgggaggttgggcgggatttcggcgaggggggcggntttcgtaagcgttcgtttttttttttttttcgtttttttttcgtttcgcgtttcgtttagcggcgtagggggtcgggtttcggttaggagggtgggggtcgcgtcggtgatagtcgattttcgtttttgttgttcgttacgttttttacgtattattcggtagaggcgcggggaaatttggcgtattggttgtggtttttttagcgggattcggtatgaggttggcgcggttgtttcgcggagtcgttttggtcggttcgggttcggggttgcgcgtcgtcggttttagtcgtagttttagttcggattcgggttttagttcggcgttcgagcgcggcgtttcgggttaggtggatttttacgcgcgtttttcgtcgttttcgttttttatgaagtagtttttggatttcggtgagtgcggttcgggattttgggtttttttgcgcggtttcgggcggggagttgcggtcgttgttttaggtcgggtcggcgtcggttagttttcgtttgaggcgtattttttttttttagcgttttcgtttttagcgttttaggtgtttttttttttttttcgaagtgtcggcgttggttggcggcgtaaataacggtgggcgtgtggttttgatcgtattgttgaaaataaattagttgggtcgcgggacgatttttcgtttttcggcgtacgtgtgtaggtgcgcgttaggttaggttttttttaaggagtcggattcgggtgggaggtcga

SEQ ID NO: 26096 - DNA, 976 bp, Artificial Sequence
  chemically treated genomic DNA (Homo sapiens) CpG-island No: 26096
  misc_feature (746)..(746): n is either a, c, g or t
tcgacctcccacccgaatccgactccttaaaaaaaacctaacctaacgcgcacctacacacgtacgccgaaaaacgaaaaatcgtcccgcgacccaactaatttattttcaacaatacgatcaaaaccacacgcccaccgttatttacgccgccaaccaacgccgacacttcgaaaaaaaaaaaaaaacacctaaaacgctaaaaacgaaaacgctaaaaaaaaaaaatacgcctcaaacgaaaactaaccgacgccgacccgacctaaaacaacgaccgcaactccccgcccgaaaccgcgcaaaaaaacccaaaatcccgaaccgcactcaccgaaatccaaaaactacttcataaaaaacgaaaacgacgaaaaacgcgcgtaaaaatccacctaacccgaaacgccgcgctcgaacgccgaactaaaacccgaatccgaactaaaactacgactaaaaccgacgacgcgcaaccccgaacccgaaccgaccaaaacgactccgcgaaacaaccgcgccaacctcataccgaatcccgctaaaaaaaccacaaccaatacgccaaatttccccgcgcctctaccgaataatacgtaaaaaacgtaacgaacaacaaaaacgaaaatcgactatcaccgacgcgacccccaccctcctaaccgaaacccgaccccctacgccgctaaacgaaacgcgaaacgaaaaaaaaacgaaaaaaaaaaaaaaacgaacgcttacgaaanccgcccccctcgccgaaatcccgcccaacctcccgaaaaaaaaaatacgaaacgcgcgccaaaccgcaaccgccgcccaaatcccgccccaaccgacgaaatataaaataaacgtatcgaccgtccccgtacacgtcgaataataaaactaaaaacactaaaaaacgaaacgatataaaacgtccccttcccgcacccttttaaaacaaatcccaccttcctacttcctc

SEQ ID NO: 26097 - DNA, 826 bp, Artificial Sequence
  chemically treated genomic DNA (Homo sapiens) CpG-island No: 26097
ttttttcggtatcggtaggtcgcggcgggagttgttttcgtttttaattttgtaggtgcgtgtgtcgcgggcgttcggggtaggtaggacgtagaggaggaggcgttcgttatgttcggtttgcggtttttcgtttcggtttttcgttcgtcgttttcgcggaacggtttgttgtagtttttgtgaagaggaagaggcggcggcggcggcggaggaggaggaggcgtcgtttttttggtaagtttttcgattcggcggtttcggtaggatttatggcggatttttcgttcgtattgtttttgcgggaaggcggttttcgcgcgtcgcggttttcggttttttcgtcgtcgtcgcgttcgcgtttcggtttcgagttcgaggaggtcgagttgtcgttgagtttggttcgtattaagattcgttcgtacggtagtatcgttagcgtgcgggcgtcgttgggcgtcggcgttatcgagcgttatgtggagtatcgggttcgcgcgggcgatacgttgtagggtatcgcgtttaagtacggtgttacggtgagtagggcgcgtcgtcgcggttcgggttggtagttatcgcgtaggaggcggtgcggttcggggtgcggtgggggtgggggtgggattgcgggtgggggtttgggggatggggagtcgtagggacggtcgtgcgttttcgggcggttcggtttttagggttcgtttagcgcgcgttgttggttatcgtagtggtcgttaaagttggttttgtagcgggaggggcggatcgttagggttttttttttaggtagttgtatcgagttttcggtgtttcgttt

SEQ ID NO: 26098 - DNA, 826 bp, Artificial Sequence
  chemically treated genomic DNA (Homo sapiens) CpG-island No: 26098
aaacgaaacaccgaaaactcgatacaactacctaaaaaaaaaaccctaacgatccgcccctcccgctacaaaaccaactttaacgaccactacgataaccaacaacgcgcgctaaacgaaccctaaaaaccgaaccgcccgaaaacgcacgaccgtccctacgactccccatcccccaaacccccacccgcaatcccacccccacccccaccgcaccccgaaccgcaccgcctcctacgcgataactaccaacccgaaccgcgacgacgcgccctactcaccgtaacaccgtacttaaacgcgataccctacaacgtatcgcccgcgcgaacccgatactccacataacgctcgataacgccgacgcccaacgacgcccgcacgctaacgatactaccgtacgaacgaatcttaatacgaaccaaactcaacgacaactcgacctcctcgaactcgaaaccgaaacgcgaacgcgacgacgacgaaaaaaccgaaaaccgcgacgcgcgaaaaccgccttcccgcaaaaacaatacgaacgaaaaatccgccataaatcctaccgaaaccgccgaatcgaaaaacttaccaaaaaaacgacgcctcctcctcctccgccgccgccgccgcctcttcctcttcacaaaaactacaacaaaccgttccgcgaaaacgacgaacgaaaaaccgaaacgaaaaaccgcaaaccgaacataacgaacgcctcctcctctacgtcctacctaccccgaacgcccgcgacacacgcacctacaaaattaaaaacgaaaacaactcccgccgcgacctaccgataccgaaaaaa

SEQ ID NO: 26099 - DNA, 826 bp, Artificial Sequence
  chemically treated genomic DNA (Homo sapiens) CpG-island No: 26099
gggcggggtatcgggaattcgatgtagttatttagggagggagttttggcggttcgtttttttcgttgtaggattagttttggcgattattgcggtggttagtagcgcgcgttgagcgagttttgggagtcgagtcgttcggggacgtacggtcgtttttgcgattttttattttttaaatttttattcgtagttttatttttatttttatcgtatttcgagtcgtatcgttttttgcgcggtagttgttagttcgggtcgcggcggcgcgttttgtttatcgtgatatcgtatttgagcgcgatgttttgtagcgtgtcgttcgcgcggattcggtgttttatatggcgttcgatgacgtcggcgtttagcggcgttcgtacgttggcggtgttgtcgtacgagcgggttttggtgcgggttaggtttagcgatagttcggttttttcggattcggagtcggagcgcgagcgcggcggcggcgagggggtcgagggtcgcggcgcgcgggggtcgttttttcgtagggatagtgcgggcgaggaattcgttatgggttttgtcgaggtcgtcgggtcggggagtttgttaagggggcggcgtttttttttttttcgtcgtcgtcgtcgtttttttttttttataggggttgtagtaggtcgtttcgcgggggcggcggacgggaagtcgaggcggggagtcgtaggtcgggtatggcgggcgtttttttttttgcgttttgtttgtttcgggcgttcgcggtatacgtatttgtaaggttaagagcgaaagtagttttcgtcgcggtttgtcggtatcgggaaga

SEQ ID NO: 26100 - DNA, 826 bp, Artificial Sequence
  chemically treated genomic DNA (Homo sapiens) CpG-island No: 26100
tcttcccgataccgacaaaccgcgacgaaaactactttcgctcttaaccttacaaatacgtataccgcgaacgcccgaaacaaacaaaacgcaaaaaaaaaaacgcccgccatacccgacctacgactccccgcctcgacttcccgtccgccgcccccgcgaaacgacctactacaacccctataaaaaaaaaaaaacgacgacgacgacgaaaaaaaaaaaaacgccgcccccttaacaaactccccgacccgacgacctcgacaaaacccataacgaattcctcgcccgcactatccctacgaaaaaacgacccccgcgcgccgcgaccctcgaccccctcgccgccgccgcgctcgcgctccgactccgaatccgaaaaaaccgaactatcgctaaacctaacccgcaccaaaacccgctcgtacgacaacaccgccaacgtacgaacgccgctaaacgccgacgtcatcgaacgccatataaaacaccgaatccgcgcgaacgacacgctacaaaacatcgcgctcaaatacgatatcacgataaacaaaacgcgccgccgcgacccgaactaacaactaccgcgcaaaaaacgatacgactcgaaatacgataaaaataaaaataaaactacgaataaaaatttaaaaaataaaaaatcgcaaaaacgaccgtacgtccccgaacgactcgactcccaaaactcgctcaacgcgcgctactaaccaccgcaataatcgccaaaactaatcctacaacgaaaaaaacgaaccgccaaaactccctccctaaataactacatcgaattcccgataccccgccc

SEQ ID NO: 26101 - DNA, 590 bp, Artificial Sequence
  chemically treated genomic DNA (Homo sapiens) CpG-island No: 26101
gttgcggtttagcgggttgtagaggttgcggtatcgtagtgcggggcgcgggatttatatttcggcgggcgtttttcgttcgggcgtagcgtttggtttttcggcgtagtcgatcgggtcgggaggcgagaggcgagaggcggttcggttttgtacgttcgttcggtcgatcgtttatgtcgcggagtattttttcgcgggtagggagggtacggcggttatcgcgttgcgggttcgggggttgtagatatcggttgtttagaataggttttattcgtttttcggggcgtttattcgttcgtgcgtttatttcggagtcggttgtgttggtcgttagttcgttagtttcggtggagcggggtcgggagaataggggcggcgtcgtggtcggggcgagcgcggcgattaataggcggttttcggtcgggcgcggcgtcggggcgcgcggttgtagcggagtaggttgggaagcgtagttttcggttgagtttcgtcgcggtttcgtagttttttagtttcgttttttttcgataggtgttttttttcggaatcggggtttgaatttcgttatagttttgtaggggaggaag

SEQ ID NO: 26102 - DNA, 590 bp, Artificial Sequence
  chemically treated genomic DNA (Homo sapiens) CpG-island No: 26102
cttcctcccctacaaaactataacgaaattcaaaccccgattccgaaaaaaaacacctatcgaaaaaaaacgaaactaaaaaactacgaaaccgcgacgaaactcaaccgaaaactacgcttcccaacctactccgctacaaccgcgcgccccgacgccgcgcccgaccgaaaaccgcctattaatcgccgcgctcgccccgaccacgacgccgcccctattctcccgaccccgctccaccgaaactaacgaactaacgaccaacacaaccgactccgaaataaacgcacgaacgaataaacgccccgaaaaacgaataaaacctattctaaacaaccgatatctacaacccccgaacccgcaacgcgataaccgccgtaccctccctacccgcgaaaaaatactccgcgacataaacgatcgaccgaacgaacgtacaaaaccgaaccgcctctcgcctctcgcctcccgacccgatcgactacgccgaaaaaccaaacgctacgcccgaacgaaaaacgcccgccgaaatataaatcccgcgccccgcactacgataccgcaacctctacaacccgctaaaccgcaac

SEQ ID NO: 26103 - DNA, 590 bp, Artificial Sequence
  chemically treated genomic DNA (Homo sapiens) CpG-island No: 26103
tttttttttttgtagagttgtggcggggtttagatttcgatttcgggagaggatatttgtcggggaagggcggggttgggggattgcggggtcgcggcgaggtttagtcgggaattacgttttttagtttgtttcgttgtagtcgcgcgtttcggcgtcgcgttcggtcgggagtcgtttgttgatcgtcgcgttcgtttcggttacggcgtcgtttttgttttttcggtttcgttttatcggggttgacggattgacggttagtatagtcggtttcgggatgagcgtacggacgggtgagcgtttcggggggcgggtggggtttgttttggatagtcggtgtttgtagttttcgggttcgtagcgcggtggtcgtcgtgttttttttgttcgcgggaggatgtttcgcgatatgggcggtcggtcgggcgggcgtgtagagtcgggtcgtttttcgtttttcgtttttcggttcggtcggttgcgtcgggagattaggcgttgcgttcgggcgggaggcgttcgtcggggtgtgagtttcgcgtttcgtattgcggtgtcgtagtttttgtagttcgttgggtcgtagt

SEQ ID NO: 26104 - DNA, 590 bp, Artificial Sequence
  chemically treated genomic DNA (Homo sapiens) CpG-island No: 26104
actacgacccaacgaactacaaaaactacgacaccgcaatacgaaacgcgaaactcacaccccgacgaacgcctcccgcccgaacgcaacgcctaatctcccgacgcaaccgaccgaaccgaaaaacgaaaaacgaaaaacgacccgactctacacgcccgcccgaccgaccgcccatatcgcgaaacatcctcccgcgaacaaaaaaaacacgacgaccaccgcgctacgaacccgaaaactacaaacaccgactatccaaaacaaaccccacccgccccccgaaacgctcacccgtccgtacgctcatcccgaaaccgactatactaaccgtcaatccgtcaaccccgataaaacgaaaccgaaaaaacaaaaacgacgccgtaaccgaaacgaacgcgacgatcaacaaacgactcccgaccgaacgcgacgccgaaacgcgcgactacaacgaaacaaactaaaaaacgtaattcccgactaaacctcgccgcgaccccgcaatcccccaaccccgcccttccccgacaaatatcctctcccgaaatcgaaatctaaaccccgccacaactctacaaaaaaaaaaa

SEQ ID NO: 26105 - DNA, 775 bp, Artificial Sequence
  chemically treated genomic DNA (Homo sapiens) CpG-island No: 26105
tcggcgacgagggcgagcgttttcgggtttattacgagtacggggatttcggcggttagcgagtagaggagtacggggggtacggcgttgttgtttttcgggttcgggtagggtttgcggtaggcgttgtcgtggtagaagaagttttgtacgtttacggtgaacgtgttcgtatattcgaagtagtacgttagtattatcgtttttgttatgattattatttggaaatagagtatgttgttggtgagcgtcgcgggtagtaggggtatgtacgtttttcgggtcgggtcgagtcgagtcgagcgggcggtcgacgcggtgggtttttttttcggttcgtcgaggtagttatcgggggcgcggcggcggaggcggcgggaggacgaggtacgggaggcgggatggagtcgttggaggaagaggcggaggtaggttcgggtttcgaggcgtcggtaggttgtagaggaggcggttattttcggacgagtttttttttttttgttcgttttttgttcgtcgtaagcgtcgttcgtttcggcgcggggtcgcgagggagggcggggagtttcgggcgacgggtagcggtcgttgcgtttttgtacgagattattcgagaagtagcggcgttgggttaattttttaggttagttcggaggaggcgttgcgtgggcggacggggcggtagtcggcgggatagcggtatttgtattttttatagggcggacgttgtggggttggagaagtttttggcgggggtaaaattaaaaggggggga

SEQ ID NO: 26106 - DNA, 775 bp, Artificial Sequence
  chemically treated genomic DNA (Homo sapiens) CpG-island No: 26106
tcccccccttttaattttacccccgccaaaaacttctccaaccccacaacgtccgccctataaaaaatacaaataccgctatcccgccgactaccgccccgtccgcccacgcaacgcctcctccgaactaacctaaaaaattaacccaacgccgctacttctcgaataatctcgtacaaaaacgcaacgaccgctacccgtcgcccgaaactccccgccctccctcgcgaccccgcgccgaaacgaacgacgcttacgacgaacaaaaaacgaacaaaaaaaaaaaaactcgtccgaaaataaccgcctcctctacaacctaccgacgcctcgaaacccgaacctacctccgcctcttcctccaacgactccatcccgcctcccgtacctcgtcctcccgccgcctccgccgccgcgcccccgataactacctcgacgaaccgaaaaaaaaacccaccgcgtcgaccgcccgctcgactcgactcgacccgacccgaaaaacgtacatacccctactacccgcgacgctcaccaacaacatactctatttccaaataataatcataacaaaaacgataatactaacgtactacttcgaatatacgaacacgttcaccgtaaacgtacaaaacttcttctaccacgacaacgcctaccgcaaaccctacccgaacccgaaaaacaacaacgccgtaccccccgtactcctctactcgctaaccgccgaaatccccgtactcgtaataaacccgaaaacgctcgccctcgtcgccga

SEQ ID NO: 26107 - DNA, 775 bp, Artificial Sequence
  chemically treated genomic DNA (Homo sapiens) CpG-island No: 26107
ttttttttttttgattttattttcgttaggagtttttttagttttatagcgttcgttttgtgaggggtataggtgtcgttgtttcgtcggttgtcgtttcgttcgtttacgtagcgtttttttcgggttagtttgggggattgatttagcgtcgttgtttttcgaatggtttcgtgtaggggcgtagcggtcgttgttcgtcgttcgggatttttcgttttttttcgcgatttcgcgtcggggcgggcggcgtttgcggcgggtagggggcgggtaggggagagggggttcgttcgggggtagtcgttttttttgtagtttgtcggcgtttcgaagttcggatttgttttcgtttttttttttagcggttttatttcgtttttcgtgtttcgttttttcgtcgttttcgtcgtcgcgttttcggtggttgtttcggcggatcggggagggggtttatcgcgtcgatcgttcgttcggttcggttcggttcggttcgggaggcgtgtatgtttttgttgttcgcggcgtttattagtagtatgttttatttttagatggtgattatggtagggacggtgatgttggcgtattatttcgagtatacggatacgtttatcgtgaacgtgtagggttttttttgttacgatagcgtttatcgtaaattttattcgggttcggaggatagtagcgtcgtgtttttcgtgtttttttattcgttggtcgtcggggttttcgtgttcgtggtaagttcgggggcgttcgttttcgtcgtcga

SEQ ID NO: 26108 - DNA, 775 bp, Artificial Sequence
  chemically treated genomic DNA (Homo sapiens) CpG-island No: 26108
tcgacgacgaaaacgaacgcccccgaacttaccacgaacacgaaaaccccgacgaccaacgaataaaaaaacacgaaaaacacgacgctactatcctccgaacccgaataaaatttacgataaacgctatcgtaacaaaaaaaaccctacacgttcacgataaacgtatccgtatactcgaaataatacgccaacatcaccgtccctaccataatcaccatctaaaaataaaacatactactaataaacgccgcgaacaacaaaaacatacacgcctcccgaaccgaaccgaaccgaaccgaacgaacgatcgacgcgataaaccccctccccgatccgccgaaacaaccaccgaaaacgcgacgacgaaaacgacgaaaaaacgaaacacgaaaaacgaaataaaaccgctaaaaaaaaaaacgaaaacaaatccgaacttcgaaacgccgacaaactacaaaaaaaacgactacccccgaacgaaccccctctcccctacccgccccctacccgccgcaaacgccgcccgccccgacgcgaaatcgcgaaaaaaaacgaaaaatcccgaacgacgaacaacgaccgctacgcccctacacgaaaccattcgaaaaacaacgacgctaaatcaatcccccaaactaacccgaaaaaaacgctacgtaaacgaacgaaacgacaaccgacgaaacaacgacacctatacccctcacaaaacgaacgctataaaactaaaaaaactcctaacgaaaataaaatcaaaaaaaaaaaa

SEQ ID NO: 26109 - DNA, 648 bp, Artificial Sequence
  chemically treated genomic DNA (Homo sapiens) CpG-island No: 26109
cgtagcgtttcgttgaagaggaagtttttaatttacgttttaattttaggttttcgtttttgcggtttttcggttcgtatttgggattttttttgtttttttttcggtttcggggttttatcgggtttcgttgtcgcgttgtttgtcgatgggggaggggcgcgtacgtgttcgcgtcgttttcgtttaaataatgtttcggagagcggggcgcgttttcggtcggtttttttttgcgttcgttaatatttatttttttttcgggttttcggttgtagcgcgggtttcgtcggtcgtcgcgagagagtacggcgaggtgagagagcgggcgaagtttcgcggagttgtttcgttataaggttttagcgattttcgtaatttgcggaagtatacggcgcggtggagttcgttcggcgcgtttcgtttcgtacgttagtagttgggcgcgtcggggcgcgcgcggcggcgcgcgcggtttcggggcggagtttttagggatgagggcggggcggggcggggcggggttggttcgggttgggatttcggttcgcgagggtattttttgggtagtgtgggcgtcgatttttgtaaaggtatagtcgtttattatttttttgttttagaagatggcgaattttaattttaagt

SEQ ID NO: 26110 - DNA, 648 bp, Artificial Sequence
  chemically treated genomic DNA (Homo sapiens) CpG-island No: 26110
acttaaaattaaaattcgccatcttctaaaacaaaaaaataataaacgactatacctttacaaaaatcgacgcccacactacccaaaaaataccctcgcgaaccgaaatcccaacccgaaccaaccccgccccgccccgccccgccctcatccctaaaaactccgccccgaaaccgcgcgcgccgccgcgcgcgccccgacgcgcccaactactaacgtacgaaacgaaacgcgccgaacgaactccaccgcgccgtatacttccgcaaattacgaaaatcgctaaaaccttataacgaaacaactccgcgaaacttcgcccgctctctcacctcgccgtactctctcgcgacgaccgacgaaacccgcgctacaaccgaaaacccgaaaaaaaaataaatattaacgaacgcaaaaaaaaaccgaccgaaaacgcgccccgctctccgaaacattatttaaacgaaaacgacgcgaacacgtacgcgcccctcccccatcgacaaacaacgcgacaacgaaacccgataaaaccccgaaaccgaaaaaaaaacaaaaaaaatcccaaatacgaaccgaaaaaccgcaaaaacgaaaacctaaaattaaaacgtaaattaaaaacttcctcttcaacgaaacgctacg

SEQ ID NO: 26111 - DNA, 648 bp, Artificial Sequence
  chemically treated genomic DNA (Homo sapiens) CpG-island No: 26111
atttggggttgaaattcgttattttttggggtaggaaagtgatggacgattgtgtttttgtaagaatcgacgtttatattgtttaggaagtgttttcgcgggtcggggttttagttcggattagtttcgtttcgtttcgtttcgtttttatttttgggagtttcgtttcgaggtcgcgcgcgtcgtcgcgcgcgtttcgacgcgtttagttgttgacgtgcggggcggaacgcgtcgggcgggttttatcgcgtcgtgtgttttcgtaggttgcgggggtcgttggggttttgtggcggggtagtttcgcggggtttcgttcgtttttttatttcgtcgtgttttttcgcggcggtcggcggggttcgcgttgtagtcggagattcggagaaagggtgagtgttggcgggcgtaggaagggatcggtcgggagcgcgtttcgtttttcggggtattgtttgggcgggggcggcgcgggtacgtgcgcgttttttttttatcggtaggtagcgcggtagcgggattcggtgaggtttcggggtcgaggggagggtagggaggattttaggtgcgggtcggggagtcgtagaagcgggagtttggaattggaacgtgagttgggggttttttttttagcggggcgttgcg

SEQ ID NO: 26112 - DNA, 648 bp, Artificial Sequence
  chemically treated genomic DNA (Homo sapiens) CpG-island No: 26112
cgcaacgccccgctaaaaaaaaaacccccaactcacgttccaattccaaactcccgcttctacgactccccgacccgcacctaaaatcctccctaccctcccctcgaccccgaaacctcaccgaatcccgctaccgcgctacctaccgataaaaaaaaaacgcgcacgtacccgcgccgcccccgcccaaacaataccccgaaaaacgaaacgcgctcccgaccgatcccttcctacgcccgccaacactcaccctttctccgaatctccgactacaacgcgaaccccgccgaccgccgcgaaaaaacacgacgaaataaaaaaacgaacgaaaccccgcgaaactaccccgccacaaaaccccaacgacccccgcaacctacgaaaacacacgacgcgataaaacccgcccgacgcgttccgccccgcacgtcaacaactaaacgcgtcgaaacgcgcgcgacgacgcgcgcgacctcgaaacgaaactcccaaaaataaaaacgaaacgaaacgaaacgaaactaatccgaactaaaaccccgacccgcgaaaacacttcctaaacaatataaacgtcgattcttacaaaaacacaatcgtccatcactttcctaccccaaaaaataacgaatttcaaccccaaat

SEQ ID NO: 26113 - DNA, 910 bp, Artificial Sequence
  chemically treated genomic DNA (Homo sapiens) CpG-island No: 26113
gcgtcgtttgtagtgtttacggattaaacgggggtgatttttgaggtcgtcggtagtttcgaggtcgcgtgggattcgggttttaggcgttttcgttttgtcgtttattttatttttttggtttcgggttttcgcgtttttttattatagggtggggattcgttgcggtttttatttagtttatatttgtacgacgtggttattgttgtagtcgcgttcgcgtcgtcgatgggtagtacgtagatttcgcgggcgtcgggcgtaggtggcgcggaggattgcgcggaggatttgtttttgcggtcgttcgttttcggttcgcgtttcggcggcggatttttgggttcggcgggcgtggtttataagtcgaagtttcgttggtattgagtgagcggtacgtttcggtcggaatttcgggcgttcgcgggaggttggtttttgcgcgaggcggcgtcgttcgtgttcggtttttcgttgtcgaggttcgagtagtcgtgtagagtgagcggtatcgttacgtcggagcggtttagttggttttaacgtcgcgttaggtagtataggcggttgatatagggttacgttatgttagtttcggcgttcgtcgtttcgttttcggcgcgcggcgttttcggtcgcgttttttgcgtttagcgttttcgttttcgcggttcgtttcgcgtcgtcgtagtatcgtttttcggtacgagggtgggcgtttcgggagggggcgtattcggcggtagttttatttggtcggggtcggttgcgtacggttggagttggagggagcgcggatgggggaaaggttgtatcgtcgttagggggtatcggaaatcgtttgtatttatttataagtgtttatttcgaagaatgttttagaattgaatttaaagtttttttagtgtta

SEQ ID NO: 26114 - DNA, 910 bp, Artificial Sequence
  chemically treated genomic DNA (Homo sapiens) CpG-island No: 26114
taacactaaaaaaactttaaattcaattctaaaacattcttcgaaataaacacttataaataaatacaaacgatttccgataccccctaacgacgatacaacctttcccccatccgcgctccctccaactccaaccgtacgcaaccgaccccgaccaaataaaactaccgccgaatacgccccctcccgaaacgcccaccctcgtaccgaaaaacgatactacgacgacgcgaaacgaaccgcgaaaacgaaaacgctaaacgcaaaaaacgcgaccgaaaacgccgcgcgccgaaaacgaaacgacgaacgccgaaactaacataacgtaaccctatatcaaccgcctatactacctaacgcgacgttaaaaccaactaaaccgctccgacgtaacgataccgctcactctacacgactactcgaacctcgacaacgaaaaaccgaacacgaacgacgccgcctcgcgcaaaaaccaacctcccgcgaacgcccgaaattccgaccgaaacgtaccgctcactcaataccaacgaaacttcgacttataaaccacgcccgccgaacccaaaaatccgccgccgaaacgcgaaccgaaaacgaacgaccgcaaaaacaaatcctccgcgcaatcctccgcgccacctacgcccgacgcccgcgaaatctacgtactacccatcgacgacgcgaacgcgactacaacaataaccacgtcgtacaaatataaactaaataaaaaccgcaacgaatccccaccctataataaaaaaacgcgaaaacccgaaaccaaaaaaataaaataaacgacaaaacgaaaacgcctaaaacccgaatcccacgcgacctcgaaactaccgacgacctcaaaaatcacccccgtttaatccgtaaacactacaaacgacgc

SEQ ID NO: 26115 - DNA, 910 bp, Artificial Sequence
  chemically treated genomic DNA (Homo sapiens) CpG-island No: 26115
tgatattgagggaattttggatttaattttgaggtatttttcgagatggatatttgtaaatgaatgtaggcggttttcggtgttttttggcgacggtgtagttttttttttattcgcgttttttttagttttagtcgtgcgtagtcggtttcggttaagtggggttgtcgtcgagtgcgttttttttcgggacgtttattttcgtgtcggggggcggtgttgcggcggcgcggggcgggtcgcgggggcggggacgttgggcgtaggaggcgcggtcgggagcgtcgcgcgtcgggagcggggcggcgggcgtcggggttggtatggcgtggttttgtattagtcgtttgtgttgtttggcgcggcgttggaattagttggatcgtttcgacgtggcggtgtcgtttattttgtacggttattcggatttcgatagcgaggagtcgggtacgggcggcgtcgtttcgcgtaggggttagtttttcgcgggcgttcgggatttcggtcgggacgtgtcgtttatttagtattagcgggatttcggtttgtggattacgttcgtcgggtttaaggattcgtcgtcggggcgcggatcgggggcgggcggtcgtaggggtaaatttttcgcgtagtttttcgcgttatttgcgttcggcgttcgcggggtttacgtgttgtttatcggcgacgcggacgcggttgtagtagtgattacgtcgtataggtatgggttgggtagggatcgtaacgagtttttattttgtggtgggaggacgcggaggttcggagttagagggatggggtgggcggtagagcggaggcgtttggagttcggattttacgcgatttcggagttgtcggcggttttagaggttattttcgtttggttcgtgggtattgtaggcggcgt

SEQ ID NO: 26116 - DNA, 910 bp, Artificial Sequence
  chemically treated genomic DNA (Homo sapiens) CpG-island No: 26116
acgccgcctacaatacccacgaaccaaacgaaaataacctctaaaaccgccgacaactccgaaatcgcgtaaaatccgaactccaaacgcctccgctctaccgcccaccccatccctctaactccgaacctccgcgtcctcccaccacaaaataaaaactcgttacgatccctacccaacccatacctatacgacgtaatcactactacaaccgcgtccgcgtcgccgataaacaacacgtaaaccccgcgaacgccgaacgcaaataacgcgaaaaactacgcgaaaaatttacccctacgaccgcccgcccccgatccgcgccccgacgacgaatccttaaacccgacgaacgtaatccacaaaccgaaatcccgctaatactaaataaacgacacgtcccgaccgaaatcccgaacgcccgcgaaaaactaacccctacgcgaaacgacgccgcccgtacccgactcctcgctatcgaaatccgaataaccgtacaaaataaacgacaccgccacgtcgaaacgatccaactaattccaacgccgcgccaaacaacacaaacgactaatacaaaaccacgccataccaaccccgacgcccgccgccccgctcccgacgcgcgacgctcccgaccgcgcctcctacgcccaacgtccccgcccccgcgacccgccccgcgccgccgcaacaccgccccccgacacgaaaataaacgtcccgaaaaaaaacgcactcgacgacaaccccacttaaccgaaaccgactacgcacgactaaaactaaaaaaaacgcgaataaaaaaaaaactacaccgtcgccaaaaaacaccgaaaaccgcctacattcatttacaaatatccatctcgaaaaatacctcaaaattaaatccaaaattccctcaatatca

SEQ ID NO: 26117 - DNA, 764 bp, Artificial Sequence
  chemically treated genomic DNA (Homo sapiens) CpG-island No: 26117
tttagagcgggggtcgtcgcgatttcgtcgagtaggaagaggcggagcgcgggacggtcgcgggaaaaggcgcgcggaaggggttttgttatcgcgttatttggtttgttttcgtttcgtcgcgttatttcgtttgttttcgtttttcgttcgtcgcgttatgtttgtggtcggttcggagttgtcgcgtcggtttttgtttttcgtcgtataggagcgggacgtcgagtcgcgttcgtcgtacggggagttgtagtatttggggtagatttaatatatttttcgttgcggcgttaggaaggacgatcgtacgggtatcggtattttgtcggtattcggtatgtaggcgcgttatagtttgagaggtgacgtcgcgggtttttgcgggacgggtggcgggaaggagggaggcgcggttggggagagcgttcgggagttgtcgggcgttgcggatttcgtttagttttaattttaattttgcgagggagggggacgtatcgtttttttcgttttatagacgtcgaaacggagggttttattagggacgtgattggcgcgggtaatatatatagtagcgatagtcgggaggtaagtcgcgttttagcggtttcgcggtcgggttcgtagtcgttttagtgatgtcgtggttttcgaggcgggcgttatcgggtagcgtttgtttagtgttggagggttagggagagttgtttgggtttgatcgcgcgtcggttttaaagttttggttttggtttttttttcgtttt

SEQ ID NO: 26118 - DNA, 764 bp, Artificial Sequence
  chemically treated genomic DNA (Homo sapiens) CpG-island No: 26118
aaaacgaaaaaaaaaccaaaaccaaaactttaaaaccgacgcgcgatcaaacccaaacaactctccctaaccctccaacactaaacaaacgctacccgataacgcccgcctcgaaaaccacgacatcactaaaacgactacgaacccgaccgcgaaaccgctaaaacgcgacttacctcccgactatcgctactatatatattacccgcgccaatcacgtccctaataaaaccctccgtttcgacgtctataaaacgaaaaaaacgatacgtccccctccctcgcaaaattaaaattaaaactaaacgaaatccgcaacgcccgacaactcccgaacgctctccccaaccgcgcctccctccttcccgccacccgtcccgcaaaaacccgcgacgtcacctctcaaactataacgcgcctacataccgaataccgacaaaataccgatacccgtacgatcgtccttcctaacgccgcaacgaaaaatatattaaatctaccccaaatactacaactccccgtacgacgaacgcgactcgacgtcccgctcctatacgacgaaaaacaaaaaccgacgcgacaactccgaaccgaccacaaacataacgcgacgaacgaaaaacgaaaacaaacgaaataacgcgacgaaacgaaaacaaaccaaataacgcgataacaaaaccccttccgcgcgccttttcccgcgaccgtcccgcgctccgcctcttcctactcgacgaaatcgcgacgacccccgctctaaa

SEQ ID NO: 26119 - DNA, 764 bp, Artificial Sequence
  chemically treated genomic DNA (Homo sapiens) CpG-island No: 26119
aaaacggaggaggggttaaagttaggattttgagatcggcgcgcggttaagtttaggtagttttttttaattttttagtattgggtaaacgttgttcgatgacgttcgtttcgggggttacggtattattggggcgattgcgagttcggtcgcggagtcgttgggacgcggtttatttttcggttgtcgttgttgtgtgtgttgttcgcgttagttacgtttttaatgggatttttcgtttcggcgtttgtaaggcgaggaggacgatgcgtttttttttttcgtaggattgaggttaggattaaacggggttcgtagcgttcggtagttttcgagcgttttttttagtcgcgtttttttttttttcgttattcgtttcgtaggggttcgcggcgttattttttaggttgtagcgcgtttgtatgtcgaatatcgatagggtgtcggtgttcgtgcggtcgttttttttgacgtcgtagcggaggatgtgttggatttgttttaggtattgtagtttttcgtgcggcggacgcggttcggcgtttcgtttttgtgcggcggggggtaagggtcggcgcggtagtttcgagtcggttataggtatggcgcggcgggcgggggacggaggtaggcgaagtggcgcggcgggacggaggtaggttaagtggcgcggtggtaggatttttttcgcgcgttttttttcgcggtcgtttcgcgtttcgtttttttttgttcggcggggtcgcggcggttttcgttttaga

SEQ ID NO: 26120 - DNA, 764 bp, Artificial Sequence
  chemically treated genomic DNA (Homo sapiens) CpG-island No: 26120
tctaaaacgaaaaccgccgcgaccccgccgaacaaaaaaaaacgaaacgcgaaacgaccgcgaaaaaaaacgcgcgaaaaaaatcctaccaccgcgccacttaacctacctccgtcccgccgcgccacttcgcctacctccgtcccccgcccgccgcgccatacctataaccgactcgaaactaccgcgccgacccttaccccccgccgcacaaaaacgaaacgccgaaccgcgtccgccgcacgaaaaactacaatacctaaaacaaatccaacacatcctccgctacgacgtcaaaaaaaacgaccgcacgaacaccgacaccctatcgatattcgacatacaaacgcgctacaacctaaaaaataacgccgcgaacccctacgaaacgaataacgaaaaaaaaaaaaacgcgactaaaaaaaacgctcgaaaactaccgaacgctacgaaccccgtttaatcctaacctcaatcctacgaaaaaaaaaaacgcatcgtcctcctcgccttacaaacgccgaaacgaaaaatcccattaaaaacgtaactaacgcgaacaacacacacaacaacgacaaccgaaaaataaaccgcgtcccaacgactccgcgaccgaactcgcaatcgccccaataataccgtaacccccgaaacgaacgtcatcgaacaacgtttacccaatactaaaaaattaaaaaaaactacctaaacttaaccgcgcgccgatctcaaaatcctaactttaacccctcctccgtttt

SEQ ID NO: 26121 - DNA, 1618 bp, Artificial Sequence
  chemically treated genomic DNA (Homo sapiens) CpG-island No: 26121
ttagcgtcgttagtagcgcggggggtagcgcggcgggcgcggtggggtcgggcggcgggggcgacgcggcgggtagcgcggggtttaggtcgttattgtttcgttcggtcgttttcgtcgcggtcgtcgtgtttagcgtcggcgagttgaggtagaaataggacgcgaagttcgagtcgtcgcggtttacgttttgcgaggttttttagatttgtatttatagggtattggtcggttttttttgttcgggttggatttaggttacgcgcggatttatttacgcgtcgttttcgcggggttcgcgcgttcgttcgtttcgacgcggtttcgttttcgtcgcgtttcgaggttcggtcgcgcgcgtacggacggacggacgggtttgggtcggtggcggcggcggcggcggcggcggcgggcgggtcgagtttcggttttttgttttagtcgcgttttcgtcgggtttcggcgtggggcggcggcggcggtgatgggtttcggtaggtcgcggcgggcggtttcggcgtttggcgcgttttagcgggcggttgcggttttcgggttttcgttttacgcggcgcggggcgggcgcgggggtcgcggcggcggcggcgttttattcgggtcgcggggagaggttatcggagaagggcgggcggcggggtcgagggggcgggtttaggcgtcgagcggttgaaggattcgcgggaggcgtcgtcgttcgtgcggttagtttttagttacgttcgcgtcgttggttcggcgtttttgcggcggcggcggcggcggcggtgaaaagatattttcggcggcgatagcgcgggggaaggagggggtcgtcgtcgcgttcgttttaatgaggggcgggggagggggcggggacgggggcggtaggaggaagcgcggtttcggtcgtcgggtcgtgtcgtcggtgcgtacgcgcgatcgattttaaatttttattagatattgtcgtcgtggttatcgcgtttgcgcgttggggtttcgtcggtcgcgggcggggtgaggacggcgttagaagttacgcgattgggaggggttggagggagaggcggtggcgttgagttattattgattaggtcggcgttgggtggaataggtagcggttggaaggttcgtacgtcgttttcggttcgtcgcggcgcgtagatttcggcgtgtagatatgcgcgttagggtcggtgttatcgggttgtcgtttgagtcgcgttgcgcgtgcgtagggtagcgtggtcgttatcgtcgtcggtggaagttttcgagtagtcgggcgggggtagcggacgttatcgtaggcgtttttttcgtcggtcggtttttttttttgacgtaagggcgggtttcggtcgtagatttcgttttaggttttttattcgagggttcgtgtagtaggttacgttgcgttttttggggttcgcgcgtcggtttacgtgttttttgtatttcgcggggtgagcggttagcgtgtcgtgtcgggtggttggtttcgtcgtttcgggagtcgggaggatacgcggtagagttttgttttttagcgggtttgtttataggcgttgggtttgttttttaaaatgattttttatgcgaaaagtgaagt

SEQ ID NO: 26122 - DNA, 1618 bp, Artificial Sequence
  chemically treated genomic DNA (Homo sapiens) CpG-island No: 26122
acttcacttttcgcataaaaaatcattttaaaaaacaaacccaacgcctataaacaaacccgctaaaaaacaaaactctaccgcgtatcctcccgactcccgaaacgacgaaaccaaccacccgacacgacacgctaaccgctcaccccgcgaaatacaaaaaacacgtaaaccgacgcgcgaaccccaaaaaacgcaacgtaacctactacacgaaccctcgaataaaaaacctaaaacgaaatctacgaccgaaacccgcccttacgtcaaaaaaaaaaaccgaccgacgaaaaaaacgcctacgataacgtccgctacccccgcccgactactcgaaaacttccaccgacgacgataacgaccacgctaccctacgcacgcgcaacgcgactcaaacgacaacccgataacaccgaccctaacgcgcatatctacacgccgaaatctacgcgccgcgacgaaccgaaaacgacgtacgaaccttccaaccgctacctattccacccaacgccgacctaatcaataataactcaacgccaccgcctctccctccaacccctcccaatcgcgtaacttctaacgccgtcctcaccccgcccgcgaccgacgaaaccccaacgcgcaaacgcgataaccacgacgacaatatctaataaaaatttaaaatcgatcgcgcgtacgcaccgacgacacgacccgacgaccgaaaccgcgcttcctcctaccgcccccgtccccgccccctcccccgcccctcattaaaacgaacgcgacgacgaccccctccttcccccgcgctatcgccgccgaaaatatcttttcaccgccgccgccgccgccgccgcaaaaacgccgaaccaacgacgcgaacgtaactaaaaactaaccgcacgaacgacgacgcctcccgcgaatccttcaaccgctcgacgcctaaacccgccccctcgaccccgccgcccgcccttctccgataacctctccccgcgacccgaataaaacgccgccgccgccgcgacccccgcgcccgccccgcgccgcgtaaaacgaaaacccgaaaaccgcaaccgcccgctaaaacgcgccaaacgccgaaaccgcccgccgcgacctaccgaaacccatcaccgccgccgccgccccacgccgaaacccgacgaaaacgcgactaaaacaaaaaaccgaaactcgacccgcccgccgccgccgccgccgccgccgccaccgacccaaacccgtccgtccgtccgtacgcgcgcgaccgaacctcgaaacgcgacgaaaacgaaaccgcgtcgaaacgaacgaacgcgcgaaccccgcgaaaacgacgcgtaaataaatccgcgcgtaacctaaatccaacccgaacaaaaaaaaccgaccaataccctataaatacaaatctaaaaaacctcgcaaaacgtaaaccgcgacgactcgaacttcgcgtcctatttctacctcaactcgccgacgctaaacacgacgaccgcgacgaaaacgaccgaacgaaacaataacgacctaaaccccgcgctacccgccgcgtcgcccccgccgcccgaccccaccgcgcccgccgcgctaccccccgcgctactaacgacgctaa

SEQ ID NO: 26123 - DNA, 1618 bp, Artificial Sequence
  chemically treated genomic DNA (Homo sapiens) CpG-island No: 26123
attttatttttcgtatagaaaattattttaaaaagtaaatttaacgtttgtaagtagattcgttagggagtaggattttgtcgcgtgttttttcggttttcggagcggcggagttagttattcggtacggtacgttggtcgtttatttcgcgaggtgtagggagtacgtgggtcgacgcgcggattttagagagcgtagcgtgatttgttgtacggattttcggatgagagatttggggcgggatttgcgatcggggttcgtttttacgttaggagggagggtcggtcggcgggggaagcgtttgcggtggcgttcgttgttttcgttcggttgttcggaaatttttatcggcggcggtgacggttacgttgttttgcgtacgcgtagcgcggtttaggcggtagttcggtgatatcggttttagcgcgtatgtttgtacgtcggggtttgcgcgtcgcggcgggtcgagggcggcgtgcgggttttttagtcgttgtttattttatttaacgtcggtttagttagtaatggtttaacgttatcgtttttttttttagttttttttagtcgcgtagtttttgacgtcgtttttatttcgttcgcggtcgacggggttttaacgcgtaggcgcggtaattacggcggtagtgtttagtgaggatttgaaatcggtcgcgcgtgcgtatcggcgatacggttcggcgatcgaggtcgcgtttttttttgtcgttttcgttttcgttttttttttcgttttttattggagcggacgcggcggcggttttttttttttttcgcgttgtcgtcgtcgagagtgtttttttatcgtcgtcgtcgtcgtcgtcgtaggagcgtcgagttagcggcgcgagcgtgattgagggttagtcgtacgggcggcggcgtttttcgcgggttttttagtcgttcggcgtttgggttcgttttttcggtttcgtcgttcgttttttttcgatggttttttttcgcggttcgagtggaacgtcgtcgtcgtcgcggttttcgcgttcgtttcgcgtcgcgtgaagcgggagttcggagatcgtagtcgttcgttgggacgcgttaagcgtcggagtcgttcgtcgcggtttgtcggggtttattatcgtcgtcgtcgttttacgtcggagttcgacgggagcgcggttagagtaggaggtcggggttcggttcgttcgtcgtcgtcgtcgtcgtcgtcgttatcggtttaggttcgttcgttcgttcgtgcgcgcgcggtcgggtttcggggcgcggcgggggcggggtcgcgtcggggcgggcgggcgcgcgggtttcgcgggggcggcgcgtggatggattcgcgcgtggtttggatttagttcgagtagaaggggtcggttaatgttttgtggatgtagatttgggagatttcgtagggcgtgggtcgcggcggttcgggtttcgcgttttatttttgttttaattcgtcggcgttggatacggcggtcgcggcgggggcggtcgggcggggtagtggcggtttgggtttcgcgttgttcgtcgcgtcgttttcgtcgttcggttttatcgcgttcgtcgcgttgtttttcgcgttgttgacggcgttgg

SEQ ID NO: 26124 - DNA, 1618 bp, Artificial Sequence
  chemically treated genomic DNA (Homo sapiens) CpG-island No: 26124
ccaacgccgtcaacaacgcgaaaaacaacgcgacgaacgcgataaaaccgaacgacgaaaacgacgcgacgaacaacgcgaaacccaaaccgccactaccccgcccgaccgcccccgccgcgaccgccgtatccaacgccgacgaattaaaacaaaaataaaacgcgaaacccgaaccgccgcgacccacgccctacgaaatctcccaaatctacatccacaaaacattaaccgaccccttctactcgaactaaatccaaaccacgcgcgaatccatccacgcgccgcccccgcgaaacccgcgcgcccgcccgccccgacgcgaccccgcccccgccgcgccccgaaacccgaccgcgcgcgcacgaacgaacgaacgaacctaaaccgataacgacgacgacgacgacgacgacgaacgaaccgaaccccgacctcctactctaaccgcgctcccgtcgaactccgacgtaaaacgacgacgacgataataaaccccgacaaaccgcgacgaacgactccgacgcttaacgcgtcccaacgaacgactacgatctccgaactcccgcttcacgcgacgcgaaacgaacgcgaaaaccgcgacgacgacgacgttccactcgaaccgcgaaaaaaaaccatcgaaaaaaaacgaacgacgaaaccgaaaaaacgaacccaaacgccgaacgactaaaaaacccgcgaaaaacgccgccgcccgtacgactaaccctcaatcacgctcgcgccgctaactcgacgctcctacgacgacgacgacgacgacgataaaaaaacactctcgacgacgacaacgcgaaaaaaaaaaaaaaccgccgccgcgtccgctccaataaaaaacgaaaaaaaaaacgaaaacgaaaacgacaaaaaaaaacgcgacctcgatcgccgaaccgtatcgccgatacgcacgcgcgaccgatttcaaatcctcactaaacactaccgccgtaattaccgcgcctacgcgttaaaaccccgtcgaccgcgaacgaaataaaaacgacgtcaaaaactacgcgactaaaaaaaactaaaaaaaaaaacgataacgttaaaccattactaactaaaccgacgttaaataaaataaacaacgactaaaaaacccgcacgccgccctcgacccgccgcgacgcgcaaaccccgacgtacaaacatacgcgctaaaaccgatatcaccgaactaccgcctaaaccgcgctacgcgtacgcaaaacaacgtaaccgtcaccgccgccgataaaaatttccgaacaaccgaacgaaaacaacgaacgccaccgcaaacgcttcccccgccgaccgaccctccctcctaacgtaaaaacgaaccccgatcgcaaatcccgccccaaatctctcatccgaaaatccgtacaacaaatcacgctacgctctctaaaatccgcgcgtcgacccacgtactccctacacctcgcgaaataaacgaccaacgtaccgtaccgaataactaactccgccgctccgaaaaccgaaaaaacacgcgacaaaatcctactccctaacgaatctacttacaaacgttaaatttactttttaaaataattttctatacgaaaaataaaat

SEQ ID NO: 26125 - DNA, 699 bp, Artificial Sequence
  chemically treated genomic DNA (Homo sapiens) CpG-island No: 26125
ggtagcggcgtgtcggagggcggatggggttaggaggtcgttcggggggtggggtttgcggcgggtcggttttcgcgtgcgcgtcgtttcgtcgggtattttaaaagttcgtcggtagggcgcggcgttagtttcgtgtgtttcgtaggcgtggtgggcgcgttttggtagtcgttcgtttggttttcgcgggattcgggtttcggttcgacgtcggttttttttttgacgtttcgtcgtcggggttgttatggtttattttttgtattcgggttatacgtttcggaatatcgttttttttgacgtttagaaggatgttttgggttgttgcgtggtataggtgagtatcggggtgcggggggcgacgcggatttcggcgttacgtttagtttcggcgagcgcggcgagttttttgggacgttgtcgaggtatttgttggggagtgtggttcgcgcggggttgcggtttagatgtcgagttttttttaggcgtaggcgtcgtcgcggaggtgcgttgtcgggggaggcggtttgggcgtcgcggagcggggggggtttttttgcgttcggcgaagcgcgtggaatttgcgttttgaggtagcgcggcgagagtttagttttagagatcggggcgagtttttttaggatttttcgttttagtgcgggttgttgtgagtttagacgtaggtgtagggtatgg

SEQ ID NO: 26126 - DNA, 699 bp, Artificial Sequence
  chemically treated genomic DNA (Homo sapiens) CpG-island No: 26126
ccataccctacacctacgtctaaactcacaacaacccgcactaaaacgaaaaatcctaaaaaaactcgccccgatctctaaaactaaactctcgccgcgctacctcaaaacgcaaattccacgcgcttcgccgaacgcaaaaaaaccccccccgctccgcgacgcccaaaccgcctcccccgacaacgcacctccgcgacgacgcctacgcctaaaaaaaactcgacatctaaaccgcaaccccgcgcgaaccacactccccaacaaatacctcgacaacgtcccaaaaaactcgccgcgctcgccgaaactaaacgtaacgccgaaatccgcgtcgccccccgcaccccgatactcacctataccacgcaacaacccaaaacatccttctaaacgtcaaaaaaaacgatattccgaaacgtataacccgaatacaaaaaataaaccataacaaccccgacgacgaaacgtcaaaaaaaaaaccgacgtcgaaccgaaacccgaatcccgcgaaaaccaaacgaacgactaccaaaacgcgcccaccacgcctacgaaacacacgaaactaacgccgcgccctaccgacgaacttttaaaatacccgacgaaacgacgcgcacgcgaaaaccgacccgccgcaaaccccaccccccgaacgacctcctaaccccatccgccctccgacacgccgctacc

SEQ ID NO: 26127 - DNA, 699 bp, Artificial Sequence
  chemically treated genomic DNA (Homo sapiens) CpG-island No: 26127
ttatgttttgtatttacgtttaagtttatagtagttcgtattggggcgaggaattttgaggaggttcgtttcggtttttgggattgggttttcgtcgcgttgttttagggcgtaagttttacgcgtttcgtcgggcgtagaaaagtttttttcgtttcgcggcgtttaggtcgtttttttcgataacgtattttcgcggcgacgtttgcgtttggaaggggttcggtatttagatcgtagtttcgcgcgggttatattttttagtaagtgtttcggtagcgttttaggagattcgtcgcgttcgtcggagttggacgtggcgtcgaggttcgcgtcgtttttcgtatttcggtgtttatttgtattacgtagtagtttagggtatttttttgagcgttaggagggacgatgtttcggggcgtgtggttcgggtgtaagaaatgaattatggtaatttcggcggcggggcgttaaaaagagagtcggcgtcgagtcggagttcggatttcgcgagaattaagcgggcggttgttaggacgcgtttattacgtttgcgaggtatacggagttagcgtcgcgttttgtcggcgagtttttgaaatgttcggcgaggcgacgcgtacgcgggggtcggttcgtcgtagattttatttttcgggcggttttttagttttattcgtttttcgatacgtcgttgtt

SEQ ID NO: 26128 - DNA, 699 bp, Artificial Sequence
  chemically treated genomic DNA (Homo sapiens) CpG-island No: 26128
aacaacgacgtatcgaaaaacgaataaaactaaaaaaccgcccgaaaaataaaatctacgacgaaccgacccccgcgtacgcgtcgcctcgccgaacatttcaaaaactcgccgacaaaacgcgacgctaactccgtatacctcgcaaacgtaataaacgcgtcctaacaaccgcccgcttaattctcgcgaaatccgaactccgactcgacgccgactctctttttaacgccccgccgccgaaattaccataattcatttcttacacccgaaccacacgccccgaaacatcgtccctcctaacgctcaaaaaaataccctaaactactacgtaatacaaataaacaccgaaatacgaaaaacgacgcgaacctcgacgccacgtccaactccgacgaacgcgacgaatctcctaaaacgctaccgaaacacttactaaaaaatataacccgcgcgaaactacgatctaaataccgaaccccttccaaacgcaaacgtcgccgcgaaaatacgttatcgaaaaaaacgacctaaacgccgcgaaacgaaaaaaacttttctacgcccgacgaaacgcgtaaaacttacgccctaaaacaacgcgacgaaaacccaatcccaaaaaccgaaacgaacctcctcaaaattcctcgccccaatacgaactactataaacttaaacgtaaatacaaaacataa

SEQ ID NO: 26129 - DNA, 514 bp, Artificial Sequence
  chemically treated genomic DNA (Homo sapiens) CpG-island No: 26129
ggcgttcggtattaggagggtaacgaaggggtaggaggcgttgtcgttcgggcgtttttcgagtatagttaggaagttttttttattttatgggtttgcggtttttcgtcgggttgcgggcgtaggtagtttattatcgcggttaggtcggtttcggatatcgcggcggcgggcgcggcgagcggggatgcgcgggcgtcggggcggtagtcgtaacggattttgtttttttcgtgtaggtcggaggtttcgtttgggcgcgcggcgttcggttttttacgtgatcgttgcgggtgggtttgcgggcggaggacgggcgacggcggggcgggtttttaggtttcggttttttttttggcggcgcgttgggtttagcgtagggaagcggattcggtagggacggggagtgggacgcgcgaggggtagtaggggtaagagttcgggcgggtggtcgcgtgggttaaaggttaaaggttattttcgtaaatggtattaattgtgtagtttggtagtg

SEQ ID NO: 26130 - DNA, 514 bp, Artificial Sequence
  chemically treated genomic DNA (Homo sapiens) CpG-island No: 26130
cactaccaaactacacaattaataccatttacgaaaataacctttaacctttaacccacgcgaccacccgcccgaactcttacccctactacccctcgcgcgtcccactccccgtccctaccgaatccgcttccctacgctaaacccaacgcgccgccaaaaaaaaaaccgaaacctaaaaacccgccccgccgtcgcccgtcctccgcccgcaaacccacccgcaacgatcacgtaaaaaaccgaacgccgcgcgcccaaacgaaacctccgacctacacgaaaaaaacaaaatccgttacgactaccgccccgacgcccgcgcatccccgctcgccgcgcccgccgccgcgatatccgaaaccgacctaaccgcgataataaactacctacgcccgcaacccgacgaaaaaccgcaaacccataaaataaaaaaaacttcctaactatactcgaaaaacgcccgaacgacaacgcctcctaccccttcgttaccctcctaataccgaacgcc

SEQ ID NO: 26131 - DNA, 514 bp, Artificial Sequence
  chemically treated genomic DNA (Homo sapiens) CpG-island No: 26131
tattgttaggttatatagttggtgttatttgcggaggtgatttttgatttttaatttacgcggttattcgttcgagtttttatttttgttgtttttcgcgcgttttatttttcgtttttgtcggattcgtttttttgcgttgggtttagcgcgtcgttagggaaggggtcggagtttgggagttcgtttcgtcgtcgttcgtttttcgttcgtaggtttattcgtagcggttacgtgaaggatcgagcgtcgcgcgtttaggcggggttttcggtttgtacgaggagggtagagttcgttgcggttgtcgtttcgacgttcgcgtattttcgttcgtcgcgttcgtcgtcgcgatgttcggggtcggtttagtcgcggtggtgagttgtttgcgttcgtagttcggcgaggagtcgtagatttatgaggtaaggaggattttttggttgtgttcggagggcgttcggacggtagcgttttttgttttttcgttgtttttttggtgtcgggcgtt

SEQ ID NO: 26132 - DNA, 514 bp, Artificial Sequence
  chemically treated genomic DNA (Homo sapiens) CpG-island No: 26132
aacgcccgacaccaaaaaaacaacgaaaaaacaaaaaacgctaccgtccgaacgccctccgaacacaaccaaaaaatcctccttacctcataaatctacgactcctcgccgaactacgaacgcaaacaactcaccaccgcgactaaaccgaccccgaacatcgcgacgacgaacgcgacgaacgaaaatacgcgaacgtcgaaacgacaaccgcaacgaactctaccctcctcgtacaaaccgaaaaccccgcctaaacgcgcgacgctcgatccttcacgtaaccgctacgaataaacctacgaacgaaaaacgaacgacgacgaaacgaactcccaaactccgaccccttccctaacgacgcgctaaacccaacgcaaaaaaacgaatccgacaaaaacgaaaaataaaacgcgcgaaaaacaacaaaaataaaaactcgaacgaataaccgcgtaaattaaaaatcaaaaatcacctccgcaaataacaccaactatataacctaacaata

SEQ ID NO: 26133 - DNA, 729 bp, Artificial Sequence
  chemically treated genomic DNA (Homo sapiens) CpG-island No: 26133
aggggttattcgtacggatgatgagcggatttatcggtattattacgatagttagtatcggttggtgtattatacgcggatataatatgaagagtcgttggtcgaaagtcgttatttttacgattcgttgggtcgtagggtggtaaaacgggtgtggcggcgtgaacgggatttgacgggttggatgtcgttgttacggaaatcgtaagtgatttggtacggttgggacggcgatcggttgattataatatagaacgatagaattcgtatttagacgatttattagtcggggagttttacgttatttattagagttgaaatcgttatcggtgagttggcgaaaacgtagcgtcgtagtttggcggatgcgttttagtagttcggcggcgaagacggtggtagtgtggtgttttcgtcggtgttggtgtagatgttcgatcggttggaaagtgaaattttggttgatcgggtgagtgaggaaagtcgtcgttggttggtatcgtgcggtttgatcgtggagtagatgtaaaattagatggattcggtgtatacgtcggcgcgaaaaatttatttgtattattgcgattatcgcggtttgtcgttggcgtttattagtacggaaggggtaatagcgtggtgcgtagaatatgatgaatggggtaatttgttgagtgatgagaattcgtattatttgtagtagtttattcgtttgtcgggttagtagtatga

SEQ ID NO: 26134 - DNA, 729 bp, Artificial Sequence
  chemically treated genomic DNA (Homo sapiens) CpG-island No: 26134
tcatactactaacccgacaaacgaataaactactacaaataatacgaattctcatcactcaacaaattaccccattcatcatattctacgcaccacgctattaccccttccgtactaataaacgccaacgacaaaccgcgataatcgcaataatacaaataaatttttcgcgccgacgtatacaccgaatccatctaattttacatctactccacgatcaaaccgcacgataccaaccaacgacgactttcctcactcacccgatcaaccaaaatttcactttccaaccgatcgaacatctacaccaacaccgacgaaaacaccacactaccaccgtcttcgccgccgaactactaaaacgcatccgccaaactacgacgctacgttttcgccaactcaccgataacgatttcaactctaataaataacgtaaaactccccgactaataaatcgtctaaatacgaattctatcgttctatattataatcaaccgatcgccgtcccaaccgtaccaaatcacttacgatttccgtaacaacgacatccaacccgtcaaatcccgttcacgccgccacacccgttttaccaccctacgacccaacgaatcgtaaaaataacgactttcgaccaacgactcttcatattatatccgcgtataatacaccaaccgatactaactatcgtaataataccgataaatccgctcatcatccgtacgaataacccct

SEQ ID NO: 26135 - DNA, 729 bp, Artificial Sequence
  chemically treated genomic DNA (Homo sapiens) CpG-island No: 26135
ttatattgttgattcggtaggcgaatgagttgttgtagatgatgcgggtttttattatttagtaggttgttttatttattatattttgcgtattacgttgttgtttttttcgtgttgatgagcgttagcggtaggtcgcgatggtcgtagtggtataggtggatttttcgcgtcggcgtgtatatcgggtttatttggttttgtatttgttttacggttaggtcgtacgatgttagttagcggcggttttttttatttattcggttagttaggattttattttttagtcggtcgagtatttgtattagtatcggcgggaatattatattgttatcgttttcgtcgtcggattgttgaagcgtattcgttaggttgcggcgttgcgttttcgttagtttatcggtggcggttttaattttgatgagtggcgtgaagtttttcggttgataaatcgtttggatgcgggttttgtcgttttgtattgtggttagtcggtcgtcgttttagtcgtattaggttatttgcggttttcgtgatagcgatatttagttcgttaggtttcgtttacgtcgttatattcgttttgttattttgcggtttagcgggtcgtaaagatagcgattttcgattagcggttttttatattgtgttcgcgtgtagtgtattagtcggtgttgattgtcgtaatggtatcggtgagttcgtttattattcgtgcggataattttt

SEQ ID NO: 26136 - DNA, 729 bp, Artificial Sequence
  chemically treated genomic DNA (Homo sapiens) CpG-island No: 26136
aaaaattatccgcacgaataataaacgaactcaccgataccattacgacaatcaacaccgactaatacactacacgcgaacacaatataaaaaaccgctaatcgaaaatcgctatctttacgacccgctaaaccgcaaaataacaaaacgaatataacgacgtaaacgaaacctaacgaactaaatatcgctatcacgaaaaccgcaaataacctaatacgactaaaacgacgaccgactaaccacaatacaaaacgacaaaacccgcatccaaacgatttatcaaccgaaaaacttcacgccactcatcaaaattaaaaccgccaccgataaactaacgaaaacgcaacgccgcaacctaacgaatacgcttcaacaatccgacgacgaaaacgataacaatataatattcccgccgatactaatacaaatactcgaccgactaaaaaataaaatcctaactaaccgaataaataaaaaaaaccgccgctaactaacatcgtacgacctaaccgtaaaacaaatacaaaaccaaataaacccgatatacacgccgacgcgaaaaatccacctataccactacgaccatcgcgacctaccgctaacgctcatcaacacgaaaaaaacaacaacgtaatacgcaaaatataataaataaaacaacctactaaataataaaaacccgcatcatctacaacaactcattcgcctaccgaatcaacaatataa

SEQ ID NO: 26137 - DNA, 515 bp, Artificial Sequence
  chemically treated genomic DNA (Homo sapiens) CpG-island No: 26137
ttttttaatttgttataatgttcgttattttttacgtcgtattattcgatttttgagtagtagtttgagtcgttttgacgagataattcgggcgggttatttgtcgtatgaattcggtattggcgttgcgaacgggtagttcggggggaacgagttttttgttttgtaaggtgcgttcgtttattttcgtttagtgtatttatttgcgagtgtatagtgtttgcgtttcgtaattcgttgggtgtttggcggtttggatatcggattgcggttgggacggttttggtgtgcgttcgtgggtgtaatttgggggtttcgttaggatataaatatgattagacgggaaacgtttttatagttaagtgcgacgtaaaaagagtagtacgattggggggcggtgttataggtttttcgtttgtttcgcggttaaaaatcggaattaggttaaaagtaggttaaaagtattttagaataaattagcgaatattttagtaatagaggtatttcgataattt

SEQ ID NO: 26138 - DNA, 515 bp, Artificial Sequence
  chemically treated genomic DNA (Homo sapiens) CpG-island No: 26138
aaattatcgaaatacctctattactaaaatattcgctaatttattctaaaatacttttaacctacttttaacctaattccgatttttaaccgcgaaacaaacgaaaaacctataacaccgccccccaatcgtactactctttttacgtcgcacttaactataaaaacgtttcccgtctaatcatatttatatcctaacgaaacccccaaattacacccacgaacgcacaccaaaaccgtcccaaccgcaatccgatatccaaaccgccaaacacccaacgaattacgaaacgcaaacactatacactcgcaaataaatacactaaacgaaaataaacgaacgcaccttacaaaacaaaaaactcgttccccccgaactacccgttcgcaacgccaataccgaattcatacgacaaataacccgcccgaattatctcgtcaaaacgactcaaactactactcaaaaatcgaataatacgacgtaaaaaataacgaacattataacaaattaaaaaa

SEQ ID NO: 26139 - DNA, 515 bp, Artificial Sequence
  chemically treated genomic DNA (Homo sapiens) CpG-island No: 26139
ggattatcggaatatttttgttattggggtattcgttggtttgttttagagtgtttttggtttgtttttggtttggtttcgatttttggtcgcgaagtaggcgaaaaatttatggtatcgttttttagtcgtgttattttttttacgtcgtatttgattgtggaggcgtttttcgtttggttatatttgtattttggcgaaatttttaggttgtatttacgagcgtatattagaatcgttttagtcgtaattcggtatttagatcgttaaatatttaacgggttgcgaggcgtaaatattatgtattcgtagatggatatattgaacggagatggacgaacgtattttgtagggtagagagttcgtttttttcgaattgttcgttcgtagcgttaatatcggatttatacgataagtgattcgttcggattgtttcgttaaaacggtttaggttgttgtttaggagtcgggtaatgcggcgtggaagatggcgggtattgtgataagttgagagg

SEQ ID NO: 26140 - DNA, 515 bp, Artificial Sequence
  chemically treated genomic DNA (Homo sapiens) CpG-island No: 26140
cctctcaacttatcacaatacccgccatcttccacgccgcattacccgactcctaaacaacaacctaaaccgttttaacgaaacaatccgaacgaatcacttatcgtataaatccgatattaacgctacgaacgaacaattcgaaaaaaacgaactctctaccctacaaaatacgttcgtccatctccgttcaatatatccatctacgaatacataatatttacgcctcgcaacccgttaaatatttaacgatctaaataccgaattacgactaaaacgattctaatatacgctcgtaaatacaacctaaaaatttcgccaaaatacaaatataaccaaacgaaaaacgcctccacaatcaaatacgacgtaaaaaaaataacacgactaaaaaacgataccataaatttttcgcctacttcgcgaccaaaaatcgaaaccaaaccaaaaacaaaccaaaaacactctaaaacaaaccaacgaataccccaataacaaaaatattccgataatcc

SEQ ID NO: 26141 - DNA, 661 bp, Artificial Sequence
  chemically treated genomic DNA (Homo sapiens) CpG-island No: 26141
aggttggcgtacgttgttaggtagtaaagagcgcgatgaagaaaacgacggtacgttattgtttgtggtggcgaaaggcgatgagttgttgtgtgaaaaaggtgaagtggtagagcggtaaatttagtcgtcgcgttattttatcgatgtaatattgttttcggcgatgatcgggatcgcgcgttttgtgtaggataaagatttgaaaaagatttttcgtgcgatcgatggtttggggatagaggtaacgcgtgtcgggattattgaattgttgtttaagcgtggttttttgattaaaaaagggcgttatatttattttatcgacgtcggaaaagcgttattttattcgttgtcggagatggcgacgcgatcggatatgatcgcgtattgggaatcggtgttgacgtaaattagcgaaaagtagtgtcgttattaggattttatgtagtcgttggtggggacgttatattagtttattgattaagttaaacgtacgtcggtgcggtagtttcgcggtattgtggtttcgggtagtggtggtagtgttgataagaaaaaggttgtatcgcgtaaacgtagtgcgaaaaaaagttcgttagtagatgaagtcggaagcggggcgatagcgtaagcgagtgaatttttcgtgttattcgagtta

SEQ ID NO: 26142 - DNA, 661 bp, Artificial Sequence
  chemically treated genomic DNA (Homo sapiens) CpG-island No: 26142
taactcgaataacacgaaaaattcactcgcttacgctatcgccccgcttccgacttcatctactaacgaactttttttcgcactacgtttacgcgatacaacctttttcttatcaacactaccaccactacccgaaaccacaataccgcgaaactaccgcaccgacgtacgtttaacttaatcaataaactaatataacgtccccaccaacgactacataaaatcctaataacgacactacttttcgctaatttacgtcaacaccgattcccaatacgcgatcatatccgatcgcgtcgccatctccgacaacgaataaaataacgcttttccgacgtcgataaaataaatataacgcccttttttaatcaaaaaaccacgcttaaacaacaattcaataatcccgacacgcgttacctctatccccaaaccatcgatcgcacgaaaaatctttttcaaatctttatcctacacaaaacgcgcgatcccgatcatcgccgaaaacaatattacatcgataaaataacgcgacgactaaatttaccgctctaccacttcacctttttcacacaacaactcatcgcctttcgccaccacaaacaataacgtaccgtcgttttcttcatcgcgctctttactacctaacaacgtacgccaacct

SEQ ID NO: 26143 - DNA, 661 bp, Artificial Sequence
  chemically treated genomic DNA (Homo sapiens) CpG-island No: 26143
tgattcgaatagtacgaaagatttattcgtttacgttatcgtttcgttttcgattttatttgttggcggattttttttcgtattacgtttacgcggtgtagttttttttttattagtattgttattattgttcggagttataatgtcgcgaaattgtcgtatcggcgtacgtttggtttgattaataagttgatatagcgtttttattagcggttgtataaagttttgatagcgatattgtttttcgttgatttgcgttagtatcgatttttagtgcgcggttatgttcggtcgcgtcgttattttcggtagcgaatggaatagcgttttttcggcgtcggtggagtggatatagcgtttttttttggttaggaaattacgtttgaataatagtttaataatttcggtacgcgttgtttttgtttttagattatcggtcgtacggaggattttttttagatttttattttgtataaagcgcgcgatttcggttatcgtcgaaagtagtgttgtatcggtaaaatggcgcggcggttgggtttgtcgttttattattttattttttttatatagtaatttatcgtttttcgttattataggtagtggcgtgtcgtcgttttttttatcgcgttttttgttgtttaatagcgtgcgttagttt

SEQ ID NO: 26144 - DNA, 661 bp, Artificial Sequence
  chemically treated genomic DNA (Homo sapiens) CpG-island No: 26144
aaactaacgcacgctattaaacaacaaaaaacgcgataaaaaaaacgacgacacgccactacctataataacgaaaaacgataaattactatataaaaaaaataaaataataaaacgacaaacccaaccgccgcgccattttaccgatacaacactactttcgacgataaccgaaatcgcgcgctttatacaaaataaaaatctaaaaaaaatcctccgtacgaccgataatctaaaaacaaaaacaacgcgtaccgaaattattaaactattattcaaacgtaatttcctaaccaaaaaaaaacgctatatccactccaccgacgccgaaaaaacgctattccattcgctaccgaaaataacgacgcgaccgaacataaccgcgcactaaaaatcgatactaacgcaaatcaacgaaaaacaatatcgctatcaaaactttatacaaccgctaataaaaacgctatatcaacttattaatcaaaccaaacgtacgccgatacgacaatttcgcgacattataactccgaacaataataacaatactaataaaaaaaaaactacaccgcgtaaacgtaatacgaaaaaaaatccgccaacaaataaaatcgaaaacgaaacgataacgtaaacgaataaatctttcgtactattcgaatca

SEQ ID NO: 26145 - DNA, 620 bp, Artificial Sequence
  chemically treated genomic DNA (Homo sapiens) CpG-island No: 26145
gtagttatcgtaagtatcggtatttagttttaacgttttttttgcgtttttacgttacgtgcgtgttcgattacggtaggttgtcggataagacgtattggtagtataggtcgttgtgttattggggtacgcgtttgtcgtttagaacgtttggtatttggcgcgttagttcgtcggcgtggtatacgacgagtttttaggcgtagttagtaagtcgttatattaggaggttttaggtcgtaaaataggtaattacgttagaggtcggtagggagaggcggttcgtatattggtttatgcgaaggtatttcgagtataaggagttgtgtaaggcggcgttaggggtaggttcgtaaattacgagtaaatcggatacgtcggattcgtaacgcggggtttacggtaatatacggttaataagtcgtgaataatagtgcgggtataggggaacgttaggttcgggtttgcgtggtttttaggttattcgtgaatcgaatttcggcggtatatagttggagcgtacgttacgaatcggtcgcggagtatgatatcgggggatttataggaaaaggtttcgggagattagtgaggcgagagtatgagtttttcggatacggggt

SEQ ID NO: 26146 - DNA, 620 bp, Artificial Sequence
  chemically treated genomic DNA (Homo sapiens) CpG-island No: 26146
accccgtatccgaaaaactcatactctcgcctcactaatctcccgaaaccttttcctataaatcccccgatatcatactccgcgaccgattcgtaacgtacgctccaactatataccgccgaaattcgattcacgaataacctaaaaaccacgcaaacccgaacctaacgttcccctatacccgcactattattcacgacttattaaccgtatattaccgtaaaccccgcgttacgaatccgacgtatccgatttactcgtaatttacgaacctacccctaacgccgccttacacaactccttatactcgaaataccttcgcataaaccaatatacgaaccgcctctccctaccgacctctaacgtaattacctattttacgacctaaaacctcctaatataacgacttactaactacgcctaaaaactcgtcgtataccacgccgacgaactaacgcgccaaataccaaacgttctaaacgacaaacgcgtaccccaataacacaacgacctatactaccaatacgtcttatccgacaacctaccgtaatcgaacacgcacgtaacgtaaaaacgcaaaaaaaacgttaaaactaaataccgatacttacgataactac

SEQ ID NO: 26147 - DNA, 620 bp, Artificial Sequence
  chemically treated genomic DNA (Homo sapiens) CpG-island No: 26147
atttcgtgttcggggagtttatgttttcgttttattggtttttcggggtttttttttgtgggtttttcggtgttatatttcgcgatcggttcgtaacgtgcgttttaattatgtgtcgtcgaggttcggtttacgagtagtttgaaggttacgtaagttcggatttaacgtttttttgtattcgtattgttgtttacgatttgttggtcgtatgttgtcgtaggtttcgcgttacgggttcggcgtattcgatttgttcgtggtttgcggatttgtttttaacgtcgttttgtataattttttatattcgggatgttttcgtatagattagtatgcggatcgtttttttttgtcggtttttgacgtagttatttgttttgcggtttaagattttttagtataacggtttgttggttacgtttagggattcgtcgtgtattacgtcgacgggttagcgcgttaagtgttaggcgttttgaacggtaggcgcgtgttttagtagtataacgatttgtattattagtacgttttgttcggtaatttatcgtgatcgagtacgtacgtagcgtagaaacgtaaggaggacgttagggttggatgtcggtatttgcgatagttgt

SEQ ID NO: 26148 - DNA, 620 bp, Artificial Sequence
  chemically treated genomic DNA (Homo sapiens) CpG-island No: 26148
acaactatcgcaaataccgacatccaaccctaacgtcctccttacgtttctacgctacgtacgtactcgatcacgataaattaccgaacaaaacgtactaataatacaaatcgttatactactaaaacacgcgcctaccgttcaaaacgcctaacacttaacgcgctaacccgtcgacgtaatacacgacgaatccctaaacgtaaccaacaaaccgttatactaaaaaatcttaaaccgcaaaacaaataactacgtcaaaaaccgacaaaaaaaaacgatccgcatactaatctatacgaaaacatcccgaatataaaaaattatacaaaacgacgttaaaaacaaatccgcaaaccacgaacaaatcgaatacgccgaacccgtaacgcgaaacctacgacaacatacgaccaacaaatcgtaaacaacaatacgaatacaaaaaaacgttaaatccgaacttacgtaaccttcaaactactcgtaaaccgaacctcgacgacacataattaaaacgcacgttacgaaccgatcgcgaaatataacaccgaaaaacccacaaaaaaaaaccccgaaaaaccaataaaacgaaaacataaactccccgaacacgaaat

SEQ ID NO: 26149 - DNA, 521 bp, Artificial Sequence
  chemically treated genomic DNA (Homo sapiens) CpG-island No: 26149
agcggttaatcggcgattaatcgttattgattgcgttaaggttcgttagaatagtatttggaaggatttttgtttgatgagcgcgaaagtaaatttcggtattgttatcgttatcggtatttggttacgtaatcggtttattacgattttttatattttttgtacgtagtcgaaaggttgatcggcggattcggtagtaataattcggtttttagttttttttagttcgggagtaggttgtttaggacgtaatagtcgtcgggtatcgcgttaattagcgaattttagaatttacgaggagtattcgaaaattcgttttgtttgtttttttaggcgtcggtaaacgaatttaacgaataggattcggaatgtttggtacgtcgggtttgaagtttgatttaggtagtttttttcgaagtagtatagcgtatttagtagattaagcggtaatcgacgattagaattggtagaagaggcgtacgtcgttaagtatcggattcgaattttaagagggcgtagaa

SEQ ID NO: 26150 - DNA, 521 bp, Artificial Sequence
  chemically treated genomic DNA (Homo sapiens) CpG-island No: 26150
ttctacgccctcttaaaattcgaatccgatacttaacgacgtacgcctcttctaccaattctaatcgtcgattaccgcttaatctactaaatacgctatactacttcgaaaaaaactacctaaatcaaacttcaaacccgacgtaccaaacattccgaatcctattcgttaaattcgtttaccgacgcctaaaaaaacaaacaaaacgaattttcgaatactcctcgtaaattctaaaattcgctaattaacgcgatacccgacgactattacgtcctaaacaacctactcccgaactaaaaaaaactaaaaaccgaattattactaccgaatccgccgatcaacctttcgactacgtacaaaaaatataaaaaatcgtaataaaccgattacgtaaccaaataccgataacgataacaataccgaaatttactttcgcgctcatcaaacaaaaatccttccaaatactattctaacgaaccttaacgcaatcaataacgattaatcgccgattaaccgct

SEQ ID NO: 26151 - DNA, 521 bp, Artificial Sequence
  chemically treated genomic DNA (Homo sapiens) CpG-island No: 26151
ttttacgtttttttagaattcgagttcggtgtttagcgacgtacgttttttttattagttttgatcgtcgattatcgtttgatttgttgaatgcgttgtattatttcggagagaattgtttgaattaggttttaaattcggcgtgttaggtatttcgagttttgttcgttgagttcgtttatcgacgtttgagggaataggtaaaacgggttttcgggtatttttcgtaggttttggaattcgttggttagcgcgatgttcgacggttgttacgttttaaatagtttattttcgggttgaaagaagttaggagtcgggttgttgttatcgaattcgtcggttagtttttcgattgcgtgtaggaagtataggaaatcgtgataagtcggttgcgtggttagatatcggtagcggtgataatatcgaggtttattttcgcgtttattaggtaggaatttttttagatattgttttagcgggttttagcgtaattagtagcggttaatcgtcgattggtcgtt

SEQ ID NO: 26152 - DNA, 521 bp, Artificial Sequence
  chemically treated genomic DNA (Homo sapiens) CpG-island No: 26152
aacgaccaatcgacgattaaccgctactaattacgctaaaacccgctaaaacaatatctaaaaaaattcctacctaataaacgcgaaaataaacctcgatattatcaccgctaccgatatctaaccacgcaaccgacttatcacgatttcctatacttcctacacgcaatcgaaaaactaaccgacgaattcgataacaacaacccgactcctaacttctttcaacccgaaaataaactatttaaaacgtaacaaccgtcgaacatcgcgctaaccaacgaattccaaaacctacgaaaaatacccgaaaacccgttttacctattccctcaaacgtcgataaacgaactcaacgaacaaaactcgaaatacctaacacgccgaatttaaaacctaattcaaacaattctctccgaaataatacaacgcattcaacaaatcaaacgataatcgacgatcaaaactaataaaaaaaacgtacgtcgctaaacaccgaactcgaattctaaaaaaacgtaaaa

SEQ ID NO: 26153 - DNA, 537 bp, Artificial Sequence
  chemically treated genomic DNA (Homo sapiens) CpG-island No: 26153
cgacggatttcgcggacgttagttttgtgtacgtcgttggttttgtcggcgtttatattcggcgtcggtagagttcgtggacgagatttagtggcgtagacgcgtttgggtagcgtcgttttggtcgtttcgcggggtcggggtcgatagtttacgttggcgcggtaggcgcgtgcgttcgtcgttttcgtgagttcgagtagcggcgagtttagggcgtcgggcggtcgggaggttggtttggtttagttgggtcgagaggtcggagggtcgagttagagcggtcggtttgattttttatgtaatattttatttttgtcgtatcgagtgtattttaggggtttttacggtcggcgggatcggttttttttttttacgatttagtaatattcgttttatcggttgtgatgttttaataaatttttttatgtttttgcggacgtcgcgtttatttttttaatggtaggggttacgggttatttagaagttcgattttggttagtggatcgggggcggggaggaggtttttgtatagta

SEQ ID NO: 26154 - DNA, 537 bp, Artificial Sequence
  chemically treated genomic DNA (Homo sapiens) CpG-island No: 26154
tactatacaaaaacctcctccccgcccccgatccactaaccaaaatcgaacttctaaataacccgtaacccctaccattaaaaaaataaacgcgacgtccgcaaaaacataaaaaaatttattaaaacatcacaaccgataaaacgaatattactaaatcgtaaaaaaaaaaaaccgatcccgccgaccgtaaaaacccctaaaatacactcgatacgacaaaaataaaatattacataaaaaatcaaaccgaccgctctaactcgaccctccgacctctcgacccaactaaaccaaaccaacctcccgaccgcccgacgccctaaactcgccgctactcgaactcacgaaaacgacgaacgcacgcgcctaccgcgccaacgtaaactatcgaccccgaccccgcgaaacgaccaaaacgacgctacccaaacgcgtctacgccactaaatctcgtccacgaactctaccgacgccgaatataaacgccgacaaaaccaacgacgtacacaaaactaacgtccgcgaaatccgtcg

SEQ ID NO: 26155 - DNA, 537 bp, Artificial Sequence
  chemically treated genomic DNA (Homo sapiens) CpG-island No: 26155
tattatatagggatttttttttcgttttcggtttattggttagggtcgggtttttggatggttcgtggtttttgttattaagaaagtaagcgcgacgttcgtaaaagtataaaaaagtttattggagtattatagtcggtggggcgggtattgttgagtcgtgggggagggaggtcgatttcgtcggtcgtaggggtttttaaagtgtattcggtgcggtaaggatggggtgttgtatagagagttaggtcggtcgttttaattcggtttttcggtttttcggtttagttaagttagattagtttttcggtcgttcggcgttttgggttcgtcgttgttcgggtttacgaaaacggcgggcgtacgcgtttgtcgcgttagcgtgggttgtcggtttcggtttcgcggggcggttagagcggcgttgtttaggcgcgtttgcgttattggatttcgtttacggattttgtcgacgtcgagtgtaggcgtcggtagggttagcggcgtgtatagggttggcgttcgcggaattcgtcg

SEQ ID NO: 26156 - DNA, 537 bp, Artificial Sequence
  chemically treated genomic DNA (Homo sapiens) CpG-island No: 26156
cgacgaattccgcgaacgccaaccctatacacgccgctaaccctaccgacgcctacactcgacgtcgacaaaatccgtaaacgaaatccaataacgcaaacgcgcctaaacaacgccgctctaaccgccccgcgaaaccgaaaccgacaacccacgctaacgcgacaaacgcgtacgcccgccgttttcgtaaacccgaacaacgacgaacccaaaacgccgaacgaccgaaaaactaatctaacttaactaaaccgaaaaaccgaaaaaccgaattaaaacgaccgacctaactctctatacaacaccccatccttaccgcaccgaatacactttaaaaacccctacgaccgacgaaatcgacctccctcccccacgactcaacaatacccgccccaccgactataatactccaataaacttttttatacttttacgaacgtcgcgcttactttcttaataacaaaaaccacgaaccatccaaaaacccgaccctaaccaataaaccgaaaacgaaaaaaaaatccctatataata

SEQ ID NO: 26157 - DNA, 866 bp, Artificial Sequence
  chemically treated genomic DNA (Homo sapiens) CpG-island No: 26157
tgtcggtttacgatgtattgtatgacggcggcgtggagtatttgttatgtcgatatgagtagggtgcggtaatggcggttatcggttatgttcgtgttatcggtaaaattggcgtatgtatcgttacgtttggttcgggcgtaattaatttgataatcgggtttgcggacgtattgttagattttatttttgttgttgttattatcggttaagtgttcgtatcgtttatcggtattgacgtattttaggaagtggatgttttgggattgtcgttagtttgtattaagtatagttttttggtgtagtcgttggaagagttgtcgcgtattatggttgaagtattcgacgttgtttgtttaggtcgttttggttcggttttggtcgatattttaaaagatatttagttagttagcggtgatttggaatcgtggtttattatcgttgaaaacgaagtgatttttttatatgtcgaagttgagtaagcgcgttagatgttggtaaaagcgtaaaaatcgatgttgtacgttggcggtggcgtgggtatggcgtaggtagtttcggttttgcgtgaatatttcgttgttataaaaatgtttggtatttgtacgttgaaagggttgggcgtagtagaagtagatatgcgtatatttgggtttttggggatgtcggtttaagcggaattttcgggcggattgtgattgtggttcgtggcgttttgattcggtgcgtatgattttggtcggcggttttatgaacgtcggaaacgtgtagttggtgaggatagcgacgtaggggaaagaggattgcgggaatcgtatcgggtcgggtatgtcgttttttgtttttttttttagtttttaaatttt

SEQ ID NO: 26158 - DNA, 866 bp, Artificial Sequence
  chemically treated genomic DNA (Homo sapiens) CpG-island No: 26158
aaaatttaaaaactaaaaaaaaaaacaaaaaacgacatacccgacccgatacgattcccgcaatcctctttcccctacgtcgctatcctcaccaactacacgtttccgacgttcataaaaccgccgaccaaaatcatacgcaccgaatcaaaacgccacgaaccacaatcacaatccgcccgaaaattccgcttaaaccgacatccccaaaaacccaaatatacgcatatctacttctactacgcccaaccctttcaacgtacaaataccaaacatttttataacaacgaaatattcacgcaaaaccgaaactacctacgccatacccacgccaccgccaacgtacaacatcgatttttacgcttttaccaacatctaacgcgcttactcaacttcgacatataaaaaaatcacttcgttttcaacgataataaaccacgattccaaatcaccgctaactaactaaatatcttttaaaatatcgaccaaaaccgaaccaaaacgacctaaacaaacaacgtcgaatacttcaaccataatacgcgacaactcttccaacgactacaccaaaaaactatacttaatacaaactaacgacaatcccaaaacatccacttcctaaaatacgtcaataccgataaacgatacgaacacttaaccgataataacaacaacaaaaataaaatctaacaatacgtccgcaaacccgattatcaaattaattacgcccgaaccaaacgtaacgatacatacgccaattttaccgataacacgaacataaccgataaccgccattaccgcaccctactcatatcgacataacaaatactccacgccgccgtcatacaatacatcgtaaaccgaca

SEQ ID NO: 26159 - DNA, 866 bp, Artificial Sequence
  chemically treated genomic DNA (Homo sapiens) CpG-island No: 26159
agaatttgggagttgagaaaagaaataaggaacgatatattcgattcggtacgattttcgtagtttttttttttttacgtcgttatttttattagttatacgttttcggcgtttatgaaatcgtcggttagggttatgcgtatcggattaaggcgttacggattatagttataattcgttcgggagtttcgtttgggtcggtatttttagaagtttagatatacgtatatttgtttttattgcgtttagtttttttagcgtataggtgttagatatttttgtggtagcgagatatttacgtaaagtcggaattgtttgcgttatatttacgttatcgttaacgtatagtatcggtttttgcgtttttgttagtatttggcgcgtttgtttaatttcggtatgtgggaaagttatttcgtttttaacggtggtgaattacggttttaggttatcgttggttaattggatattttttgggatatcgattagaatcggattaggacgatttgagtaggtaacgtcgaatgttttagttatgatgcgcggtaatttttttagcgattgtattagaaagttgtgtttggtataggttaacgataattttaggatatttattttttgaaatgcgttagtgtcgataaacggtgcggatatttgatcggtgatggtaataatagggatggaatttaatagtgcgttcgtaagttcggttattaggttggttgcgttcggattagacgtggcgatatatacgttagttttgtcggtagtacgagtataatcgatagtcgttattgtcgtattttgtttatgtcggtatagtaagtgttttacgtcgtcgttatataatgtatcgtaaatcggta

SEQ ID NO: 26160 - DNA, 866 bp, Artificial Sequence
  chemically treated genomic DNA (Homo sapiens) CpG-island No: 26160
taccgatttacgatacattatataacgacgacgtaaaacacttactataccgacataaacaaaatacgacaataacgactatcgattatactcgtactaccgacaaaactaacgtatatatcgccacgtctaatccgaacgcaaccaacctaataaccgaacttacgaacgcactattaaattccatccctattattaccatcaccgatcaaatatccgcaccgtttatcgacactaacgcatttcaaaaaataaatatcctaaaattatcgttaacctataccaaacacaactttctaatacaatcgctaaaaaaattaccgcgcatcataactaaaacattcgacgttacctactcaaatcgtcctaatccgattctaatcgatatcccaaaaaatatccaattaaccaacgataacctaaaaccgtaattcaccaccgttaaaaacgaaataactttcccacataccgaaattaaacaaacgcgccaaatactaacaaaaacgcaaaaaccgatactatacgttaacgataacgtaaatataacgcaaacaattccgactttacgtaaatatctcgctaccacaaaaatatctaacacctatacgctaaaaaaactaaacgcaataaaaacaaatatacgtatatctaaacttctaaaaataccgacccaaacgaaactcccgaacgaattataactataatccgtaacgccttaatccgatacgcataaccctaaccgacgatttcataaacgccgaaaacgtataactaataaaaataacgacgtaaaaaaaaaaaaactacgaaaatcgtaccgaatcgaatatatcgttccttatttcttttctcaactcccaaattct

SEQ ID NO: 26161 - DNA, 639 bp, Artificial Sequence
  chemically treated genomic DNA (Homo sapiens) CpG-island No: 26161
  misc_feature (53)..(53): n is either a, c, g or t
  misc_feature (87)..(87): n is either a, c, g or t
  misc_feature (97)..(98): n is either a, c, g or t
  misc_feature (113)..(114): n is either a, c, g or t
gaaaatcgtcgtattttatgtttgtacgttaagcgcgaggaatatgtagttanatttggggtttagtggtagagttaaaggttcgangaaaatttanncgttttggaaatgtnncggttttgtattacgcgcggtaaaatcggttagtagtagcgtaatcgtttcgataatatttattagatgtagaattttcggcgttattaggaataggtcgtgggtacgggcgattaggtagatattcgcggttattatggttgcggcgtggattagcgcggagataggcgtcgggttcgttatcgcgtcggtaagttatgtttgtaacggtaattgcgtagatttatcgatcgtatcgtttagtagtattagcgtcgtttatattagtatgttattgtcgttagtaaagtgcgttggtgttagttttattatttcgcggaagtttagggtgtttagttcgttgtaaagaatgaatagtgcgaaagcgaggaatacgttatttatacgggttacgacgaacgtttttattgtcgttgcgttatttttcggatcggtgtaatagaattcgattagtagataggagtataggtttacgtttttttagtcgaggtatattagtagtaggttgtcggtaagtattagaat

SEQ ID NO: 26162 - DNA, 639 bp, Artificial Sequence
  chemically treated genomic DNA (Homo sapiens) CpG-island No: 26162
  misc_feature (526)..(527): n is either a, c, g or t
  misc_feature (542)..(543): n is either a, c, g or t
  misc_feature (553)..(553): n is either a, c, g or t
  misc_feature (587)..(587): n is either a, c, g or t
attctaatacttaccgacaacctactactaatatacctcgactaaaaaaacgtaaacctatactcctatctactaatcgaattctattacaccgatccgaaaaataacgcaacgacaataaaaacgttcgtcgtaacccgtataaataacgtattcctcgctttcgcactattcattctttacaacgaactaaacaccctaaacttccgcgaaataataaaactaacaccaacgcactttactaacgacaataacatactaatataaacgacgctaatactactaaacgatacgatcgataaatctacgcaattaccgttacaaacataacttaccgacgcgataacgaacccgacgcctatctccgcgctaatccacgccgcaaccataataaccgcgaatatctacctaatcgcccgtacccacgacctattcctaataacgccgaaaattctacatctaataaatattatcgaaacgattacgctactactaaccgattttaccgcgcgtaatacaaaaccgnnacatttccaaaacgnntaaattttcntcgaacctttaactctaccactaaaccccaaatntaactacatattcctcgcgcttaacgtacaaacataaaatacgacgattttc

SEQ ID NO: 26163 - DNA, 639 bp, Artificial Sequence
  chemically treated genomic DNA (Homo sapiens) CpG-island No: 26163
  misc_feature (526)..(527): n is either a, c, g or t
  misc_feature (542)..(543): n is either a, c, g or t
  misc_feature (553)..(553): n is either a, c, g or t
  misc_feature (587)..(587): n is either a, c, g or t
gttttggtgtttgtcgataatttgttgttgatgtatttcggttgggaaggcgtgggtttgtgtttttatttgttgatcgggttttattatatcgattcgaagaatggcgtagcggtaatgaaagcgttcgtcgtgattcgtgtgggtgacgtgtttttcgttttcgtattgtttattttttataacgaattgggtattttgaattttcgcgaaatggtggaattggtattagcgtattttgttgacggtaataatatgttgatgtgggcgacgttgatgttgttgggcggtgcggtcggtaaatttgcgtagttgtcgttgtagatatggtttgtcgacgcgatggcgggttcgacgtttgttttcgcgttgatttacgtcgtaattatggtaatcgcgggtgtttatttgatcgttcgtatttacggtttgtttttgatgacgtcggaagttttgtatttggtgggtattgtcggggcggttacgttgttgttggtcggttttgtcgcgcgtggtataggatcgnnatatttttaaaacgnntgggtttttntcgggtttttaattttattattgagttttagatntggttatatgtttttcgcgtttggcgtgtaggtatgggatgcggcgattttt

SEQ ID NO: 26164 - DNA, 639 bp, Artificial Sequence
  chemically treated genomic DNA (Homo sapiens) CpG-island No: 26164
  misc_feature (53)..(53): n is either a, c, g or t
  misc_feature (87)..(87): n is either a, c, g or t
  misc_feature (97)..(98): n is either a, c, g or t
  misc_feature (113)..(114): n is either a, c, g or t
aaaaatcgccgcatcccatacctacacgccaaacgcgaaaaacatataaccanatctaaaactcaataataaaattaaaaacccganaaaaacccanncgttttaaaaatatnncgatcctataccacgcgcgacaaaaccgaccaacaacaacgtaaccgccccgacaatacccaccaaatacaaaacttccgacgtcatcaaaaacaaaccgtaaatacgaacgatcaaataaacacccgcgattaccataattacgacgtaaatcaacgcgaaaacaaacgtcgaacccgccatcgcgtcgacaaaccatatctacaacgacaactacgcaaatttaccgaccgcaccgcccaacaacatcaacgtcgcccacatcaacatattattaccgtcaacaaaatacgctaataccaattccaccatttcgcgaaaattcaaaatacccaattcgttataaaaaataaacaatacgaaaacgaaaaacacgtcacccacacgaatcacgacgaacgctttcattaccgctacgccattcttcgaatcgatataataaaacccgatcaacaaataaaaacacaaacccacgccttcccaaccgaaatacatcaacaacaaattatcgacaaacaccaaaac

SEQ ID NO: 26165 - DNA, 559 bp, Artificial Sequence
  chemically treated genomic DNA (Homo sapiens) CpG-island No: 26165
tgttcgtcgttgcgtcgtagttaatagcgcgggtgcgtttggtggcggtttatgtttggttgcgttttttgattgggcgttttcgggggcggggttaagtttaagtttggcgcgtagagtgtatttttttgagttcgagcggtttagcgttaagttcggggtttggggttggagcggttggttacgtggttggttcgcggcggtgcgcggggcgttgggttagcgggtttgggattggtggtatcggcggcggcgtaggacggaggcgtcgttaggtacgtgcgcgggtcgtgtttcggtaggtgggcggtttcgggttcgagggtcgcggcgttttagagttcggggggtgtttcggcgttttcgttgtttttcgtcgtattttattttttgtagtcgtaatgacgggaggggagcgtttgggtcgcgtttgggttggggatcgggcggcggttagtcgtagcgttttagttttaggtatattcggtatgatggggtggcggttcgtggtttttggtaagaatgcgaaggtttatcggggatgtgagtagtagttttt

SEQ ID NO: 26166 - DNA, 559 bp, Artificial Sequence
  chemically treated genomic DNA (Homo sapiens) CpG-island No: 26166
aaaaactactactcacatccccgataaaccttcgcattcttaccaaaaaccacgaaccgccaccccatcataccgaatatacctaaaactaaaacgctacgactaaccgccgcccgatccccaacccaaacgcgacccaaacgctcccctcccgtcattacgactacaaaaaataaaatacgacgaaaaacaacgaaaacgccgaaacaccccccgaactctaaaacgccgcgaccctcgaacccgaaaccgcccacctaccgaaacacgacccgcgcacgtacctaacgacgcctccgtcctacgccgccgccgataccaccaatcccaaacccgctaacccaacgccccgcgcaccgccgcgaaccaaccacgtaaccaaccgctccaaccccaaaccccgaacttaacgctaaaccgctcgaactcaaaaaaatacactctacgcgccaaacttaaacttaaccccgcccccgaaaacgcccaatcaaaaaacgcaaccaaacataaaccgccaccaaacgcacccgcgctattaactacgacgcaacgacgaaca

SEQ ID NO: 26167 - DNA, 559 bp, Artificial Sequence
  chemically treated genomic DNA (Homo sapiens) CpG-island No: 26167
gagagttattatttatattttcgataagttttcgtatttttgttaaaggttacgggtcgttattttattatatcgaatgtgtttggaattggggcgttgcggttggtcgtcgttcgatttttagtttaggcgcgatttaagcgtttttttttcgttattgcggttgtagagggtggggtacggcgggggatagcgaggacgtcgaagtatttttcgggttttgggacgtcgcggttttcggattcgaagtcgtttatttatcggaatacggttcgcgtacgtatttagcgacgttttcgttttacgtcgtcgtcggtgttattagttttagattcgttgatttaacgtttcgcgtatcgtcgcgggttagttacgtgattagtcgttttaattttaaatttcgaatttggcgttggatcgttcgagtttaggaaggtgtattttgcgcgttaggtttgggtttggtttcgttttcggaggcgtttaattagagagcgtagttaagtatgggtcgttattaaacgtattcgcgttattggttgcggcgtagcggcgggta

SEQ ID NO: 26168 - DNA, 559 bp, Artificial Sequence
  chemically treated genomic DNA (Homo sapiens) CpG-island No: 26168
tacccgccgctacgccgcaaccaataacgcgaatacgtttaataacgacccatacttaactacgctctctaattaaacgcctccgaaaacgaaaccaaacccaaacctaacgcgcaaaatacaccttcctaaactcgaacgatccaacgccaaattcgaaatttaaaattaaaacgactaatcacgtaactaacccgcgacgatacgcgaaacgttaaatcaacgaatctaaaactaataacaccgacgacgacgtaaaacgaaaacgtcgctaaatacgtacgcgaaccgtattccgataaataaacgacttcgaatccgaaaaccgcgacgtcccaaaacccgaaaaatacttcgacgtcctcgctatcccccgccgtaccccaccctctacaaccgcaataacgaaaaaaaaacgcttaaatcgcgcctaaactaaaaatcgaacgacgaccaaccgcaacgccccaattccaaacacattcgatataataaaataacgacccgtaacctttaacaaaaatacgaaaacttatcgaaaatataaataataactctc

SEQ ID NO: 26169 - DNA, 1017 bp, Artificial Sequence
  chemically treated genomic DNA (Homo sapiens) CpG-island No: 26169
ggtaaagcgttttcgtagttttttcggtttgttcgattcggtttttttcgtttttgtttcggttgcggtattattttttggagttacgtttcggcgagcgggggtcgtacgagggggtcgttgtgtcgttatttattcgagtcgttcgggttggtcgcgagtcgggattcgcgagggttggcgggttttggttttcgaggacgtagatatgtggtttgaattttcgtttttttagtcgttgtttttgtgtatttttttgggcgtttttagcgaatgcgagcggcgaggcgaggtaaagcgcgtcgattaagagcggtataggttcggagtttgttcgtttcgcgttgcgtcgagcgtcgggtttttttcgcgagttcgacggggtcgcgcgcgcgttttttattgttttcgtttttcgcgcggcgcgtgttttttatttttcgtcgcgcgttttcgtaatcgttcggttttacgcggcgcgcgtttgttttgtcgttagcggcggcggcggcggcggcgcgttttttttcgaacgtcgtttttagggttgttggttgcgttttttattgtttcgcggttgttgttcggggtgggcggttaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcgttattgtcgttgttattgcggtcgtcgtcgttgaagagaggaggacgaggagggtaaggggtagaagtaggttttgttttgtttgttttag

SEQ ID NO: 26170 - DNA, 1017 bp, Artificial Sequence
  chemically treated genomic DNA (Homo sapiens) CpG-island No: 26170
ctaaaacaaacaaaacaaaacctacttctaccccttaccctcctcgtcctcctctcttcaacgacgacgaccgcaataacaacgacaataacgactactaccactactctaccgctaccgaaccgatcacctaaacacccgcgaaaccgcgccgctactaccgccccgacgacctcccgaaatacgcgaaaaaaacgacgaaaaaacgaaatatccataataaccgaaaatacgaaaaacgcccaacaacaacgaatacctaaaaaccaaaaaaaaacccccgcgcgccgacaacccccaatactaaacgccctacaacccccgcgcgccgcgcctaaacccgcatcgctctcgcaataaaaatccgcccgaacgataaaccctccccgacgaccaaaccgacacctcccccccgcctaaccgcccaccccgaacaacaaccgcgaaacaataaaaaacgcaaccaacaaccctaaaaacgacgttcgaaaaaaaacgcgccgccgccgccgccgccgctaacgacaaaacaaacgcgcgccgcgtaaaaccgaacgattacgaaaacgcgcgacgaaaaataaaaaacacgcgccgcgcgaaaaacgaaaacaataaaaaacgcgcgcgcgaccccgtcgaactcgcgaaaaaaacccgacgctcgacgcaacgcgaaacgaacaaactccgaacctataccgctcttaatcgacgcgctttacctcgcctcgccgctcgcattcgctaaaaacgcccaaaaaaatacacaaaaacaacgactaaaaaaacgaaaattcaaaccacatatctacgtcctcgaaaaccaaaacccgccaaccctcgcgaatcccgactcgcgaccaacccgaacgactcgaataaataacgacacaacgaccccctcgtacgacccccgctcgccgaaacgtaactccaaaaaataataccgcaaccgaaacaaaaacgaaaaaaaccgaatcgaacaaaccgaaaaaactacgaaaacgctttacc

SEQ ID NO: 26171 - DNA, 1017 bp, Artificial Sequence
  chemically treated genomic DNA (Homo sapiens) CpG-island No: 26171
ttggggtagatagagtaggatttgtttttgttttttgtttttttcgtttttttttttttagcggcggcgatcgtagtaatagcggtagtggcggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttggtcgtttatttcgggtagtagtcgcggaataatggagagcgtagttagtagttttggagacggcgttcgggggaggacgcgtcgtcgtcgtcgtcgtcgttgacgatagggtaggcgcgcgtcgcgtggagtcgggcggttgcgagggcgcgcggcggggggtggggggtacgcgtcgcgcggagggcggaggtagtggggggcgcgcgcgcggtttcgtcgagttcgcggagagagttcggcgttcggcgtagcgcggggcgggtaagtttcgagtttgtatcgtttttggtcggcgcgttttgtttcgtttcgtcgttcgtattcgttgggggcgtttagaaagatgtatagaggtaacggttaggggagcggaggtttaagttatatgtttgcgttttcgggggttagagttcgttagttttcgcggatttcggttcgcggttagttcgagcggttcgggtgagtagcggtatagcggttttttcgtgcggttttcgttcgtcgagacgtggttttaagaagtggtgtcgtagtcggggtagaggcggaggaagtcgagtcgggtaagtcgggaaggttgcggagacgttttgtt

SEQ ID NO: 26172 - DNA, 1017 bp, Artificial Sequence
  chemically treated genomic DNA (Homo sapiens) CpG-island No: 26172
aacaaaacgtctccgcaaccttcccgacttacccgactcgacttcctccgcctctaccccgactacgacaccacttcttaaaaccacgtctcgacgaacgaaaaccgcacgaaaaaaccgctataccgctactcacccgaaccgctcgaactaaccgcgaaccgaaatccgcgaaaactaacgaactctaacccccgaaaacgcaaacatataacttaaacctccgctcccctaaccgttacctctatacatctttctaaacgcccccaacgaatacgaacgacgaaacgaaacaaaacgcgccgaccaaaaacgatacaaactcgaaacttacccgccccgcgctacgccgaacgccgaactctctccgcgaactcgacgaaaccgcgcgcgcgccccccactacctccgccctccgcgcgacgcgtaccccccaccccccgccgcgcgccctcgcaaccgcccgactccacgcgacgcgcgcctaccctatcgtcaacgacgacgacgacgacgacgcgtcctcccccgaacgccgtctccaaaactactaactacgctctccattattccgcgactactacccgaaataaacgaccaaacgaaaaaaaaatatcgacttaaccgccgaaaaaaacttaccgctcgaacgaaccctcactacgaaaacgatacgaacccaaacgcgacgcgcgaaaactacaaaacgcctaacactaaaaattaccgacgcgcgaaaacctcctcctaactcccaaacactcgctactactaaacgcccctcgcatcctcgattactataaatatctcgctcctccgccgccccctccgcgcactccgaaaaaccgccgaaacgataacaacgacgcgactccgcgaatacccaaataaccgactcgacaacgacaaaacaataacaacaaccgccactaccgctattactacgatcgccgccgctaaaaaaaaaaaaacgaaaaaaacaaaaaacaaaaacaaatcctactctatctaccccaa

SEQ ID NO: 26173 - DNA, 594 bp, Artificial Sequence
  chemically treated genomic DNA (Homo sapiens) CpG-island No: 26173
ggtcggtgcggtgcgtaagtatttgattagcggcggtgataggttgcgtaggtgcgcgcgatcgtggtgggttgttggaagatagggacgtacgtttgtgtatatttattttttttattttagatttacgtcggtcggtgtttttttgttttgtgtttcgtgcgttcgtaaggtgcggtgcgcggggaagggggtagttagtggtcgttggatttatttcgttgttgtatacgcgtgcgtttgatatgtcgcgagttgttatattttgttaggtagaggtagtgcgtgtgcgttgaggagagtattatttttgtgcggagggtgtggtgagtgggtgttaattagtgcgtacgcgtggatagcgtgcgtcgtagatgtatggttacgtttcggtttttattttatcgtagttgcgtgtgaggtattcgtggagggtaggcgtatttatatgtgttagggtagcgttgttagtggttataatcgatcgtttgcggcgtttttcgtatagcggaagaagtgagtttcgggatgaaagaggtgagataagttgaattgtgtcgcgtacggtcggatatttagataaacgtggtaggt

SEQ ID NO: 26174 - DNA, 594 bp, Artificial Sequence
  chemically treated genomic DNA (Homo sapiens) CpG-island No: 26174
acctaccacgtttatctaaatatccgaccgtacgcgacacaattcaacttatctcacctctttcatcccgaaactcacttcttccgctatacgaaaaacgccgcaaacgatcgattataaccactaacaacgctaccctaacacatataaatacgcctaccctccacgaatacctcacacgcaactacgataaaataaaaaccgaaacgtaaccatacatctacgacgcacgctatccacgcgtacgcactaattaacacccactcaccacaccctccgcacaaaaataatactctcctcaacgcacacgcactacctctacctaacaaaatataacaactcgcgacatatcaaacgcacgcgtatacaacaacgaaataaatccaacgaccactaactacccccttccccgcgcaccgcaccttacgaacgcacgaaacacaaaacaaaaaaacaccgaccgacgtaaatctaaaataaaaaaaataaatatacacaaacgtacgtccctatcttccaacaacccaccacgatcgcgcgcacctacgcaacctatcaccgccgctaatcaaatacttacgcaccgcaccgacc

SEQ ID NO: 26175 - DNA, 594 bp, Artificial Sequence
  chemically treated genomic DNA (Homo sapiens) CpG-island No: 26175
atttgttacgtttatttgagtattcgatcgtacgcgatataatttaatttattttattttttttatttcgaagtttatttttttcgttgtgcggaagacgtcgtaaacgatcggttataattattggtagcgttattttaatatatatgagtacgtttattttttacgggtattttatacgtagttgcggtaaggtaaaagtcgaagcgtaattatatatttacgacgtacgttatttacgcgtgcgtattagttaatatttatttattatatttttcgtataagggtagtgttttttttaacgtatacgtattgtttttgtttagtaaaatgtgatagttcgcgatatgttaagcgtacgcgtatgtaatagcgagatgagtttaacggttattaattgttttttttttcgcgtatcgtattttacggacgtacggaatataagataggaagatatcgatcgacgtaggtttgagatgaaggaagtaagtatgtatagacgtacgtttttattttttaataatttattacggtcgcgcgtatttacgtaatttattatcgtcgttaattaagtatttacgtatcgtatcgatt

SEQ ID NO: 26176 - DNA, 594 bp, Artificial Sequence
  chemically treated genomic DNA (Homo sapiens) CpG-island No: 26176
aatcgatacgatacgtaaatacttaattaacgacgataataaattacgtaaatacgcgcgaccgtaataaattattaaaaaataaaaacgtacgtctatacatacttacttccttcatctcaaacctacgtcgatcgatatcttcctatcttatattccgtacgtccgtaaaatacgatacgcgaaaaaaaaaacaattaataaccgttaaactcatctcgctattacatacgcgtacgcttaacatatcgcgaactatcacattttactaaacaaaaacaatacgtatacgttaaaaaaaacactacccttatacgaaaaatataataaataaatattaactaatacgcacgcgtaaataacgtacgtcgtaaatatataattacgcttcgacttttaccttaccgcaactacgtataaaatacccgtaaaaaataaacgtactcatatatattaaaataacgctaccaataattataaccgatcgtttacgacgtcttccgcacaacgaaaaaaataaacttcgaaataaaaaaaataaaataaattaaattatatcgcgtacgatcgaatactcaaataaacgtaacaaat

SEQ ID NO: 26177 - DNA, 828 bp, Artificial Sequence
  chemically treated genomic DNA (Homo sapiens) CpG-island No: 26177
  misc_feature (822)..(822): n is either a, c, g or t
tttttgtagttcgggggtatggatgcgcggatagtcgttgttggttttttggatgtcgacggatttgtattgtcggtagaatttcgcgaggtcgtttagttttaggtagtagttgaattaattcgcgaggggatcgagttcggggtgggcgaaaaattttagtatgagattttcgcgttggaggattatttagtcggcgtttcggaaaacgatttcgaagtttaattttttatagaaggcgtcggtggaatcgaattttcgtgatggtaggttgggcgtcgtttgttcggttatttcgaattttagagtttcgtttagaagaattcgttaagaaggcgatagaaggcgatgcgttgcgaatcgggagcggcgatatcgtatagtacgaggaagcggttagtttattcgtcgttaagttttttagtaatattacgggtagttaacgttatgttttgatagcggttcgttatatttagtcggttatagtcgatgaatttagaaaagcggttattttttattatgatattcggtaagtaggtatcgttatgggttacgacgagattttcgtcgtcgggtatgcgcgttttgagtttggcgaatagttcggttggcgcgagtttttgatgtttttcgtttagattattttgatcgataagatcggtttttattcgagtacgtgttcgttcgatgcgatgtttcgtttggtggtcgaatgggtaggtagtcggattaagcgtatgtagtcgtcgtattgtattagttatgatggatattttttcggtaggagtaaggtgagatgataggaggttttgttttaatggnggcgtt

SEQ ID NO: 26178 - DNA, 828 bp, Artificial Sequence
  chemically treated genomic DNA (Homo sapiens) CpG-island No: 26178
  misc_feature (7)..(7): n is either a, c, g or t
aacgccnccattaaaacaaaacctcctatcatctcaccttactcctaccgaaaaaatatccatcataactaatacaatacgacgactacatacgcttaatccgactacctacccattcgaccaccaaacgaaacatcgcatcgaacgaacacgtactcgaataaaaaccgatcttatcgatcaaaataatctaaacgaaaaacatcaaaaactcgcgccaaccgaactattcgccaaactcaaaacgcgcatacccgacgacgaaaatctcgtcgtaacccataacgatacctacttaccgaatatcataataaaaaataaccgcttttctaaattcatcgactataaccgactaaatataacgaaccgctatcaaaacataacgttaactacccgtaatattactaaaaaacttaacgacgaataaactaaccgcttcctcgtactatacgatatcgccgctcccgattcgcaacgcatcgccttctatcgccttcttaacgaattcttctaaacgaaactctaaaattcgaaataaccgaacaaacgacgcccaacctaccatcacgaaaattcgattccaccgacgccttctataaaaaattaaacttcgaaatcgttttccgaaacgccgactaaataatcctccaacgcgaaaatctcatactaaaatttttcgcccaccccgaactcgatcccctcgcgaattaattcaactactacctaaaactaaacgacctcgcgaaattctaccgacaatacaaatccgtcgacatccaaaaaaccaacaacgactatccgcgcatccatacccccgaactacaaaaa

SEQ ID NO: 26179 - DNA, 828 bp, Artificial Sequence
  chemically treated genomic DNA (Homo sapiens) CpG-island No: 26179
  misc_feature (7)..(7): n is either a, c, g or t
agcgttnttattaggataggattttttgttattttattttgtttttgtcgagaaagtatttattatggttgatgtaatgcggcggttgtatacgtttgattcggttatttgtttattcgattattaagcgaaatatcgtatcgagcgagtacgtattcggatggaagtcggttttgtcgattaggatgatttggacgaagagtattaggggttcgcgttagtcgaattgttcgttaggtttaaggcgcgtatgttcgacggcgaggatttcgtcgtgatttatggcgatgtttgtttgtcgaatattatggtggaaaatggtcgtttttttggatttatcgattgtggtcggttgggtgtggcggatcgttattaggatatagcgttggttattcgtgatattgttgaagagtttggcggcgaatgggttgatcgttttttcgtgttatacggtatcgtcgttttcgattcgtagcgtatcgttttttatcgtttttttgacgagtttttttgagcgggattttggggttcgaaatgatcgaataagcgacgtttaatttgttattacgagaattcgattttatcggcgttttttatgaaaggttgggtttcggaatcgtttttcgggacgtcggttggatgattttttagcgcggggattttatgttggagtttttcgtttatttcgggttcgattttttcgcgagttggtttagttgttgtttgaggttggacgatttcgcggagttttatcggtagtgtaaattcgtcggtatttaggaaattagtagcggttattcgcgtatttatgttttcgaattgtaggag

SEQ ID NO: 26180 - DNA, 828 bp, Artificial Sequence
  chemically treated genomic DNA (Homo sapiens) CpG-island No: 26180
  misc_feature (822)..(822): n is either a, c, g or t
ctcctacaattcgaaaacataaatacgcgaataaccgctactaatttcctaaataccgacgaatttacactaccgataaaactccgcgaaatcgtccaacctcaaacaacaactaaaccaactcgcgaaaaaatcgaacccgaaataaacgaaaaactccaacataaaatccccgcgctaaaaaatcatccaaccgacgtcccgaaaaacgattccgaaacccaacctttcataaaaaacgccgataaaatcgaattctcgtaataacaaattaaacgtcgcttattcgatcatttcgaaccccaaaatcccgctcaaaaaaactcgtcaaaaaaacgataaaaaacgatacgctacgaatcgaaaacgacgataccgtataacacgaaaaaacgatcaacccattcgccgccaaactcttcaacaatatcacgaataaccaacgctatatcctaataacgatccgccacacccaaccgaccacaatcgataaatccaaaaaaacgaccattttccaccataatattcgacaaacaaacatcgccataaatcacgacgaaatcctcgccgtcgaacatacgcgccttaaacctaacgaacaattcgactaacgcgaacccctaatactcttcgtccaaatcatcctaatcgacaaaaccgacttccatccgaatacgtactcgctcgatacgatatttcgcttaataatcgaataaacaaataaccgaatcaaacgtatacaaccgccgcattacatcaaccataataaatactttctcgacaaaaacaaaataaaataacaaaaaatcctatcctaataanaacgct

SEQ ID NO: 26181 - DNA, 633 bp, Artificial Sequence
  chemically treated genomic DNA (Homo sapiens) CpG-island No: 26181
cgcggttggaggaggatagcgtagggggaggagcgagaggttttcgaaaggttttttatttcggtcgcgagtcggcgggtttttcgtatttcgttttttttttttttatttgggaatcggaggcgtaaggagggttatcgttgggcgtcgggtttgtttttagttttattcggcgatatggcggtcgacgtgttgttacggagtttgttcgggttttttttggtttcggtggaggagatatttttcgttttttcgtttcgtttttttttgcgtatttttcgcggttggtcggttggaggttggcggttcgcgatcgcggagtatagagtattggcggttagagaggaagcgtagagcgcggataattatagagtacgagttcggatattagtcggatggtcggtcgttttttttaacggtttatttataattttcgggcggttgagtcgaggcggaagcggaagtgagggagaaaagtaggaaggtttcgttgttcgtatgcgtaggttttagtgtttattttcgtttgatttggttcggacgttagaaaatgttttacgtgggatattttgcgtggggtttattgtagtagttgtattaggtgatttttggagcgggtttgagagataagga

SEQ ID NO: 26182 - DNA, 633 bp, Artificial Sequence
  chemically treated genomic DNA (Homo sapiens) CpG-island No: 26182
tccttatctctcaaacccgctccaaaaatcacctaatacaactactacaataaaccccacgcaaaatatcccacgtaaaacattttctaacgtccgaaccaaatcaaacgaaaataaacactaaaacctacgcatacgaacaacgaaaccttcctacttttctccctcacttccgcttccgcctcgactcaaccgcccgaaaattataaataaaccgttaaaaaaaacgaccgaccatccgactaatatccgaactcgtactctataattatccgcgctctacgcttcctctctaaccgccaatactctatactccgcgatcgcgaaccgccaacctccaaccgaccaaccgcgaaaaatacgcaaaaaaaaacgaaacgaaaaaacgaaaaatatctcctccaccgaaaccaaaaaaaacccgaacaaactccgtaacaacacgtcgaccgccatatcgccgaataaaactaaaaacaaacccgacgcccaacgataaccctccttacgcctccgattcccaaataaaaaaaaaaaaaacgaaatacgaaaaacccgccgactcgcgaccgaaataaaaaacctttcgaaaacctctcgctcctccccctacgctatcctcctccaaccgcg

SEQ ID NO: 26183 - DNA, 633 bp, Artificial Sequence
  chemically treated genomic DNA (Homo sapiens) CpG-island No: 26183
tttttgttttttaggttcgttttaagaattatttagtgtagttattatagtgaattttacgtagggtattttacgtggaatattttttggcgttcgggttaggttaagcggaagtaaatattagagtttgcgtatgcgaatagcggagtttttttgttttttttttttattttcgttttcgtttcggtttagtcgttcgaggattgtgagtggatcgttgaggagagcgatcgattattcggttggtgttcggattcgtattttatggttgttcgcgttttgcgttttttttttagtcgttagtgttttatgtttcgcggtcgcgggtcgttagtttttagtcggttagtcgcgaggggtgcgtagagggaggcggggcggaaaggcgagaggtgttttttttatcggagttaggggagattcgagtaagtttcgtgatagtacgtcggtcgttatgtcgtcgagtggggttggaaatagattcggcgtttagcggtagttttttttgcgttttcgatttttaggtgaggagaggaggagcgggatgcgggggattcgtcggttcgcggtcgggatggaaagtttttcggaagtttttcgtttttttttttgcgttgtttttttttagtcgcg

SEQ ID NO: 26184 - DNA, 633 bp, Artificial Sequence
  chemically treated genomic DNA (Homo sapiens) CpG-island No: 26184
cgcgactaaaaaaaaacaacgcaaaaaaaaaaacgaaaaacttccgaaaaactttccatcccgaccgcgaaccgacgaatcccccgcatcccgctcctcctctcctcacctaaaaatcgaaaacgcaaaaaaaactaccgctaaacgccgaatctatttccaaccccactcgacgacataacgaccgacgtactatcacgaaacttactcgaatctcccctaactccgataaaaaaaacacctctcgcctttccgccccgcctccctctacgcacccctcgcgactaaccgactaaaaactaacgacccgcgaccgcgaaacataaaacactaacgactaaaaaaaaaacgcaaaacgcgaacaaccataaaatacgaatccgaacaccaaccgaataatcgatcgctctcctcaacgatccactcacaatcctcgaacgactaaaccgaaacgaaaacgaaaataaaaaaaaaaaacaaaaaaactccgctattcgcatacgcaaactctaatatttacttccgcttaacctaacccgaacgccaaaaaatattccacgtaaaataccctacgtaaaattcactataataactacactaaataattcttaaaacgaacctaaaaaacaaaaa

SEQ ID NO: 26185 - DNA, 869 bp, Artificial Sequence
  chemically treated genomic DNA (Homo sapiens) CpG-island No: 26185
cgtgcgtttcgaggacgtcgtgttcgggttcgcgtaggttttattcgggttacggttcgggatacgtgcgtcgggcgtttagcgggttggggggggcgggttcgcgggacgcgggtgcggggtacggaggcggtcgggtcgtattatcgcgtcgcgggaagaggggtagttttcggtcggttttgtcgttttacgtatattcgcgggcggaggattcgtcgttaggttgcgttttacgtttagttcggaagtttcgcgagttcgggttatattatcgcgcggcgggaggaggattatttcgggtcgtattattcgttcggtcgggggacgcgttttggtttcgtcgcgttttcgtagttggcgtttcgtaggtttcgttcggtaggtgtcgttttttttcgggtagacgtgtagaaaagaacgcgtcggtttcgttcgcgaagggtcgcgcggcggtgggcggggcgtcgcgaatttttttcgcgtttattggttgcgttgcggtagggcgggttcggttaggtcggttattggttgagggattaggttatttgtatacggggttgggcgtggagtcgcggggttcggggtcggtcgggtcgggtcggggggcgagagggtgttagcggtcgtagttgaagttgggtcgagagtcggcgacggtttcgcgtcggggtcgtaggtgacgcgcgagggattttaggttggcgggcggggcgttttttagaggtcgttttttcgcgggggttgcggggggtcgggttgggtaggcgcggcggggttcggacgtttaagttggaggggacgggggtggggttaattttttcgttcgtttattcggtagtgtttttaggcgtagggtagttttt

SEQ ID NO: 26186 - DNA, 869 bp, Artificial Sequence
  chemically treated genomic DNA (Homo sapiens) CpG-island No: 26186
aaaaactaccctacgcctaaaaacactaccgaataaacgaacgaaaaaattaaccccacccccgtcccctccaacttaaacgtccgaaccccgccgcgcctacccaacccgaccccccgcaacccccgcgaaaaaacgacctctaaaaaacgccccgcccgccaacctaaaatccctcgcgcgtcacctacgaccccgacgcgaaaccgtcgccgactctcgacccaacttcaactacgaccgctaacaccctctcgccccccgacccgacccgaccgaccccgaaccccgcgactccacgcccaaccccgtatacaaataacctaatccctcaaccaataaccgacctaaccgaacccgccctaccgcaacgcaaccaataaacgcgaaaaaaattcgcgacgccccgcccaccgccgcgcgacccttcgcgaacgaaaccgacgcgttcttttctacacgtctacccgaaaaaaaacgacacctaccgaacgaaacctacgaaacgccaactacgaaaacgcgacgaaaccaaaacgcgtcccccgaccgaacgaataatacgacccgaaataatcctcctcccgccgcgcgataatataacccgaactcgcgaaacttccgaactaaacgtaaaacgcaacctaacgacgaatcctccgcccgcgaatatacgtaaaacgacaaaaccgaccgaaaactacccctcttcccgcgacgcgataatacgacccgaccgcctccgtaccccgcacccgcgtcccgcgaacccgccccccccaacccgctaaacgcccgacgcacgtatcccgaaccgtaacccgaataaaacctacgcgaacccgaacacgacgtcctcgaaacgcacg

SEQ ID NO: 26187 - DNA, 869 bp, Artificial Sequence
  chemically treated genomic DNA (Homo sapiens) CpG-island No: 26187
aggggttgttttgcgtttggaggtattgtcgggtgggcgggcggagggattgattttattttcgttttttttaatttgggcgttcgagtttcgtcgcgtttgtttagttcgatttttcgtagttttcgcgggagggcggtttttgaggggcgtttcgttcgttaatttgggatttttcgcgcgttatttgcgatttcggcgcggggtcgtcgtcggttttcggtttaattttagttgcggtcgttggtattttttcgtttttcggttcgattcgatcggtttcgggtttcgcggttttacgtttagtttcgtatgtaaatgatttggttttttagttaatggtcggtttagtcgggttcgttttatcgtaacgtagttagtgggcgcgaggggggttcgcgacgtttcgtttatcgtcgcgcggtttttcgcgggcgaggtcggcgcgtttttttttgtacgtttgttcggggaggggcggtatttgtcgggcggggtttgcggggcgttagttgcgagggcgcggcggggttagggcgcgtttttcggtcgggcggatggtacggttcgaggtggtttttttttcgtcgcgcggtggtatggttcgggttcgcggggttttcgggttgggcgtggggcgtagtttggcgacgggtttttcgttcgcgggtgtgcgtggggcggtagggtcggtcgggagttgttttttttttcgcggcgcggtggtacgattcggtcgttttcgtgtttcgtattcgcgtttcgcgggttcgttttttttaattcgttgggcgttcggcgtacgtatttcgggtcgtgattcgggtggggtttgcgcgggttcggatacggcgttttcgggacgtacg

SEQ ID NO: 26188 - DNA, 869 bp, Artificial Sequence
  chemically treated genomic DNA (Homo sapiens) CpG-island No: 26188
cgtacgtcccgaaaacgccgtatccgaacccgcgcaaaccccacccgaatcacgacccgaaatacgtacgccgaacgcccaacgaattaaaaaaaacgaacccgcgaaacgcgaatacgaaacacgaaaacgaccgaatcgtaccaccgcgccgcgaaaaaaaaaacaactcccgaccgaccctaccgccccacgcacacccgcgaacgaaaaacccgtcgccaaactacgccccacgcccaacccgaaaaccccgcgaacccgaaccataccaccgcgcgacgaaaaaaaaaccacctcgaaccgtaccatccgcccgaccgaaaaacgcgccctaaccccgccgcgccctcgcaactaacgccccgcaaaccccgcccgacaaataccgcccctccccgaacaaacgtacaaaaaaaaacgcgccgacctcgcccgcgaaaaaccgcgcgacgataaacgaaacgtcgcgaacccccctcgcgcccactaactacgttacgataaaacgaacccgactaaaccgaccattaactaaaaaaccaaatcatttacatacgaaactaaacgtaaaaccgcgaaacccgaaaccgatcgaatcgaaccgaaaaacgaaaaaataccaacgaccgcaactaaaattaaaccgaaaaccgacgacgaccccgcgccgaaatcgcaaataacgcgcgaaaaatcccaaattaacgaacgaaacgcccctcaaaaaccgccctcccgcgaaaactacgaaaaatcgaactaaacaaacgcgacgaaactcgaacgcccaaattaaaaaaaacgaaaataaaatcaatccctccgcccgcccacccgacaatacctccaaacgcaaaacaacccct

SEQ ID NO: 26189 - DNA, 932 bp, Artificial Sequence
  chemically treated genomic DNA (Homo sapiens) CpG-island No: 26189
cgtattttcggaataaggcgaattattaattagatttagtattttttattcgttttatttggttcggaggatattgtttttttttcgggcggcgcggaggcgttcgtacgttaggtttcgcggtcgtcggtatgggaacgttttatttcgatttgtttaggtcgtagaggcgttcggggtcgtaatttagatttcgattttgtagatggagtagatttcgggtttgagtagttttcgttagttcggggagtttcgtcgttgtcgtttaatcgttgcgttcgtttcgaaagtttcggttttcgtcgcgggtatcgaagttcgcgtcgcgattttagtttggcgggagttagggcgttttcgtttcgtagggcgggcgtaggtgcggcgtcgttttcgtttttcgttcgggtatcgcggaaaattttttttagttggagtcggcgttcggtcggttcgaggcgcgtttcgcgtttttaagtatcggggattcggcgcggtttatttgggcgttcgttagtttggagattcgtttcggcgtcgtcgtaatttgtcgtttttagcgtcgcggcgtattcgggtttcgcgtttttattggttcgcggttcgtacgtttcgtttttagtatttttattggttgtttagcgcgggcgtttcgtttttttttcgcgtttattggttgtttttgatacgttttttttcgatttattggttcgtcgtcgcgtttcgtttttttcgagattataggtgtgggcgggtcggaggggggcgtcgagtcgtagttttcgtttttatttttcgtttatcgcgaaaaacgcggaaatgcggtggttgcggttcgcgggtaggcgtcggggtaggtgtttggtttcgtttttgggtcgatttttttagtagttttttagtgtggcgggttttcgtttaggaagggtttt

SEQ ID NO: 26190 - DNA, 932 bp, Artificial Sequence
  chemically treated genomic DNA (Homo sapiens) CpG-island No: 26190
aaaacccttcctaaacgaaaacccgccacactaaaaaactactaaaaaaatcgacccaaaaacgaaaccaaacacctaccccgacgcctacccgcgaaccgcaaccaccgcatttccgcgtttttcgcgataaacgaaaaataaaaacgaaaactacgactcgacgcccccctccgacccgcccacacctataatctcgaaaaaaacgaaacgcgacgacgaaccaataaatcgaaaaaaaacgtatcaaaaacaaccaataaacgcgaaaaaaaaacgaaacgcccgcgctaaacaaccaataaaaatactaaaaacgaaacgtacgaaccgcgaaccaataaaaacgcgaaacccgaatacgccgcgacgctaaaaacgacaaattacgacgacgccgaaacgaatctccaaactaacgaacgcccaaataaaccgcgccgaatccccgatacttaaaaacgcgaaacgcgcctcgaaccgaccgaacgccgactccaactaaaaaaaattttccgcgatacccgaacgaaaaacgaaaacgacgccgcacctacgcccgccctacgaaacgaaaacgccctaactcccgccaaactaaaatcgcgacgcgaacttcgatacccgcgacgaaaaccgaaactttcgaaacgaacgcaacgattaaacgacaacgacgaaactccccgaactaacgaaaactactcaaacccgaaatctactccatctacaaaatcgaaatctaaattacgaccccgaacgcctctacgacctaaacaaatcgaaataaaacgttcccataccgacgaccgcgaaacctaacgtacgaacgcctccgcgccgcccgaaaaaaaaacaatatcctccgaaccaaataaaacgaataaaaaatactaaatctaattaataattcgccttattccgaaaatacg

SEQ ID NO: 26191 - DNA, 932 bp, Artificial Sequence
  chemically treated genomic DNA (Homo sapiens) CpG-island No: 26191
gagattttttttgggcgggaattcgttatattagaaggttgttgaggaagtcggtttaggagcggggttagatatttatttcgacgtttgttcgcgggtcgtagttatcgtattttcgcgtttttcgcggtaggcgggaggtgggggcggggattgcggttcggcgttttttttcgattcgtttatatttgtagtttcggggggggcggggcgcggcgacgagttaatgggtcggggaggggcgtgttagaggtagttaatgggcgcggggagggggcggaacgttcgcgttgagtagttaataggggtgttaggggcggggcgtgcggatcgcgggttaatgggggcgcggggttcgggtgcgtcgcggcgttgggggcggtaggttgcggcggcgtcggagcgggtttttaggttggcgagcgtttaggtgagtcgcgtcgggttttcggtatttgggagcgcggggcgcgtttcgagtcggtcggacgtcgattttaattggggagagtttttcgcgatgttcggacggagagcgggggcggcgtcgtatttgcgttcgttttgcggaacggggacgttttggttttcgttaggttggggtcgcggcgcgggtttcggtgttcgcggcggggatcgggattttcggggcgagcgtagcgattaggcggtagcggcggggtttttcgggttggcgggggttgtttagattcggagtttgttttatttgtagggtcgaggtttgggttgcgatttcgagcgtttttgcggtttgagtaggtcggggtggggcgtttttatgtcggcggtcgcggggtttggcgtgcgggcgttttcgcgtcgttcggggagggggtagtgtttttcgagttaggtgaggcgagtaggaaatgttggatttggttaatgattcgttttgtttcgggagtgcg

SEQ ID NO: 26192 - DNA, 932 bp, Artificial Sequence
  chemically treated genomic DNA (Homo sapiens) CpG-island No: 26192
cgcactcccgaaacaaaacgaatcattaaccaaatccaacatttcctactcgcctcacctaactcgaaaaacactaccccctccccgaacgacgcgaaaacgcccgcacgccaaaccccgcgaccgccgacataaaaacgccccaccccgacctactcaaaccgcaaaaacgctcgaaatcgcaacccaaacctcgaccctacaaataaaacaaactccgaatctaaacaacccccgccaacccgaaaaaccccgccgctaccgcctaatcgctacgctcgccccgaaaatcccgatccccgccgcgaacaccgaaacccgcgccgcgaccccaacctaacgaaaaccaaaacgtccccgttccgcaaaacgaacgcaaatacgacgccgcccccgctctccgtccgaacatcgcgaaaaactctccccaattaaaatcgacgtccgaccgactcgaaacgcgccccgcgctcccaaataccgaaaacccgacgcgactcacctaaacgctcgccaacctaaaaacccgctccgacgccgccgcaacctaccgcccccaacgccgcgacgcacccgaaccccgcgcccccattaacccgcgatccgcacgccccgcccctaacacccctattaactactcaacgcgaacgttccgccccctccccgcgcccattaactacctctaacacgcccctccccgacccattaactcgtcgccgcgccccgccccccccgaaactacaaatataaacgaatcgaaaaaaaacgccgaaccgcaatccccgcccccacctcccgcctaccgcgaaaaacgcgaaaatacgataactacgacccgcgaacaaacgtcgaaataaatatctaaccccgctcctaaaccgacttcctcaacaaccttctaatataacgaattcccgcccaaaaaaaatctc

SEQ ID NO: 26193 - DNA, 652 bp, Artificial Sequence
  chemically treated genomic DNA (Homo sapiens) CpG-island No: 26193
gcggtagggcggattcgtagggggtatgggcgtgggtgttatagagcgaggcgagtgggttttcgtcgcgttttcgtaagtttaggacgttcgttcgtaggttacgggttttttagtttcggcggggttttttagtttcggcggggttttttagtttcggcggggttttttagtttcggcggggttttttagtttcggcggggttttttagtttcggcggggttttttagtttcggcggggttttttagtttcggcggggttttttagtttcggcggggttttttagcgcgcgcgcgttcgttcgttttttcggttcgcggttagcgcggcgtaggtttcgtttcgcggtgtaggtcgtagataaagcgcgtggcgtttataggcggttcgcggttcggaggagtagggtttttagggtcggcgcggtcgtcgtatttattcggaaatttcgcgtttcgtagtcgttcgcgagcgttcgtcgtcgttgtacgatcgagagtcgtttttaggttcggtcgtcgtcgtttttgtcgtcgtcgtgcgtttttcgattcggaagagtacggcgtttttttcgggtttttttgttttgttcgttgattggaattattgagattagagcgggaaagaaatgattgaagtgaggaaggt

SEQ ID NO: 26194 - DNA, 652 bp, Artificial Sequence
  chemically treated genomic DNA (Homo sapiens) CpG-island No: 26194
accttcctcacttcaatcatttctttcccgctctaatctcaataattccaatcaacgaacaaaacaaaaaaacccgaaaaaaacgccgtactcttccgaatcgaaaaacgcacgacgacgacaaaaacgacgacgaccgaacctaaaaacgactctcgatcgtacaacgacgacgaacgctcgcgaacgactacgaaacgcgaaatttccgaataaatacgacgaccgcgccgaccctaaaaaccctactcctccgaaccgcgaaccgcctataaacgccacgcgctttatctacgacctacaccgcgaaacgaaacctacgccgcgctaaccgcgaaccgaaaaaacgaacgaacgcgcgcgcgctaaaaaaccccgccgaaactaaaaaaccccgccgaaactaaaaaaccccgccgaaactaaaaaaccccgccgaaactaaaaaaccccgccgaaactaaaaaaccccgccgaaactaaaaaaccccgccgaaactaaaaaaccccgccgaaactaaaaaaccccgccgaaactaaaaaacccgtaacctacgaacgaacgtcctaaacttacgaaaacgcgacgaaaacccactcgcctcgctctataacacccacgcccataccccctacgaatccgccctaccgc

SEQ ID NO: 26195 - DNA, 652 bp, Artificial Sequence
  chemically treated genomic DNA (Homo sapiens) CpG-island No: 26195
attttttttattttagttatttttttttcgttttggttttagtggttttagttagcgagtaggatagaggagttcggaagaggcgtcgtgttttttcgggtcgaagagcgtacggcggcggtagaggcggcggcggtcgggtttaggagcgattttcggtcgtgtagcggcggcgagcgttcgcgagcggttgcgggacgcgaggttttcgggtaagtgcggcggtcgcgtcggttttgggggttttgttttttcgggtcgcgggtcgtttgtgggcgttacgcgttttgtttgcggtttgtatcgcggggcgaggtttgcgtcgcgttggtcgcgggtcgggagggcgggcgggcgcgcgcgcgttgggaggtttcgtcgagattgggaggtttcgtcgagattgggaggtttcgtcgagattgggaggtttcgtcgagattgggaggtttcgtcgagattgggaggtttcgtcgagattgggaggtttcgtcgagattgggaggtttcgtcgagattgggaggtttcgtcgagattgggaggttcgtggtttgcgggcggacgttttgggtttgcgaggacgcggcgagagtttattcgtttcgttttgtggtatttacgtttatgttttttgcgagttcgttttgtcgt

SEQ ID NO: 26196 - DNA, 652 bp, Artificial Sequence
  chemically treated genomic DNA (Homo sapiens) CpG-island No: 26196
acgacaaaacgaactcgcaaaaaacataaacgtaaataccacaaaacgaaacgaataaactctcgccgcgtcctcgcaaacccaaaacgtccgcccgcaaaccacgaacctcccaatctcgacgaaacctcccaatctcgacgaaacctcccaatctcgacgaaacctcccaatctcgacgaaacctcccaatctcgacgaaacctcccaatctcgacgaaacctcccaatctcgacgaaacctcccaatctcgacgaaacctcccaatctcgacgaaacctcccaacgcgcgcgcgcccgcccgccctcccgacccgcgaccaacgcgacgcaaacctcgccccgcgatacaaaccgcaaacaaaacgcgtaacgcccacaaacgacccgcgacccgaaaaaacaaaacccccaaaaccgacgcgaccgccgcacttacccgaaaacctcgcgtcccgcaaccgctcgcgaacgctcgccgccgctacacgaccgaaaatcgctcctaaacccgaccgccgccgcctctaccgccgccgtacgctcttcgacccgaaaaaacacgacgcctcttccgaactcctctatcctactcgctaactaaaaccactaaaaccaaaacgaaaaaaaaataactaaaataaaaaaaat

SEQ ID NO: 26197 - DNA, 884 bp, Artificial Sequence
  chemically treated genomic DNA (Homo sapiens) CpG-island No: 26197
cgttcggggagattaatattttggaagagttcgtattgtttaattcgcgattatgggttggtttaggtcgtttttttcgcggtcgggatagttggtatcgttcggattttcgtttatcgtttagagcgaatgggagttgttttttgtacgttagtttcgtttttacgttcgtagtttcgttttttttcgggttcgtagttttatttcgtttttacgtacgtagtttcgtttttattttcgtagtttcgtttcgtttcgcgttcgtagtttcgtttttacgtttgtagtttcgttttgtttcgggacggtcgtttacggtttcgttttttttttcgtagtttcgttttacgttcgttgtttcgtagtttcgtttttattttcgtagtttcgtttttacgtcgtaatttcgttcgtagtttttttttagtttcgcgcgcggcgggagtatttggggagaagagttttggcgtcgtttgttattagcgtcgcgtttttttgaataaatattgtcggagtttttcgtgagtcggttattttagtttagtttcgcgttcgttcgtttcgtagtaggcgcggtgaatcgtgcgcgttggcggacgaggcgggttcggtaggacgttgttgtgtcgtttcgtgtggatttggttttaggtcgttttgaggatgtcgcgtagaagtcgtgtgggtttcgggacgtaggtttgcgtggttgtagcgtattaggggaggtttcggggatttcgagttggcgcggattcgcgagattttttggtcgttttgcggggagcgttggggaggcgtttcgagcgggcgttagagattcgcgggtttttcgtgtaggggttgtttgggttggggttcgggtgggtttgcgtaggtgtggg

SEQ ID NO: 26198 - DNA, 884 bp, Artificial Sequence
  chemically treated genomic DNA (Homo sapiens) CpG-island No: 26198
cccacacctacgcaaacccacccgaaccccaacccaaacaacccctacacgaaaaacccgcgaatctctaacgcccgctcgaaacgcctccccaacgctccccgcaaaacgaccaaaaaatctcgcgaatccgcgccaactcgaaatccccgaaacctcccctaatacgctacaaccacgcaaacctacgtcccgaaacccacacgacttctacgcgacatcctcaaaacgacctaaaaccaaatccacacgaaacgacacaacaacgtcctaccgaacccgcctcgtccgccaacgcgcacgattcaccgcgcctactacgaaacgaacgaacgcgaaactaaactaaaataaccgactcacgaaaaactccgacaatatttattcaaaaaaacgcgacgctaataacaaacgacgccaaaactcttctccccaaatactcccgccgcgcgcgaaactaaaaaaaaactacgaacgaaattacgacgtaaaaacgaaactacgaaaataaaaacgaaactacgaaacaacgaacgtaaaacgaaactacgaaaaaaaaaacgaaaccgtaaacgaccgtcccgaaacaaaacgaaactacaaacgtaaaaacgaaactacgaacgcgaaacgaaacgaaactacgaaaataaaaacgaaactacgtacgtaaaaacgaaataaaactacgaacccgaaaaaaaacgaaactacgaacgtaaaaacgaaactaacgtacaaaaaacaactcccattcgctctaaacgataaacgaaaatccgaacgataccaactatcccgaccgcgaaaaaaacgacctaaaccaacccataatcgcgaattaaacaatacgaactcttccaaaatattaatctccccgaacg

SEQ ID NO: 26199 - DNA, 884 bp, Artificial Sequence
  chemically treated genomic DNA (Homo sapiens) CpG-island No: 26199
tttatatttgcgtagatttattcgggttttagtttaggtagtttttgtacggggagttcgcgggtttttggcgttcgttcgggacgtttttttagcgtttttcgtagagcggttagggggtttcgcgagttcgcgttagttcgggattttcggagttttttttggtgcgttgtagttacgtaggtttgcgtttcgaggtttatacggtttttgcgcggtatttttaggacgatttggagttaaatttatacgggacggtatagtagcgttttgtcgagttcgtttcgttcgttagcgcgtacgatttatcgcgtttgttgcgggacgggcggacgcggggttgggttggaatagtcggtttacggagggtttcggtagtgtttgtttagaggagcgcggcgttggtagtaggcgacgttaggatttttttttttaggtgttttcgtcgcgcgcggggttagggaggagttgcgggcggggttgcggcgtgggggcggggttgcgagggtgggggcggggttgcggagtagcgggcgtgaggcggggttgcgagggagggggcggggtcgtgggcggtcgtttcgaggtagggcggggttgtagacgtgggggcggagttgcgggcgcgaggcggggcggggttgcgggggtgggggcggggttacgtgcgtgggggcggggtggggttgcgggttcgaggagggacggggttgcgggcgtgggggcggagttgacgtataggaagtagtttttattcgttttgggcggtgggcggagattcgggcggtattagttgtttcggtcgcgggggggacggtttggattagtttatggtcgcgggttaaatagtacgagtttttttaggatattggttttttcgggcg

SEQ ID NO: 26200 - DNA, 884 bp, Artificial Sequence
  chemically treated genomic DNA (Homo sapiens) CpG-island No: 26200
cgcccgaaaaaaccaatatcctaaaaaaactcgtactatttaacccgcgaccataaactaatccaaaccgtcccccccgcgaccgaaacaactaataccgcccgaatctccgcccaccgcccaaaacgaataaaaactacttcctatacgtcaactccgcccccacgcccgcaaccccgtccctcctcgaacccgcaaccccaccccgcccccacgcacgtaaccccgcccccacccccgcaaccccgccccgcctcgcgcccgcaactccgcccccacgtctacaaccccgccctacctcgaaacgaccgcccacgaccccgccccctccctcgcaaccccgcctcacgcccgctactccgcaaccccgcccccaccctcgcaaccccgcccccacgccgcaaccccgcccgcaactcctccctaaccccgcgcgcgacgaaaacacctaaaaaaaaaaatcctaacgtcgcctactaccaacgccgcgctcctctaaacaaacactaccgaaaccctccgtaaaccgactattccaacccaaccccgcgtccgcccgtcccgcaacaaacgcgataaatcgtacgcgctaacgaacgaaacgaactcgacaaaacgctactataccgtcccgtataaatttaactccaaatcgtcctaaaaataccgcgcaaaaaccgtataaacctcgaaacgcaaacctacgtaactacaacgcaccaaaaaaaactccgaaaatcccgaactaacgcgaactcgcgaaaccccctaaccgctctacgaaaaacgctaaaaaaacgtcccgaacgaacgccaaaaacccgcgaactccccgtacaaaaactacctaaactaaaacccgaataaatctacgcaaatataaa

SEQ ID NO: 26201 - DNA, 1013 bp, Artificial Sequence
  chemically treated genomic DNA (Homo sapiens) CpG-island No: 26201
gagggtcgggacgtacgtacgggtcgggtaggatggcgttggcgtcgatgttcgcgcgttttagggtttggtttggtcgtttttttatttttgtcggtttttcgggtcgcggatttcgcgcggcgtcgggcgatgttggtttgttcgtggttattatttcgttttattttcgtttttttgggtcgtcgtattcgtttacgtgttcgtttttttttgcgtaaaattttaagatgagtaaatattgggtttacggtggagcgtcgcgggggtttttttgagtcggggcgggtcgggggcgggattagggttcggtcggggcgtgttcgaggggagggatttttcggtttgcgattcggcgttgttcgcggtgtttagcgttcgttcgggcgcgttatggggaatcgtagtatcgcggacgcggacgggttgttggttgggcgcgggtcggtcgcgggggtatttgcgggggtatttgcggggttggttgggtagggcgcggcggcgttggtggggggcgtgttgtttatcggcgcggtgttcgcggggaattcgttcgtgtgcgtgagcgtggttatcgagcgcgttttgtagacgtttattaatttttttatcgtgagtttggcggtcgtcgatttttttttcgtttttttggtgttgtcgtttttcgtttatttcgaggtgagtcgcgttcggtcgtacgagtatttttatttgtttttcggtttttcgtttttgtttttacggaggattcggcgcgattcggtttttttttggtgcggagtttttagttggggcggcggtaggggcgttgcgttttgtttttcggcgatatatttatcgtcgttatttcgcgattttttattcgttgcgttgtttgtttttcgattttcgtttttttttttttttttcgtttgttttggcgtttgttatttaggagatgttcgtttttttatttagggatttcggaaataggcgattttgttaagtttagtttttttcgtagttggatttta

SEQ ID NO: 26202 - DNA, 1013 bp, Artificial Sequence
  chemically treated genomic DNA (Homo sapiens) CpG-island No: 26202
taaaatccaactacgaaaaaaactaaacttaacaaaatcgcctatttccgaaatccctaaataaaaaaacgaacatctcctaaataacaaacgccaaaacaaacgaaaaaaaaaaaaaaaaacgaaaatcgaaaaacaaacaacgcaacgaataaaaaatcgcgaaataacgacgataaatatatcgccgaaaaacaaaacgcaacgcccctaccgccgccccaactaaaaactccgcaccaaaaaaaaaccgaatcgcgccgaatcctccgtaaaaacaaaaacgaaaaaccgaaaaacaaataaaaatactcgtacgaccgaacgcgactcacctcgaaataaacgaaaaacgacaacaccaaaaaaacgaaaaaaaaatcgacgaccgccaaactcacgataaaaaaattaataaacgtctacaaaacgcgctcgataaccacgctcacgcacacgaacgaattccccgcgaacaccgcgccgataaacaacacgccccccaccaacgccgccgcgccctacccaaccaaccccgcaaatacccccgcaaatacccccgcgaccgacccgcgcccaaccaacaacccgtccgcgtccgcgatactacgattccccataacgcgcccgaacgaacgctaaacaccgcgaacaacgccgaatcgcaaaccgaaaaatccctcccctcgaacacgccccgaccgaaccctaatcccgcccccgacccgccccgactcaaaaaaacccccgcgacgctccaccgtaaacccaatatttactcatcttaaaattttacgcaaaaaaaaacgaacacgtaaacgaatacgacgacccaaaaaaacgaaaataaaacgaaataataaccacgaacaaaccaacatcgcccgacgccgcgcgaaatccgcgacccgaaaaaccgacaaaaataaaaaaacgaccaaaccaaaccctaaaacgcgcgaacatcgacgccaacgccatcctacccgacccgtacgtacgtcccgaccctc

SEQ ID NO: 26203 - DNA, 1013 bp, Artificial Sequence
  chemically treated genomic DNA (Homo sapiens) CpG-island No: 26203
tgaaatttagttacggaggggattgggtttgataaagtcgtttgttttcggggtttttggatagaaggacgggtattttttggataatagacgttaagatagacggggaaggagaagaggaacgagggtcgggggatagatagcgtagcgggtggaaggtcgcgaggtggcggcggtgggtgtatcgtcgagggataaggcgtagcgtttttgtcgtcgttttagttggaagtttcgtattagaaaggggtcgggtcgcgtcgggtttttcgtagggatagggacggggaatcgaggagtaggtgaggatgttcgtgcggtcggacgcggtttatttcggagtagacgaagagcggtagtattaggagagcgaggaggaggtcggcggtcgttaggtttacgatgaaggagttggtgggcgtttgtagggcgcgttcggtggttacgtttacgtatacgagcgagtttttcgcgagtatcgcgtcgatgagtagtacgttttttattagcgtcgtcgcgttttgtttagttagtttcgtagatgttttcgtagatgttttcgcggtcggttcgcgtttagttagtagttcgttcgcgttcgcggtgttgcggttttttatggcgcgttcgggcgggcgttgagtatcgcggataacgtcgggtcgtaagtcggggagttttttttttcgggtacgtttcggtcggattttggtttcgttttcgattcgtttcggtttaggggggttttcgcggcgttttatcgtgagtttagtatttgtttattttggaattttgcgtagggagagacgggtacgtggacgaatgcggcggtttaaagagacgggaatgaagcgaggtggtggttacgggtaggttagtatcgttcggcgtcgcgcggggttcgcgattcgagaaatcgataaggatggaggggcggttagattaggttttgaagcgcgcgggtatcgacgttagcgttattttattcggttcgtgcgtgcgtttcggttttt

SEQ ID NO: 26204 - DNA, 1013 bp, Artificial Sequence
  chemically treated genomic DNA (Homo sapiens) CpG-island No: 26204
aaaaaccgaaacgcacgcacgaaccgaataaaataacgctaacgtcgatacccgcgcgcttcaaaacctaatctaaccgcccctccatccttatcgatttctcgaatcgcgaaccccgcgcgacgccgaacgatactaacctacccgtaaccaccacctcgcttcattcccgtctctttaaaccgccgcattcgtccacgtacccgtctctccctacgcaaaattccaaaataaacaaatactaaactcacgataaaacgccgcgaaaacccccctaaaccgaaacgaatcgaaaacgaaaccaaaatccgaccgaaacgtacccgaaaaaaaaaactccccgacttacgacccgacgttatccgcgatactcaacgcccgcccgaacgcgccataaaaaaccgcaacaccgcgaacgcgaacgaactactaactaaacgcgaaccgaccgcgaaaacatctacgaaaacatctacgaaactaactaaacaaaacgcgacgacgctaataaaaaacgtactactcatcgacgcgatactcgcgaaaaactcgctcgtatacgtaaacgtaaccaccgaacgcgccctacaaacgcccaccaactccttcatcgtaaacctaacgaccgccgacctcctcctcgctctcctaatactaccgctcttcgtctactccgaaataaaccgcgtccgaccgcacgaacatcctcacctactcctcgattccccgtccctatccctacgaaaaacccgacgcgacccgacccctttctaatacgaaacttccaactaaaacgacgacaaaaacgctacgccttatccctcgacgatacacccaccgccgccacctcgcgaccttccacccgctacgctatctatcccccgaccctcgttcctcttctccttccccgtctatcttaacgtctattatccaaaaaatacccgtccttctatccaaaaaccccgaaaacaaacgactttatcaaacccaatcccctccgtaactaaatttca

SEQ ID NO: 26205 - DNA, 734 bp, Artificial Sequence
  chemically treated genomic DNA (Homo sapiens) CpG-island No: 26205
tggcgcgtggttgttgagttttcgtttgtgcgacgtttttatggttatggacgttatgttgtgtatcgtttttatttttaatttgtgcgttattagcgtggataggtgcgtcgtttttttcgttcgcgtttcggcgttttcgcgtttcgttcgtcgtttttatcgcggtttgtgcgttgttcggcgttttttcggcgtttttcgtaggttcgtggtcgtggtcgtgtcgttgcgttataatcggtagggtgggagtcgtcggtagttgttgtttatcggcgttacgtggttgttgttcgcggcggtggcggcgttcgtattgtgcggttttaacgacgtgcgcggtcgcgatttcgtcgtgtgtcgtttggaggatcgcgattacgtggtttattcgttcgtgtgttttttttttttattttgttcgtttatgttgttgttttattgggttacgtttcgcggtttgtagcgttgggaggtggtacgtcgcgttaagttgtacggtcgcgcgttacgtcgatttagcggttttggatcgttattatattaagtttatcggggttagtttcgttaggattcgtgtggtttcgaatgtgcgtttatcgcgttaggtttttttcggggtttttgcggcgtagtttgagcgttcgtcgagtttagtttatattaggatttttgcggtttagattgagcgtttattgagttcggttttttttcgggtatttgaggttgta

SEQ ID NO: 26206 - DNA, 734 bp, Artificial Sequence
  chemically treated genomic DNA (Homo sapiens) CpG-island No: 26206
tacaacctcaaatacccgaaaaaaaaccgaactcaataaacgctcaatctaaaccgcaaaaatcctaatataaactaaactcgacgaacgctcaaactacgccgcaaaaaccccgaaaaaaacctaacgcgataaacgcacattcgaaaccacacgaatcctaacgaaactaaccccgataaacttaatataataacgatccaaaaccgctaaatcgacgtaacgcgcgaccgtacaacttaacgcgacgtaccacctcccaacgctacaaaccgcgaaacgtaacccaataaaacaacaacataaacgaacaaaataaaaaaaaaaaacacacgaacgaataaaccacgtaatcgcgatcctccaaacgacacacgacgaaatcgcgaccgcgcacgtcgttaaaaccgcacaatacgaacgccgccaccgccgcgaacaacaaccacgtaacgccgataaacaacaactaccgacgactcccaccctaccgattataacgcaacgacacgaccacgaccacgaacctacgaaaaacgccgaaaaaacgccgaacaacgcacaaaccgcgataaaaacgacgaacgaaacgcgaaaacgccgaaacgcgaacgaaaaaaacgacgcacctatccacgctaataacgcacaaattaaaaataaaaacgatacacaacataacgtccataaccataaaaacgtcgcacaaacgaaaactcaacaaccacgcgcca

SEQ ID NO: 26207 - DNA, 734 bp, Artificial Sequence
  chemically treated genomic DNA (Homo sapiens) CpG-island No: 26207
tgtagttttaagtgttcggggggaggtcgggtttagtggacgtttagtttgggtcgtaagggttttggtgtaggttgggttcggcgagcgtttagattacgtcgtagggatttcggggaaggtttggcgcggtgggcgtatattcgaggttatacgggttttgacggagttagtttcgatgggtttgatgtgatggcggtttaaggtcgttgggtcggcgtggcgcgcggtcgtgtagtttggcgcgacgtgttattttttagcgttgtaggtcgcggaacgtggtttagtagagtagtagtatgagcgggtagggtaggaagaaggagtatacggacgagtagattacgtagtcgcggttttttaggcggtatacggcggggtcgcggtcgcgtacgtcgttgaggtcgtatagtacgggcgtcgttatcgtcgcggatagtagttacgtggcgtcgatgagtagtagttgtcggcggtttttattttgtcggttgtagcgtagcggtacggttacggttacgaatttgcggggagcgtcgagggggcgtcggatagcgtataggtcgcggtgagggcggcgggcggggcgcgggggcgtcggggcgcgggcggggagggcggcgtatttgtttacgttgatggcgtataggttgaagatggaggcggtgtatagtatgacgtttatggttatgagggcgtcgtataggcgggggtttagtagttacgcgtta

SEQ ID NO: 26208 - DNA, 734 bp, Artificial Sequence
  chemically treated genomic DNA (Homo sapiens) CpG-island No: 26208
taacgcgtaactactaaacccccgcctatacgacgccctcataaccataaacgtcatactatacaccgcctccatcttcaacctatacgccatcaacgtaaacaaatacgccgccctccccgcccgcgccccgacgcccccgcgccccgcccgccgccctcaccgcgacctatacgctatccgacgccccctcgacgctccccgcaaattcgtaaccgtaaccgtaccgctacgctacaaccgacaaaataaaaaccgccgacaactactactcatcgacgccacgtaactactatccgcgacgataacgacgcccgtactatacgacctcaacgacgtacgcgaccgcgaccccgccgtataccgcctaaaaaaccgcgactacgtaatctactcgtccgtatactccttcttcctaccctacccgctcatactactactctactaaaccacgttccgcgacctacaacgctaaaaaataacacgtcgcgccaaactacacgaccgcgcgccacgccgacccaacgaccttaaaccgccatcacatcaaacccatcgaaactaactccgtcaaaacccgtataacctcgaatatacgcccaccgcgccaaaccttccccgaaatccctacgacgtaatctaaacgctcgccgaacccaacctacaccaaaacccttacgacccaaactaaacgtccactaaacccgacctccccccgaacacttaaaactaca

SEQ ID NO: 26209 - DNA, 1298 bp, Artificial Sequence
  chemically treated genomic DNA (Homo sapiens) CpG-island No: 26209
gttgcgttcgtcgttcggaattttatcggggttgtaagcgttttcggggtgggttgcggtgggagtaggggagttggggtgcgtggtggtaggtggggtgcgcggtcgttttatttgcgcggaagggtagtcgggtaatcggatttcgcggttattcgggggtttttagtttcgagtatttcgttttggtttcggcggattttagtttttttttagttcgtagtttcgggattttcgcggtgggcggcgtcgcgttgtcggcgtagggagggtttttggtgtatcggtatcgttgagtcgggttttttcgtcggtttgttttcgggagagttcggggttttgttcggagatgtcgtttcgggtttttagatatcggttttttggtttttttcgagtaatttcgagttcggtttcggtttttagttaagtttaatttcgagaggtcgcggttttattggtttcgtttttcgcgttgttttcggaagtttcgttcgatcgcggtttttgatagacgggtcgtttagttaatcggggtggggcggggttcgatggcgcgtagttaatggtaggtcgcgtttggtagacggacgggcgcggggcggggcgtgcgtaggttcgttcgagttttcgtcgttcgtgttttgcgttcgtaattcgagtcgtattcgtcgcggacggagtttatgcgcggggcgaatcgcgcgttttcgttttcgtttcgtttcggtttcggtttcggttttggtttcgggggtagtcgcgtttgtgaacggtgagtgcgggtagggatcggtcgggtcgcgcgtttttttcgtttttaggcggtagtaatacgcgcggcgcgggtcgggggcgcggggtcggcgggcgtaagcggcggcggcggcggcggcggcgggtgggtggggtcgggcggggttcgcgggtataggtgagcgggcgtcgggggttgcggcgggcgggggtttttttttttttggggtttgcgggaattcgggttttattcgtggtttcgcgttgggtacggtttttacgtcggcgtattcgggagtttcgggttcggcgtttttatattcgggggcgtttgggaggaggcggtcgcggttacggtacgttcgggtattttcgatttagtattataggtcgcggattaggtcgggggttttagttttagtgtttttttttttttcgggtttttcgcgtcgtttttcggtttttttttgtcgtttagtttttgttttttaggagtttttttgttttttttagttttttgtggttgaaagatgttttcggttttt

SEQ ID NO: 26210 - DNA, 1298 bp, Artificial Sequence
  chemically treated genomic DNA (Homo sapiens) CpG-island No: 26210
aaaaaccgaaaacatctttcaaccacaaaaaactaaaaaaaacaaaaaaactcctaaaaaacaaaaactaaacgacaaaaaaaaaccgaaaaacgacgcgaaaaacccgaaaaaaaaaaaaacactaaaactaaaacccccgacctaatccgcgacctataatactaaatcgaaaatacccgaacgtaccgtaaccgcgaccgcctcctcccaaacgcccccgaatataaaaacgccgaacccgaaactcccgaatacgccgacgtaaaaaccgtacccaacgcgaaaccacgaataaaacccgaattcccgcaaaccccaaaaaaaaaaaaacccccgcccgccgcaacccccgacgcccgctcacctatacccgcgaaccccgcccgaccccacccacccgccgccgccgccgccgccgccgcttacgcccgccgaccccgcgcccccgacccgcgccgcgcgtattactaccgcctaaaaacgaaaaaaacgcgcgacccgaccgatccctacccgcactcaccgttcacaaacgcgactacccccgaaaccaaaaccgaaaccgaaaccgaaacgaaacgaaaacgaaaacgcgcgattcgccccgcgcataaactccgtccgcgacgaatacgactcgaattacgaacgcaaaacacgaacgacgaaaactcgaacgaacctacgcacgccccgccccgcgcccgtccgtctaccaaacgcgacctaccattaactacgcgccatcgaaccccgccccaccccgattaactaaacgacccgtctatcaaaaaccgcgatcgaacgaaacttccgaaaacaacgcgaaaaacgaaaccaataaaaccgcgacctctcgaaattaaacttaactaaaaaccgaaaccgaactcgaaattactcgaaaaaaaccaaaaaaccgatatctaaaaacccgaaacgacatctccgaacaaaaccccgaactctcccgaaaacaaaccgacgaaaaaacccgactcaacgataccgatacaccaaaaaccctccctacgccgacaacgcgacgccgcccaccgcgaaaatcccgaaactacgaactaaaaaaaaactaaaatccgccgaaaccaaaacgaaatactcgaaactaaaaacccccgaataaccgcgaaatccgattacccgactacccttccgcgcaaataaaacgaccgcgcaccccacctaccaccacgcaccccaactcccctactcccaccgcaacccaccccgaaaacgcttacaaccccgataaaattccgaacgacgaacgcaac

SEQ ID NO: 26211 - DNA, 1298 bp, Artificial Sequence
  chemically treated genomic DNA (Homo sapiens) CpG-island No: 26211
gggaatcgggggtattttttagttatagaaagttggagaagatagaggagtttttgggaagtagggattgagcgataggaaggggtcgagaagcggcgcgggagattcggagagggaaaaggtattggggttgaggttttcggtttggttcgcgatttgtgatgttgaatcgggggtgttcgggcgtgtcgtggtcgcggtcgtttttttttagacgttttcgggtgtgagggcgtcgggttcgaggttttcgggtacgtcggcgtggggatcgtgtttagcgcgaggttacgggtggggttcggattttcgtaggttttagggaggaaggggttttcgttcgtcgtagttttcgacgttcgtttatttgtgttcgcgggtttcgttcggttttatttattcgtcgtcgtcgtcgtcgtcgtcgtttacgttcgtcggtttcgcgttttcggttcgcgtcgcgcgtattgttgtcgtttgggggcgaggagggcgcgcggttcggtcgatttttgttcgtatttatcgtttataggcgcgattgttttcggggttagggtcggggtcgaggtcggggcggggcgggggcgggggcgcgcggttcgtttcgcgtatgggtttcgttcgcggcgggtgcggttcgggttgcgggcgtagggtacgggcggcggagattcgggcgggtttgcgtacgtttcgtttcgcgttcgttcgtttgttaggcgcggtttattattggttgcgcgttatcgggtttcgttttatttcggttggttgagcggttcgtttgttaggagtcgcggtcgggcggggttttcgggagtaacgcgggaggcggagttagtagggtcgcggtttttcggggttgggtttggttggagatcggagtcgagttcggggttgttcgaggaaggttagggagtcggtgtttgggggttcggggcggtattttcgagtagggtttcgggttttttcgggaataggtcggcgagagaattcgatttagcggtgtcggtgtattagaggttttttttgcgtcggtagcgcggcgtcgtttatcgcggaggtttcggggttacgggttggggaaaggttgggattcgtcgggattaaggcgggatgttcggagttgggggttttcgggtggtcgcggggttcggttgttcggttgttttttcgcgtaggtggagcggtcgcgtattttatttattattacgtattttagtttttttatttttatcgtaatttatttcgaggacgtttgtagtttcggtggggtttcgggcggcgggcgtagt

SEQ ID NO: 26212 - DNA, 1298 bp, Artificial Sequence
  chemically treated genomic DNA (Homo sapiens) CpG-island No: 26212
actacgcccgccgcccgaaaccccaccgaaactacaaacgtcctcgaaataaattacgataaaaataaaaaaactaaaatacgtaataataaataaaatacgcgaccgctccacctacgcgaaaaaacaaccgaacaaccgaaccccgcgaccacccgaaaacccccaactccgaacatcccgccttaatcccgacgaatcccaacctttccccaacccgtaaccccgaaacctccgcgataaacgacgccgcgctaccgacgcaaaaaaaacctctaatacaccgacaccgctaaatcgaattctctcgccgacctattcccgaaaaaacccgaaaccctactcgaaaataccgccccgaacccccaaacaccgactccctaaccttcctcgaacaaccccgaactcgactccgatctccaaccaaacccaaccccgaaaaaccgcgaccctactaactccgcctcccgcgttactcccgaaaaccccgcccgaccgcgactcctaacaaacgaaccgctcaaccaaccgaaataaaacgaaacccgataacgcgcaaccaataataaaccgcgcctaacaaacgaacgaacgcgaaacgaaacgtacgcaaacccgcccgaatctccgccgcccgtaccctacgcccgcaacccgaaccgcacccgccgcgaacgaaacccatacgcgaaacgaaccgcgcgcccccgcccccgccccgccccgacctcgaccccgaccctaaccccgaaaacaatcgcgcctataaacgataaatacgaacaaaaatcgaccgaaccgcgcgccctcctcgcccccaaacgacaacaatacgcgcgacgcgaaccgaaaacgcgaaaccgacgaacgtaaacgacgacgacgacgacgacgacgaataaataaaaccgaacgaaacccgcgaacacaaataaacgaacgtcgaaaactacgacgaacgaaaaccccttcctccctaaaacctacgaaaatccgaaccccacccgtaacctcgcgctaaacacgatccccacgccgacgtacccgaaaacctcgaacccgacgccctcacacccgaaaacgtctaaaaaaaaacgaccgcgaccacgacacgcccgaacacccccgattcaacatcacaaatcgcgaaccaaaccgaaaacctcaaccccaataccttttccctctccgaatctcccgcgccgcttctcgaccccttcctatcgctcaatccctacttcccaaaaactcctctatcttctccaactttctataactaaaaaatacccccgattccc

SEQ ID NO: 26213 - DNA, 1232 bp, Artificial Sequence
  chemically treated genomic DNA (Homo sapiens) CpG-island No: 26213
ttcgaattcggtgttttttttggagtcgatagttttttaggtttagttcggtttttgcgggaggcgacggtagggtggggttattcgggatggcgggtaggtgttgcggcgcggggatttcggggttttcgggtcgcgtaggtttttttcgcgcgtggaagagttttttcgagtttattgggggtagtaggtttcgcgttttggtggggcgagggtcgtgagggcggcggtcggttcgggaaaggcggttttagagggtttcgcgtttggggcggggtaggggtcgcggggcgtattggaggattagggggcggtcggggcggggtttggggaagtaggggttcgttttagcgaggggatacgagggatcgtttttgttgggtcggggtttggggagggaggttagatttcggggattcgcggtttttattttggttttcggcgattgattcggggttttcgtattcggtttttgcgtaggggtcgaggtgggcgcggcggtttgcgggtgtcggcgtcgggttcggttttagggagcgggaagcggtcgatggataagtcggtgtcgtcggcgaagattttcggggtcggagtttcgcggcgtgggattcggtgtttattgaggatttgcggggcgcgtcggttatttttatattttagtttcggtcgttttatcggggattcgtatcgatttcgtttttggggtttaggagtagcgtcgcgtagtcgcggatggagaggaggggaacgggttttcggttcgaggacgcgcgtagcggttttttggcgttgcgggtcgtttcgttttagatttggaggggcgtggagcggcgggtgaggggcggtcgggtcgggtcgtcggggtcgggttttcgggtcggggcgtatcgtgacgtggtgtcgcggggttagtagcgtgttcggcgggaagcggtataggcgtttcgggaagtcgcgtattagttgttttagtattatgtcgtttaggtcggtcgtgtttttttgcgacgggttgaagatgcggacgaatttttttcggtagtttatagttacgatttttaggtttgtcgggttgggaagagaggagacgttgtgaggagatgcggtcggtttattcgtatagttgcgcgtttcgttcggaaattagttttagttcggcgtcggaggtttgggttattcgttttttatttttgtaggagtttcgggttttagtggttcgggtttgtgtaggg

SEQ ID NO: 26214 - DNA, 1232 bp, Artificial Sequence
  chemically treated genomic DNA (Homo sapiens) CpG-island No: 26214
ccctacacaaacccgaaccactaaaacccgaaactcctacaaaaataaaaaacgaataacccaaacctccgacgccgaactaaaactaatttccgaacgaaacgcgcaactatacgaataaaccgaccgcatctcctcacaacgtctcctctcttcccaacccgacaaacctaaaaatcgtaactataaactaccgaaaaaaattcgtccgcatcttcaacccgtcgcaaaaaaacacgaccgacctaaacgacataatactaaaacaactaatacgcgacttcccgaaacgcctataccgcttcccgccgaacacgctactaaccccgcgacaccacgtcacgatacgccccgacccgaaaacccgaccccgacgacccgacccgaccgcccctcacccgccgctccacgcccctccaaatctaaaacgaaacgacccgcaacgccaaaaaaccgctacgcgcgtcctcgaaccgaaaacccgttcccctcctctccatccgcgactacgcgacgctactcctaaaccccaaaaacgaaatcgatacgaatccccgataaaacgaccgaaactaaaatataaaaataaccgacgcgccccgcaaatcctcaataaacaccgaatcccacgccgcgaaactccgaccccgaaaatcttcgccgacgacaccgacttatccatcgaccgcttcccgctccctaaaaccgaacccgacgccgacacccgcaaaccgccgcgcccacctcgacccctacgcaaaaaccgaatacgaaaaccccgaatcaatcgccgaaaaccaaaataaaaaccgcgaatccccgaaatctaacctccctccccaaaccccgacccaacaaaaacgatccctcgtatcccctcgctaaaacgaacccctacttccccaaaccccgccccgaccgccccctaatcctccaatacgccccgcgacccctaccccgccccaaacgcgaaaccctctaaaaccgcctttcccgaaccgaccgccgccctcacgaccctcgccccaccaaaacgcgaaacctactacccccaataaactcgaaaaaactcttccacgcgcgaaaaaaacctacgcgacccgaaaaccccgaaatccccgcgccgcaacacctacccgccatcccgaataaccccaccctaccgtcgcctcccgcaaaaaccgaactaaacctaaaaaactatcgactccaaaaaaaacaccgaattcgaa

SEQ ID NO: 26215 - DNA, 1232 bp, Artificial Sequence
  chemically treated genomic DNA (Homo sapiens) CpG-island No: 26215
ttttgtatagattcggattattggagttcggaatttttgtagaggtaaggggcgagtgatttaagttttcggcgtcggattggagttggttttcgggcggggcgcgtagttgtgcgggtggatcggtcgtatttttttatagcgttttttttttttttagttcgataggtttgaagatcgtggttgtgagttgtcgggagaagttcgttcgtatttttaattcgtcgtaggagagtacggtcgatttgagcggtatggtgttgaagtagttggtgcgcggtttttcggagcgtttgtatcgtttttcgtcgggtacgttgttggtttcgcggtattacgttacggtgcgtttcggttcgggagttcggtttcgacggttcggttcggtcgttttttattcgtcgttttacgtttttttaggtttggggcgaggcgattcgtagcgttaagaagtcgttgcgcgcgttttcgagtcgggagttcgttttttttttttttattcgcggttgcgcgacgttgtttttgagttttaagggcgaggtcggtgcgggttttcggtggggcggtcggggttggggtgtgggggtgatcgacgcgtttcgtaggtttttagtgagtatcggattttacgtcgcgagatttcggtttcgagggttttcgtcgacggtatcgatttgtttatcgatcgtttttcgttttttgaggtcgggttcggcgtcgatattcgtaagtcgtcgcgtttatttcgatttttgcgtaaaggtcgggtgcgggagtttcgggttagtcgtcggagattagggtggggatcgcgggttttcgggatttggtttttttttttaggtttcgatttagtagaaacggtttttcgtattttttcgttaggacggatttttatttttttaggtttcgtttcggtcgttttttggttttttagtacgtttcgcggtttttgtttcgttttaggcgcggagttttttagggtcgtttttttcgggtcggtcgtcgtttttacgattttcgttttattaggacgcggggtttgttgtttttagtgagttcggggaagtttttttacgcgcgggaggggtttgcgcggttcgagaatttcgagattttcgcgtcgtagtatttgttcgttatttcgggtgattttattttgtcgtcgtttttcgtagaggtcgggttgggtttggaggattgtcggttttagaaagaatatcgagttcggg

SEQ ID NO: 26216 - DNA, 1232 bp, Artificial Sequence
  chemically treated genomic DNA (Homo sapiens) CpG-island No: 26216
cccgaactcgatattctttctaaaaccgacaatcctccaaacccaacccgacctctacgaaaaacgacgacaaaataaaatcacccgaaataacgaacaaatactacgacgcgaaaatctcgaaattctcgaaccgcgcaaacccctcccgcgcgtaaaaaaacttccccgaactcactaaaaacaacaaaccccgcgtcctaataaaacgaaaatcgtaaaaacgacgaccgacccgaaaaaaacgaccctaaaaaactccgcgcctaaaacgaaacaaaaaccgcgaaacgtactaaaaaaccaaaaaacgaccgaaacgaaacctaaaaaaataaaaatccgtcctaacgaaaaaatacgaaaaaccgtttctactaaatcgaaacctaaaaaaaaaaaccaaatcccgaaaacccgcgatccccaccctaatctccgacgactaacccgaaactcccgcacccgacctttacgcaaaaatcgaaataaacgcgacgacttacgaatatcgacgccgaacccgacctcaaaaaacgaaaaacgatcgataaacaaatcgataccgtcgacgaaaaccctcgaaaccgaaatctcgcgacgtaaaatccgatactcactaaaaacctacgaaacgcgtcgatcacccccacaccccaaccccgaccgccccaccgaaaacccgcaccgacctcgcccttaaaactcaaaaacaacgtcgcgcaaccgcgaataaaaaaaaaaaaaacgaactcccgactcgaaaacgcgcgcaacgacttcttaacgctacgaatcgcctcgccccaaacctaaaaaaacgtaaaacgacgaataaaaaacgaccgaaccgaaccgtcgaaaccgaactcccgaaccgaaacgcaccgtaacgtaataccgcgaaaccaacaacgtacccgacgaaaaacgatacaaacgctccgaaaaaccgcgcaccaactacttcaacaccataccgctcaaatcgaccgtactctcctacgacgaattaaaaatacgaacgaacttctcccgacaactcacaaccacgatcttcaaacctatcgaactaaaaaaaaaaaaaacgctataaaaaaatacgaccgatccacccgcacaactacgcgccccgcccgaaaaccaactccaatccgacgccgaaaacttaaatcactcgccccttacctctacaaaaattccgaactccaataatccgaatctatacaaaa

SEQ ID NO: 26217 - DNA, 838 bp, Artificial Sequence
  chemically treated genomic DNA (Homo sapiens) CpG-island No: 26217
ggtgcggtttttttcgattttttatcgggacgtttttatttcgtggtagcgatagatcggttcgtaaggttttttagtttggttttaggatttatttatttcgtttttagggtaggtttcgcggcggttttcgcgttcgggtttttcgcggtaattagaagtagtttcgggtcgggagtttcgcgttggttaggtcgtttttgttattttcgcgtgatgcgtcggggggcgggaggagtttgcgggggcggggggcgcgttttaaggttttttttgtatatttggcgtaatggggagcgttcgtttttttttttcgggttttgtttttatagttgtgtttatttcgttcgtgatttcgcgagtgatttttgataggtgatgaattggcggcggcggtggcggcggcggcggcgcgcgggttagttcgcggcggggtcggagtcggagtttcggagtagattttttggcgttaggcgcgtgacgtcgtttatttacgtcgttttgtagttttgttttcgcggcgtcgtttaggcggttgttatggtaatcgcgtcgttatttagcgcgcgcgtttagttgattaatgtttgcgaggttcggtagttttaggttcgtttaggttcggtcgtcggttcgcgcgtatttgtagacgttgtacgttttaagtttcgagtgatttggggaaggaaagaggatcgagaagaaaagaaaagggttcgggggggggggggggtgggcgggtgaggggcggaggagaggacgaaggaaaaaagtcgggagagggagaagaaagaaattttttttttgtaaaaggaggtataatgtggtttagaggttg

SEQ ID NO: 26218 - DNA, 838 bp, Artificial Sequence
  chemically treated genomic DNA (Homo sapiens) CpG-island No: 26218
caacctctaaaccacattatacctccttttacaaaaaaaaaatttctttcttctccctctcccgacttttttccttcgtcctctcctccgcccctcacccgcccacccccccccccccccgaacccttttcttttcttctcgatcctctttccttccccaaatcactcgaaacttaaaacgtacaacgtctacaaatacgcgcgaaccgacgaccgaacctaaacgaacctaaaactaccgaacctcgcaaacattaatcaactaaacgcgcgcgctaaataacgacgcgattaccataacaaccgcctaaacgacgccgcgaaaacaaaactacaaaacgacgtaaataaacgacgtcacgcgcctaacgccaaaaaatctactccgaaactccgactccgaccccgccgcgaactaacccgcgcgccgccgccgccgccaccgccgccgccaattcatcacctatcaaaaatcactcgcgaaatcacgaacgaaataaacacaactataaaaacaaaacccgaaaaaaaaaaacgaacgctccccattacgccaaatatacaaaaaaaaccttaaaacgcgccccccgcccccgcaaactcctcccgccccccgacgcatcacgcgaaaataacaaaaacgacctaaccaacgcgaaactcccgacccgaaactacttctaattaccgcgaaaaacccgaacgcgaaaaccgccgcgaaacctaccctaaaaacgaaataaataaatcctaaaaccaaactaaaaaaccttacgaaccgatctatcgctaccacgaaataaaaacgtcccgataaaaaatcgaaaaaaaccgcacc

SEQ ID NO: 26219 - DNA, 838 bp, Artificial Sequence
  chemically treated genomic DNA (Homo sapiens) CpG-island No: 26219
taatttttaagttatattatgtttttttttgtaaaaggaagattttttttttttttttttttcggtttttttttttcgttttttttttcgttttttattcgtttattttttttttttttcgagtttttttttttttttttcggttttttttttttttttaaattattcgaaatttaagacgtgtagcgtttgtaggtgcgcgcgggtcggcggtcgggtttgggcgagtttgggattgtcgggtttcgtaggtattgattagttgggcgcgcgcgttgagtgacggcgcggttgttatggtagtcgtttgagcggcgtcgcgaggataaggttgtagggcggcgtgaatgggcggcgttacgcgtttggcgttagagagtttgtttcggggtttcggtttcggtttcgtcgcgggttggttcgcgcgtcgtcgtcgtcgttatcgtcgtcgttaatttattatttgttagggattattcgcggggttacgggcggaatggatatagttgtgagaataaaattcgggaaagaaaggcgaacgttttttattgcgttagatgtgtagggaggattttgagacgcgtttttcgttttcgtaggtttttttcgtttttcggcgtattacgcgggggtggtaaaggcggtttggttagcgcggagttttcggttcggagttgtttttgattatcgcgaggggttcggacgcgagagtcgtcgcggggtttgttttagaggcggagtgagtgagttttggagttaggttgggggattttacgggtcggtttgtcgttgttacggggtgggggcgtttcggtggggagtcgaggggaatcgtatt

SEQ ID NO: 26220 - DNA, 838 bp, Artificial Sequence
  chemically treated genomic DNA (Homo sapiens) CpG-island No: 26220
aatacgattcccctcgactccccaccgaaacgcccccaccccgtaacaacgacaaaccgacccgtaaaatcccccaacctaactccaaaactcactcactccgcctctaaaacaaaccccgcgacgactctcgcgtccgaacccctcgcgataatcaaaaacaactccgaaccgaaaactccgcgctaaccaaaccgcctttaccacccccgcgtaatacgccgaaaaacgaaaaaaacctacgaaaacgaaaaacgcgtctcaaaatcctccctacacatctaacgcaataaaaaacgttcgcctttctttcccgaattttattctcacaactatatccattccgcccgtaaccccgcgaataatccctaacaaataataaattaacgacgacgataacgacgacgacgacgcgcgaaccaacccgcgacgaaaccgaaaccgaaaccccgaaacaaactctctaacgccaaacgcgtaacgccgcccattcacgccgccctacaaccttatcctcgcgacgccgctcaaacgactaccataacaaccgcgccgtcactcaacgcgcgcgcccaactaatcaatacctacgaaacccgacaatcccaaactcgcccaaacccgaccgccgacccgcgcgcacctacaaacgctacacgtcttaaatttcgaataatttaaaaaaaaaaaaaaaaccgaaaaaaaaaaaaaaaaactcgaaaaaaaaaaaaaataaacgaataaaaaacgaaaaaaaaaacgaaaaaaaaaaaccgaaaaaaaaaaaaaaaaaaaatcttccttttacaaaaaaaaacataatataacttaaaaatta

SEQ ID NO: 26221 - DNA, 881 bp, Artificial Sequence
  chemically treated genomic DNA (Homo sapiens) CpG-island No: 26221
gtttttagtttcggggcgcgaggtgggttgggaggttttggaaggcgggttttaggtggacgcgaatcgggggaggaagggattcgggcggggtagtagtttatttggggcggaataggtgttcgggcggcgttatcgaggagttcgcgcgttttttcgttttgattttcgatcgtttttcgcgggcgttggcgttggaggagggcgggggtcgtggagtcgcggtcgttcggatcgttttgcggattcgcgtcggggattgggttttgtcggggttagcgcggggcggtcgtgtggttgattattatattcggaggaagttttgagggtcgtaggggcgtttttttcgtcgtaggttattcgcggatttggtttttaggttttcgttatttgtcgttagtcgcggtttcggtcgatttttgcgcggcggggagggaagcgcgttttggttttaattcgattttcgtttcgttttcgggagaggcgtagacgtcggtcgtacgttcgttttttagttacggggattcgcgcgtagttcgttcggacggttttggggagcgttttcggacggaagtagtgcgggcgggattgtgggggcggttcgggttttttcgagtttttgtcgggtatcgttggcgacgttggtttcgggatttttggagtcgtagtcgaggcgtagtagtttttttcggaggcgatttttcgcggcgttagtcgcgttgttcgatttcggtcgtggagttcgggcgttatttgttggtcgatacgaggacggcggttttcgcgcggggtttggtgggtttggggttcgggtattgggaattcgaggagtaattcgtggggtggaggaggtttcgggagaaaacgttagggagtgcggt

SEQ ID NO: 26222 - DNA, 881 bp, Artificial Sequence
  chemically treated genomic DNA (Homo sapiens) CpG-island No: 26222
accgcactccctaacgttttctcccgaaacctcctccaccccacgaattactcctcgaattcccaatacccgaaccccaaacccaccaaaccccgcgcgaaaaccgccgtcctcgtatcgaccaacaaataacgcccgaactccacgaccgaaatcgaacaacgcgactaacgccgcgaaaaatcgcctccgaaaaaaactactacgcctcgactacgactccaaaaatcccgaaaccaacgtcgccaacgatacccgacaaaaactcgaaaaaacccgaaccgcccccacaatcccgcccgcactacttccgtccgaaaacgctccccaaaaccgtccgaacgaactacgcgcgaatccccgtaactaaaaaacgaacgtacgaccgacgtctacgcctctcccgaaaacgaaacgaaaatcgaattaaaaccaaaacgcgcttccctccccgccgcgcaaaaatcgaccgaaaccgcgactaacgacaaataacgaaaacctaaaaaccaaatccgcgaataacctacgacgaaaaaaacgcccctacgaccctcaaaacttcctccgaatataataatcaaccacacgaccgccccgcgctaaccccgacaaaacccaatccccgacgcgaatccgcaaaacgatccgaacgaccgcgactccacgacccccgccctcctccaacgccaacgcccgcgaaaaacgatcgaaaatcaaaacgaaaaaacgcgcgaactcctcgataacgccgcccgaacacctattccgccccaaataaactactaccccgcccgaatcccttcctcccccgattcgcgtccacctaaaacccgccttccaaaacctcccaacccacctcgcgccccgaaactaaaaac

SEQ ID NO: 26223 - DNA, 881 bp, Artificial Sequence
  chemically treated genomic DNA (Homo sapiens) CpG-island No: 26223
gtcgtattttttggcgttttttttcgggattttttttattttacggattgtttttcgggtttttagtgttcgggttttaggtttattaggtttcgcgcgagagtcgtcgttttcgtgtcggttagtaggtggcgttcgggttttacggtcggagtcgggtagcgcggttggcgtcgcgggaagtcgttttcgagaggggttgttgcgtttcggttgcggttttaggggtttcggggttaacgtcgttagcggtgttcggtaggggttcgaaagggttcgggtcgtttttatagtttcgttcgtattgttttcgttcggggacgttttttagggtcgttcgagcggattacgcgcgggttttcgtggttggggggcgagcgtgcggtcggcgtttgcgtttttttcggaggcgaggcgggggtcgggttgggattagagcgcgttttttttttcgtcgcgtagaggtcggtcggggtcgcggttggcgataggtggcggggatttgggggttaggttcgcgggtagtttgcgacggggaagacgtttttacggtttttagggtttttttcgggtatgatgattaattatacgatcgtttcgcgttggtttcggtagagtttagttttcggcgcgggttcgtagggcgattcgggcggtcgcggttttacggttttcgtttttttttagcgttagcgttcgcggggagcgatcgggggttagggcggggagacgcgcggatttttcggtggcgtcgttcgaatatttgtttcgttttaggtgagttgttgtttcgttcggatttttttttttttcggttcgcgtttatttgggattcgttttttagagttttttagtttatttcgcgtttcgggattgaaaat

SEQ ID NO: 26224 - DNA, 881 bp, Artificial Sequence
  chemically treated genomic DNA (Homo sapiens) CpG-island No: 26224
attttcaatcccgaaacgcgaaataaactaaaaaactctaaaaaacgaatcccaaataaacgcgaaccgaaaaaaaaaaaaatccgaacgaaacaacaactcacctaaaacgaaacaaatattcgaacgacgccaccgaaaaatccgcgcgtctccccgccctaacccccgatcgctccccgcgaacgctaacgctaaaaaaaaacgaaaaccgtaaaaccgcgaccgcccgaatcgccctacgaacccgcgccgaaaactaaactctaccgaaaccaacgcgaaacgatcgtataattaatcatcatacccgaaaaaaaccctaaaaaccgtaaaaacgtcttccccgtcgcaaactacccgcgaacctaacccccaaatccccgccacctatcgccaaccgcgaccccgaccgacctctacgcgacgaaaaaaaaaacgcgctctaatcccaacccgacccccgcctcgcctccgaaaaaaacgcaaacgccgaccgcacgctcgccccccaaccacgaaaacccgcgcgtaatccgctcgaacgaccctaaaaaacgtccccgaacgaaaacaatacgaacgaaactataaaaacgacccgaaccctttcgaacccctaccgaacaccgctaacgacgttaaccccgaaacccctaaaaccgcaaccgaaacgcaacaacccctctcgaaaacgacttcccgcgacgccaaccgcgctacccgactccgaccgtaaaacccgaacgccacctactaaccgacacgaaaacgacgactctcgcgcgaaacctaataaacctaaaacccgaacactaaaaacccgaaaaacaatccgtaaaataaaaaaaatcccgaaaaaaaacgccaaaaaatacgac

SEQ ID NO: 26225 - DNA, 699 bp, Artificial Sequence
  chemically treated genomic DNA (Homo sapiens) CpG-island No: 26225
  misc_feature (618)..(618): n is either a, c, g or t
aaacgagtttagaatagcgaaatcgggttaaaaaatcgcgaattagcgaaattcggaaatagcggcgaaacgcgcgaaaagaaagagagaatcgttattcggggaaggtcgtaaaagaaaaaaacgggtcgaaaaggtcggaaagtcgtaaaaacgcgcgaatatcgcgagaaacgagtcgaaacggcgtaaagagagtttatatagcgaaacgagcgcgttaatagcgcgagaaacgtcgttataatcgtcgtaaaaatcggtagaataacggcgcgaaaagggggcgcgaataagcgtcgataaaggcggattaaatatcgtcgaataggtcgcgataaaaaacggaataaatgcgtttcgataaaagcgcgaataaaatagggcgaaagagcgcgtaataaatcgggtcgtataaaagtcgttagtaagagaaggtagtaatagacgtcgaataataagcgatcgtatagattcgcgggatgataagggttttaaataaacgcgcgcgagtaatagagcgggggtataataggaggggggaaaaaaacgagcgacgagaagagggaggtatatagaacgggcgcgttgaaaaagatcgggggtataatacgtcgnggaggaagaagacgttatataaaaagaacggtttacgatagggaatcgtcgtataataaatatagtatcgtaaagtacgga

SEQ ID NO: 26226 - DNA, 699 bp, Artificial Sequence
  chemically treated genomic DNA (Homo sapiens) CpG-island No: 26226
  misc_feature (82)..(82): n is either a, c, g or t
tccgtactttacgatactatatttattatacgacgattccctatcgtaaaccgttctttttatataacgtcttcttcctccncgacgtattatacccccgatctttttcaacgcgcccgttctatatacctccctcttctcgtcgctcgtttttttcccccctcctattatacccccgctctattactcgcgcgcgtttatttaaaacccttatcatcccgcgaatctatacgatcgcttattattcgacgtctattactaccttctcttactaacgacttttatacgacccgatttattacgcgctctttcgccctattttattcgcgcttttatcgaaacgcatttattccgttttttatcgcgacctattcgacgatatttaatccgcctttatcgacgcttattcgcgcccccttttcgcgccgttattctaccgatttttacgacgattataacgacgtttctcgcgctattaacgcgctcgtttcgctatataaactctctttacgccgtttcgactcgtttctcgcgatattcgcgcgtttttacgactttccgaccttttcgacccgtttttttcttttacgaccttccccgaataacgattctctctttcttttcgcgcgtttcgccgctatttccgaatttcgctaattcgcgattttttaacccgatttcgctattctaaactcgttt

SEQ ID NO: 26227 - DNA, 699 bp, Artificial Sequence
  chemically treated genomic DNA (Homo sapiens) CpG-island No: 26227
  misc_feature (82)..(82): n is either a, c, g or t
ttcgtgttttgcggtgttgtgtttgttgtgcggcggttttttatcgtgggtcgttttttttgtgtggcgttttttttttttncggcgtgttgtgttttcggttttttttagcgcgttcgttttgtgtgttttttttttttcgtcgttcgtttttttttttttttttgttgtgttttcgttttattattcgcgcgcgtttgtttggggtttttgttatttcgcgggtttgtgcggtcgtttattgttcggcgtttgttgttgtttttttttgttggcggtttttgtgcggttcggtttgttgcgcgttttttcgttttgttttgttcgcgtttttgtcggggcgtatttgtttcgttttttgtcgcggtttgttcggcggtgtttggttcgtttttgtcggcgtttgttcgcgtttttttttcgcgtcgttgttttgtcggtttttgcggcggttgtggcggcgtttttcgcgttgttggcgcgttcgtttcgttgtgtgggttttttttgcgtcgtttcggttcgtttttcgcggtgttcgcgcgtttttgcggtttttcggttttttcggttcgttttttttttttgcggtttttttcgggtggcggtttttttttttttttcgcgcgtttcgtcgttgttttcgggtttcgttggttcgcggttttttggttcggtttcgttgttttgggttcgttt

SEQ ID NO: 26228 - DNA, 699 bp, Artificial Sequence
  chemically treated genomic DNA (Homo sapiens) CpG-island No: 26228
  misc_feature (618)..(618): n is either a, c, g or t
aaacgaacccaaaacaacgaaaccgaaccaaaaaaccgcgaaccaacgaaacccgaaaacaacgacgaaacgcgcgaaaaaaaaaaaaaaaccgccacccgaaaaaaaccgcaaaaaaaaaaaacgaaccgaaaaaaccgaaaaaccgcaaaaacgcgcgaacaccgcgaaaaacgaaccgaaacgacgcaaaaaaaacccacacaacgaaacgaacgcgccaacaacgcgaaaaacgccgccacaaccgccgcaaaaaccgacaaaacaacgacgcgaaaaaaaaacgcgaacaaacgccgacaaaaacgaaccaaacaccgccgaacaaaccgcgacaaaaaacgaaacaaatacgccccgacaaaaacgcgaacaaaacaaaacgaaaaaacgcgcaacaaaccgaaccgcacaaaaaccgccaacaaaaaaaaacaacaacaaacgccgaacaataaacgaccgcacaaacccgcgaaataacaaaaaccccaaacaaacgcgcgcgaataataaaacgaaaacacaacaaaaaaaaaaaaaaaaacgaacgacgaaaaaaaaaaaacacacaaaacgaacgcgctaaaaaaaaccgaaaacacaacacgccgnaaaaaaaaaaaacgccacacaaaaaaaacgacccacgataaaaaaccgccgcacaacaaacacaacaccgcaaaacacgaa

SEQ ID NO: 26229 - DNA, 626 bp, Artificial Sequence
  chemically treated genomic DNA (Homo sapiens) CpG-island No: 26229
cgggaaggatggttgcggaatggcgaagttacgattaggatcgggtgaaggagtttggtttttcgggaaggtagcgggaatcgcgtaggttgcgggaatggcggagaaacgaggacgttttttaggaaatttatttttttgtttaggtagaagaatatcgtgggattttcgagagggttacggcggtcgttaaggttttcgataagtaacggttttacgtttttaatcgggagtattagtagtttcggaaagtttacgtcgttttggtaatcgttgttgttcggtcgtattcggggcgtcgcgggatattttcggtgacgttttcgtatcgggtatcggcgtagtgcgtttgtcggacgtcgatgggtttgtgggcgtagggcggaggcgtaggcggtacgtgggttagttttgttttttggcgtttgggtttttttgtttttcgtaagagtttgggtcgcgatttgttattgttagtcgtgcgttcgttttttgcgtttcgtttcgtggttattgtcgttttttttttcgttatatttgtgatgatcgttatggagtcgcgttttaggtggtattattataaatttaagaggagaggcgttcgttcgaataagggtaaattattt

SEQ ID NO: 26230 - DNA, 626 bp, Artificial Sequence
  chemically treated genomic DNA (Homo sapiens) CpG-island No: 26230
aaataatttacccttattcgaacgaacgcctctcctcttaaatttataataataccacctaaaacgcgactccataacgatcatcacaaatataacgaaaaaaaaaacgacaataaccacgaaacgaaacgcaaaaaacgaacgcacgactaacaataacaaatcgcgacccaaactcttacgaaaaacaaaaaaacccaaacgccaaaaaacaaaactaacccacgtaccgcctacgcctccgccctacgcccacaaacccatcgacgtccgacaaacgcactacgccgatacccgatacgaaaacgtcaccgaaaatatcccgcgacgccccgaatacgaccgaacaacaacgattaccaaaacgacgtaaactttccgaaactactaatactcccgattaaaaacgtaaaaccgttacttatcgaaaaccttaacgaccgccgtaaccctctcgaaaatcccacgatattcttctacctaaacaaaaaaataaatttcctaaaaaacgtcctcgtttctccgccattcccgcaacctacgcgattcccgctaccttcccgaaaaaccaaactccttcacccgatcctaatcgtaacttcgccattccgcaaccatccttcccg

SEQ ID NO: 26231 - DNA, 626 bp, Artificial Sequence
  chemically treated genomic DNA (Homo sapiens) CpG-island No: 26231
aaataatttgtttttattcgaacgggcgtttttttttttaggtttatagtaatgttatttgaggcgcggttttatagcgattattataggtgtggcgggagggagggcggtagtgattacgagacggggcgtagagggcgagcgtacggttggtagtgataggtcgcgatttaggtttttgcggagagtagaaaggtttagacgttagggaataggattagtttacgtatcgtttgcgttttcgttttgcgtttataaatttatcgacgttcggtaggcgtattacgtcggtgttcggtgcgagggcgttatcggaagtgtttcgcggcgtttcggatgcgatcgggtaatagcggttgttagggcgacgtgagtttttcggagttgttggtattttcgattggagacgtagaatcgttatttgtcgagggttttagcggtcgtcgtgattttttcggggattttacgatgtttttttatttgagtaagaaagtgagttttttggggggcgttttcgttttttcgttattttcgtagtttgcgcgattttcgttgttttttcgagaagttaggtttttttattcggttttggtcgtggtttcgttatttcgtagttatttttttcg

SEQ ID NO: 26232 - DNA, 626 bp, Artificial Sequence
  chemically treated genomic DNA (Homo sapiens) CpG-island No: 26232
cgaaaaaaataactacgaaataacgaaaccacgaccaaaaccgaataaaaaaacctaacttctcgaaaaaacaacgaaaatcgcgcaaactacgaaaataacgaaaaaacgaaaacgccccccaaaaaactcactttcttactcaaataaaaaaacatcgtaaaatccccgaaaaaatcacgacgaccgctaaaaccctcgacaaataacgattctacgtctccaatcgaaaataccaacaactccgaaaaactcacgtcgccctaacaaccgctattacccgatcgcatccgaaacgccgcgaaacacttccgataacgccctcgcaccgaacaccgacgtaatacgcctaccgaacgtcgataaatttataaacgcaaaacgaaaacgcaaacgatacgtaaactaatcctattccctaacgtctaaacctttctactctccgcaaaaacctaaatcgcgacctatcactaccaaccgtacgctcgccctctacgccccgtctcgtaatcactaccgccctccctcccgccacacctataataatcgctataaaaccgcgcctcaaataacattactataaacctaaaaaaaaaaacgcccgttcgaataaaaacaaattattt

SEQ ID NO: 26233 - DNA, 598 bp, Artificial Sequence
  chemically treated genomic DNA (Homo sapiens) CpG-island No: 26233
gcgcgtttggtggatgttttgggttttttttcgttcgatgtttacgcgtttttttcgtcgttcgtttgtatttgtatcgcgggcgcggttaggttcgttggtttcggaagcgggcgcgtcgtcgggagtcgtaggagaggggcggcgtttagggttgttttcgggatttcgggtttttagttttcggaagttcgggcgggttacggggtcgggggcggcggagggtagtagtagtagcggttagagtagtaggaggagtttcgggaggcggcgcgcgggggtcgggtcggtatggtgggtttcgtgggtttggtggtgttcgtcgggggttaggagttacgcgaggttcggatttaaaggtttcgcggtttcgggttcgttcgtttcggcgtttcgagcgttaggtcggttcgcgatatttcgtttaaggttaataaggagttttgttcgcgtattttagcggtagaaacggaatgtttgggcgaggcggttagcggcgcggttggttatttttcgtttttgttttaagtttcgagtcggttgtaattgggtgggttcggttgttgtcgtaattttcgtttttttagtaatatcgggg

SEQ ID NO: 26234 - DNA, 598 bp, Artificial Sequence
  chemically treated genomic DNA (Homo sapiens) CpG-island No: 26234
ccccgatattactaaaaaaacgaaaattacgacaacaaccgaacccacccaattacaaccgactcgaaacttaaaacaaaaacgaaaaataaccaaccgcgccgctaaccgcctcgcccaaacattccgtttctaccgctaaaatacgcgaacaaaactccttattaaccttaaacgaaatatcgcgaaccgacctaacgctcgaaacgccgaaacgaacgaacccgaaaccgcgaaacctttaaatccgaacctcgcgtaactcctaacccccgacgaacaccaccaaacccacgaaacccaccataccgacccgacccccgcgcgccgcctcccgaaactcctcctactactctaaccgctactactactaccctccgccgcccccgaccccgtaacccgcccgaacttccgaaaactaaaaacccgaaatcccgaaaacaaccctaaacgccgcccctctcctacgactcccgacgacgcgcccgcttccgaaaccaacgaacctaaccgcgcccgcgatacaaatacaaacgaacgacgaaaaaaacgcgtaaacatcgaacgaaaaaaaacccaaaacatccaccaaacgcgc

SEQ ID NO: 26235 - DNA, 598 bp, Artificial Sequence
  chemically treated genomic DNA (Homo sapiens) CpG-island No: 26235
tttcggtgttattgggaggacggaggttgcgatagtagtcgagtttatttagttgtagtcggttcggggtttagggtaggggcgggaggtgattaatcgcgtcgttggtcgtttcgtttagatatttcgtttttgtcgttggaatgcgcggataaggttttttgttggttttgggcggggtatcgcgggtcggtttggcgttcgaagcgtcggggcgggcgggttcgaggtcgcgggatttttaaattcgagtttcgcgtggtttttggttttcgacggatattattaggtttacggagtttattatgtcggttcggttttcgcgcgtcgtttttcgggattttttttgttgttttggtcgttgttgttgttgtttttcgtcgttttcgatttcgtggttcgttcgggttttcggaggttggagattcgaggtttcgggggtagttttggacgtcgttttttttttgcggttttcgacggcgcgttcgttttcgggattagcgagtttggtcgcgttcgcggtgtaggtataggcgggcggcgggagggacgcgtgagtatcgaacgaggagaagtttagggtatttattaagcgcgt

SEQ ID NO: 26236 - DNA, 598 bp, Artificial Sequence
  chemically treated genomic DNA (Homo sapiens) CpG-island No: 26236
acgcgcttaataaataccctaaacttctcctcgttcgatactcacgcgtccctcccgccgcccgcctatacctacaccgcgaacgcgaccaaactcgctaatcccgaaaacgaacgcgccgtcgaaaaccgcaaaaaaaaaacgacgtccaaaactacccccgaaacctcgaatctccaacctccgaaaacccgaacgaaccacgaaatcgaaaacgacgaaaaacaacaacaacaacgaccaaaacaacaaaaaaaatcccgaaaaacgacgcgcgaaaaccgaaccgacataataaactccgtaaacctaataatatccgtcgaaaaccaaaaaccacgcgaaactcgaatttaaaaatcccgcgacctcgaacccgcccgccccgacgcttcgaacgccaaaccgacccgcgataccccgcccaaaaccaacaaaaaaccttatccgcgcattccaacgacaaaaacgaaatatctaaacgaaacgaccaacgacgcgattaatcacctcccgcccctaccctaaaccccgaaccgactacaactaaataaactcgactactatcgcaacctccgtcctcccaataacaccgaaa

SEQ ID NO: 26237 - DNA, 622 bp, Artificial Sequence
  chemically treated genomic DNA (Homo sapiens) CpG-island No: 26237
agtgcgtaggcgcgaagaagttggtaggggtacgagtcgggggcgggtttgaagacgcgtcgttgggttttggaggtcgtgaaatagtcgtttgagtttggttgcgggtggagaacgtttgttaggggttcggttaagaaggaggttcgtttgttacgatggtgtttatgagttttaagcggaatcgtagtgatcggttttatagtattcggtgttgcggttgttgttatgttcgtatcgggacgattattttggggatttggtatatggtaaggcgggtaggcgtggcgcgtatgttcggggggtttggggagcggggtttggtgcggagggggtgagattggaaacggggtgttgggtggggcggggatttggagggcgttgttttttaaggcgcgttaattttggatgaagtttaaggattttgggaaagtaattttgtttaggaatcggagtcgggggagcggggggcggtggtaagtatggggagattgttttttggtaagaatttgaggagagaagcgggtttgggagagtagaggttttgtaggcgaagggacgagggtggtaggatttggtgggaatttttttgttttggtttttgttgtatttttacgatttg

SEQ ID NO: 26238 - DNA, 622 bp, Artificial Sequence
  chemically treated genomic DNA (Homo sapiens) CpG-island No: 26238
caaatcgtaaaaatacaacaaaaaccaaaacaaaaaaattcccaccaaatcctaccaccctcgtcccttcgcctacaaaacctctactctcccaaacccgcttctctcctcaaattcttaccaaaaaacaatctccccatacttaccaccgccccccgctcccccgactccgattcctaaacaaaattactttcccaaaatccttaaacttcatccaaaattaacgcgccttaaaaaacaacgccctccaaatccccgccccacccaacaccccgtttccaatctcaccccctccgcaccaaaccccgctccccaaaccccccgaacatacgcgccacgcctacccgccttaccatataccaaatccccaaaataatcgtcccgatacgaacataacaacaaccgcaacaccgaatactataaaaccgatcactacgattccgcttaaaactcataaacaccatcgtaacaaacgaacctccttcttaaccgaacccctaacaaacgttctccacccgcaaccaaactcaaacgactatttcacgacctccaaaacccaacgacgcgtcttcaaacccgcccccgactcgtacccctaccaacttcttcgcgcctacgcact

SEQ ID NO: 26239 - DNA, 622 bp, Artificial Sequence
  chemically treated genomic DNA (Homo sapiens) CpG-island No: 26239
tagatcgtagaaatataataagaattaaaatagaggaatttttattaaattttattattttcgttttttcgtttgtaaagtttttgtttttttaagttcgtttttttttttaaatttttgttaaagaataatttttttatgtttattatcgtttttcgttttttcgatttcgatttttgaataaggttatttttttaaagtttttggattttatttagagttggcgcgttttaaaaagtagcgttttttaagttttcgttttatttaatatttcgtttttagttttatttttttcgtattaggtttcgttttttaggtttttcggatatacgcgttacgtttgttcgttttattatgtattaggtttttaggatgatcgtttcggtgcggatatggtaatagtcgtagtatcgggtgttgtagaatcggttattgcggtttcgtttgaaatttatggatattatcgtaataggcgggttttttttttggtcgggtttttgataaacgttttttattcgtagttaaatttaaacggttgttttacggtttttaaaatttaacgacgcgtttttaaattcgttttcggttcgtgtttttgttagttttttcgcgtttgcgtatt

SEQ ID NO: 26240 - DNA, 622 bp, Artificial Sequence
  chemically treated genomic DNA (Homo sapiens) CpG-island No: 26240
aatacgcaaacgcgaaaaaactaacaaaaacacgaaccgaaaacgaatttaaaaacgcgtcgttaaattttaaaaaccgtaaaacaaccgtttaaatttaactacgaataaaaaacgtttatcaaaaacccgaccaaaaaaaaaacccgcctattacgataatatccataaatttcaaacgaaaccgcaataaccgattctacaacacccgatactacgactattaccatatccgcaccgaaacgatcatcctaaaaacctaatacataataaaacgaacaaacgtaacgcgtatatccgaaaaacctaaaaaacgaaacctaatacgaaaaaaataaaactaaaaacgaaatattaaataaaacgaaaacttaaaaaacgctactttttaaaacgcgccaactctaaataaaatccaaaaactttaaaaaaataaccttattcaaaaatcgaaatcgaaaaaacgaaaaacgataataaacataaaaaaattattctttaacaaaaatttaaaaaaaaaaacgaacttaaaaaaacaaaaactttacaaacgaaaaaacgaaaataataaaatttaataaaaattcctctattttaattcttattatatttctacgatcta

SEQ ID NO: 26241 - DNA, 634 bp, Artificial Sequence
  chemically treated genomic DNA (Homo sapiens) CpG-island No: 26241
ggggacggcggttttttagttaggcgattttaggtttcgcgatttttcgtcgtttaattttttttttttatttttatttatttttttttagcggtttttaggacgggtttaaaaattaattttatacgtaatttagtttatttcgcggagttgagaagtagggttgggtttcgagcgggcgtcggcgtttttggcgtgtggcggggaggtggcggtcgcggggggcgtcgcgagtcgttcgtgttcgtcgcggatgaataggcggttgcgagtagttttcggagtcgcgtagtattcgcgtatttagtgacggtggaagttacgttcgttcgagagtcggggggttgttttcgttttttttattttttttttttttatcgattttttttcggtcgcgttttttttttttttttcgcgtcggttttcggttcgttttcggttcggttcgcgggaggcgttgggcgtcggggttggcgcgttttttcgggtttatatatagtcgcgtacgtacgttcggggtcgtttttcgcgtcggtttttgtttttcgcgtttatgcggacggatcgagcgacggaagatggttgacgattttacggggtttcgaggatgcggttcggcggcggcggcggcggg

SEQ ID NO: 26242 - DNA, 634 bp, Artificial Sequence
  chemically treated genomic DNA (Homo sapiens) CpG-island No: 26242
cccgccgccgccgccgccgaaccgcatcctcgaaaccccgtaaaatcgtcaaccatcttccgtcgctcgatccgtccgcataaacgcgaaaaacaaaaaccgacgcgaaaaacgaccccgaacgtacgtacgcgactatatataaacccgaaaaaacgcgccaaccccgacgcccaacgcctcccgcgaaccgaaccgaaaacgaaccgaaaaccgacgcgaaaaaaaaaaaaaaaacgcgaccgaaaaaaaatcgataaaaaaaaaaaaaataaaaaaaacgaaaacaaccccccgactctcgaacgaacgtaacttccaccgtcactaaatacgcgaatactacgcgactccgaaaactactcgcaaccgcctattcatccgcgacgaacacgaacgactcgcgacgccccccgcgaccgccacctccccgccacacgccaaaaacgccgacgcccgctcgaaacccaaccctacttctcaactccgcgaaataaactaaattacgtataaaattaatttttaaacccgtcctaaaaaccgctaaaaaaaaataaataaaaataaaaaaaaaaaattaaacgacgaaaaatcgcgaaacctaaaatcgcctaactaaaaaaccgccgtcccc

SEQ ID NO: 26243 - DNA, 634 bp, Artificial Sequence
  chemically treated genomic DNA (Homo sapiens) CpG-island No: 26243
ttcgtcgtcgtcgtcgtcgggtcgtattttcggggtttcgtggagtcgttagttatttttcgtcgttcggttcgttcgtatgggcgcggggagtaagggtcggcgcggagagcggtttcgggcgtgcgtgcgcggttgtgtgtgagttcgggagagcgcgttagtttcggcgtttagcgtttttcgcgagtcgagtcgggggcgggtcgggggtcggcgcgggaggaggggagggagcgcggtcgggagggggtcggtagggaggggaaaggtggggggggcgaggatagtttttcggttttcgagcgggcgtggtttttatcgttattggatacgcggatgttgcgcggtttcgggggttgttcgtagtcgtttgtttattcgcggcgggtacgggcggttcgcggcgtttttcgcggtcgttattttttcgttatacgttaggggcgtcggcgttcgttcggaatttagttttgttttttagtttcgcgaggtgggttgggttgcgtgtggagttggtttttgagttcgttttaggagtcgttgaggaaaaatgaatgggggtgaaaggagaaggttgggcggcgggaggtcgcgagatttgaggtcgtttggttagagggtcgtcgttttt

SEQ ID NO: 26244 - DNA, 634 bp, Artificial Sequence
  chemically treated genomic DNA (Homo sapiens) CpG-island No: 26244
aaaaacgacgaccctctaaccaaacgacctcaaatctcgcgacctcccgccgcccaaccttctcctttcacccccattcatttttcctcaacgactcctaaaacgaactcaaaaaccaactccacacgcaacccaacccacctcgcgaaactaaaaaacaaaactaaattccgaacgaacgccgacgcccctaacgtataacgaaaaaataacgaccgcgaaaaacgccgcgaaccgcccgtacccgccgcgaataaacaaacgactacgaacaacccccgaaaccgcgcaacatccgcgtatccaataacgataaaaaccacgcccgctcgaaaaccgaaaaactatcctcgccccccccacctttcccctccctaccgaccccctcccgaccgcgctccctcccctcctcccgcgccgacccccgacccgcccccgactcgactcgcgaaaaacgctaaacgccgaaactaacgcgctctcccgaactcacacacaaccgcgcacgcacgcccgaaaccgctctccgcgccgacccttactccccgcgcccatacgaacgaaccgaacgacgaaaaataactaacgactccacgaaaccccgaaaatacgacccgacgacgacgacgacgaa

SEQ ID NO: 26245 - DNA, 732 bp, Artificial Sequence
  chemically treated genomic DNA (Homo sapiens) CpG-island No: 26245
aggatacggattttatcgttttttttattttttaaaacgttttcggggtttttaggatatcgttttttgtaatttcgtgtagggcgtttttattttagtttaacgcgcggtttcgttttatcgcgggtattttttagtttcggagttttatttcggagttatttcggagttatttcgcgcgttttcgcgtcgcgacgtacgtgtttttcgtttttatttatttcgtttattgttgttattggagtcgtgatttttgagtttcgtcgggcgcgcgttttttaattttatttgcgcgcggatttcggtagcggcgttcggttttaacggtttcgtacggtcgggggagtcgggttcggggtttcgcgtcgtcggtttttaggagtagtcgcgtcgttatcgttattagcgcgaggttatggtcggagtttgaaagtcgcggtagggcggcggtttcgtttttggttcgcgatttttttttcgggattcggagtcggaaatttggtataggaagcgtttcggttaggttcgggagcgcggttcgttttttttcgtttgcggttcggttgtcggcgcggatatttcgggtgtttgttcgtttgtagttaacggggattgtagtcgttttcgggaggcgacggggtaggggcgtgcggagatttggtttggggatttcgagcgtgatttttttcggggcgagttttttatttttattttttttcggaagttgtgtag

SEQ ID NO: 26246 - DNA, 732 bp, Artificial Sequence
  chemically treated genomic DNA (Homo sapiens) CpG-island No: 26246
ctacacaacttccgaaaaaaaataaaaataaaaaactcgccccgaaaaaaatcacgctcgaaatccccaaaccaaatctccgcacgcccctaccccgtcgcctcccgaaaacgactacaatccccgttaactacaaacgaacaaacacccgaaatatccgcgccgacaaccgaaccgcaaacgaaaaaaaacgaaccgcgctcccgaacctaaccgaaacgcttcctataccaaatttccgactccgaatcccgaaaaaaaaatcgcgaaccaaaaacgaaaccgccgccctaccgcgactttcaaactccgaccataacctcgcgctaataacgataacgacgcgactactcctaaaaaccgacgacgcgaaaccccgaacccgactcccccgaccgtacgaaaccgttaaaaccgaacgccgctaccgaaatccgcgcgcaaataaaattaaaaaacgcgcgcccgacgaaactcaaaaatcacgactccaataacaacaataaacgaaataaataaaaacgaaaaacacgtacgtcgcgacgcgaaaacgcgcgaaataactccgaaataactccgaaataaaactccgaaactaaaaaatacccgcgataaaacgaaaccgcgcgttaaactaaaataaaaacgccctacacgaaattacaaaaaacgatatcctaaaaaccccgaaaacgttttaaaaaataaaaaaaacgataaaatccgtatcct

SEQ ID NO: 26247 - DNA, 732 bp, Artificial Sequence
  chemically treated genomic DNA (Homo sapiens) CpG-island No: 26247
ttgtatagttttcgggaagaggtggggataggaggttcgtttcggggaaggttacgttcggggtttttagattaggttttcgtacgtttttgtttcgtcgtttttcgggagcggttgtagttttcgttggttgtagacgggtagatattcgaagtgttcgcgtcggtagtcggatcgtaagcgaggaagagcgaatcgcgttttcgggtttggtcgaagcgttttttgtgttaggttttcggtttcgggtttcgggaggaggatcgcgggttagaggcggagtcgtcgttttgtcgcgatttttagatttcgattatggtttcgcgttggtggcggtggcggcgcggttgtttttggaagtcggcggcgcggagtttcgggttcggttttttcggtcgtgcgggatcgttggggtcgagcgtcgttgtcgaagttcgcgcgtaggtgaggttgggaggcgcgcgttcggcggggtttagaggttacggttttaatgatagtagtgggcggaatgaatgggagcggggagtacgtgcgtcgcgacgcgggggcgcgcggggtagtttcggggtagtttcggggtgggatttcggagttgaggggtgttcgcggtgggacggagtcgcgcgttggattgaagtaggggcgttttatacggggttgtagaaagcggtgttttggggatttcgggagcgttttggggggtggagaaagcggtgggattcgtgtttt

SEQ ID NO: 26248 - DNA, 732 bp, Artificial Sequence
  chemically treated genomic DNA (Homo sapiens) CpG-island No: 26248
aaaacacgaatcccaccgctttctccaccccccaaaacgctcccgaaatccccaaaacaccgctttctacaaccccgtataaaacgcccctacttcaatccaacgcgcgactccgtcccaccgcgaacacccctcaactccgaaatcccaccccgaaactaccccgaaactaccccgcgcgcccccgcgtcgcgacgcacgtactccccgctcccattcattccgcccactactatcattaaaaccgtaacctctaaaccccgccgaacgcgcgcctcccaacctcacctacgcgcgaacttcgacaacgacgctcgaccccaacgatcccgcacgaccgaaaaaaccgaacccgaaactccgcgccgccgacttccaaaaacaaccgcgccgccaccgccaccaacgcgaaaccataatcgaaatctaaaaatcgcgacaaaacgacgactccgcctctaacccgcgatcctcctcccgaaacccgaaaccgaaaacctaacacaaaaaacgcttcgaccaaacccgaaaacgcgattcgctcttcctcgcttacgatccgactaccgacgcgaacacttcgaatatctacccgtctacaaccaacgaaaactacaaccgctcccgaaaaacgacgaaacaaaaacgtacgaaaacctaatctaaaaaccccgaacgtaaccttccccgaaacgaacctcctatccccacctcttcccgaaaactatacaa

SEQ ID NO: 26249 - DNA, 607 bp, Artificial Sequence
  chemically treated genomic DNA (Homo sapiens) CpG-island No: 26249
aagcggtttcggagtgattaattcggggataatttattttttttcgtttttcggcgcgaatttcgcgaagcgggattggagcgagttattttcgagagcgtagcgcgttttttttcggtcgggcggatatttggtttattttagtcgtagaagtttagggttttcgcgtatcgggatttttttcgagtagaaaaaagttttagagtttttttgatttttttttttttcggcggcgagcggagtttttttttcggcgttgtcggtcgcgttatgtcgcgttcgcggggacgggagttggggcgttgcggttgtttcgcggggagggttcgcggcgaaatcgggatttcggcgtttgtgtcgggcgtcgggagtcgttggggtcgttcgtcgtcgttaacgtcgtcgtttttgttgttgttgttgggttgtgggttgtttagcgtttcggtcgtcgcgggtgagtttagtcgcgtcgaggagttagcggtcgtcgcgcgttttattcgagtttcgagtttatttattttcgattcggttttagttttttttttcgtttttatttttgtttgaattttttatttttttagttgtttatttttatttttat

SEQ ID NO: 26250 - DNA, 607 bp, Artificial Sequence
  chemically treated genomic DNA (Homo sapiens) CpG-island No: 26250
ataaaaataaaaataaacaactaaaaaaataaaaaattcaaacaaaaataaaaacgaaaaaaaaaactaaaaccgaatcgaaaataaataaactcgaaactcgaataaaacgcgcgacgaccgctaactcctcgacgcgactaaactcacccgcgacgaccgaaacgctaaacaacccacaacccaacaacaacaacaaaaacgacgacgttaacgacgacgaacgaccccaacgactcccgacgcccgacacaaacgccgaaatcccgatttcgccgcgaaccctccccgcgaaacaaccgcaacgccccaactcccgtccccgcgaacgcgacataacgcgaccgacaacgccgaaaaaaaaactccgctcgccgccgaaaaaaaaaaaaatcaaaaaaactctaaaacttttttctactcgaaaaaaatcccgatacgcgaaaaccctaaacttctacgactaaaataaaccaaatatccgcccgaccgaaaaaaaacgcgctacgctctcgaaaataactcgctccaatcccgcttcgcgaaattcgcgccgaaaaacgaaaaaaaataaattatccccgaattaatcactccgaaaccgctt

SEQ ID NO: 26251 - DNA, 607 bp, Artificial Sequence
  chemically treated genomic DNA (Homo sapiens) CpG-island No: 26251
atgagaatgagagtaggtaattgggagggtgggagatttaggtagggatagaggcggggggagggattgggatcgggtcgaggatgggtgggttcggggttcgggtggggcgcgcggcggtcgttggtttttcggcgcggttggatttattcgcggcggtcgagacgttgagtaatttatagtttagtaatagtagtagaggcggcggcgttggcggcggcgggcggttttagcggttttcggcgttcggtataagcgtcgaaatttcggtttcgtcgcgagtttttttcgcggggtagtcgtagcgttttagttttcgttttcgcgagcgcggtatggcgcggtcggtagcgtcgagggagaggtttcgttcgtcgtcgaggagaaaggaggttaggagagttttggagtttttttttgttcggaaaaaatttcggtacgcgggagttttgagtttttgcggttggaatgaattaagtgttcgttcggtcggggagaggcgcgttgcgttttcggaaatgattcgttttaatttcgtttcgcggggttcgcgtcggggggcgggagggggtgaattattttcggattaattatttcggagtcgttt

SEQ ID NO: 26252 - DNA, 607 bp, Artificial Sequence
  chemically treated genomic DNA (Homo sapiens) CpG-island No: 26252
aaacgactccgaaataattaatccgaaaataattcaccccctcccgccccccgacgcgaaccccgcgaaacgaaattaaaacgaatcatttccgaaaacgcaacgcgcctctccccgaccgaacgaacacttaattcattccaaccgcaaaaactcaaaactcccgcgtaccgaaattttttccgaacaaaaaaaaactccaaaactctcctaacctcctttctcctcgacgacgaacgaaacctctccctcgacgctaccgaccgcgccataccgcgctcgcgaaaacgaaaactaaaacgctacgactaccccgcgaaaaaaactcgcgacgaaaccgaaatttcgacgcttataccgaacgccgaaaaccgctaaaaccgcccgccgccgccaacgccgccgcctctactactattactaaactataaattactcaacgtctcgaccgccgcgaataaatccaaccgcgccgaaaaaccaacgaccgccgcgcgccccacccgaaccccgaacccacccatcctcgacccgatcccaatccctccccccgcctctatccctacctaaatctcccaccctcccaattacctactctcattctcat

SEQ ID NO: 26253 - DNA, 608 bp, Artificial Sequence
  chemically treated genomic DNA (Homo sapiens) CpG-island No: 26253
ggtgaagagtaggcgggcggggtgcggaggggtgaggtcggcgagggtcgtgcgcgcgtcgtcgtcgggggggaggggagaggagggtatttaggttttttttttttttttttttttttcgcgcgttatgtaatttcgtttcgtcggcggtgagtttaagattttcgcgcgtatcgagtcgagtcggcggttgaggagagttaggttcgatgtggcgggggttacgcgtcgcggtcgagtcgtgaggaagcggttcgcgtttacgcgttttttagtatttcgagcggttgttttatatcgtttagtttaggtttgtcggggtatgagtgtgttcgggacgtttggagcgatggagtcggttggggaggaagagcggtcgttatcggcggtcgaaggagaggacgacgaggaggaggtggtagcggcggtttagattttagggtcggtttacggaaggagtgttttttcgttggaggacgcggacgattaggaggaagagatggaggcgatggtgatcggaggcggttgttgtaaggagtaggagttgatttacgagttatagtagggttatcgtattttgggcgagtttttgtaggagaagtatcggg

SEQ ID NO: 26254 - DNA, 608 bp, Artificial Sequence
  chemically treated genomic DNA (Homo sapiens) CpG-island No: 26254
cccgatacttctcctacaaaaactcgcccaaaatacgataaccctactataactcgtaaatcaactcctactccttacaacaaccgcctccgatcaccatcgcctccatctcttcctcctaatcgtccgcgtcctccaacgaaaaaacactccttccgtaaaccgaccctaaaatctaaaccgccgctaccacctcctcctcgtcgtcctctccttcgaccgccgataacgaccgctcttcctccccaaccgactccatcgctccaaacgtcccgaacacactcataccccgacaaacctaaactaaacgatataaaacaaccgctcgaaatactaaaaaacgcgtaaacgcgaaccgcttcctcacgactcgaccgcgacgcgtaacccccgccacatcgaacctaactctcctcaaccgccgactcgactcgatacgcgcgaaaatcttaaactcaccgccgacgaaacgaaattacataacgcgcgaaaaaaaaaaaaaaaaaaaaaaaacctaaataccctcctctcccctcccccccgacgacgacgcgcgcacgaccctcgccgacctcacccctccgcaccccgcccgcctactcttcacc

SEQ ID NO: 26255 - DNA, 608 bp, Artificial Sequence
  chemically treated genomic DNA (Homo sapiens) CpG-island No: 26255
ttcggtgttttttttgtaggaattcgtttaggatgcggtagttttgttgtagttcgtaggttagtttttgttttttgtagtaatcgttttcgattattatcgtttttattttttttttttgatcgttcgcgttttttagcgaggaggtatttttttcgtgggtcggttttgaggtttgggtcgtcgttgttatttttttttcgtcgttttttttttcggtcgtcggtggcggtcgttttttttttttagtcggttttatcgttttaggcgtttcgggtatatttatgtttcggtaggtttaggttgggcggtgtggaatagtcgttcgaggtgttgggggacgcgtgagcgcgagtcgtttttttacggttcggtcgcggcgcgtagttttcgttatatcgggtttggttttttttagtcgtcggttcggttcggtgcgcgcgggggttttgagtttatcgtcggcggggcggggttatatggcgcgcgaggaggggggagagaagaggagagtttaggtgttttttttttttttttttttcggcggcggcgcgcgtacggttttcgtcggttttattttttcgtatttcgttcgtttgttttttatt

SEQ ID NO: 26256 - DNA, 608 bp, Artificial Sequence
  chemically treated genomic DNA (Homo sapiens) CpG-island No: 26256
aataaaaaacaaacgaacgaaatacgaaaaaataaaaccgacgaaaaccgtacgcgcgccgccgccgaaaaaaaaaaaaaaaaaaaacacctaaactctcctcttctctcccccctcctcgcgcgccatataaccccgccccgccgacgataaactcaaaacccccgcgcgcaccgaaccgaaccgacgactaaaaaaaaccaaacccgatataacgaaaactacgcgccgcgaccgaaccgtaaaaaaacgactcgcgctcacgcgtcccccaacacctcgaacgactattccacaccgcccaacctaaacctaccgaaacataaatatacccgaaacgcctaaaacgataaaaccgactaaaaaaaaaaaacgaccgccaccgacgaccgaaaaaaaaaacgacgaaaaaaaaataacaacgacgacccaaacctcaaaaccgacccacgaaaaaaatacctcctcgctaaaaaacgcgaacgatcaaaaaaaaaaaataaaaacgataataatcgaaaacgattactacaaaaaacaaaaactaacctacgaactacaacaaaactaccgcatcctaaacgaattcctacaaaaaaaacaccgaa

SEQ ID NO: 26257 - DNA, 551 bp, Artificial Sequence
  chemically treated genomic DNA (Homo sapiens) CpG-island No: 26257
gaggcggcgggcgtcgcgcgtggttcgcgggcgggcggattcggggagggcgttagcgattgcgcgggcggtgggtgtggcgtttcggtttttagttgttaggcgcgtttgtttcgttattcgggttgtgatcgcgtcgttttcgtcgtcgcgttatgcgttttaggtttcggttttttttttcggttagttttcggtttcggggttaacggtttagggttcgtattttcgcgttcggggtttcggcgtttcgtgttcgttgagagcgggaggggtcgcgggtgggagcgcggagaattagggagtacggttgtgcgcgcgcgcggggaggggtcgcgtcgttattcggagagttcggcggatttcggattttcgttcgtcgtttttttcgtcgcgtattttcgtttatcgttcgttcggttttagtcgtcgtcgtattgtgagtatttacgttcggtagttcgtcgttttcgcgttttgtttttgtagtttttttttcgtttagttttgatttgggtttttgtggttgttgtttttatgattatatttaa

SEQ ID NO: 26258 - DNA, 551 bp, Artificial Sequence
  chemically treated genomic DNA (Homo sapiens) CpG-island No: 26258
ttaaatataatcataaaaacaacaaccacaaaaacccaaatcaaaactaaacgaaaaaaaaactacaaaaacaaaacgcgaaaacgacgaactaccgaacgtaaatactcacaatacgacgacgactaaaaccgaacgaacgataaacgaaaatacgcgacgaaaaaaacgacgaacgaaaatccgaaatccgccgaactctccgaataacgacgcgacccctccccgcgcgcgcgcacaaccgtactccctaattctccgcgctcccacccgcgacccctcccgctctcaacgaacacgaaacgccgaaaccccgaacgcgaaaatacgaaccctaaaccgttaaccccgaaaccgaaaactaaccgaaaaaaaaaaccgaaacctaaaacgcataacgcgacgacgaaaacgacgcgatcacaacccgaataacgaaacaaacgcgcctaacaactaaaaaccgaaacgccacacccaccgcccgcgcaatcgctaacgccctccccgaatccgcccgcccgcgaaccacgcgcgacgcccgccgcctc

SEQ ID NO: 26259 - DNA, 551 bp, Artificial Sequence
  chemically treated genomic DNA (Homo sapiens) CpG-island No: 26259
ttaggtataattataaaaataatagttataggagtttaaattagaattaaacgaaaaaaaagttgtaggagtagagcgcgggggcggcgggttatcggacgtgggtatttatagtgcggcggcggttggagtcgggcgagcggtgagcggaggtgcgcggcgggaggagcggcgggcgggagttcgggattcgtcgggtttttcgggtgacggcgcggttttttttcgcgcgcgcgtatagtcgtgttttttggtttttcgcgtttttattcgcggtttttttcgtttttagcgggtacggggcgtcggggtttcgggcgcggagatgcgaattttgagtcgttgatttcgaggtcggggattggtcggaagaagaggtcgaagtttggagcgtatggcgcggcggcggggacggcgcggttatagttcgagtggcggggtaggcgcgtttgatagttgagagtcggggcgttatatttatcgttcgcgtagtcgttagcgtttttttcgggttcgttcgttcgcgggttacgcgcggcgttcgtcgtttt

SEQ ID NO: 26260 - DNA, 551 bp, Artificial Sequence
  chemically treated genomic DNA (Homo sapiens) CpG-island No: 26260
aaaacgacgaacgccgcgcgtaacccgcgaacgaacgaacccgaaaaaaacgctaacgactacgcgaacgataaatataacgccccgactctcaactatcaaacgcgcctaccccgccactcgaactataaccgcgccgtccccgccgccgcgccatacgctccaaacttcgacctcttcttccgaccaatccccgacctcgaaatcaacgactcaaaattcgcatctccgcgcccgaaaccccgacgccccgtacccgctaaaaacgaaaaaaaccgcgaataaaaacgcgaaaaaccaaaaaacacgactatacgcgcgcgcgaaaaaaaaccgcgccgtcacccgaaaaacccgacgaatcccgaactcccgcccgccgctcctcccgccgcgcacctccgctcaccgctcgcccgactccaaccgccgccgcactataaatacccacgtccgataacccgccgcccccgcgctctactcctacaacttttttttcgtttaattctaatttaaactcctataactattatttttataattatacctaa

SEQ ID NO: 26261 - DNA, 1003 bp, Artificial Sequence
  chemically treated genomic DNA (Homo sapiens) CpG-island No: 26261
tcgcgcgtttaattcggagcgttttgttgggcgggttcgagtttcggcggcggcgttgaaaatggtttatttgttttttgttttttttatttcgtaggagcggcggtatggaggtttttattatttagttggggtcggggcgcgagggtagtttttcgtttaattttaagtaggagttgtagtcgtattcgggttttagcgtttttaaatttaattaggtgggcgagacgtcgttgtacggggtgtttattgtgtcgttggttatcgacggttaggagcgtttatgtttggcgtagatttttaatattttttttaagaattatagttataatgagatttataatcgtcgcgtggttttgggtattacgtgcgtgtagtgtacgtcggtatagttggagattttgcgtcgggtcggggttatgtttatttcgtcgcgtcgttgcggtatgattattaagcgagaggtcgaacgtttgtgtaagtcgtttttgggcgagtataaattatttaagttgttcgagaatttcgttttcgatgtggtgtacgagtgcgcgtggggttcgcgtggtagttttatttttgcgcgttataatagttttcgtgttaagtgtattaagtgcggttattgtagtatgtatttttcgtttaataagtttattttttattcgtatcgaatattcgacgttaagtatacgtagttcgatgtcgttaattttaatttttggcgtcgttattttaaatttagtgataagtcggttatagacgaattgagttatgtttgggaggacgttaaggttatgtttaatggcggtacgcgtaagcggattttttttttataaggaggcggcggaggcggtgttaatggcgggtcgggtgggtaggggaagggtggtgttggcggcggtggcggcggtggtttagggtgcggtgtagagatggttttaggttcgtcgttttataaaagtttgcgttgtggcgaagatgaggttgtcgggttttcggg

SEQ ID NO: 26262 - DNA, 1003 bp, Artificial Sequence
  chemically treated genomic DNA (Homo sapiens) CpG-island No: 26262
cccgaaaacccgacaacctcatcttcgccacaacgcaaacttttataaaacgacgaacctaaaaccatctctacaccgcaccctaaaccaccgccgccaccgccgccaacaccacccttcccctacccacccgacccgccattaacaccgcctccgccgcctccttataaaaaaaaaatccgcttacgcgtaccgccattaaacataaccttaacgtcctcccaaacataactcaattcgtctataaccgacttatcactaaatttaaaataacgacgccaaaaattaaaattaacgacatcgaactacgtatacttaacgtcgaatattcgatacgaataaaaaataaacttattaaacgaaaaatacatactacaataaccgcacttaatacacttaacacgaaaactattataacgcgcaaaaataaaactaccacgcgaaccccacgcgcactcgtacaccacatcgaaaacgaaattctcgaacaacttaaataatttatactcgcccaaaaacgacttacacaaacgttcgacctctcgcttaataatcataccgcaacgacgcgacgaaataaacataaccccgacccgacgcaaaatctccaactataccgacgtacactacacgcacgtaatacccaaaaccacgcgacgattataaatctcattataactataattcttaaaaaaaatattaaaaatctacgccaaacataaacgctcctaaccgtcgataaccaacgacacaataaacaccccgtacaacgacgtctcgcccacctaattaaatttaaaaacgctaaaacccgaatacgactacaactcctacttaaaattaaacgaaaaactaccctcgcgccccgaccccaactaaataataaaaacctccataccgccgctcctacgaaataaaaaaaacaaaaaacaaataaaccattttcaacgccgccgccgaaactcgaacccgcccaacaaaacgctccgaattaaacgcgcga

SEQ ID NO: 26263 - DNA, 1003 bp, Artificial Sequence
  chemically treated genomic DNA (Homo sapiens) CpG-island No: 26263
ttcggaggttcggtagttttattttcgttatagcgtaggtttttgtggggcggcgggtttggggttatttttgtatcgtattttgggttatcgtcgttatcgtcgttagtattattttttttttgtttattcgattcgttattggtatcgttttcgtcgtttttttgtagggagaaggttcgtttgcgcgtgtcgttattaaatatggttttgacgtttttttaagtatggtttagttcgtttgtggtcgatttgttattgagtttgaggtgacgacgttaggagttgaagttggcggtatcgggttgcgtgtatttggcgtcgggtgttcggtgcgagtggaagatgaatttgttgggcgagaagtatatgttgtagtagtcgtatttgatgtatttggtacgagagttgttgtaacgcgtagggatgaagttattacgcgagttttacgcgtattcgtgtattatatcgaaggcgaagttttcgggtagtttgggtggtttgtgttcgtttaggaacgatttgtataggcgttcggtttttcgtttagtgattatgtcgtagcggcgcgacgagatgggtatggtttcggttcgacgtagaatttttagttgtatcggcgtgtattgtacgtacgtgatgtttagggttacgcggcggttgtggattttattatagttgtagtttttgaggagggtgttggagatttgcgttaggtataggcgtttttggtcgtcgatgattagcgatataatgggtatttcgtatagcgacgtttcgtttatttggttgggtttgagagcgttggagttcgagtacggttgtagtttttgtttggagttgggcgaggaattgttttcgcgtttcggttttagttgagtggtgagagtttttatgtcgtcgtttttgcgaaatagagaaagtagagagtagatgagttatttttagcgtcgtcgtcgaggttcgggttcgtttagtagggcgtttcgagttgggcgcgcgg

SEQ ID NO: 26264 - DNA, 1003 bp, Artificial Sequence
  chemically treated genomic DNA (Homo sapiens) CpG-island No: 26264
ccgcgcgcccaactcgaaacgccctactaaacgaacccgaacctcgacgacgacgctaaaaataactcatctactctctactttctctatttcgcaaaaacgacgacataaaaactctcaccactcaactaaaaccgaaacgcgaaaacaattcctcgcccaactccaaacaaaaactacaaccgtactcgaactccaacgctctcaaacccaaccaaataaacgaaacgtcgctatacgaaatacccattatatcgctaatcatcgacgaccaaaaacgcctatacctaacgcaaatctccaacaccctcctcaaaaactacaactataataaaatccacaaccgccgcgtaaccctaaacatcacgtacgtacaatacacgccgatacaactaaaaattctacgtcgaaccgaaaccatacccatctcgtcgcgccgctacgacataatcactaaacgaaaaaccgaacgcctatacaaatcgttcctaaacgaacacaaaccacccaaactacccgaaaacttcgccttcgatataatacacgaatacgcgtaaaactcgcgtaataacttcatccctacgcgttacaacaactctcgtaccaaatacatcaaatacgactactacaacatatacttctcgcccaacaaattcatcttccactcgcaccgaacacccgacgccaaatacacgcaacccgataccgccaacttcaactcctaacgtcgtcacctcaaactcaataacaaatcgaccacaaacgaactaaaccatacttaaaaaaacgtcaaaaccatatttaataacgacacgcgcaaacgaaccttctccctacaaaaaaacgacgaaaacgataccaataacgaatcgaataaacaaaaaaaaaataatactaacgacgataacgacgataacccaaaatacgatacaaaaataaccccaaacccgccgccccacaaaaacctacgctataacgaaaataaaactaccgaacctccgaa

SEQ ID NO: 26265 - DNA, 1158 bp, Artificial Sequence
  chemically treated genomic DNA (Homo sapiens) CpG-island No: 26265
cgtagcggtagtggttgtagcggtcgtcgtcgttattgtgtattcgacgttttttatgttttggttagtagtaggtagtttttcggtatcgttttatttcgttgtttagagttaagttaaggtcgtggcggtagtcgtggcggcggtagcggcggcggtagcggtagttgttggtagcggtgttttagagtttttggacggtgtcgagttagttaaagagagtggtttcggcgcggaggagcgttgttcgagcgttttgtttcgcgggtttttggacgaagacggtacggacgaggcgttgttatcgtttttggtttcgttgttttcgtcgttttcgtcgttcgtacgtaaaggtttttacgtgtcggtttttcggtcggtggttaaggatatcgagagtatcgttaagttttacgggagcgttcgggaggcgtacggcgcggggtttgttcgggggtcgggattcggcgttgggagcggcggttacgtgagttcggattttttgagcgagggtagttttagttataatttcgtttcgttcgacgtggatatcgcggacgagttcgaggtggacgtggaatttaatcgttttttcgacgacgaggacgtttaagaggagatcgagtttagcgtatttagcgtagggggcggtttagacggtgaatagtttattggattttttttcgttattttttttggcgcggacggtttcgtaaattttttcgacggcggtagttttcgttttcggcgtcgtttcgggttatttttagttggtcggttcgtatttggggatttggtagtcgaagatttggtgcggagatttgagaggagttcgttaagcggcggcggcggttacgagttgcgagagttttgcgggtttttaggaggtttcgcgtcggttaaggtgagtttcgcgttcgtttcgttagtggcgtttttttatttattttgtgcgcggtagggttgcggggtcgggcggagaacgggaattttgtttcgcgtaggcgtgggagtagtaggtttcggttatttttcgtaggtttagttttgggcgcgttgcgaaatcgggtttattcgtattttttagtgagggtttcgaagggaagggaagttgggggcggcgggaggattggggaatttgtgtgttttgtttttgtt

SEQ ID NO: 26266 - DNA, 1158 bp, Artificial Sequence
  chemically treated genomic DNA (Homo sapiens) CpG-island No: 26266
aacaaaaacaaaacacacaaattccccaatcctcccgccgcccccaacttcccttcccttcgaaaccctcactaaaaaatacgaataaacccgatttcgcaacgcgcccaaaactaaacctacgaaaaataaccgaaacctactactcccacgcctacgcgaaacaaaattcccgttctccgcccgaccccgcaaccctaccgcgcacaaaataaataaaaaaacgccactaacgaaacgaacgcgaaactcaccttaaccgacgcgaaacctcctaaaaacccgcaaaactctcgcaactcgtaaccgccgccgccgcttaacgaactcctctcaaatctccgcaccaaatcttcgactaccaaatccccaaatacgaaccgaccaactaaaaataacccgaaacgacgccgaaaacgaaaactaccgccgtcgaaaaaatttacgaaaccgtccgcgccaaaaaaaataacgaaaaaaaatccaataaactattcaccgtctaaaccgccccctacgctaaatacgctaaactcgatctcctcttaaacgtcctcgtcgtcgaaaaaacgattaaattccacgtccacctcgaactcgtccgcgatatccacgtcgaacgaaacgaaattataactaaaactaccctcgctcaaaaaatccgaactcacgtaaccgccgctcccaacgccgaatcccgacccccgaacaaaccccgcgccgtacgcctcccgaacgctcccgtaaaacttaacgatactctcgatatccttaaccaccgaccgaaaaaccgacacgtaaaaacctttacgtacgaacgacgaaaacgacgaaaacaacgaaaccaaaaacgataacaacgcctcgtccgtaccgtcttcgtccaaaaacccgcgaaacaaaacgctcgaacaacgctcctccgcgccgaaaccactctctttaactaactcgacaccgtccaaaaactctaaaacaccgctaccaacaactaccgctaccgccgccgctaccgccgccacgactaccgccacgaccttaacttaactctaaacaacgaaataaaacgataccgaaaaactacctactactaaccaaaacataaaaaacgtcgaatacacaataacgacgacgaccgctacaaccactaccgctacg

SEQ ID NO: 26267 - DNA, 1158 bp, Artificial Sequence
  chemically treated genomic DNA (Homo sapiens) CpG-island No: 26267
aataaaaataaagtatataagttttttagttttttcgtcgtttttagtttttttttttttcgaaatttttattggagggtgcgggtgggttcggtttcgtagcgcgtttaaggttgggtttgcggagagtggtcgaggtttgttgtttttacgtttgcgcggaataaaattttcgtttttcgttcggtttcgtagttttgtcgcgtatagggtaggtgggaaggcgttattggcggggcgggcgcggggtttattttggtcggcgcggggttttttaggggttcgtaaggttttcgtagttcgtagtcgtcgtcgtcgtttggcgggttttttttaggttttcgtattaagttttcggttgttaagtttttaaatgcgggtcggttagttgggggtggttcgaggcggcgtcgggggcgggggttgtcgtcgtcgggagagtttgcgggatcgttcgcgttagaggaggtggcggaagggggtttagtgggttgtttatcgtttgggtcgttttttgcgttgggtgcgttgggttcggtttttttttgggcgttttcgtcgtcggggaagcggttggattttacgtttatttcgggttcgttcgcggtgtttacgtcgggcgaggcggaattgtagttggagttgttttcgtttagaaagttcgggtttacgtagtcgtcgtttttagcgtcgggtttcggttttcgagtaggtttcgcgtcgtacgtttttcgggcgttttcgtagagtttagcgatgttttcggtgtttttgattatcggtcggaaggtcgatacgtaggagtttttgcgtgcgggcggcgggggcggcgggggtaacggggttaggggcggtggtagcgtttcgttcgtgtcgttttcgtttaggggttcgcgggatagagcgttcgggtagcgttttttcgcgtcgaggttattttttttggttggttcggtatcgtttaggggttttggggtatcgttgttagtagttgtcgttgtcgtcgtcgttgtcgtcgttacggttgtcgttacggttttggtttggttttgagtagcggggtaggacggtatcgggaggttgtttgttgttggttagaatatgggaaacgtcgggtatatagtggcggcggcggtcgttgtagttattgtcgttgcg

SEQ ID NO: 26268 - DNA, 1158 bp, Artificial Sequence
  chemically treated genomic DNA (Homo sapiens) CpG-island No: 26268
cgcaacgacaataactacaacgaccgccgccgccactatatacccgacgtttcccatattctaaccaacaacaaacaacctcccgataccgtcctaccccgctactcaaaaccaaaccaaaaccgtaacgacaaccgtaacgacgacaacgacgacgacaacgacaactactaacaacgataccccaaaacccctaaacgataccgaaccaaccaaaaaaaataacctcgacgcgaaaaaacgctacccgaacgctctatcccgcgaacccctaaacgaaaacgacacgaacgaaacgctaccaccgcccctaaccccgttacccccgccgcccccgccgcccgcacgcaaaaactcctacgtatcgaccttccgaccgataatcaaaaacaccgaaaacatcgctaaactctacgaaaacgcccgaaaaacgtacgacgcgaaacctactcgaaaaccgaaacccgacgctaaaaacgacgactacgtaaacccgaactttctaaacgaaaacaactccaactacaattccgcctcgcccgacgtaaacaccgcgaacgaacccgaaataaacgtaaaatccaaccgcttccccgacgacgaaaacgcccaaaaaaaaaccgaacccaacgcacccaacgcaaaaaacgacccaaacgataaacaacccactaaacccccttccgccacctcctctaacgcgaacgatcccgcaaactctcccgacgacgacaacccccgcccccgacgccgcctcgaaccacccccaactaaccgacccgcatttaaaaacttaacaaccgaaaacttaatacgaaaacctaaaaaaaacccgccaaacgacgacgacgactacgaactacgaaaaccttacgaacccctaaaaaaccccgcgccgaccaaaataaaccccgcgcccgccccgccaataacgccttcccacctaccctatacgcgacaaaactacgaaaccgaacgaaaaacgaaaattttattccgcgcaaacgtaaaaacaacaaacctcgaccactctccgcaaacccaaccttaaacgcgctacgaaaccgaacccacccgcaccctccaataaaaatttcgaaaaaaaaaaaaactaaaaacgacgaaaaaactaaaaaacttatatactttatttttatt

SEQ ID NO: 26269 - DNA, 503 bp, Artificial Sequence
  chemically treated genomic DNA (Homo sapiens) CpG-island No: 26269
gcgggagggaaaatgtttaaaaggaggcgggtgtagagggtggaggatattttgaacgtttttcggtttgggagtcgttttgtgtttagagtaattttttcgagggcgttaataattattttgaatttataagggggtaagggtgcgtcgcgtgcgttattgtgttcgtttaagtttagcgggcgtattaatttttgttatttcgtcggtttttttttttggtcgcggggtagggttgggcgtttttgggtcgtcgtagggcgtttttttaatcgtttgttatttttcggtcgtcgtaggtgttcgcgttcgagagggatgagtacgtgaagagcgcggcggtggcgttggggttcgcggttttttacgtttgtattttcgaggtttacggtaacgtttgtcgcggtcgttggttattgtaatgggggaatcgtagatagagggtcggggttaaggaaggtttgcgaaggaagataaggagagagacgtagagaaagagggag

SEQ ID NO: 26270 - DNA, 503 bp, Artificial Sequence
  chemically treated genomic DNA (Homo sapiens) CpG-island No: 26270
ctccctctttctctacgtctctctccttatcttccttcgcaaaccttccttaaccccgaccctctatctacgattcccccattacaataaccaacgaccgcgacaaacgttaccgtaaacctcgaaaatacaaacgtaaaaaaccgcgaaccccaacgccaccgccgcgctcttcacgtactcatccctctcgaacgcgaacacctacgacgaccgaaaaataacaaacgattaaaaaaacgccctacgacgacccaaaaacgcccaaccctaccccgcgaccaaaaaaaaaaaccgacgaaataacaaaaattaatacgcccgctaaacttaaacgaacacaataacgcacgcgacgcacccttacccccttataaattcaaaataattattaacgccctcgaaaaaattactctaaacacaaaacgactcccaaaccgaaaaacgttcaaaatatcctccaccctctacacccgcctccttttaaacattttccctcccgc

SEQ ID NO: 26271 - DNA, 503 bp, Artificial Sequence
  chemically treated genomic DNA (Homo sapiens) CpG-island No: 26271
ttttttttttttttgcgtttttttttttgttttttttcgtaggttttttttgatttcggttttttgtttgcggtttttttattatagtggttagcggtcgcgataggcgttatcgtgggtttcgggggtgtagacgtaggaggtcgcgggttttagcgttatcgtcgcgttttttacgtgtttatttttttcgggcgcgaatatttgcgacggtcgagaaatgataggcgattaggggggcgttttgcggcggtttaaagacgtttagttttatttcgcggttaagagggaaagtcgacggagtggtaaaggttggtgcgttcgttggatttgagcgggtatagtgacgtacgcggcgtatttttgtttttttgtagatttagggtaattgttagcgttttcgggaaaattattttaaatataaagcggtttttaagtcgaggggcgtttaaagtgttttttattttttgtattcgtttttttttaggtattttttttttcgt

SEQ ID NO: 26272 - DNA, 503 bp, Artificial Sequence
  chemically treated genomic DNA (Homo sapiens) CpG-island No: 26272
acgaaaaaaaaaatacctaaaaaaaaacgaatacaaaaaataaaaaacactttaaacgcccctcgacttaaaaaccgctttatatttaaaataattttcccgaaaacgctaacaattaccctaaatctacaaaaaaacaaaaatacgccgcgtacgtcactatacccgctcaaatccaacgaacgcaccaacctttaccactccgtcgactttccctcttaaccgcgaaataaaactaaacgtctttaaaccgccgcaaaacgcccccctaatcgcctatcatttctcgaccgtcgcaaatattcgcgcccgaaaaaaataaacacgtaaaaaacgcgacgataacgctaaaacccgcgacctcctacgtctacacccccgaaacccacgataacgcctatcgcgaccgctaaccactataataaaaaaaccgcaaacaaaaaaccgaaatcaaaaaaaacctacgaaaaaaaacaaaaaaaaaaacgcaaaaaaaaaaaaaa

SEQ ID NO: 26273 - DNA, 826 bp, Artificial Sequence
  chemically treated genomic DNA (Homo sapiens) CpG-island No: 26273
attatcgttagtaggtatttatttacgttcgcgttatgattttcgtttggttttgatttacgttttcggtagagatttttttttggtcgattttgatttacgatttcgttgggattttttttagttttaatttacgtttttttatttcgggttgacgttgtttttagcgtttcggagataatatttcgcggtcgtattcgcgttgtcgattcggggttttattttcggttaggattcgtcgtattcgtagtcgtagttcgtttagttttatcgtttgttttacgaagttattttggtcgcggtcggaagtatcgtttagggagtttggattcgttaagaagtcgagcgtcgattgtagtagcgatatggcggtggttgcgtcgtatttcgcggtagtcggagtggtcgggttcgggttttcgttttttcgtcgttcgggttagtttagtaatcgtcggttcggaggtgtattatttttcgtttcgacgtcgtgacgtaggcgttcgtgaggacgcgtcgcgttaggcggcgattcggtttagtttcgtttttttcgtcgcggttttattttttggttgcgcgcgtaggcgcggaggtttgacggagatagcgcgtgcgcggcgtcgtcgggtttgcgatgaattttcggttgttaagttttcggtcgggttgatttaagcggaggcgcgcggaatagtcgtcgaggcgattttcgtttaggtagtttagcgttttagtttagttttcggtatcgttttttatatggtttgttttgtgggaggtttttttttaggtgttttcggtttaagcgtttcgttattttttg

SEQ ID NO: 26274 - DNA, 826 bp, Artificial Sequence
  chemically treated genomic DNA (Homo sapiens) CpG-island No: 26274
caaaaaataacgaaacgcttaaaccgaaaacacctaaaaaaaaacctcccacaaaacaaaccatataaaaaacgataccgaaaactaaactaaaacgctaaactacctaaacgaaaatcgcctcgacgactattccgcgcgcctccgcttaaatcaacccgaccgaaaacttaacaaccgaaaattcatcgcaaacccgacgacgccgcgcacgcgctatctccgtcaaacctccgcgcctacgcgcgcaaccaaaaaataaaaccgcgacgaaaaaaacgaaactaaaccgaatcgccgcctaacgcgacgcgtcctcacgaacgcctacgtcacgacgtcgaaacgaaaaataatacacctccgaaccgacgattactaaactaacccgaacgacgaaaaaacgaaaacccgaacccgaccactccgactaccgcgaaatacgacgcaaccaccgccatatcgctactacaatcgacgctcgacttcttaacgaatccaaactccctaaacgatacttccgaccgcgaccaaaataacttcgtaaaacaaacgataaaactaaacgaactacgactacgaatacgacgaatcctaaccgaaaataaaaccccgaatcgacaacgcgaatacgaccgcgaaatattatctccgaaacgctaaaaacaacgtcaacccgaaataaaaaaacgtaaattaaaactaaaaaaaatcccaacgaaatcgtaaatcaaaatcgaccaaaaaaaaatctctaccgaaaacgtaaatcaaaaccaaacgaaaatcataacgcgaacgtaaataaatacctactaacgataat

SEQ ID NO: 26275 - DNA, 826 bp, Artificial Sequence
  chemically treated genomic DNA (Homo sapiens) CpG-island No: 26275
tagaggatggcgaagcgtttaaatcggagatatttgagaaggagttttttataaaatagattatgtggggaacggtatcgggagttggattggggcgttgaattatttgggcgggaatcgtttcggcgattgtttcgcgcgttttcgtttgagttagttcggtcgggagtttgatagtcggaagtttatcgtaagttcggcgacgtcgcgtacgcgttgttttcgttagattttcgcgtttgcgcgcgtagttaggaagtgaggtcgcggcggaggggacggggttaggtcgggtcgtcgtttgacgcgacgcgtttttacgggcgtttacgttacggcgtcgaggcggaagatggtgtattttcgggtcggcggttgttgagttgattcggacggcgagggagcgggagttcgagttcgattatttcggttgtcgcggggtgcggcgtagttatcgttatgtcgttgttgtagtcggcgttcgattttttggcgggtttaggttttttgggcggtgttttcggtcgcgattagagtgatttcgtggggtagacggtggaattgggcgagttgcggttgcgggtgcggcgggttttggtcgaaggtgaggtttcgggtcggtagcgcgggtgcggtcgcggagtgttgttttcgggacgttgggggtagcgttagttcggagtggaagggcgtgggttagggttggggagggttttagcgggatcgtgggttagggtcggttaggggagggtttttgtcgagggcgtgggttagggttaggcgaaggttatagcgcgggcgtaggtgagtgtttgttggcggtgat

SEQ ID NO: 26276 - DNA, 826 bp, Artificial Sequence
  chemically treated genomic DNA (Homo sapiens) CpG-island No: 26276
atcaccgccaacaaacactcacctacgcccgcgctataaccttcgcctaaccctaacccacgccctcgacaaaaaccctcccctaaccgaccctaacccacgatcccgctaaaaccctccccaaccctaacccacgcccttccactccgaactaacgctacccccaacgtcccgaaaacaacactccgcgaccgcacccgcgctaccgacccgaaacctcaccttcgaccaaaacccgccgcacccgcaaccgcaactcgcccaattccaccgtctaccccacgaaatcactctaatcgcgaccgaaaacaccgcccaaaaaacctaaacccgccaaaaaatcgaacgccgactacaacaacgacataacgataactacgccgcaccccgcgacaaccgaaataatcgaactcgaactcccgctccctcgccgtccgaatcaactcaacaaccgccgacccgaaaatacaccatcttccgcctcgacgccgtaacgtaaacgcccgtaaaaacgcgtcgcgtcaaacgacgacccgacctaaccccgtcccctccgccgcgacctcacttcctaactacgcgcgcaaacgcgaaaatctaacgaaaacaacgcgtacgcgacgtcgccgaacttacgataaacttccgactatcaaactcccgaccgaactaactcaaacgaaaacgcgcgaaacaatcgccgaaacgattcccgcccaaataattcaacgccccaatccaactcccgataccgttccccacataatctattttataaaaaactccttctcaaatatctccgatttaaacgcttcgccatcctcta

SEQ ID NO: 26277 - DNA, 849 bp, Artificial Sequence
  chemically treated genomic DNA (Homo sapiens) CpG-island No: 26277
tcgttttgattttcgtttttttcgtagtacggtattaagaagaaggaggagcgcgaggtcgaggtttaggtcgttatggaggttaatttcgaggggagtttgacgcggtttaagaaggttatttcgtcgggttgcggggacgaggtggaggaggaggacgagagtattttggatatcgttattaagtatttgttcgggtcgttgtaggatatgtttaagaagtagtcgcgcgcgggatagcggtttcgcggagttttcgtttttttttttatagatttttcgcggaggtttttgagggacgagtagagcgtagtttttacgtcgatataagttatagttttaggttcgttttgttcgcgttcgtcgttttttttattcggtaaggggcgcgcgtttttaggatttttttagttcgtttcgtgtttttttgttcgcgggtggttggagttttatcgtttgggacgttttttttttttgttgtttatcgtttatttagtagcgttcgaggttagggtcgtcgaagggtagtttcgcgattatttttgtgcgcgcgttcgcggcggtgggcgtttgtcgggttcgtatttaggagtatagttatagtagacggggggttgcgggcggggcgagggcggcggggtttgggttttttttttgtacgcggatttcggggttcggatcgtttcgtcgtgagtatttgcgttcgtacgcggtcgtttttcgtttttcggtttggttttttcgcgtttttgtttattcgtttttgttcgcgttttttttttttttttttggaaggttttgttttttacgaacgttacggtcgtgtttatttttaaattaaaggaaata

SEQ ID NO: 26278 - DNA, 849 bp, Artificial Sequence
  chemically treated genomic DNA (Homo sapiens) CpG-island No: 26278
tatttcctttaatttaaaaataaacacgaccgtaacgttcgtaaaaaacaaaaccttccaaaaaaaaaaaaaaaaaacgcgaacaaaaacgaataaacaaaaacgcgaaaaaaccaaaccgaaaaacgaaaaacgaccgcgtacgaacgcaaatactcacgacgaaacgatccgaaccccgaaatccgcgtacaaaaaaaaaacccaaaccccgccgccctcgccccgcccgcaaccccccgtctactataactatactcctaaatacgaacccgacaaacgcccaccgccgcgaacgcgcgcacaaaaataatcgcgaaactacccttcgacgaccctaacctcgaacgctactaaataaacgataaacaacaaaaaaaaaaaacgtcccaaacgataaaactccaaccacccgcgaacaaaaaaacacgaaacgaactaaaaaaatcctaaaaacgcgcgccccttaccgaataaaaaaaacgacgaacgcgaacaaaacgaacctaaaactataacttatatcgacgtaaaaactacgctctactcgtccctcaaaaacctccgcgaaaaatctataaaaaaaaaaacgaaaactccgcgaaaccgctatcccgcgcgcgactacttcttaaacatatcctacaacgacccgaacaaatacttaataacgatatccaaaatactctcgtcctcctcctccacctcgtccccgcaacccgacgaaataaccttcttaaaccgcgtcaaactcccctcgaaattaacctccataacgacctaaacctcgacctcgcgctcctccttcttcttaataccgtactacgaaaaaaacgaaaatcaaaacga

SEQ ID NO: 26279 - DNA, 849 bp, Artificial Sequence
  chemically treated genomic DNA (Homo sapiens) CpG-island No: 26279
tgttttttttagtttagaagtgaatacggtcgtggcgttcgtaagaagtaaaattttttagagaggagaggaaaggacgcggatagagacggatggataggggcgcgagggggttaggtcggggggcggagagcggtcgcgtgcggacgtaaatatttacggcggagcgattcgaatttcggagttcgcgtgtaggagggggatttaggtttcgtcgttttcgtttcgttcgtagtttttcgtttgttatggttgtgtttttgagtgcgggttcgataggcgtttatcgtcgcgaacgcgcgtataggggtggtcgcggggttgtttttcggcggttttggtttcgggcgttgttgggtgggcggtaaatagtaagagaaaggggcgttttaggcgatggggttttagttattcgcgggtagaggagtacggggcggattgggggggttttgggggcgcgcgttttttgtcgggtgagggaggcggcgggcgcgggtagggcgggtttggggttatggtttatatcggcgtgggggttgcgttttgttcgttttttaggggttttcgcggaggatttgtagggggaggggcgggggtttcgcggggtcgttgtttcgcgcgcggttattttttgagtatgttttgtagcggttcgggtaggtatttgatgacggtgtttaggatgttttcgttttttttttttatttcgttttcgtagttcggcgggatggtttttttgggtcgcgttaagtttttttcggagttggtttttatggcggtttgggtttcggtttcgcgtttttttttttttttgatgtcgtattgcgggggaggcgggggttagggcgg

SEQ ID NO: 26280 - DNA, 849 bp, Artificial Sequence
  chemically treated genomic DNA (Homo sapiens) CpG-island No: 26280
ccgccctaacccccgcctcccccgcaatacgacatcaaaaaaaaaaaaaaacgcgaaaccgaaacccaaaccgccataaaaaccaactccgaaaaaaacttaacgcgacccaaaaaaaccatcccgccgaactacgaaaacgaaataaaaaaaaaaaacgaaaacatcctaaacaccgtcatcaaatacctacccgaaccgctacaaaacatactcaaaaaataaccgcgcgcgaaacaacgaccccgcgaaacccccgcccctccccctacaaatcctccgcgaaaacccctaaaaaacgaacaaaacgcaacccccacgccgatataaaccataaccccaaacccgccctacccgcgcccgccgcctccctcacccgacaaaaaacgcgcgcccccaaaacccccccaatccgccccgtactcctctacccgcgaataactaaaaccccatcgcctaaaacgcccctttctcttactatttaccgcccacccaacaacgcccgaaaccaaaaccgccgaaaaacaaccccgcgaccacccctatacgcgcgttcgcgacgataaacgcctatcgaacccgcactcaaaaacacaaccataacaaacgaaaaactacgaacgaaacgaaaacgacgaaacctaaatccccctcctacacgcgaactccgaaattcgaatcgctccgccgtaaatatttacgtccgcacgcgaccgctctccgccccccgacctaaccccctcgcgcccctatccatccgtctctatccgcgtcctttcctctcctctctaaaaaattttacttcttacgaacgccacgaccgtattcacttctaaactaaaaaaaaca

SEQ ID NO: 26281 - DNA, 1809 bp, Artificial Sequence
  chemically treated genomic DNA (Homo sapiens) CpG-island No: 26281
gataacgattattatcgtagcgacgagtaggtgggcggggttcgggggtcgttgtagtgttagtgttcgtcgtggaggcgtgagtaggtgggcggggttcgggggtcgttgtagtgttagtgttcgtcgtggaggcgtgagtaggtgggcggggttcgggggtcgttgtagtgttagtgttcgtcgtggaggcgtgagtaggtgggcggggttcgggggtcgttgtagtgttagtgttcgtcgtggaggcgtgagtaggtgggcggggttcgggggtcgttgtagtgttagtgttcgtcgtggaggcgtgagtaggtgggcggggtttcgggggtcgttgtagtgttagtgttcgtcgtggaggcgtgagtaggtgggcggggttcgggggtcgttgtagtgttagtgttcgtcgtggaggcgtgagtaggtgggcggggttcggggtcgttgtagtgttagtgttcgtcgtggaggcgtgagtaggtgggcggggttcgggggtcgttgtagtgttagtgttcgtcgtggaggcgtgagtaggtgggcggggttcgggggtcgttgtagtgttagtgttcgtcgtggaggcgtgagtaggtgggcggggttcgggggtcgttgtagtgttagtgttcgtcgtggaggcgtgagtaggtgggcggggtttcggggtcgttgtagtgttagtgtttttcgtggaggcgtgagtaggtgggcggggtttcggggtcgttgtagtgttagtgtttttcgtggaggcgtgagtaggtgggcggggttcgggggtcgttgtagtgttagtgtttttcgtggaggcgtgagtaggtgggcggggttcgggggtcgttgtagtgttagtgtttttcgtggaggcgtgagtaggtgggcggggttcgggggtcgttgtagtgttagtgtttttcgtggaggcgtgagtaggtgggcggggttcgggggtcgttgtagtgttagtgttcgtcgtggaggcgtgagtaggtgggcggggtttcggggtcgttgtagtgttagtgttcgtcgtggaggcgtgagtaggtgggcggggttcgggggtcgttgtagtgttagtgtttttcgtggaggcgtgagtaggtgggcggggttcgggggtcgttgtagtgttagtgttcgtcgtggaggcgtgagtaggtgggcggggtttcggggtcgttgtagtgttagtgttcgtcgtggaggcgtgagtaggtgggcggggttcgggggtcgttgtagtgttagtgtttttcgtggaggcgtgagtaggtgggcggggttcgggggtcgttgtagtgttagtgtttttcgtggaggcgtgagtaggtgggcggggttcgggggtcgttgtagtgttagtgtttttcgtggaggcgtgagtaggtgggcggggtttcgggggtcgttgtagtgttagtgttcgtcgtggaggcgtgagtaggtgggcggggtttcggggtcgttgtagtgttagtgttcgtcgtggaggcgtgagtaggtgggcggggttcggggtcgttgtatagttagggttcgtcgtggaggtttgagtaggtgggcggggttcgggggttttttaaagttagtgtttttttcggaggcgtgagtacgtgggcggggtttcggggtttttttatagttatagtttttttcggaggcgtgagtatatgggcggggtttcggggtttttttagagttaaagtttttttcggaggcgtgagtacgtgggcggggtttcggggtcgttttaaagttaaagtttttttaggaggcgtgagtacgtgggttgggttt

SEQ ID NO: 26282 - DNA, 1809 bp, Artificial Sequence
  chemically treated genomic DNA (Homo sapiens) CpG-island No: 26282
aaacccaacccacgtactcacgcctcctaaaaaaactttaactttaaaacgaccccgaaaccccgcccacgtactcacgcctccgaaaaaaactttaactctaaaaaaaccccgaaaccccgcccatatactcacgcctccgaaaaaaactataactataaaaaaaccccgaaaccccgcccacgtactcacgcctccgaaaaaaacactaactttaaaaaacccccgaaccccgcccacctactcaaacctccacgacgaaccctaactatacaacgaccccgaaccccgcccacctactcacgcctccacgacgaacactaacactacaacgaccccgaaaccccgcccacctactcacgcctccacgacgaacactaacactacaacgacccccgaaaccccgcccacctactcacgcctccacgaaaaacactaacactacaacgacccccgaaccccgcccacctactcacgcctccacgaaaaacactaacactacaacgacccccgaaccccgcccacctactcacgcctccacgaaaaacactaacactacaacgacccccgaaccccgcccacctactcacgcctccacgacgaacactaacactacaacgaccccgaaaccccgcccacctactcacgcctccacgacgaacactaacactacaacgacccccgaaccccgcccacctactcacgcctccacgaaaaacactaacactacaacgacccccgaaccccgcccacctactcacgcctccacgacgaacactaacactacaacgaccccgaaaccccgcccacctactcacgcctccacgacgaacactaacactacaacgacccccgaaccccgcccacctactcacgcctccacgaaaaacactaacactacaacgacccccgaaccccgcccacctactcacgcctccacgaaaaacactaacactacaacgacccccgaaccccgcccacctactcacgcctccacgaaaaacactaacactacaacgacccccgaaccccgcccacctactcacgcctccacgaaaaacactaacactacaacgaccccgaaaccccgcccacctactcacgcctccacgaaaaacactaacactacaacgaccccgaaaccccgcccacctactcacgcctccacgacgaacactaacactacaacgacccccgaaccccgcccacctactcacgcctccacgacgaacactaacactacaacgacccccgaaccccgcccacctactcacgcctccacgacgaacactaacactacaacgacccccgaaccccgcccacctactcacgcctccacgacgaacactaacactacaacgaccccgaaccccgcccacctactcacgcctccacgacgaacactaacactacaacgacccccgaaccccgcccacctactcacgcctccacgacgaacactaacactacaacgacccccgaaaccccgcccacctactcacgcctccacgacgaacactaacactacaacgacccccgaaccccgcccacctactcacgcctccacgacgaacactaacactacaacgacccccgaaccccgcccacctactcacgcctccacgacgaacactaacactacaacgacccccgaaccccgcccacctactcacgcctccacgacgaacactaacactacaacgacccccgaaccccgcccacctactcacgcctccacgacgaacactaacactacaacgacccccgaaccccgcccacctactcgtcgctacgataataatcgttatc

SEQ ID NO: 26283 - DNA, 1809 bp, Artificial Sequence
  chemically treated genomic DNA (Homo sapiens) CpG-island No: 26283
gggtttagtttacgtgtttacgttttttgggagagttttaattttaaagcgatttcggggtttcgtttacgtgtttacgttttcggggagagttttaattttaaagagatttcggggtttcgtttatgtgtttacgttttcggggagagttataattgtaaagagatttcggggtttcgtttacgtgtttacgttttcggggagagtattaattttaaagagttttcgggtttcgtttatttgtttaggtttttacggcgagttttaattatgtagcgatttcgggtttcgtttatttgtttacgtttttacggcgagtattaatattgtagcgatttcggggtttcgtttatttgtttacgtttttacggcgagtattaatattgtagcgattttcggggtttcgtttatttgtttacgtttttacggagagtattaatattgtagcgattttcgggtttcgtttatttgtttacgtttttacggagagtattaatattgtagcgattttcgggtttcgtttatttgtttacgtttttacggagagtattaatattgtagcgattttcgggtttcgtttatttgtttacgtttttacggcgagtattaatattgtagcgatttcggggtttcgtttatttgtttacgtttttacggcgagtattaatattgtagcgattttcgggtttcgtttatttgtttacgtttttacggagagtattaatattgtagcgattttcgggtttcgtttatttgtttacgtttttacggcgaatattaatattgtagcgatttcggggtttcgtttatttgtttacgtttttacggcgagtattaatattgtagcgattttcgggtttcgtttatttgtttacgtttttacggagagtattaatattgtagcgattttcgggtttcgtttatttgtttacgtttttacggagagtattaatattgtagcgattttcgggtttcgtttatttgtttacgtttttacggagagtattaatattgtagcgattttcgggtttcgtttatttgtttacgtttttacggagagtattaatattgtagcgatttcggggtttcgtttatttgtttacgtttttacggagagtattaatattgtagcgatttcggggtttcgtttatttgtttacgtttttacggcgagtattaatattgtagcgattttcgggtttcgtttatttgtttacgtttttacggcgagtattaatattgtagcgattttcgggtttcgtttatttgtttacgtttttacggcgagtattaatattgtagcgattttcgggtttcgtttatttgtttacgtttttacggcgaatattaatattgtagcgatttcgggtttcgtttatttgtttacgtttttacggcgagtattaatattgtagcgattttcgggtttcgtttatttgtttacgtttttacggcgaatattaatattgtagcgattttcggggtttcgtttatttgtttacgtttttacggcgagtattaatattgtagcgattttcgggtttcgtttatttgtttacgtttttacggcgagtattaatattgtagcgattttcgggtttcgtttatttgtttacgtttttacggcgagtattaatattgtagcgattttcgggtttcgtttatttgtttacgtttttacggcgagtattaatattgtagcgattttcgggtttcgtttatttgtttacgtttttacggcgagtattaatattgtagcgattttcgggtttcgtttatttgttcgtcgttgcggtggtagtcgttgtt

SEQ ID NO: 26284 - DNA, 1809 bp, Artificial Sequence
  chemically treated genomic DNA (Homo sapiens) CpG-island No: 26284
aacaacgactaccaccgcaacgacgaacaaataaacgaaacccgaaaatcgctacaatattaatactcgccgtaaaaacgtaaacaaataaacgaaacccgaaaatcgctacaatattaatactcgccgtaaaaacgtaaacaaataaacgaaacccgaaaatcgctacaatattaatactcgccgtaaaaacgtaaacaaataaacgaaacccgaaaatcgctacaatattaatactcgccgtaaaaacgtaaacaaataaacgaaacccgaaaatcgctacaatattaatactcgccgtaaaaacgtaaacaaataaacgaaaccccgaaaatcgctacaatattaatattcgccgtaaaaacgtaaacaaataaacgaaacccgaaaatcgctacaatattaatactcgccgtaaaaacgtaaacaaataaacgaaacccgaaatcgctacaatattaatattcgccgtaaaaacgtaaacaaataaacgaaacccgaaaatcgctacaatattaatactcgccgtaaaaacgtaaacaaataaacgaaacccgaaaatcgctacaatattaatactcgccgtaaaaacgtaaacaaataaacgaaacccgaaaatcgctacaatattaatactcgccgtaaaaacgtaaacaaataaacgaaaccccgaaatcgctacaatattaatactctccgtaaaaacgtaaacaaataaacgaaaccccgaaatcgctacaatattaatactctccgtaaaaacgtaaacaaataaacgaaacccgaaaatcgctacaatattaatactctccgtaaaaacgtaaacaaataaacgaaacccgaaaatcgctacaatattaatactctccgtaaaaacgtaaacaaataaacgaaacccgaaaatcgctacaatattaatactctccgtaaaaacgtaaacaaataaacgaaacccgaaaatcgctacaatattaatactcgccgtaaaaacgtaaacaaataaacgaaaccccgaaatcgctacaatattaatattcgccgtaaaaacgtaaacaaataaacgaaacccgaaaatcgctacaatattaatactctccgtaaaaacgtaaacaaataaacgaaacccgaaaatcgctacaatattaatactcgccgtaaaaacgtaaacaaataaacgaaaccccgaaatcgctacaatattaatactcgccgtaaaaacgtaaacaaataaacgaaacccgaaaatcgctacaatattaatactctccgtaaaaacgtaaacaaataaacgaaacccgaaaatcgctacaatattaatactctccgtaaaaacgtaaacaaataaacgaaacccgaaaatcgctacaatattaatactctccgtaaaaacgtaaacaaataaacgaaaccccgaaaatcgctacaatattaatactcgccgtaaaaacgtaaacaaataaacgaaaccccgaaatcgctacaatattaatactcgccgtaaaaacgtaaacaaataaacgaaacccgaaatcgctacataattaaaactcgccgtaaaaacctaaacaaataaacgaaacccgaaaactctttaaaattaatactctccccgaaaacgtaaacacgtaaacgaaaccccgaaatctctttacaattataactctccccgaaaacgtaaacacataaacgaaaccccgaaatctctttaaaattaaaactctccccgaaaacgtaaacacgtaaacgaaaccccgaaatcgctttaaaattaaaactctcccaaaaaacgtaaacacgtaaactaaaccc

SEQ ID NO: 26285 - DNA, 746 bp, Artificial Sequence
  chemically treated genomic DNA (Homo sapiens) CpG-island No: 26285
cgagcgtagcgcgcgttcggttttcgtttttcgggttttttttttcggtttcggcgtttttttttcggttttcgttttttttcgtttttttcgtcggtttcggtttttttttttcggtttttttttttttcgcggtttcggtttcgtttagttttttttttcggttttcgtttttcgggtttttttttttcggtttcggttttttttttcggtttcggttttttttttcggttttcgttttttttttcgatttcggttttttttcgtagttttcgtttttttttcgggtttcgcgcgcgcggggttcggggcgggcgttgtttattgtcgcggtgttgaagcggttttcgcggtttcggttcgcgttcggtttttttttcgtttttttttgtttcgaggtttttttttttttttttcgttttttttttttttttttttggcgcgttttcgtttgagggtcgttcggttcgttcgtaaagtcgaggggtgcgggtgcggcggggtcggagttttgcgggtttgcggggttcggtcgtgtttttttttttcgcgtcgcgggagttaggggagaagtttggaggagaatcggcgttgcggtaaagttttcgaggggcgtttttcgttcgtcgtttttttagttttcgcgcgagttttttttttttgcggagggcgaggggtgaatcgttaaatagtgtttttttagggatttggggtttttcgataggagagatttcgtaaaatcgggg

SEQ ID NO: 26286 - DNA, 746 bp, Artificial Sequence
  chemically treated genomic DNA (Homo sapiens) CpG-island No: 26286
ccccgattttacgaaatctctcctatcgaaaaaccccaaatccctaaaaaaacactatttaacgattcacccctcgccctccgcaaaaaaaaaaaactcgcgcgaaaactaaaaaaacgacgaacgaaaaacgcccctcgaaaactttaccgcaacgccgattctcctccaaacttctcccctaactcccgcgacgcgaaaaaaaaaaacacgaccgaaccccgcaaacccgcaaaactccgaccccgccgcacccgcacccctcgactttacgaacgaaccgaacgaccctcaaacgaaaacgcgccaaaaaaaaaaaaaaaaaaaacgaaaaaaaaaaaaaaaaacctcgaaacaaaaaaaaacgaaaaaaaaaccgaacgcgaaccgaaaccgcgaaaaccgcttcaacaccgcgacaataaacaacgcccgccccgaaccccgcgcgcgcgaaacccgaaaaaaaaacgaaaactacgaaaaaaaaccgaaatcgaaaaaaaaaacgaaaaccgaaaaaaaaaaccgaaaccgaaaaaaaaaaccgaaaccgaaaaaaaaaaacccgaaaaacgaaaaccgaaaaaaaaaactaaacgaaaccgaaaccgcgaaaaaaaaaaaaaccgaaaaaaaaaaaccgaaaccgacgaaaaaaacgaaaaaaaacgaaaaccgaaaaaaaaacgccgaaaccgaaaaaaaaaacccgaaaaacgaaaaccgaacgcgcgctacgctcg

SEQ ID NO: 26287 - DNA, 746 bp, Artificial Sequence
  chemically treated genomic DNA (Homo sapiens) CpG-island No: 26287
tttcggttttgcggggttttttttatcggggaattttaggtttttggagagatattgtttgacggtttatttttcgtttttcgtagaggaaggagattcgcgcggggattgggagggcggcgggcggggagcgtttttcggaggttttgtcgtagcgtcgatttttttttaaattttttttttggttttcgcggcgcggggaaggagggtacggtcgggtttcgtagattcgtagggtttcggtttcgtcgtattcgtatttttcggttttgcgggcgggtcgagcggtttttaggcgggagcgcgttaggagaggaaagaaagagggcgagggaggagagggggagtttcgagataggaagaagcgaggaggaggtcgggcgcgggtcgggatcgcgggggtcgttttagtatcgcggtagtggatagcgttcgtttcggatttcgcgcgcgcggagttcgggagagaaacgggggttgcggggagaagtcggggtcggggggagaaacgggggtcggagggagaggtcggagtcggggggagaagtcggagtcggggaggagagattcggggagcggaggtcggggggaggagttgggcgaagtcggggtcgcggggagaaggggggtcgggaaggagaaatcggggtcggcgggagaagcggggagaagcgggggtcggggaggagacgtcggggtcgggaggggagattcggggagcggaggtcgggcgcgcgttgcgttcg

SEQ ID NO: 26288 - DNA, 746 bp, Artificial Sequence
  chemically treated genomic DNA (Homo sapiens) CpG-island No: 26288
cgaacgcaacgcgcgcccgacctccgctccccgaatctcccctcccgaccccgacgtctcctccccgacccccgcttctccccgcttctcccgccgaccccgatttctccttcccgaccccccttctccccgcgaccccgacttcgcccaactcctccccccgacctccgctccccgaatctctcctccccgactccgacttctccccccgactccgacctctccctccgacccccgtttctccccccgaccccgacttctccccgcaacccccgtttctctcccgaactccgcgcgcgcgaaatccgaaacgaacgctatccactaccgcgatactaaaacgacccccgcgatcccgacccgcgcccgacctcctcctcgcttcttcctatctcgaaactccccctctcctccctcgccctctttctttcctctcctaacgcgctcccgcctaaaaaccgctcgacccgcccgcaaaaccgaaaaatacgaatacgacgaaaccgaaaccctacgaatctacgaaacccgaccgtaccctccttccccgcgccgcgaaaaccaaaaaaaaaatttaaaaaaaaatcgacgctacgacaaaacctccgaaaaacgctccccgcccgccgccctcccaatccccgcgcgaatctccttcctctacgaaaaacgaaaaataaaccgtcaaacaatatctctccaaaaacctaaaattccccgataaaaaaaaccccgcaaaaccgaaa

SEQ ID NO: 26289 - DNA, 869 bp, Artificial Sequence
  chemically treated genomic DNA (Homo sapiens) CpG-island No: 26289
ggcgagtattaatattgtagcgatttcggggtttcgtttatttgtttacgtttttacggcgagtattaatattgtagcgattttcgggtttcgtttatttgtttacgtttttacggcgaatattaatattgtagcgatttcgggtttcgtttatttgtttacgtttttacggcgagtattaatattgtagcgattttcgggtttcgtttatttgtttacgtttttacggcgaatattaatattgtagcgattttcggggtttcgtttatttgtttacgtttttacggcgagtattaatattgtagcgattttcgggtttcgtttatttgtttacgtttttacggagagtattaatattgtagcgattttcgggtttcgtttatttgtttacgtttttacggcgagtattaatattgtagcgatttcggggtttcgtttatttgtttacgtttatacggcgagtattaatattgtagcgattttcgggtttcgtttatttgtttacgtttttacggcgagtattaatattgtagcgatttcggggtttcgtttatttgtttacgtttttacggcgagtattaatattgtagcgatttcggggtttcgtttatttgtttacgtttttacggcgagtattaatattgtagcgattttcgggtttcgtttatttgtttacgtttttacggcgaatattaatattgtagcgatttcgggtttcgtttatttgtttacgtttttacggcgagtattaatattgtagcgattttcgggtttcgtttatttgtttacgtttttacggcgaatattaatattgtagcgattttcggggtttcgtttatttgtttacgtttttacggcgagtattatta

SEQ ID NO: 26290 - DNA, 869 bp, Artificial Sequence
  chemically treated genomic DNA (Homo sapiens) CpG-island No: 26290
taataatactcgccgtaaaaacgtaaacaaataaacgaaaccccgaaaatcgctacaatattaatattcgccgtaaaaacgtaaacaaataaacgaaacccgaaaatcgctacaatattaatactcgccgtaaaaacgtaaacaaataaacgaaacccgaaatcgctacaatattaatattcgccgtaaaaacgtaaacaaataaacgaaacccgaaaatcgctacaatattaatactcgccgtaaaaacgtaaacaaataaacgaaaccccgaaatcgctacaatattaatactcgccgtaaaaacgtaaacaaataaacgaaaccccgaaatcgctacaatattaatactcgccgtaaaaacgtaaacaaataaacgaaacccgaaaatcgctacaatattaatactcgccgtataaacgtaaacaaataaacgaaaccccgaaatcgctacaatattaatactcgccgtaaaaacgtaaacaaataaacgaaacccgaaaatcgctacaatattaatactctccgtaaaaacgtaaacaaataaacgaaacccgaaaatcgctacaatattaatactcgccgtaaaaacgtaaacaaataaacgaaaccccgaaaatcgctacaatattaatattcgccgtaaaaacgtaaacaaataaacgaaacccgaaaatcgctacaatattaatactcgccgtaaaaacgtaaacaaataaacgaaacccgaaatcgctacaatattaatattcgccgtaaaaacgtaaacaaataaacgaaacccgaaaatcgctacaatattaatactcgccgtaaaaacgtaaacaaataaacgaaaccccgaaatcgctacaatattaatactcgcc

SEQ ID NO: 26291 - DNA, 869 bp, Artificial Sequence
  chemically treated genomic DNA (Homo sapiens) CpG-island No: 26291
tggtagtgttcgtcgtggaggcgtgagtaggtgggcggggtttcgggggtcgttgtagtgttagtgttcgtcgtggaggcgtgagtaggtgggcggggttcgggggtcgttgtagtgttagtgttcgtcgtggaggcgtgagtaggtgggcggggttcggggtcgttgtagtgttagtgttcgtcgtggaggcgtgagtaggtgggcggggttcgggggtcgttgtagtgttagtgttcgtcgtggaggcgtgagtaggtgggcggggtttcggggtcgttgtagtgttagtgttcgtcgtggaggcgtgagtaggtgggcggggtttcggggtcgttgtagtgttagtgttcgtcgtggaggcgtgagtaggtgggcggggttcgggggtcgttgtagtgttagtgttcgtcgtgtaggcgtgagtaggtgggcggggtttcggggtcgttgtagtgttagtgttcgtcgtggaggcgtgagtaggtgggcggggttcgggggtcgttgtagtgttagtgtttttcgtggaggcgtgagtaggtgggcggggttcgggggtcgttgtagtgttagtgttcgtcgtggaggcgtgagtaggtgggcggggtttcgggggtcgttgtagtgttagtgttcgtcgtggaggcgtgagtaggtgggcggggttcgggggtcgttgtagtgttagtgttcgtcgtggaggcgtgagtaggtgggcggggttcggggtcgttgtagtgttagtgttcgtcgtggaggcgtgagtaggtgggcggggttcgggggtcgttgtagtgttagtgttcgtcgtggaggcgtgagtaggtgggcggggtttcggggtcgttgtagtgttagtgttcgtt

SEQ ID NO: 26292 - DNA, 869 bp, Artificial Sequence
  chemically treated genomic DNA (Homo sapiens) CpG-island No: 26292
aacgaacactaacactacaacgaccccgaaaccccgcccacctactcacgcctccacgacgaacactaacactacaacgacccccgaaccccgcccacctactcacgcctccacgacgaacactaacactacaacgaccccgaaccccgcccacctactcacgcctccacgacgaacactaacactacaacgacccccgaaccccgcccacctactcacgcctccacgacgaacactaacactacaacgacccccgaaaccccgcccacctactcacgcctccacgacgaacactaacactacaacgacccccgaaccccgcccacctactcacgcctccacgaaaaacactaacactacaacgacccccgaaccccgcccacctactcacgcctccacgacgaacactaacactacaacgaccccgaaaccccgcccacctactcacgcctacacgacgaacactaacactacaacgacccccgaaccccgcccacctactcacgcctccacgacgaacactaacactacaacgaccccgaaaccccgcccacctactcacgcctccacgacgaacactaacactacaacgaccccgaaaccccgcccacctactcacgcctccacgacgaacactaacactacaacgacccccgaaccccgcccacctactcacgcctccacgacgaacactaacactacaacgaccccgaaccccgcccacctactcacgcctccacgacgaacactaacactacaacgacccccgaaccccgcccacctactcacgcctccacgacgaacactaacactacaacgacccccgaaaccccgcccacctactcacgcctccacgacgaacactacca

SEQ ID NO: 26293 - DNA, 692 bp, Artificial Sequence
  chemically treated genomic DNA (Homo sapiens) CpG-island No: 26293
gggagaggggtcgcgcggggagaaagattcggagttcggaaggagaagaattcgggagaggggtcgcgcggggagaaagattcggagttcggagtaagaagagttcgggagaggggtcgcgcggggagaaagattcggagttcggagtaagaagagttcgggagaggggtcgcgaggggagaaagattcggagttcggaaggagaagaattcgggagaggggtcgcgcggggagaaagatttggagttcggaaggagaagaattcgggagaggggtcgcgcggggagaaagaattggagtcgggatggagaagaattcgggggaggggtcgtgcggggaaagattcggagtttggagggagaattcgggagaggggtcgcgtggggagaaagatttagagttcggagcgagaagagttcgggagaggggtcgtacgggaagaaagattcggagttcggaaggagaagaattcgggagaggggtcgcgcggggagaaagattcggagttcggaaggagaagaatttcggagaggggtttcgaggggagaaagatttggagttcggagcgagaagaattcgggagaggggtcgcgcggggagaaagatttggagtttggcggaagaagtgagaagtagggagaaagggggtgttcggtgagagtcgcggtgggggtgtttgtgtagggaggggt

SEQ ID NO: 26294 - DNA, 692 bp, Artificial Sequence
  chemically treated genomic DNA (Homo sapiens) CpG-island No: 26294
acccctccctacacaaacacccccaccgcgactctcaccgaacaccccctttctccctacttctcacttcttccgccaaactccaaatctttctccccgcgcgacccctctcccgaattcttctcgctccgaactccaaatctttctcccctcgaaacccctctccgaaattcttctccttccgaactccgaatctttctccccgcgcgacccctctcccgaattcttctccttccgaactccgaatctttcttcccgtacgacccctctcccgaactcttctcgctccgaactctaaatctttctccccacgcgacccctctcccgaattctccctccaaactccgaatctttccccgcacgacccctcccccgaattcttctccatcccgactccaattctttctccccgcgcgacccctctcccgaattcttctccttccgaactccaaatctttctccccgcgcgacccctctcccgaattcttctccttccgaactccgaatctttctcccctcgcgacccctctcccgaactcttcttactccgaactccgaatctttctccccgcgcgacccctctcccgaactcttcttactccgaactccgaatctttctccccgcgcgacccctctcccgaattcttctccttccgaactccgaatctttctccccgcgcgacccctctccc

SEQ ID NO: 26295 - DNA, 692 bp, Artificial Sequence
  chemically treated genomic DNA (Homo sapiens) CpG-island No: 26295
gtttttttttgtataagtatttttatcgcggtttttatcgggtattttttttttttttgttttttatttttttcgttaaattttaggttttttttttcgcgcggtttttttttcgagtttttttcgtttcggattttaggttttttttttttcgaggttttttttcggagttttttttttttcggatttcgggttttttttttcgcgcggtttttttttcgagttttttttttttcggatttcgggttttttttttcgtgcggtttttttttcgagtttttttcgtttcggattttgggtttttttttttacgcggtttttttttcgagttttttttttagatttcgggttttttttcgtacggtttttttttcgagtttttttttatttcgattttagtttttttttttcgcgcggtttttttttcgagttttttttttttcggattttaggttttttttttcgcgcggtttttttttcgagttttttttttttcggatttcgggttttttttttttcgcggtttttttttcgagttttttttgtttcggatttcgggttttttttttcgcgcggtttttttttcgagttttttttgtttcggatttcgggttttttttttcgcgcggtttttttttcgagttttttttttttcggatttcgggttttttttttcgcgcggtttttttttt

SEQ ID NO: 26296 - DNA, 692 bp, Artificial Sequence
  chemically treated genomic DNA (Homo sapiens) CpG-island No: 26296
aaaaaaaaaaccgcgcgaaaaaaaaaacccgaaatccgaaaaaaaaaaaactcgaaaaaaaaaccgcgcgaaaaaaaaaacccgaaatccgaaacaaaaaaaactcgaaaaaaaaaccgcgcgaaaaaaaaaacccgaaatccgaaacaaaaaaaactcgaaaaaaaaaccgcgaaaaaaaaaaaacccgaaatccgaaaaaaaaaaaactcgaaaaaaaaaccgcgcgaaaaaaaaaacctaaaatccgaaaaaaaaaaaactcgaaaaaaaaaccgcgcgaaaaaaaaaaactaaaatcgaaataaaaaaaaactcgaaaaaaaaaccgtacgaaaaaaaacccgaaatctaaaaaaaaaactcgaaaaaaaaaccgcgtaaaaaaaaaaacccaaaatccgaaacgaaaaaaactcgaaaaaaaaaccgcacgaaaaaaaaaacccgaaatccgaaaaaaaaaaaactcgaaaaaaaaaccgcgcgaaaaaaaaaacccgaaatccgaaaaaaaaaaaactccgaaaaaaaacctcgaaaaaaaaaaaacctaaaatccgaaacgaaaaaaactcgaaaaaaaaaccgcgcgaaaaaaaaaacctaaaatttaacgaaaaaaataaaaaacaaaaaaaaaaaaaatacccgataaaaaccgcgataaaaatacttatacaaaaaaaaac

SEQ ID NO: 26297 - DNA, 753 bp, Artificial Sequence
  chemically treated genomic DNA (Homo sapiens) CpG-island No: 26297
gtcgcggtttcggttttagaggtcgcgcgtcgcggggtcgggggaggtgggggagaggaggtcgttttggggtcgatttcgttcgtagttgggggttttcgttacgtgattagtcgggcgtttaggttacgtgtcggggcggggaggggggggttgtcgggggcgacgggcgttcgggtagtggcgcgcgcggtacgcgagtagcgtacgaggagaggtggcgcgggtcggagtcgcggagggaggcggcggcggcggcggcggcggcggcggcggcggcggtggaaggggcggtttcgcggtttcgcgttcgcgttacgtggtgcgaggcgggtagttattttgttataaatataaatatagaggagtcggttcgtcgtcggagtcggtcgagtttagagaagcgttcggagttaggcgcgcggggtcgttagcgaggatttttttcgtttttttttcgaggtcgtcgtagttcggtgcgttttttcgttttttcgttcgtttcggtttattttcgtcgtcgggatttttttttagagtcggttagtttcggggaggtttcgggagtcggcgttcggtttagggggcgatcgttcgtttttttcgtatttggcgtttttttttgaagggtacgtcgttttttcgggtcggcgcgttgttttttattttcgcgtttttaacggtcgttttcgggtttttgttaagttttgttttgggtcgtttgggggttttcgattttagcgttttagggtg

SEQ ID NO: 26298 - DNA, 753 bp, Artificial Sequence
  chemically treated genomic DNA (Homo sapiens) CpG-island No: 26298
caccctaaaacgctaaaatcgaaaacccccaaacgacccaaaacaaaacttaacaaaaacccgaaaacgaccgttaaaaacgcgaaaataaaaaacaacgcgccgacccgaaaaaacgacgtacccttcaaaaaaaaacgccaaatacgaaaaaaacgaacgatcgccccctaaaccgaacgccgactcccgaaacctccccgaaactaaccgactctaaaaaaaaatcccgacgacgaaaataaaccgaaacgaacgaaaaaacgaaaaaacgcaccgaactacgacgacctcgaaaaaaaaacgaaaaaaatcctcgctaacgaccccgcgcgcctaactccgaacgcttctctaaactcgaccgactccgacgacgaaccgactcctctatatttatatttataacaaaataactacccgcctcgcaccacgtaacgcgaacgcgaaaccgcgaaaccgccccttccaccgccgccgccgccgccgccgccgccgccgccgccgcctccctccgcgactccgacccgcgccacctctcctcgtacgctactcgcgtaccgcgcgcgccactacccgaacgcccgtcgcccccgacaacccccccctccccgccccgacacgtaacctaaacgcccgactaatcacgtaacgaaaacccccaactacgaacgaaatcgaccccaaaacgacctcctctcccccacctcccccgaccccgcgacgcgcgacctctaaaaccgaaaccgcgac

SEQ ID NO: 26299 - DNA, 753 bp, Artificial Sequence
  chemically treated genomic DNA (Homo sapiens) CpG-island No: 26299
tattttaggacgttagggtcgggggtttttaggcggtttagggtagggtttggtaggggttcgggggcgatcgttaggagcgcgggggtggaaggtagcgcgtcggttcgggaggacggcgtgttttttagggaggggcgttaggtgcgaggggggcgagcggtcgttttttaagtcgggcgtcggttttcggggttttttcgaggttggtcggttttgggggagggtttcggcggcggggatgggtcggagcgggcgggagagcgggaggacgtatcgggttgcggcggtttcggggaggagacgggggaggttttcgttggcggtttcgcgcgtttggtttcgggcgtttttttaagttcggtcggtttcggcggcgggtcggtttttttgtgtttgtgtttgtagtaagatggttgttcgtttcgtattacgtgacgcggacgcggggtcgcggggtcgttttttttatcgtcgtcgtcgtcgtcgtcgtcgtcgtcgtcgtcgttttttttcgcggtttcggttcgcgttattttttttcgtgcgttgttcgcgtgtcgcgcgcgttattgttcggacgttcgtcgttttcgatagttttttttttttcgtttcgatacgtgatttgggcgttcggttggttacgtgacgggggtttttagttgcgggcgggatcggttttagagcggtttttttttttttatttttttcggtttcgcgacgcgcgatttttgggatcgaggtcgcggt

SEQ ID NO: 26300 - DNA, 753 bp, Artificial Sequence
  chemically treated genomic DNA (Homo sapiens) CpG-island No: 26300
accgcgacctcgatcccaaaaatcgcgcgtcgcgaaaccgaaaaaaataaaaaaaaaaaaaccgctctaaaaccgatcccgcccgcaactaaaaacccccgtcacgtaaccaaccgaacgcccaaatcacgtatcgaaacgaaaaaaaaaaaactatcgaaaacgacgaacgtccgaacaataacgcgcgcgacacgcgaacaacgcacgaaaaaaaataacgcgaaccgaaaccgcgaaaaaaaacgacgacgacgacgacgacgacgacgacgacgacgataaaaaaaacgaccccgcgaccccgcgtccgcgtcacgtaatacgaaacgaacaaccatcttactacaaacacaaacacaaaaaaaccgacccgccgccgaaaccgaccgaacttaaaaaaacgcccgaaaccaaacgcgcgaaaccgccaacgaaaacctcccccgtctcctccccgaaaccgccgcaacccgatacgtcctcccgctctcccgcccgctccgacccatccccgccgccgaaaccctcccccaaaaccgaccaacctcgaaaaaaccccgaaaaccgacgcccgacttaaaaaacgaccgctcgcccccctcgcacctaacgcccctccctaaaaaacacgccgtcctcccgaaccgacgcgctaccttccacccccgcgctcctaacgatcgcccccgaacccctaccaaaccctaccctaaaccgcctaaaaacccccgaccctaacgtcctaaaata

SEQ ID NO: 26301 - DNA, 524 bp, Artificial Sequence
  chemically treated genomic DNA (Homo sapiens) CpG-island No: 26301
gtcggtcgttggcgagcgttttatttttgttttttttttttttttcgttagatttcggcgtcggagttttatttttattgacgggttttgattggtcgtttttgacgcgtttcggggttacgattggttcgttcggtttcggatatcgtttttttttttttgaggtaattacggcggttttaaggagggggtgggggaaggagggacggtcggtttcgttagttaggtagcgggagtcgtcgggagcggatggcggcggtcgtagcggttttattcgtcgtcgggggtgaggaggcggtagttacgattttcgtgttcgggtttttaggtttgtcggggagacgtagtgtagagcgggttttagaggacgtcgtggttatcgggattttgaatttgtttaatcggcgtttgaagtatttttttcggggcgcggttcgtagttacgatttgttagatattatttaggttggtgagtgtagtcgggtttcgggtttaatcgggttttttatttgtatagttttatt

SEQ ID NO: 26302 - DNA, 524 bp, Artificial Sequence
  chemically treated genomic DNA (Homo sapiens) CpG-island No: 26302
aataaaactatacaaataaaaaacccgattaaacccgaaacccgactacactcaccaacctaaataatatctaacaaatcgtaactacgaaccgcgccccgaaaaaaatacttcaaacgccgattaaacaaattcaaaatcccgataaccacgacgtcctctaaaacccgctctacactacgtctccccgacaaacctaaaaacccgaacacgaaaatcgtaactaccgcctcctcacccccgacgacgaataaaaccgctacgaccgccgccatccgctcccgacgactcccgctacctaactaacgaaaccgaccgtccctccttcccccaccccctccttaaaaccgccgtaattacctcaaaaaaaaaaaaacgatatccgaaaccgaacgaaccaatcgtaaccccgaaacgcgtcaaaaacgaccaatcaaaacccgtcaataaaaataaaactccgacgccgaaatctaacgaaaaaaaaaaaaaaaacaaaaataaaacgctcgccaacgaccgac

SEQ ID NO: 26303 - DNA, 524 bp, Artificial Sequence
  chemically treated genomic DNA (Homo sapiens) CpG-island No: 26303
ggtggggttatgtaaatgagggattcggttgggttcggggttcggttgtatttattagtttgggtgatgtttgataggtcgtagttacgggtcgcgtttcgggggaagtgttttaagcgtcggttagataggtttagggtttcggtggttacggcgttttttagggttcgttttgtattgcgttttttcggtagatttggagattcgggtacggaggtcgtggttgtcgtttttttattttcggcggcgagtggagtcgttacggtcgtcgttattcgttttcggcggttttcgttgtttgattgacgggatcggtcgttttttttttttttattttttttttggagtcgtcgtagttgttttaagggggagggagcggtgttcgggatcggacggattaatcgtggtttcgagacgcgttagaagcggttaattagaattcgttagtgggggtggagtttcggcgtcggagtttgacgagagaagggaggggaataaggatagagcgttcgttaacggtcgat

SEQ ID NO: 26304 - DNA, 524 bp, Artificial Sequence
  chemically treated genomic DNA (Homo sapiens) CpG-island No: 26304
atcgaccgttaacgaacgctctatccttattcccctcccttctctcgtcaaactccgacgccgaaactccacccccactaacgaattctaattaaccgcttctaacgcgtctcgaaaccacgattaatccgtccgatcccgaacaccgctccctcccccttaaaacaactacgacgactccaaaaaaaaaataaaaaaaaaaaaaacgaccgatcccgtcaatcaaacaacgaaaaccgccgaaaacgaataacgacgaccgtaacgactccactcgccgccgaaaataaaaaaacgacaaccacgacctccgtacccgaatctccaaatctaccgaaaaaacgcaatacaaaacgaaccctaaaaaacgccgtaaccaccgaaaccctaaacctatctaaccgacgcttaaaacacttcccccgaaacgcgacccgtaactacgacctatcaaacatcacccaaactaataaatacaaccgaaccccgaacccaaccgaatccctcatttacataaccccacc

SEQ ID NO: 26305 - DNA, 951 bp, Artificial Sequence
  chemically treated genomic DNA (Homo sapiens) CpG-island No: 26305
gtttttggcggggtgtgtcgtttttagttggatttttaatatagggaattggtaatacgtttttggcggggtgtgtcgtttttagttggatttttaatataaggaattggttagacgtttttggcggggtgtgtcgttttttattggatttttaacgtagggaattggtaatacgtttttggcggggtgtgtcgtttttagttggatttttaatatagggaattggttagacgtttttggcggggtgtgtcgtttttagttggatttttaatatagggaattggtaatacgtttttggcggggtgtgtcgtttttagttggatttttaatataaggaattggttagacgtttttggcggggtgtgttattttttattggatttttaacgtagggaattggttatacgtttttggcggggtgtgtcgtttttagttggatttttaatatagggaattggttagacgtttttggcggggtgtgtcgttttttattggatttttaatatagggaattggttagacgtttttggcggggtgtgtcgttttttattggatttttaacgtagggaattggttatacgtttttggcggggtgtgtcgtttttagttggatttttaacgtagggaattggttatacgtttttggcggggtgtgtcgtttttagttggatttttaatatagggaattggttagacgtttttggcggggtgtgtcgtttttagttggatttttaacgtagggaattggttagacgtttttggcggggtgtgtcgtttttagttggatttttaatatagggaattggttagacgtttttggcggggtgtgtcgttttttattggatttttaacgtagggaattggttagacgtttttggcggggtgtgtagtaggataagaggagttacgtagaaatatcgggttgtagtttttaattgggttgttgataat

SEQ ID NO: 26306 - DNA, 951 bp, Artificial Sequence
  chemically treated genomic DNA (Homo sapiens) CpG-island No: 26306
attatcaacaacccaattaaaaactacaacccgatatttctacgtaactcctcttatcctactacacaccccgccaaaaacgtctaaccaattccctacgttaaaaatccaataaaaaacgacacaccccgccaaaaacgtctaaccaattccctatattaaaaatccaactaaaaacgacacaccccgccaaaaacgtctaaccaattccctacgttaaaaatccaactaaaaacgacacaccccgccaaaaacgtctaaccaattccctatattaaaaatccaactaaaaacgacacaccccgccaaaaacgtataaccaattccctacgttaaaaatccaactaaaaacgacacaccccgccaaaaacgtataaccaattccctacgttaaaaatccaataaaaaacgacacaccccgccaaaaacgtctaaccaattccctatattaaaaatccaataaaaaacgacacaccccgccaaaaacgtctaaccaattccctatattaaaaatccaactaaaaacgacacaccccgccaaaaacgtataaccaattccctacgttaaaaatccaataaaaaataacacaccccgccaaaaacgtctaaccaattccttatattaaaaatccaactaaaaacgacacaccccgccaaaaacgtattaccaattccctatattaaaaatccaactaaaaacgacacaccccgccaaaaacgtctaaccaattccctatattaaaaatccaactaaaaacgacacaccccgccaaaaacgtattaccaattccctacgttaaaaatccaataaaaaacgacacaccccgccaaaaacgtctaaccaattccttatattaaaaatccaactaaaaacgacacaccccgccaaaaacgtattaccaattccctatattaaaaatccaactaaaaacgacacaccccgccaaaaac

SEQ ID NO: 26307 - DNA, 951 bp, Artificial Sequence
  chemically treated genomic DNA (Homo sapiens) CpG-island No: 26307
attattagtaatttaattagagattgtagttcgatatttttgcgtggttttttttattttgttatatatttcgttagggacgtttaattaattttttgcgttgaaaatttagtgggaagcgatatatttcgttagggacgtttaattaattttttgtgttgaaaatttagttggaagcgatatatttcgttagggacgtttaattaattttttgcgttgaaaatttagttggaagcgatatatttcgttagggacgtttaattaattttttgtgttgaaaatttagttggaagcgatatatttcgttagggacgtgtaattaattttttgcgttgaaaatttagttggaagcgatatatttcgttagggacgtgtaattaattttttgcgttgaaaatttagtgggaagcgatatatttcgttagggacgtttaattaattttttgtgttgaaaatttagtgggaagcgatatatttcgttagggacgtttaattaattttttgtgttgaaaatttagttggaagcgatatatttcgttagggacgtgtaattaattttttgcgttgaaaatttagtgggaagtgatatatttcgttagggacgtttaattaattttttgtgttgaaaatttagttggaagcgatatatttcgttagggacgtgttattaattttttgtgttgaaaatttagttggaagcgatatatttcgttagggacgtttaattaattttttgtgttgaaaatttagttggaagcgatatatttcgttagggacgtgttattaattttttgcgttgaaaatttagtgggaagcgatatatttcgttagggacgtttaattaattttttgtgttgaaaatttagttggaagcgatatatttcgttagggacgtgttattaattttttgtgttgaaaatttagttggaagcgatatatttcgttagggat

SEQ ID NO: 26308 - DNA, 951 bp, Artificial Sequence
  chemically treated genomic DNA (Homo sapiens) CpG-island No: 26308
atccctaacgaaatatatcgcttccaactaaattttcaacacaaaaaattaataacacgtccctaacgaaatatatcgcttccaactaaattttcaacacaaaaaattaattaaacgtccctaacgaaatatatcgcttcccactaaattttcaacgcaaaaaattaataacacgtccctaacgaaatatatcgcttccaactaaattttcaacacaaaaaattaattaaacgtccctaacgaaatatatcgcttccaactaaattttcaacacaaaaaattaataacacgtccctaacgaaatatatcgcttccaactaaattttcaacacaaaaaattaattaaacgtccctaacgaaatatatcacttcccactaaattttcaacgcaaaaaattaattacacgtccctaacgaaatatatcgcttccaactaaattttcaacacaaaaaattaattaaacgtccctaacgaaatatatcgcttcccactaaattttcaacacaaaaaattaattaaacgtccctaacgaaatatatcgcttcccactaaattttcaacgcaaaaaattaattacacgtccctaacgaaatatatcgcttccaactaaattttcaacgcaaaaaattaattacacgtccctaacgaaatatatcgcttccaactaaattttcaacacaaaaaattaattaaacgtccctaacgaaatatatcgcttccaactaaattttcaacgcaaaaaattaattaaacgtccctaacgaaatatatcgcttccaactaaattttcaacacaaaaaattaattaaacgtccctaacgaaatatatcgcttcccactaaattttcaacgcaaaaaattaattaaacgtccctaacgaaatatataacaaaataaaaaaaaccacgcaaaaatatcgaactacaatctctaattaaattactaataat

SEQ ID NO: 26309 - DNA, 1032 bp, Artificial Sequence
  chemically treated genomic DNA (Homo sapiens) CpG-island No: 26309
atttagcgttcgtttatgtatatacgtttatttcgtatttagagttcgttcgtgtatatatttattttgtatttagagtttatttatgtatatacgtttattttttatttagcgttggttcgtgtatatacgtttatttcgtatttagtattcgttcgtgtatatacgtttatttcgtatttagtgtttatgtatatatatttatttcgtaattagcgtttatttatgtatataggtttatttcgtatttagcgttcgttcgtgtatatacgtttatttcgtatttagcgttcgttcgtgtatatacgtttatttcgtatttagcgttcgttcgtgtatatacgtttatttcgtatttagcgttcgttcgtgtatatacgtttatttcgtatttagcgttcgttcgtgtatacgtttatttcgtatttagcgttcgttcgtgtatatacgtttatttcgtatttagcgttcgttcgtgtatatacgtttatttcgtatttagcgttcgttcgtgtatatacgtttatttcgtatttagcgttcgttcgtgtatacgtttatttcgtatttagcgttcgttcgtgtatacgtttatttcgtatttagcgttcgtttgtgtatatatgtttttttcgtatcgagcgtttgttcgtgtatacgtttattttatatttagtatttatttgtgtatatacgtttttttcgtatttagtattcgtgtatacgtttatttcgtatttagtatttgtttatgtatatatttttttcgtatttagcgttcgtttatgtatatatttattttgtatttagtatttatttgtgtatatatttttatttcgtatttagtatttgttcgtgtatatacgtttattttatatatatttttttcgtatttagcgttcgtcggtgtatatacgtttatttttcgtatttttcgtggaggcggtatttaggtagggaagtaaggatattttgcgtttatttttttttttaaatattaaggttttcgtaattcgaggaatatatttgata

SEQ ID NO: 26310 - DNA, 1032 bp, Artificial Sequence
  chemically treated genomic DNA (Homo sapiens) CpG-island No: 26310
tatcaaatatattcctcgaattacgaaaaccttaatatttaaaaaaaaaaataaacgcaaaatatccttacttccctacctaaataccgcctccacgaaaaatacgaaaaataaacgtatatacaccgacgaacgctaaatacgaaaaaaatatatataaaataaacgtatatacacgaacaaatactaaatacgaaataaaaatatatacacaaataaatactaaatacaaaataaatatatacataaacgaacgctaaatacgaaaaaaatatatacataaacaaatactaaatacgaaataaacgtatacacgaatactaaatacgaaaaaaacgtatatacacaaataaatactaaatataaaataaacgtatacacgaacaaacgctcgatacgaaaaaaacatatatacacaaacgaacgctaaatacgaaataaacgtatacacgaacgaacgctaaatacgaaataaacgtatacacgaacgaacgctaaatacgaaataaacgtatatacacgaacgaacgctaaatacgaaataaacgtatatacacgaacgaacgctaaatacgaaataaacgtatatacacgaacgaacgctaaatacgaaataaacgtatacacgaacgaacgctaaatacgaaataaacgtatatacacgaacgaacgctaaatacgaaataaacgtatatacacgaacgaacgctaaatacgaaataaacgtatatacacgaacgaacgctaaatacgaaataaacgtatatacacgaacgaacgctaaatacgaaataaacctatatacataaataaacgctaattacgaaataaatatatatacataaacactaaatacgaaataaacgtatatacacgaacgaatactaaatacgaaataaacgtatatacacgaaccaacgctaaataaaaaataaacgtatatacataaataaactctaaatacaaaataaatatatacacgaacgaactctaaatacgaaataaacgtatatacataaacgaacgctaaat

SEQ ID NO: 26311 - DNA, 1032 bp, Artificial Sequence
  chemically treated genomic DNA (Homo sapiens) CpG-island No: 26311
tgttaaatatatttttcggattgcgggggttttggtgtttagagagaggaatggacgtagagtgtttttgtttttttgtttggatgtcgtttttacgggaggtgcgggaggtgagcgtgtgtgtatcgacggacgttgggtgcgaggggagtgtgtgtgaggtgagcgtgtgtgtacggatagatgttgggtgcgaggtgagggtgtgtgtatagatggatgttgggtgtaaggtgagtatgtgtatggacggacgttaggtgcgaggggagtgtgtgtatggatagatgttgggtgcgaggtgagcgtgtgtacggatgttgggtgcgaggggagcgtgtgtgtatagatggatgttgggtgtgaggtaagcgtgtgtacggatagacgttcggtgcgaggggagtatgtgtgtatagacggacgttgggtacgaggtgagcgtgtgtacggacggacgttgggtgcgaggtgagcgtgtgtacggacggacgttgggtgcgaggtgagcgtgtgtgtacggacggacgttgggtgcgaggtgagcgtgtgtgtacggacggacgttgggtgcgaggtgagcgtgtgtgtacggacggacgttgggtgcgaggtgagcgtgtgtacggacggacgttgggtgcgaggtgagcgtgtgtgtacggacggacgttgggtgcgaggtgagcgtgtgtgtacggacggacgttgggtgcgaggtgagcgtgtgtgtacggacggacgttgggtgcgaggtgagcgtgtgtgtacggacggacgttgggtgcgaggtgagtttgtgtgtatggatggacgttggttgcgaggtgagtgtgtgtgtatggatattgggtgcgaggtgagcgtgtgtgtacggacggatgttgggtgcgaagtgagcgtgtgtgtacggattaacgttgggtgagagatgagcgtgtgtgtatggatggattttgggtgtaaggtgagtgtgtgtacggacggattttgggtgcgaggtgagcgtgtgtgtatggacggacgttgggt

SEQ ID NO: 26312 - DNA, 1032 bp, Artificial Sequence
  chemically treated genomic DNA (Homo sapiens) CpG-island No: 26312
acccaacgtccgtccatacacacacgctcacctcgcacccaaaatccgtccgtacacacactcaccttacacccaaaatccatccatacacacacgctcatctctcacccaacgttaatccgtacacacacgctcacttcgcacccaacatccgtccgtacacacacgctcacctcgcacccaatatccatacacacacactcacctcgcaaccaacgtccatccatacacacaaactcacctcgcacccaacgtccgtccgtacacacacgctcacctcgcacccaacgtccgtccgtacacacacgctcacctcgcacccaacgtccgtccgtacacacacgctcacctcgcacccaacgtccgtccgtacacacacgctcacctcgcacccaacgtccgtccgtacacacgctcacctcgcacccaacgtccgtccgtacacacacgctcacctcgcacccaacgtccgtccgtacacacacgctcacctcgcacccaacgtccgtccgtacacacacgctcacctcgcacccaacgtccgtccgtacacacgctcacctcgcacccaacgtccgtccgtacacacgctcacctcgtacccaacgtccgtctatacacacatactcccctcgcaccgaacgtctatccgtacacacgcttacctcacacccaacatccatctatacacacacgctcccctcgcacccaacatccgtacacacgctcacctcgcacccaacatctatccatacacacactcccctcgcacctaacgtccgtccatacacatactcaccttacacccaacatccatctatacacacaccctcacctcgcacccaacatctatccgtacacacacgctcacctcacacacactcccctcgcacccaacgtccgtcgatacacacacgctcacctcccgcacctcccgtaaaaacgacatccaaacaaaaaaacaaaaacactctacgtccattcctctctctaaacaccaaaacccccgcaatccgaaaaatatatttaaca

SEQ ID NO: 26313 - DNA, 1501 bp, Artificial Sequence
  chemically treated genomic DNA (Homo sapiens) CpG-island No: 26313
cgggtcggaggtgtcggttttttttttcgtttcgtttttttcgcggtgattttatttaaatttttttttttttcgttgttttatcggatttaggggttggggtcgtagttcggcgggtagcggtgtttatttttcgtataaatttgggttttttcgcggggtagttttcgggttttgtgttgggtcgtagtttcgggcggttttttcggggcgggacgtgttttcgttcgttttcgttcgttttcgtcgttttcgggtttcggttcgtttcgttttcgtagtcgtaggttcgttgcggcgttcgtttttttttttttttttcgggttttgttttgttcgtcgtttcgttttttgttcggtttttgttcggtttcgtttcgcgttcgttttttgttcgcgttcgtttcgttttttgttcggtttttgttcggtttttgttcgttttttgttcggttttttagcggcggcggttgtagcgcggcggttcgagcgggtgtatcgcggcggaggaggtagtatttcgcggcgttgacggttttggggagagtatggcgtcgaggtgaggtcggggttgcgggtaggggttgggggacgttaagatgcggttgcgggggtcgcgggggtcgcggggttcggtcgggttttgcgggggtcgcgggggttttgcggggtttgattcgtgtttgtttcgcgtaggtgtttttggttatggtcgcggcggcggcgttttttggacgtgttcgcgtttttggttttgttgttcggggttcgcgcggttttcgcggagttaggtaagattcgggcgggacgggaaggttcgcgtcggtgttcgtcggtttcgtcgttttggttggggttttcgttcggtttttttattttcgtttcggtcgttttgggtttagtttcggttttgtttacgcgcgtaggaggcgtcggagtcggacggagcggggcggggtggtcggagtttcgtttatttatttttttcgcggggttcgggtcgggaggggtgcgcggtgcgagcggtcggagttttcgcgcggggatcgaattttcgcggtcggcggggtcgtcggtgtcgggagggttcggggcggggtcgcggggtttcgggagacgcggtttttgtcgtcgttacggtttcgttttcgtagcgtcgggtttcgggattgatcgcgggcggaaggcggcggagcgcggggcgtcgttttcgcgtttttaatttgttgaggtttttcgtcgcgggtcgggttttgtgcgtttttgttttcgtcgtttttaggtttttgttttcgcgttcgtcgtggtgtcgggttgcgcggttttttttgatgttaatcgagcgtcgcgcggttcgagaataatgtttagaagtcgttgtttcgtcggtttcgtcgtttttcgtgcgcggtaaacggtgcgcggggttcgtggggatttttttgtttttaatttcgggatttagttttttattatttgttaatcggggttttttgttttt

SEQ ID NO: 26314 - DNA, 1501 bp, Artificial Sequence
  chemically treated genomic DNA (Homo sapiens) CpG-island No: 26314
aaaaacaaaaaaccccgattaacaaataataaaaaactaaatcccgaaattaaaaacaaaaaaatccccacgaaccccgcgcaccgtttaccgcgcacgaaaaacgacgaaaccgacgaaacaacgacttctaaacattattctcgaaccgcgcgacgctcgattaacatcaaaaaaaaccgcgcaacccgacaccacgacgaacgcgaaaacaaaaacctaaaaacgacgaaaacaaaaacgcacaaaacccgacccgcgacgaaaaacctcaacaaattaaaaacgcgaaaacgacgccccgcgctccgccgccttccgcccgcgatcaatcccgaaacccgacgctacgaaaacgaaaccgtaacgacgacaaaaaccgcgtctcccgaaaccccgcgaccccgccccgaaccctcccgacaccgacgaccccgccgaccgcgaaaattcgatccccgcgcgaaaactccgaccgctcgcaccgcgcacccctcccgacccgaaccccgcgaaaaaaataaataaacgaaactccgaccaccccgccccgctccgtccgactccgacgcctcctacgcgcgtaaacaaaaccgaaactaaacccaaaacgaccgaaacgaaaataaaaaaaccgaacgaaaaccccaaccaaaacgacgaaaccgacgaacaccgacgcgaaccttcccgtcccgcccgaatcttacctaactccgcgaaaaccgcgcgaaccccgaacaacaaaaccaaaaacgcgaacacgtccaaaaaacgccgccgccgcgaccataaccaaaaacacctacgcgaaacaaacacgaatcaaaccccgcaaaacccccgcgacccccgcaaaacccgaccgaaccccgcgacccccgcgacccccgcaaccgcatcttaacgtcccccaacccctacccgcaaccccgacctcacctcgacgccatactctccccaaaaccgtcaacgccgcgaaatactacctcctccgccgcgatacacccgctcgaaccgccgcgctacaaccgccgccgctaaaaaaccgaacaaaaaacgaacaaaaaccgaacaaaaaccgaacaaaaaacgaaacgaacgcgaacaaaaaacgaacgcgaaacgaaaccgaacaaaaaccgaacaaaaaacgaaacgacgaacaaaacaaaacccgaaaaaaaaaaaaaaaaacgaacgccgcaacgaacctacgactacgaaaacgaaacgaaccgaaacccgaaaacgacgaaaacgaacgaaaacgaacgaaaacacgtcccgccccgaaaaaaccgcccgaaactacgacccaacacaaaacccgaaaactaccccgcgaaaaaacccaaatttatacgaaaaataaacaccgctacccgccgaactacgaccccaacccctaaatccgataaaacaacgaaaaaaaaaaaaatttaaataaaatcaccgcgaaaaaaacgaaacgaaaaaaaaaaccgacacctccgacccg

SEQ ID NO: 26315 - DNA, 1501 bp, Artificial Sequence
  chemically treated genomic DNA (Homo sapiens) CpG-island No: 26315
ggaggtaggaggtttcggttagtaggtggtggggaattgggtttcggggttggaggtaggaaggtttttacgggtttcgcgtatcgtttgtcgcgtacgggaagcggcgaggtcggcggggtagcggtttttgggtattgttttcggatcgcgcggcgttcggttggtattaaaggggatcgcgtaattcgatattacggcgggcgcggggatagaggtttgagggcggcggggatagaggcgtataaggttcggttcgcggcgaggagttttaataggttggaaacgcggagacgacgtttcgcgtttcgtcgtttttcgttcgcggttagtttcgggattcggcgttgcggggacgaggtcgtgacggcgatagaggtcgcgtttttcgagatttcgcggtttcgtttcgagttttttcggtatcgacgatttcgtcggtcgcggaggttcggttttcgcgcggggatttcggtcgttcgtatcgcgtatttttttcggttcggatttcgcggggagaatgaatgggcgggatttcggttatttcgtttcgtttcgttcggtttcggcgttttttgcgcgcgtgggtagggtcggggttgaatttagagcggtcggggcgggggtgagggagtcgggcggggattttagttagggcggcgaggtcggcgggtatcggcgcgaattttttcgtttcgttcgggttttatttggtttcgcggaggtcgcgcggatttcgagtagtaggattaggggcgcgagtacgtttaggaggcgtcgtcgtcgcggttatggttaggggtatttgcgcgggataggtacgggttagatttcgtaggattttcgcgattttcgtaggattcggtcgagtttcgcgattttcgcgattttcgtagtcgtattttggcgttttttaatttttgttcgtagtttcggttttatttcggcgttatgttttttttaggatcgttagcgtcgcgggatgttgtttttttcgtcgcggtgtattcgttcggatcgtcgcgttgtagtcgtcgtcgttgggaggtcgggtagggggcgggtaggggtcgggtaggggtcgggtagggggcggggcgggcgcgggtagggggcgggcgcggggcggggtcgggtaggggtcgggtagggggcggagcgacgagtagggtaaggttcggggaggggagaggggggcgggcgtcgtagcggatttgcggttgcgaggacggggcgggtcgggattcgggggcggcggggacgggcgaggacggacggggatacgtttcgtttcgagggaatcgttcgaggttgcgatttagtatagggttcgggggttgtttcgcgaggaagtttaggtttatgcggaaggtgaatatcgttgttcgtcgggttacgattttagtttttgagttcggtggggtagcgggaaggggggagatttgaatagagttatcgcgggggggacgggacggaggaggaagtcggtattttcggttcg

SEQ ID NO: 26316 - DNA, 1501 bp, Artificial Sequence
  chemically treated genomic DNA (Homo sapiens) CpG-island No: 26316
cgaaccgaaaataccgacttcctcctccgtcccgtcccccccgcgataactctattcaaatctccccccttcccgctaccccaccgaactcaaaaactaaaatcgtaacccgacgaacaacgatattcaccttccgcataaacctaaacttcctcgcgaaacaacccccgaaccctatactaaatcgcaacctcgaacgattccctcgaaacgaaacgtatccccgtccgtcctcgcccgtccccgccgcccccgaatcccgacccgccccgtcctcgcaaccgcaaatccgctacgacgcccgcccccctctcccctccccgaaccttaccctactcgtcgctccgccccctacccgacccctacccgaccccgccccgcgcccgccccctacccgcgcccgccccgccccctacccgacccctacccgacccctacccgccccctacccgacctcccaacgacgacgactacaacgcgacgatccgaacgaatacaccgcgacgaaaaaaacaacatcccgcgacgctaacgatcctaaaaaaaacataacgccgaaataaaaccgaaactacgaacaaaaattaaaaaacgccaaaatacgactacgaaaatcgcgaaaatcgcgaaactcgaccgaatcctacgaaaatcgcgaaaatcctacgaaatctaacccgtacctatcccgcgcaaatacccctaaccataaccgcgacgacgacgcctcctaaacgtactcgcgcccctaatcctactactcgaaatccgcgcgacctccgcgaaaccaaataaaacccgaacgaaacgaaaaaattcgcgccgatacccgccgacctcgccgccctaactaaaatccccgcccgactccctcacccccgccccgaccgctctaaattcaaccccgaccctacccacgcgcgcaaaaaacgccgaaaccgaacgaaacgaaacgaaataaccgaaatcccgcccattcattctccccgcgaaatccgaaccgaaaaaaatacgcgatacgaacgaccgaaatccccgcgcgaaaaccgaacctccgcgaccgacgaaatcgtcgataccgaaaaaactcgaaacgaaaccgcgaaatctcgaaaaacgcgacctctatcgccgtcacgacctcgtccccgcaacgccgaatcccgaaactaaccgcgaacgaaaaacgacgaaacgcgaaacgtcgtctccgcgtttccaacctattaaaactcctcgccgcgaaccgaaccttatacgcctctatccccgccgccctcaaacctctatccccgcgcccgccgtaatatcgaattacgcgatcccctttaataccaaccgaacgccgcgcgatccgaaaacaatacccaaaaaccgctaccccgccgacctcgccgcttcccgtacgcgacaaacgatacgcgaaacccgtaaaaaccttcctacctccaaccccgaaacccaattccccaccacctactaaccgaaacctcctacctcc

SEQ ID NO: 26317 - DNA, 639 bp, Artificial Sequence
  chemically treated genomic DNA (Homo sapiens) CpG-island No: 26317
attttcggcggtcgcgtttcgtttcggaattacgtttcgttttcgtgaaatgcgtttttagtagttacggtaacgtttagtttcgtttttttcgcgtatgcgttatgcgttattatcggtaagtaggggcgggagggggaattgcgcgtgcgtagagttttcgtttttttgatcgtagcggttagaggttttattgtagattcggaggtcgtggttgtggttcgcggcggtgttgtcgcgggcgttttggcgtagtttacgtaggggtttttgagggttcgcgaggtcgggaggttcgggggtcgggaggtttcggggtcgggaagtcggtggattttgtaggttagtggggagggtacgcgagattgggggtcgggagggttgacggttggtggcgcggggcgggttcgtggggaggaggttcggggttggtaggggcgggagggttggacggcgggggcggggcggaggagggggttcgtagacggggtcggcgtcgggtgttttcgtttttttggagttggggtcggggcgggagtcgcgtatgagagtttgggtttttagtcggggggcgtcgtcgagttttatatttgcggttttttgggtgtttttaattttggagtttcggcgagggggtat

SEQ ID NO: 26318 - DNA, 639 bp, Artificial Sequence
  chemically treated genomic DNA (Homo sapiens) CpG-island No: 26318
ataccccctcgccgaaactccaaaattaaaaacacccaaaaaaccgcaaatataaaactcgacgacgccccccgactaaaaacccaaactctcatacgcgactcccgccccgaccccaactccaaaaaaacgaaaacacccgacgccgaccccgtctacgaaccccctcctccgccccgcccccgccgtccaaccctcccgcccctaccaaccccgaacctcctccccacgaacccgccccgcgccaccaaccgtcaaccctcccgacccccaatctcgcgtaccctccccactaacctacaaaatccaccgacttcccgaccccgaaacctcccgacccccgaacctcccgacctcgcgaaccctcaaaaacccctacgtaaactacgccaaaacgcccgcgacaacaccgccgcgaaccacaaccacgacctccgaatctacaataaaacctctaaccgctacgatcaaaaaaacgaaaactctacgcacgcgcaattccccctcccgcccctacttaccgataataacgcataacgcatacgcgaaaaaaacgaaactaaacgttaccgtaactactaaaaacgcatttcacgaaaacgaaacgtaattccgaaacgaaacgcgaccgccgaaaat

SEQ ID NO: 26319 - DNA, 639 bp, Artificial Sequence
  chemically treated genomic DNA (Homo sapiens) CpG-island No: 26319
gtgttttttcgtcggggttttagggttgggggtatttaggaggtcgtaggtgtggagttcgacggcgtttttcgattagaaatttaggtttttatgcgcggttttcgtttcgattttagttttagaggggcgagagtattcggcgtcgatttcgtttacggattttttttttcgtttcgttttcgtcgtttagttttttcgtttttattagtttcgggttttttttttacggattcgtttcgcgttattagtcgttagttttttcggtttttagtttcgcgtattttttttattggtttgtagggtttatcgatttttcgatttcgggatttttcgattttcggatttttcggtttcgcggatttttaggagtttttgcgtgggttgcgttagggcgttcgcgatagtatcgtcgcgaattatagttacggttttcgggtttgtaatggaatttttagtcgttgcggttaggagggcggagattttgcgtacgcgtagttttttttttcgtttttgtttgtcggtgatggcgtataacgtatgcgcggggagggcggagttgggcgttgtcgtggttattgggaacgtattttacgggggcggggcgtggtttcggggcggggcgcggtcgtcggaagt

SEQ ID NO: 26320 - DNA, 639 bp, Artificial Sequence
  chemically treated genomic DNA (Homo sapiens) CpG-island No: 26320
acttccgacgaccgcgccccgccccgaaaccacgccccgcccccgtaaaatacgttcccaataaccacgacaacgcccaactccgccctccccgcgcatacgttatacgccatcaccgacaaacaaaaacgaaaaaaaaaactacgcgtacgcaaaatctccgccctcctaaccgcaacgactaaaaattccattacaaacccgaaaaccgtaactataattcgcgacgatactatcgcgaacgccctaacgcaacccacgcaaaaactcctaaaaatccgcgaaaccgaaaaatccgaaaatcgaaaaatcccgaaatcgaaaaatcgataaaccctacaaaccaataaaaaaaatacgcgaaactaaaaaccgaaaaaactaacgactaataacgcgaaacgaatccgtaaaaaaaaaacccgaaactaataaaaacgaaaaaactaaacgacgaaaacgaaacgaaaaaaaaaatccgtaaacgaaatcgacgccgaatactctcgcccctctaaaactaaaatcgaaacgaaaaccgcgcataaaaacctaaatttctaatcgaaaaacgccgtcgaactccacacctacgacctcctaaatacccccaaccctaaaaccccgacgaaaaaacac

SEQ ID NO: 26321 - DNA, 777 bp, Artificial Sequence
  chemically treated genomic DNA (Homo sapiens) CpG-island No: 26321
aaaggggcggggtcggcgggtagcgtgcggtagtgcggagtttttgagatcggcgggtatacgggggtttgtggttttcgtcgtagtagtggttgtcgtcgtcgtttggttttcgtcggtttgcgggaggcgggttatggcggcggcggtagtgagagttgtgaatgaatttttcgggtggacgagggaagaagaaaggtttcggcggcgttagtaattcggtgttttttaggttttcgtttttttgtttggttttcgtttttttcgtcgtcgggtcggttttttcgttcgagtcgtcgtataagcggaatttgtattattttttttattcgttgtttgtaggtttcgcgttgttgcgtttggtcgttttttatttggggttttttttcgtgtggttttgttagcgtttttttcgcgtttttatggtagttaagaggagtttcggggtcgcgttagtatttgtttcggtttcggtttcggcgtcggtgtcgggcggcgaggtcgagcgcgttcgagttttttataaataggttttcgagtatatttttattgttttgcgtatcgatgaggatgagaaaggtaattagggggttgggggagggggcggcggcgtcgggaagaaggcggtggggtcgtcgggggagggtaatatttgcgttttttttttgcgggaggggacggtgtattttcggaattgatatgtttcgggagattgttttttcgtaggtcggagttttattttttagtatttttaaaatttttttttttttagggtat

SEQ ID NO: 26322 - DNA, 777 bp, Artificial Sequence
  chemically treated genomic DNA (Homo sapiens) CpG-island No: 26322
ataccctaaaaaaaaaaaaattttaaaaatactaaaaaataaaactccgacctacgaaaaaacaatctcccgaaacatatcaattccgaaaatacaccgtcccctcccgcaaaaaaaaaacgcaaatattaccctcccccgacgaccccaccgccttcttcccgacgccgccgccccctcccccaaccccctaattacctttctcatcctcatcgatacgcaaaacaataaaaatatactcgaaaacctatttataaaaaactcgaacgcgctcgacctcgccgcccgacaccgacgccgaaaccgaaaccgaaacaaatactaacgcgaccccgaaactcctcttaactaccataaaaacgcgaaaaaaacgctaacaaaaccacacgaaaaaaaaccccaaataaaaaacgaccaaacgcaacaacgcgaaacctacaaacaacgaataaaaaaaataatacaaattccgcttatacgacgactcgaacgaaaaaaccgacccgacgacgaaaaaaacgaaaaccaaacaaaaaaacgaaaacctaaaaaacaccgaattactaacgccgccgaaacctttcttcttccctcgtccacccgaaaaattcattcacaactctcactaccgccgccgccataacccgcctcccgcaaaccgacgaaaaccaaacgacgacgacaaccactactacgacgaaaaccacaaacccccgtatacccgccgatctcaaaaactccgcactaccgcacgctacccgccgaccccgccccttt

SEQ ID NO: 26323 - DNA, 777 bp, Artificial Sequence
  chemically treated genomic DNA (Homo sapiens) CpG-island No: 26323
gtgttttgaaaggggagaggttttaagaatattagaagatgaggtttcgatttacgggaaagtagtttttcggggtatattaatttcgggggtgtatcgttttttttcgtagaaaagggacgtaggtgttgttttttttcggcgattttatcgtttttttttcggcgtcgtcgtttttttttttagttttttagttattttttttatttttatcgatgcgtagggtaatggagatgtattcgaaggtttgtttgtggaagattcggacgcgttcggtttcgtcgttcggtatcggcgtcggggtcgaggtcgaggtaggtgttggcgcggtttcggagttttttttggttgttatgagggcgcgggagaagcgttggtagagttatacgaagaggagttttaggtggaaggcgattaaacgtagtagcgcgaagtttataaatagcgggtaggagaaatagtataggtttcgtttatgcggcgattcgggcggaggggtcggttcggcggcgggaggggcgggggttaggtaagggggcggaggtttgggaggtatcgggttgttggcgtcgtcggagtttttttttttttttcgtttattcggagaatttatttatagtttttattgtcgtcgtcgttataattcgtttttcgtagatcgacgggaattaagcgacggcggtagttattgttacggcgggggttatagattttcgtgtgttcgtcggttttaggagtttcgtattgtcgtacgttgttcgtcggtttcgttttttt

SEQ ID NO: 26324 - DNA, 777 bp, Artificial Sequence
  chemically treated genomic DNA (Homo sapiens) CpG-island No: 26324
aaaaaaacgaaaccgacgaacaacgtacgacaatacgaaactcctaaaaccgacgaacacacgaaaatctataacccccgccgtaacaataactaccgccgtcgcttaattcccgtcgatctacgaaaaacgaattataacgacgacgacaataaaaactataaataaattctccgaataaacgaaaaaaaaaaaaaaactccgacgacgccaacaacccgatacctcccaaacctccgcccccttacctaacccccgcccctcccgccgccgaaccgacccctccgcccgaatcgccgcataaacgaaacctatactatttctcctacccgctatttataaacttcgcgctactacgtttaatcgccttccacctaaaactcctcttcgtataactctaccaacgcttctcccgcgccctcataacaaccaaaaaaaactccgaaaccgcgccaacacctacctcgacctcgaccccgacgccgataccgaacgacgaaaccgaacgcgtccgaatcttccacaaacaaaccttcgaatacatctccattaccctacgcatcgataaaaataaaaaaaataactaaaaaactaaaaaaaaaaacgacgacgccgaaaaaaaaacgataaaatcgccgaaaaaaaacaacacctacgtcccttttctacgaaaaaaaacgatacacccccgaaattaatataccccgaaaaactactttcccgtaaatcgaaacctcatcttctaatattcttaaaacctctcccctttcaaaacac

SEQ ID NO: 26325 - DNA, 883 bp, Artificial Sequence
  chemically treated genomic DNA (Homo sapiens) CpG-island No: 26325
gtggggcggggtggaagaggtagttcggtcggttgggtttcggggcgggtttttcgttcgtacgttttttaatttatttattcgggttttcgcggcggcggggcgttttatcggtcgcggggcggtttttttttttagggtggtttgagcgcggggcggaggtcgtttttttttttttttcgggcgtcgtcgggttaggggatcgaagtttttttcgtcgttgagggttgggggacgaagtagggggttatggattatgatttttaataattttttttagtttttaggaggtcgggttcggtagcggggggttcgagggcgggcgggcggattagcggcgacgacgcggggatggcggatcggagggtggttcgtgtcgcgtaacggtagacggtatgggttgtcgtcggtagacggttttgtttttttggtttcgcgtcgttcgagttacggtttgttttagttaataattcgtattttttcgcgtttcggttcgaagtgagtaaagttaatgaaaagttttatttttagtaattttgcgtacggattcggtttttttatttttgcgtgatgcgttttttcgttttgtaggggcggggttagggttcggtcgggattattttttagttagtttcgcgttttagttcgttggtatttcgcggagtagtttttgtgtttttttgtgttcgtcggtcgtgcgttcggtttttcgtttttttttttttgttatagcgtcgcgtcgtattttttttttttatttttatattattttgaatttgtgcgcgtcgtgtgaggtgtttttttaggggcgtttcgtgagggtcggggattatttggggtcgggttgtttacgagtcgggtatagtgtattttttttttagtt

SEQ ID NO: 26326 - DNA, 883 bp, Artificial Sequence
  chemically treated genomic DNA (Homo sapiens) CpG-island No: 26326
aactaaaaaaaaaatacactatacccgactcgtaaacaacccgaccccaaataatccccgaccctcacgaaacgcccctaaaaaaacacctcacacgacgcgcacaaattcaaaataatataaaaataaaaaaaaaaaatacgacgcgacgctataacaaaaaaaaaaaaacgaaaaaccgaacgcacgaccgacgaacacaaaaaaacacaaaaactactccgcgaaataccaacgaactaaaacgcgaaactaactaaaaaataatcccgaccgaaccctaaccccgcccctacaaaacgaaaaaacgcatcacgcaaaaataaaaaaaccgaatccgtacgcaaaattactaaaaataaaacttttcattaactttactcacttcgaaccgaaacgcgaaaaaatacgaattattaactaaaacaaaccgtaactcgaacgacgcgaaaccaaaaaaacaaaaccgtctaccgacgacaacccataccgtctaccgttacgcgacacgaaccaccctccgatccgccatccccgcgtcgtcgccgctaatccgcccgcccgccctcgaaccccccgctaccgaacccgacctcctaaaaactaaaaaaaattattaaaaatcataatccataaccccctacttcgtcccccaaccctcaacgacgaaaaaaacttcgatcccctaacccgacgacgcccgaaaaaaaaaaaaaaacgacctccgccccgcgctcaaaccaccctaaaaaaaaaaaccgccccgcgaccgataaaacgccccgccgccgcgaaaacccgaataaataaattaaaaaacgtacgaacgaaaaacccgccccgaaacccaaccgaccgaactacctcttccaccccgccccac

SEQ ID NO: 26327 - DNA, 883 bp, Artificial Sequence
  chemically treated genomic DNA (Homo sapiens) CpG-island No: 26327
aattaaagggagagtgtattgtgttcggttcgtgagtaattcggttttaggtggttttcggtttttacggagcgtttttgggagaatattttatacgacgcgtataagtttagagtggtatgggaatgaaggaaaggagtgcggcgcggcgttgtgatagggaggggaagacggggagtcggacgtacgatcggcgagtatagaagggtataggagttgtttcgcgagatattagcgagttgaggcgcggggttggttgggaagtagtttcggtcgggttttggtttcgtttttgtagggcggagggacgtattacgtaggggtggggaagtcggattcgtgcgtagggttgttaagggtgaaattttttattgattttgtttatttcgggtcggggcgcgggaaggtgcgggttgttggttgaggtaagtcgtggttcgggcgacgcggggttaggagggtaggatcgtttgtcggcgatagtttatatcgtttgtcgttgcgcgatacgaattatttttcgattcgttattttcgcgtcgtcgtcgttagttcgttcgttcgttttcgggtttttcgttgtcgagttcgattttttaagagttgaaagaaattattgagagttatagtttatagttttttgtttcgttttttaatttttaacgacgaaaaggatttcggttttttggttcggcgacgttcgggaaggaaaggagagcgattttcgtttcgcgtttaggttattttggagggagaagtcgtttcgcggtcggtagagcgtttcgtcgtcgcggagattcgagtgagtgagttggggggcgtgcgggcggggggttcgtttcgagatttagtcggtcggattattttttttatttcgttttat

SEQ ID NO: 26328 - DNA, 883 bp, Artificial Sequence
  chemically treated genomic DNA (Homo sapiens) CpG-island No: 26328
ataaaacgaaataaaaaaaataatccgaccgactaaatctcgaaacgaaccccccgcccgcacgccccccaactcactcactcgaatctccgcgacgacgaaacgctctaccgaccgcgaaacgacttctccctccaaaataacctaaacgcgaaacgaaaatcgctctcctttccttcccgaacgtcgccgaaccaaaaaaccgaaatccttttcgtcgttaaaaattaaaaaacgaaacaaaaaactataaactataactctcaataatttctttcaactcttaaaaaatcgaactcgacaacgaaaaacccgaaaacgaacgaacgaactaacgacgacgacgcgaaaataacgaatcgaaaaataattcgtatcgcgcaacgacaaacgatataaactatcgccgacaaacgatcctaccctcctaaccccgcgtcgcccgaaccacgacttacctcaaccaacaacccgcaccttcccgcgccccgacccgaaataaacaaaatcaataaaaaatttcacccttaacaaccctacgcacgaatccgacttccccacccctacgtaatacgtccctccgccctacaaaaacgaaaccaaaacccgaccgaaactacttcccaaccaaccccgcgcctcaactcgctaatatctcgcgaaacaactcctatacccttctatactcgccgatcgtacgtccgactccccgtcttcccctccctatcacaacgccgcgccgcactcctttccttcattcccataccactctaaacttatacgcgtcgtataaaatattctcccaaaaacgctccgtaaaaaccgaaaaccacctaaaaccgaattactcacgaaccgaacacaatacactctccctttaatt

SEQ ID NO: 26329 - DNA, 529 bp, Artificial Sequence
  chemically treated genomic DNA (Homo sapiens) CpG-island No: 26329
acgagtatcgcgggggaggggagggagttattatgttcgtcggaaatttttcgttgagtcgttcgttttgtatttgtttcggagtttatggttcggacgtttgttcgagtcgtttttcggggttttttttttagtttcgagcgtttggtcgtgttcgcggcgatagtatcgtttcgttacggtttttgcgggagggggaattgaggggacgacgcgggttttggaaatatttcggattcgtttcgggtaggtatgagtttttcgagcgttttgtgatttttcggggggtttaacgtcgaaagaaaggcgagggagattttggggtttgggttacgttgtgcgggagtaagaggagtcgaggacgaggttgacggtcgtgaaattagtcgagtgttataaaggattttttttttatcgtttttggcgtttttttttttgtagtttggagggtcggttttggttttgcgtaggcgcgcgggcgtagttttttttttaatttttgtttgttttttttggttagcgattttag

SEQ ID NO: 26330 - DNA, 529 bp, Artificial Sequence
  chemically treated genomic DNA (Homo sapiens) CpG-island No: 26330
ctaaaatcgctaaccaaaaaaaacaaacaaaaattaaaaaaaaaactacgcccgcgcgcctacgcaaaaccaaaaccgaccctccaaactacaaaaaaaaaaacgccaaaaacgataaaaaaaaaatcctttataacactcgactaatttcacgaccgtcaacctcgtcctcgactcctcttactcccgcacaacgtaacccaaaccccaaaatctccctcgcctttctttcgacgttaaaccccccgaaaaatcacaaaacgctcgaaaaactcatacctacccgaaacgaatccgaaatatttccaaaacccgcgtcgtcccctcaattccccctcccgcaaaaaccgtaacgaaacgatactatcgccgcgaacacgaccaaacgctcgaaactaaaaaaaaaaccccgaaaaacgactcgaacaaacgtccgaaccataaactccgaaacaaatacaaaacgaacgactcaacgaaaaatttccgacgaacataataactccctcccctcccccgcgatactcgt

SEQ ID NO: 26331 - DNA, 529 bp, Artificial Sequence
  chemically treated genomic DNA (Homo sapiens) CpG-island No: 26331
ttggggtcgttggttagaaagagtaaataagagttgggagaggggttgcgttcgcgcgtttgcgtagagttagagtcggttttttaggttgtaaggaaaggagcgttagaggcggtgaggggaaggttttttgtggtattcggttagttttacggtcgttagtttcgttttcggttttttttattttcgtatagcgtggtttaggttttagagtttttttcgtttttttttcgacgttgagtttttcgaggaattataaggcgttcggaagatttatgtttgttcgaaacgggttcgaaatgtttttagagttcgcgtcgtttttttagttttttttttcgtagaggtcgtaacggggcgatgttatcgtcgcggatacggttagacgttcggagttggagggaaggtttcgggaaacggttcgggtaaacgttcgaattatgggtttcgaggtaggtgtagggcggacgatttagcggggggttttcggcgggtatggtgatttttttttttttttcgcgatattcgt

SEQ ID NO: 26332 - DNA, 529 bp, Artificial Sequence
  chemically treated genomic DNA (Homo sapiens) CpG-island No: 26332
acgaatatcgcgaaaaaaaaaaaaaaatcaccatacccgccgaaaaccccccgctaaatcgtccgccctacacctacctcgaaacccataattcgaacgtttacccgaaccgtttcccgaaaccttccctccaactccgaacgtctaaccgtatccgcgacgataacatcgccccgttacgacctctacgaaaaaaaaaactaaaaaaacgacgcgaactctaaaaacatttcgaacccgtttcgaacaaacataaatcttccgaacgccttataattcctcgaaaaactcaacgtcgaaaaaaaaacgaaaaaaactctaaaacctaaaccacgctatacgaaaataaaaaaaaccgaaaacgaaactaacgaccgtaaaactaaccgaataccacaaaaaaccttcccctcaccgcctctaacgctcctttccttacaacctaaaaaaccgactctaactctacgcaaacgcgcgaacgcaacccctctcccaactcttatttactctttctaaccaacgaccccaa

SEQ ID NO: 26333 - DNA, 747 bp, Artificial Sequence
  chemically treated genomic DNA (Homo sapiens) CpG-island No: 26333
gcgtatagaaatacggacgcgtagaggcggtttcggagacgtttatttttttcggttcggtttcgttttcgggttttatttatcgaggtcgtagatttcgcggcgtaggttaagacggtcgcgttttttcgttatggtacgtagtatgtgttgtagcgagcgtttttcggtttcggcgtcgttcgtaggttcgggggcggcggcggcggggagggcgggcggttcggttcgtagttcgtcgcgagtattaaggaagttatagttcgtttttgtgcgcgtcgtcgtcgtcgtcgtcgtcgttattattcgttaaatatagtatcggcgagcgtattttcgcgtcgtcgtcgttcgcgcgttttcggtttcgttcgtttcgtttcggttcggttcggtttcggttcggtttcgtttttttttcgtttcggtttcgtttttgttttttttcgtttcgtttttgaacggttcggatttatttcggttttttggtttcgttttttgattttttttgtttcgtttatttttaaacggttagttttcgttaattttcggatgtttaggatagttttttttaaatcgttcgcggggtttcgtttttatttaaggttttaaacgttttattaacgggattacgtttttgagtttttttcgtcgtttttttagggtattttttttttttttcgttgttattttacgggatgtgtattttgttattcgttttgtgcgttgttatttttattaagtttt

SEQ ID NO: 26334 - DNA, 747 bp, Artificial Sequence
  chemically treated genomic DNA (Homo sapiens) CpG-island No: 26334
aaaacttaataaaaataacaacgcacaaaacgaataacaaaatacacatcccgtaaaataacaacgaaaaaaaaaaaaaataccctaaaaaaacgacgaaaaaaactcaaaaacgtaatcccgttaataaaacgtttaaaaccttaaataaaaacgaaaccccgcgaacgatttaaaaaaaactatcctaaacatccgaaaattaacgaaaactaaccgtttaaaaataaacgaaacaaaaaaaatcaaaaaacgaaaccaaaaaaccgaaataaatccgaaccgttcaaaaacgaaacgaaaaaaaacaaaaacgaaaccgaaacgaaaaaaaaacgaaaccgaaccgaaaccgaaccgaaccgaaacgaaacgaacgaaaccgaaaacgcgcgaacgacgacgacgcgaaaatacgctcgccgatactatatttaacgaataataacgacgacgacgacgacgacgacgcgcacaaaaacgaactataacttccttaatactcgcgacgaactacgaaccgaaccgcccgccctccccgccgccgccgcccccgaacctacgaacgacgccgaaaccgaaaaacgctcgctacaacacatactacgtaccataacgaaaaaacgcgaccgtcttaacctacgccgcgaaatctacgacctcgataaataaaacccgaaaacgaaaccgaaccgaaaaaaataaacgtctccgaaaccgcctctacgcgtccgtatttctatacgc

SEQ ID NO: 26335 - DNA, 747 bp, Artificial Sequence
  chemically treated genomic DNA (Homo sapiens) CpG-island No: 26335
gggatttggtggaggtggtaacgtatagggcgggtgataaagtatatatttcgtggggtagtagcgggggaggggagaggtgttttgaaggggcggcgggaggggtttagaggcgtgatttcgttggtggggcgtttaggattttgggtggaggcgggatttcgcgagcggtttgagggaggttgttttgggtattcgaagattggcggagattggtcgtttggaagtgggcggggtaagggaggttagggggcggggttagggagtcggggtgggttcgggtcgtttagaggcggggcgggaggggataggggcggggtcggggcggggaaggggcggggtcggatcggggtcgggtcgggtcggggcggggcgagcggagtcgggggcgcgcgggcggcggcggcgcggaggtgcgttcgtcggtgttgtgtttggcgggtggtggcggcggcggcggcgacggcgacgcgtatagaggcggattgtggtttttttggtgttcgcggcgggttgcgggtcgggtcgttcgtttttttcgtcgtcgtcgttttcgagtttgcgggcggcgtcgaggtcgaggagcgttcgttgtagtatatgttgcgtgttatagcggaggagcgcggtcgttttagtttgcgtcgcgaggtttgcggtttcggtgagtgggattcgggggcgaggtcgggtcgggagaggtgagcgttttcggggtcgtttttgcgcgttcgtgtttttgtgcgt

SEQ ID NO: 26336 - DNA, 747 bp, Artificial Sequence
  chemically treated genomic DNA (Homo sapiens) CpG-island No: 26336
acgcacaaaaacacgaacgcgcaaaaacgaccccgaaaacgctcacctctcccgacccgacctcgcccccgaatcccactcaccgaaaccgcaaacctcgcgacgcaaactaaaacgaccgcgctcctccgctataacacgcaacatatactacaacgaacgctcctcgacctcgacgccgcccgcaaactcgaaaacgacgacgacgaaaaaaacgaacgacccgacccgcaacccgccgcgaacaccaaaaaaaccacaatccgcctctatacgcgtcgccgtcgccgccgccgccgccaccacccgccaaacacaacaccgacgaacgcacctccgcgccgccgccgcccgcgcgcccccgactccgctcgccccgccccgacccgacccgaccccgatccgaccccgccccttccccgccccgaccccgcccctatcccctcccgccccgcctctaaacgacccgaacccaccccgactccctaaccccgccccctaacctcccttaccccgcccacttccaaacgaccaatctccgccaatcttcgaatacccaaaacaacctccctcaaaccgctcgcgaaatcccgcctccacccaaaatcctaaacgccccaccaacgaaatcacgcctctaaacccctcccgccgccccttcaaaacacctctcccctcccccgctactaccccacgaaatatatactttatcacccgccctatacgttaccacctccaccaaatccc

SEQ ID NO: 26337 - DNA, 686 bp, Artificial Sequence
  chemically treated genomic DNA (Homo sapiens) CpG-island No: 26337
gtaaagtgttttcgttttttttttgtaaatgaggaaacgggacgcgcggttcgtcgggttaggtagggttaggacgcggattttaggtttaagcgttttttagcgtaagttttttttcgtatattcgatcgcgtttgcgttggagatttcgggggcgtggttttttcggtgggcgggatcgtggttatcgaggtgggcggtgttagaggatttggcggcggggcggggcggggcgcgcgttttggtttcgttttttttcggggcggggttttcggggatcgcggggtcgttggtttcgggacggaacgtttacgcggttggggcgggcgcgcgggggaagggtttgcggcggcgtcgttgtcggttaacgcggaggggcgtttggaggcggcgtggcgttcgttttggtttcgatttcggttttcgttttcgtttttagttcgcgtgtttgcgtagtttttttttcgagaattatttttttgtttcgtttagcgttaggggtgcgcggtcgtcgagagatttcggaggcgtagtcggttgcggaggcgaagaggtggtagcgcgagttgggattagcgtttcggaggcgtcgtaggtgagggggcggggcgggttcgcggtttttgtattcggagtttttggggatttcgagatttttaggattcgtttcggtttcggggttattt

SEQ ID NO: 26338 - DNA, 686 bp, Artificial Sequence
  chemically treated genomic DNA (Homo sapiens) CpG-island No: 26338
aaataaccccgaaaccgaaacgaatcctaaaaatctcgaaatccccaaaaactccgaatacaaaaaccgcgaacccgccccgccccctcacctacgacgcctccgaaacgctaatcccaactcgcgctaccacctcttcgcctccgcaaccgactacgcctccgaaatctctcgacgaccgcgcacccctaacgctaaacgaaacaaaaaaataattctcgaaaaaaaaactacgcaaacacgcgaactaaaaacgaaaacgaaaaccgaaatcgaaaccaaaacgaacgccacgccgcctccaaacgcccctccgcgttaaccgacaacgacgccgccgcaaacccttcccccgcgcgcccgccccaaccgcgtaaacgttccgtcccgaaaccaacgaccccgcgatccccgaaaaccccgccccgaaaaaaaacgaaaccaaaacgcgcgccccgccccgccccgccgccaaatcctctaacaccgcccacctcgataaccacgatcccgcccaccgaaaaaaccacgcccccgaaatctccaacgcaaacgcgatcgaatatacgaaaaaaaacttacgctaaaaaacgcttaaacctaaaatccgcgtcctaaccctacctaacccgacgaaccgcgcgtcccgtttcctcatttacaaaaaaaaaacgaaaacactttac

SEQ ID NO: 26339 - DNA, 686 bp, Artificial Sequence
  chemically treated genomic DNA (Homo sapiens) CpG-island No: 26339
gggtggtttcggggtcggggcggattttgaggatttcggggtttttaggggtttcggatgtagggatcgcgggttcgtttcgtttttttatttgcggcgttttcgagacgttggttttagttcgcgttgttattttttcgttttcgtagtcggttacgttttcggggtttttcggcggtcgcgtatttttgacgttgggcggggtaaggggatggttttcggggaggggattgcgtaggtacgcgggttagaagcgagagcgagagtcggagtcggagttagagcggacgttacgtcgtttttaggcgttttttcgcgttagtcggtagcggcgtcgtcgtaaatttttttttcgcgcgttcgttttagtcgcgtgaacgtttcgtttcgaaattaacggtttcgcggttttcggaggtttcgtttcggggaagggcgaagttaggacgcgcgtttcgtttcgtttcgtcgttagattttttggtatcgtttatttcggtgattacggtttcgtttatcggggaggttacgttttcggggtttttagcgtaggcgcggtcggatgtgcgggggagggtttgcgttggggagcgtttgggtttagagttcgcgttttagttttatttggttcggcgagtcgcgcgtttcgtttttttatttgtagaaagggggcgggagtattttgt

SEQ ID NO: 26340 - DNA, 686 bp, Artificial Sequence
  chemically treated genomic DNA (Homo sapiens) CpG-island No: 26340
acaaaatactcccgccccctttctacaaataaaaaaacgaaacgcgcgactcgccgaaccaaataaaactaaaacgcgaactctaaacccaaacgctccccaacgcaaaccctcccccgcacatccgaccgcgcctacgctaaaaaccccgaaaacgtaacctccccgataaacgaaaccgtaatcaccgaaataaacgataccaaaaaatctaacgacgaaacgaaacgaaacgcgcgtcctaacttcgcccttccccgaaacgaaacctccgaaaaccgcgaaaccgttaatttcgaaacgaaacgttcacgcgactaaaacgaacgcgcgaaaaaaaaatttacgacgacgccgctaccgactaacgcgaaaaaacgcctaaaaacgacgtaacgtccgctctaactccgactccgactctcgctctcgcttctaacccgcgtacctacgcaatcccctccccgaaaaccatccccttaccccgcccaacgtcaaaaatacgcgaccgccgaaaaaccccgaaaacgtaaccgactacgaaaacgaaaaaataacaacgcgaactaaaaccaacgtctcgaaaacgccgcaaataaaaaaacgaaacgaacccgcgatccctacatccgaaacccctaaaaaccccgaaatcctcaaaatccgccccgaccccgaaaccaccc

SEQ ID NO: 26341 - DNA, 842 bp, Artificial Sequence
  chemically treated genomic DNA (Homo sapiens) CpG-island No: 26341
tttcgttttttcgttttatttttttttttttcgtttatttttttttgggtttttttttcggttattcgttttgtttcggtttttgtaattttgtttttcgttttttttttttttttttttcgtttgcgtttttttcgtggggtcgtggtaatttcgtgtttcgtttgtttaatgagaatacggtttggggcggggcgcggttaggatcggagcggaagtggcgatcggagcggaagtggagttatcgttatcgtcgtcgtcgatttcggagtcggggtagtcgtcgtcgtcgtcgtcgttgtagttattgtaggtatcgttgtcgtcgtttgagtagtgggtttaggaaggaagaggttatttcgttcggagtttcgttcggaagggtttttgttttttgtagtttttttacggtgagtgcggcgcggggttcgatcggggttttcgggggtttaaattcgaagtttttttttggttgttgcgacgacggcggtttagtgggtgggtttcgtggggtagcggcgcgttgtttttttcgtttcgcgcggtcgtcggcggcgaggttagatttcgtagcggtttttttttgttttcggggtcgggttttttattttttggagaggttcgggtcgtttgaggttttgtcggtcgggcggggtgtaatttcgtattgtgtcgtaagggatagcggagtcggggatttcggatttttttttattatttgtttcgggttttacgcgatttttttttgcgttttggtcggtaagaacgttttttttagttttgttatttttgtttcgtgttttttggtttttagaaattaaaatttaattaaacgcgga

SEQ ID NO: 26342 - DNA, 842 bp, Artificial Sequence
  chemically treated genomic DNA (Homo sapiens) CpG-island No: 26342
tccgcgtttaattaaattttaatttctaaaaaccaaaaaacacgaaacaaaaataacaaaactaaaaaaaacgttcttaccgaccaaaacgcaaaaaaaaatcgcgtaaaacccgaaacaaataataaaaaaaaatccgaaatccccgactccgctatcccttacgacacaatacgaaattacaccccgcccgaccgacaaaacctcaaacgacccgaacctctccaaaaaataaaaaacccgaccccgaaaacaaaaaaaaaccgctacgaaatctaacctcgccgccgacgaccgcgcgaaacgaaaaaaacaacgcgccgctaccccacgaaacccacccactaaaccgccgtcgtcgcaacaaccaaaaaaaaacttcgaatttaaacccccgaaaaccccgatcgaaccccgcgccgcactcaccgtaaaaaaactacaaaaaacaaaaacccttccgaacgaaactccgaacgaaataacctcttccttcctaaacccactactcaaacgacgacaacgatacctacaataactacaacgacgacgacgacgacgactaccccgactccgaaatcgacgacgacgataacgataactccacttccgctccgatcgccacttccgctccgatcctaaccgcgccccgccccaaaccgtattctcattaaacaaacgaaacacgaaattaccacgaccccacgaaaaaaacgcaaacgaaaaaaaaaaaaaaaaaaaacgaaaaacaaaattacaaaaaccgaaacaaaacgaataaccgaaaaaaaaacccaaaaaaaaataaacgaaaaaaaaaaaaataaaacgaaaaaacgaaa

SEQ ID NO: 26343 - DNA, 842 bp, Artificial Sequence
  chemically treated genomic DNA (Homo sapiens) CpG-island No: 26343
ttcgcgtttgattaaattttaatttttggaaattagaaagtacggagtagaggtgatagggttgaaggggacgtttttgtcgattaagacgtagggaggggtcgcgtggggttcgaagtagatagtgagggagggttcgggattttcggtttcgttgttttttacggtatagtacggagttgtatttcgttcggtcggtaggattttaggcggttcgagtttttttaagaggtaaagggttcggtttcggaaatagggaggggtcgttgcgaggtttggtttcgtcgtcggcggtcgcgcggagcgaaagaggtagcgcgtcgttattttacggggtttatttattgggtcgtcgtcgtcgtagtagttagagaggggtttcgagtttgggttttcgggggtttcggtcggatttcgcgtcgtatttatcgtgggagggttgtagggaataaagattttttcgagcgaagtttcgagcgagatgatttttttttttttaagtttattatttaggcggcggtagcggtgtttgtagtggttgtagcggcggcggcggcggcgattatttcggtttcggaatcggcggcggcggtggcggtagttttattttcgtttcgatcgttattttcgtttcggttttggtcgcgtttcgttttaaatcgtgtttttattgggtaagcgaggtacggggttgttacggttttacgggaggggcgtagacggaagggaggaggaagaagagcgaaaggtagggttgtaggggtcggggtagggcggatggtcgggggagggatttaggaggaggtgggcggagaagaaggaaatggggcgggggagcggga

SEQ ID NO: 26344 - DNA, 842 bp, Artificial Sequence
  chemically treated genomic DNA (Homo sapiens) CpG-island No: 26344
tcccgctcccccgccccatttccttcttctccgcccacctcctcctaaatccctcccccgaccatccgccctaccccgacccctacaaccctacctttcgctcttcttcctcctcccttccgtctacgcccctcccgtaaaaccgtaacaaccccgtacctcgcttacccaataaaaacacgatttaaaacgaaacgcgaccaaaaccgaaacgaaaataacgatcgaaacgaaaataaaactaccgccaccgccgccgccgattccgaaaccgaaataatcgccgccgccgccgccgctacaaccactacaaacaccgctaccgccgcctaaataataaacttaaaaaaaaaaaaatcatctcgctcgaaacttcgctcgaaaaaatctttattccctacaaccctcccacgataaatacgacgcgaaatccgaccgaaacccccgaaaacccaaactcgaaacccctctctaactactacgacgacgacgacccaataaataaaccccgtaaaataacgacgcgctacctctttcgctccgcgcgaccgccgacgacgaaaccaaacctcgcaacgacccctccctatttccgaaaccgaaccctttacctcttaaaaaaactcgaaccgcctaaaatcctaccgaccgaacgaaatacaactccgtactataccgtaaaaaacaacgaaaccgaaaatcccgaaccctccctcactatctacttcgaaccccacgcgacccctccctacgtcttaatcgacaaaaacgtccccttcaaccctatcacctctactccgtactttctaatttccaaaaattaaaatttaatcaaacgcgaa

SEQ ID NO: 26345 - DNA, 2050 bp, Artificial Sequence
  chemically treated genomic DNA (Homo sapiens) CpG-island No: 26345
tcgcgcgggtgcgtcgagttcgtttttcgtttgtagcgaaggtttcggcgttagcgcggtcggttttttttttttcgttttagtttagggtttattttgggcgagggtttgatttggcggtttatacgtagttcggtggtttcgattttgagtaggttcgcggtgtatatatagaatcgaattcgaatacgtatacgtatattttacgcgcggagggttcgtaacgtcgcgtatagatagttttttcgcgtcggcggcgaaacgttcggttttgttcgtattaagaggggttagaggttacgggaggtcgaggtcgagggtattcggtagcggagcgcggcgggaagggggcgttttatttaggggtcgggaacggtcgatggcggggcgtaggagcgttcggtataaattcgggagttgtttttttttggtgtatagagcgcggggtttacggtcgcggggtagttgttgggacgagtcgggcgggtttcgagtcgagggagcggagtttcggaaaatcgtcgcgagtttcgcgcgtattcggtttacgtttgggggttcggtttcgggagttgcgaggtcggtttggagggattcggtttcggaggcgcggacggaacggcgtgggtcgggcggggatttcgaggggagcggttcgggcgttttttttgcgggtgggcgggcgggcggtttgtagaggagggggcggcgggagtaggcggcgtcgatttcgtttcgcgcggcgttggtcgtttcgttgtagtcggggtttcggcggggttgcgggagtcgcgttggtcgggtcgcggtttcgtttgtttttatttgttcgttcgttttatcgcggatggcgtcggcgatcggggttgcggggtgcgcgcgggttgttcggaggcgttgtggcgggcgagggcgcgggtggttggagtattcggttcgcggtaaggatcggttggcggtaggcggggcgcgcggagttcggggttcggtcgagacggagcgaaagagaaagtaagatcgaggatcgggtagtttggtcggggtagttttgttttcgtcgggttcggttgtgttaggtaagcgggtatagaggggtttacgcgggttcgagggcggtagcggcgggtcgggaggtggtcgggtgggttttttttgtcggaggtattgtcgtttcggcggttcgcgtaggttgtcggcgttttagaggagcgttttttattacgcggggtatagtcggggataaattttacgattatagtttttagttcgggtaaaagtttttattttgttttttaagtggttgcggttgtttcgtcgtcgttatttttgtttttgcgttcgcggagtcgggtgggcgtcggttcgcgttttttttttcgttttttttcggttcggggttttttttttttgcgttcggttggcggacgttaaaggcggtgttttagcgtttattattttaaaagttcggaatatgatttgattaggattgagagttattcggagagagagagggagagagcgagcggggaggaaaaagttgtttttttttttcgttaatttttcgttaatttttatttttcgtttttttttattttcggtttttttttttcgttttttttttcggtttttatcgcgcgtttcgggttttcgggttcgagcgtttgatattggtggggggggagggggtttcgcggggagggggtcggcgttttcggggagcgcgcggttcgggcgtttcgagttttcgcgtcgagttcggtcgtttcggagcgcgggaggcggagtagtttttcgggtcgcgcggtcgagtcgggggttcggagtcgtaggcgcgtcggtcgcgtttcgacgcgtatttttggttcgggcgtttcggttcggcggttcgggtttcggcggcgcggcgcggtcgagcgcgggagatttatttttggttagttttttcgttttcgttttggatcgtatggtgtcggttcgcggaatttttttttttttttttgagtttagaagtagttatatattatttttatttttttagtattgttagttt

SEQ ID NO: 26346 - DNA, 2050 bp, Artificial Sequence
  chemically treated genomic DNA (Homo sapiens) CpG-island No: 26346
aaactaacaatactaaaaaaataaaaataatatataactacttctaaactcaaaaaaaaaaaaaaaaattccgcgaaccgacaccatacgatccaaaacgaaaacgaaaaaactaaccaaaaataaatctcccgcgctcgaccgcgccgcgccgccgaaacccgaaccgccgaaccgaaacgcccgaaccaaaaatacgcgtcgaaacgcgaccgacgcgcctacgactccgaacccccgactcgaccgcgcgacccgaaaaactactccgcctcccgcgctccgaaacgaccgaactcgacgcgaaaactcgaaacgcccgaaccgcgcgctccccgaaaacgccgaccccctccccgcgaaaccccctccccccccaccaatatcaaacgctcgaacccgaaaacccgaaacgcgcgataaaaaccgaaaaaaaaaacgaaaaaaaaaaaccgaaaataaaaaaaaacgaaaaataaaaattaacgaaaaattaacgaaaaaaaaaaacaactttttcctccccgctcgctctctccctctctctctccgaataactctcaatcctaatcaaatcatattccgaacttttaaaataataaacgctaaaacaccgcctttaacgtccgccaaccgaacgcaaaaaaaaaaaaccccgaaccgaaaaaaaacgaaaaaaaaaacgcgaaccgacgcccacccgactccgcgaacgcaaaaacaaaaataacgacgacgaaacaaccgcaaccacttaaaaaacaaaataaaaacttttacccgaactaaaaactataatcgtaaaatttatccccgactataccccgcgtaataaaaaacgctcctctaaaacgccgacaacctacgcgaaccgccgaaacgacaatacctccgacaaaaaaaacccacccgaccacctcccgacccgccgctaccgccctcgaacccgcgtaaacccctctatacccgcttacctaacacaaccgaacccgacgaaaacaaaactaccccgaccaaactacccgatcctcgatcttactttctctttcgctccgtctcgaccgaaccccgaactccgcgcgccccgcctaccgccaaccgatccttaccgcgaaccgaatactccaaccacccgcgccctcgcccgccacaacgcctccgaacaacccgcgcgcaccccgcaaccccgatcgccgacgccatccgcgataaaacgaacgaacaaataaaaacaaacgaaaccgcgacccgaccaacgcgactcccgcaaccccgccgaaaccccgactacaacgaaacgaccaacgccgcgcgaaacgaaatcgacgccgcctactcccgccgccccctcctctacaaaccgcccgcccgcccacccgcaaaaaaaacgcccgaaccgctcccctcgaaatccccgcccgacccacgccgttccgtccgcgcctccgaaaccgaatccctccaaaccgacctcgcaactcccgaaaccgaacccccaaacgtaaaccgaatacgcgcgaaactcgcgacgattttccgaaactccgctccctcgactcgaaacccgcccgactcgtcccaacaactaccccgcgaccgtaaaccccgcgctctatacaccaaaaaaaaacaactcccgaatttataccgaacgctcctacgccccgccatcgaccgttcccgacccctaaataaaacgcccccttcccgccgcgctccgctaccgaataccctcgacctcgacctcccgtaacctctaacccctcttaatacgaacaaaaccgaacgtttcgccgccgacgcgaaaaaactatctatacgcgacgttacgaaccctccgcgcgtaaaatatacgtatacgtattcgaattcgattctatatatacaccgcgaacctactcaaaatcgaaaccaccgaactacgtataaaccgccaaatcaaaccctcgcccaaaataaaccctaaactaaaacgaaaaaaaaaaaaccgaccgcgctaacgccgaaaccttcgctacaaacgaaaaacgaactcgacgcacccgcgcga

SEQ ID NO: 26347 - DNA, 2050 bp, Artificial Sequence
  chemically treated genomic DNA (Homo sapiens) CpG-island No: 26347
aaattgataatgttggggagatgaagatagtgtgtggttgtttttggatttaaggaggaggagagagatttcgcgagtcgatattatgcgatttaaggcgagggcgaggaagttagttaaaagtaagtttttcgcgttcggtcgcgtcgcgtcgtcggggttcgggtcgtcgggtcggggcgttcgggttaggggtgcgcgtcggggcgcggtcggcgcgtttgcggtttcgggttttcggttcggtcgcgcggttcggggggttgtttcgtttttcgcgtttcggggcgatcgggttcggcgcggaggttcggggcgttcgggtcgcgcgtttttcgaaggcgtcggtttttttttcgcggaattttttttttttttattagtgttaggcgttcgggttcgggaattcgaggcgcgcggtgggggtcggggaggggggcggagggggagggtcgggggtggaggggagcgaaaagtgaaagttagcgaaaagttgacgaaaggggagagtaattttttttttttcgttcgtttttttttttttttttttcgagtggtttttagttttggttaaattatatttcgggtttttgaaatagtgggcgttagagtatcgtttttggcgttcgttagtcgggcgtagaggagggagatttcgagtcggggaggggcggaggagggggcgcgggtcggcgtttattcggtttcgcgggcgtaggggtaggggtggcgacggcgggatagtcgtagttatttggggagtaaaatggagatttttgttcgggttgggaattgtggtcgtgaagtttattttcggttgtgtttcgcgtggtggagggcgtttttttgggacgtcggtagtttgcgcgggtcgtcggggcgatagtgttttcgataggagggatttattcggttatttttcgattcgtcgttgtcgttttcgggttcgcgtggatttttttgtattcgtttgtttggtatagtcgggttcggcggggatagagttgtttcggttaggttgttcggttttcggttttattttttttttcgtttcgtttcggtcgagtttcgggtttcgcgcgtttcgtttgtcgttagtcggtttttgtcgcgggtcgggtgttttagttattcgcgttttcgttcgttatagcgttttcgagtagttcgcgcgtatttcgtagtttcggtcgtcggcgttattcgcggtgaggcgggcgggtaggtgaggataggcggagtcgcggttcggttagcgcggttttcgtagtttcgtcgaagtttcggttgtagcgaagcggttagcgtcgcgcggagcggaatcggcgtcgtttgttttcgtcgtttttttttttgtaggtcgttcgttcgtttattcgtagaagaggcgttcgggtcgtttttttcgaggttttcgttcgatttacgtcgtttcgttcgcgttttcggggtcgggtttttttaggtcggtttcgtagttttcggggtcgagtttttaaacgtgagtcgggtgcgcgcgggattcgcggcggtttttcgaagtttcgttttttcggttcggggttcgttcggttcgttttaatagttgtttcgcggtcgtaggtttcgcgttttgtgtattagggaaaagtagttttcgagtttgtgtcggacgtttttgcgtttcgttatcggtcgttttcggtttttgggtgaggcgtttttttttcgtcgcgtttcgttgtcgggtgttttcggtttcggtttttcgtgatttttgattttttttggtgcgaataagatcgggcgtttcgtcgtcgacgcgaaggggttgtttgtgcgcggcgttgcgggtttttcgcgcgtggggtgtgcgtgtgcgtgttcgggttcggttttgtgtgtgtatcgcgggtttgtttagagtcgggattatcgggttgcgtgtgggtcgttaggttaggttttcgtttaggatgggttttaagttggaacgagaaaggggaaatcggtcgcgttgacgtcggggttttcgttgtaagcgagaggcggattcggcgtattcgcgcgg

SEQ ID NO: 26348 - DNA, 2050 bp, Artificial Sequence
  chemically treated genomic DNA (Homo sapiens) CpG-island No: 26348
ccgcgcgaatacgccgaatccgcctctcgcttacaacgaaaaccccgacgtcaacgcgaccgatttcccctttctcgttccaacttaaaacccatcctaaacgaaaacctaacctaacgacccacacgcaacccgataatcccgactctaaacaaacccgcgatacacacacaaaaccgaacccgaacacgcacacgcacaccccacgcgcgaaaaacccgcaacgccgcgcacaaacaaccccttcgcgtcgacgacgaaacgcccgatcttattcgcaccaaaaaaaatcaaaaatcacgaaaaaccgaaaccgaaaacacccgacaacgaaacgcgacgaaaaaaaaacgcctcacccaaaaaccgaaaacgaccgataacgaaacgcaaaaacgtccgacacaaactcgaaaactacttttccctaatacacaaaacgcgaaacctacgaccgcgaaacaactattaaaacgaaccgaacgaaccccgaaccgaaaaaacgaaacttcgaaaaaccgccgcgaatcccgcgcgcacccgactcacgtttaaaaactcgaccccgaaaactacgaaaccgacctaaaaaaacccgaccccgaaaacgcgaacgaaacgacgtaaatcgaacgaaaacctcgaaaaaaacgacccgaacgcctcttctacgaataaacgaacgaacgacctacaaaaaaaaaaacgacgaaaacaaacgacgccgattccgctccgcgcgacgctaaccgcttcgctacaaccgaaacttcgacgaaactacgaaaaccgcgctaaccgaaccgcgactccgcctatcctcacctacccgcccgcctcaccgcgaataacgccgacgaccgaaactacgaaatacgcgcgaactactcgaaaacgctataacgaacgaaaacgcgaataactaaaacacccgacccgcgacaaaaaccgactaacgacaaacgaaacgcgcgaaacccgaaactcgaccgaaacgaaacgaaaaaaaaaataaaaccgaaaaccgaacaacctaaccgaaacaactctatccccgccgaacccgactataccaaacaaacgaatacaaaaaaatccacgcgaacccgaaaacgacaacgacgaatcgaaaaataaccgaataaatccctcctatcgaaaacactatcgccccgacgacccgcgcaaactaccgacgtcccaaaaaaacgccctccaccacgcgaaacacaaccgaaaataaacttcacgaccacaattcccaacccgaacaaaaatctccattttactccccaaataactacgactatcccgccgtcgccacccctacccctacgcccgcgaaaccgaataaacgccgacccgcgccccctcctccgcccctccccgactcgaaatctccctcctctacgcccgactaacgaacgccaaaaacgatactctaacgcccactatttcaaaaacccgaaatataatttaaccaaaactaaaaaccactcgaaaaaaaaaaaaaaaaaaacgaacgaaaaaaaaaaaattactctcccctttcgtcaacttttcgctaactttcacttttcgctcccctccacccccgaccctccccctccgcccccctccccgacccccaccgcgcgcctcgaattcccgaacccgaacgcctaacactaataaaaaaaaaaaaaattccgcgaaaaaaaaaccgacgccttcgaaaaacgcgcgacccgaacgccccgaacctccgcgccgaacccgatcgccccgaaacgcgaaaaacgaaacaaccccccgaaccgcgcgaccgaaccgaaaacccgaaaccgcaaacgcgccgaccgcgccccgacgcgcacccctaacccgaacgccccgacccgacgacccgaaccccgacgacgcgacgcgaccgaacgcgaaaaacttacttttaactaacttcctcgccctcgccttaaatcgcataatatcgactcgcgaaatctctctcctcctccttaaatccaaaaacaaccacacactatcttcatctccccaacattatcaattt

SEQ ID NO: 26349 - DNA, 1020 bp, Artificial Sequence
  chemically treated genomic DNA (Homo sapiens) CpG-island No: 26349
aaaaaaattttgtaatgtatttattatttttatcgtcgcgtcgtcgtcgtcgtcgtcgtcgtttcggcgcgggattggggggtttttttcggttttttcggttttcgttttatttattttttttttttttttttttttttttttttagcgtagttcggaattggttttttaagaaaatatttcgtgttcggcgttttcgttcggggttcgtatttcggatattttaaaaggatttaggtggtttcggaggcgaggtgattatttttttattttgtttttgcgtcgcggcgcgtcgcgttgttgttttcgttttagtcggggtcgaagatggggcggcggttgcggttttttatacgatttttttggatttcggggtatacgcgtcgatagttcggacgcgagttcgggttggttttgtttcgttttattgcgtttgattattaatttaaaagttttgcgtttttcgtcgtttcggttcgttttttttttgtatttttttttcggttttcgttttcgttttgcgatcgttggagggggcgtcggggttcgcgcgttagaattcggttttttcgaagtttttttcgggttttatcgtttttttcgcgtttttcggttttcgttttttttttttcgtttttatttaacggttgttgtttcgggtttcgcggtttaaaaataatagcggaggcgtcgttagtttcgcgtttcgttattgtttaggtcggcgggcggtattcggattcgtcgttttcggtttttcgcgaggttacggaggttaatacgtttcgtacggggggatagcgcgggggtagtcgtttaaatattaggcgttttcggttggtcgttttagggcgttcgtattttttcgttcgcgtttttttgtcgtcgcgtttttaaggtgagtattcggttgcgcgagcgttcgagttgggttattttcggggattcgggttattggggatatttttttttggtttttcggggtttaggtgcgtagcgggcggaaaggttagcggcgta

SEQ ID NO: 26350 - DNA, 1020 bp, Artificial Sequence
  chemically treated genomic DNA (Homo sapiens) CpG-island No: 26350
tacgccgctaacctttccgcccgctacgcacctaaaccccgaaaaaccaaaaaaaaatatccccaataacccgaatccccgaaaataacccaactcgaacgctcgcgcaaccgaatactcaccttaaaaacgcgacgacaaaaaaacgcgaacgaaaaaatacgaacgccctaaaacgaccaaccgaaaacgcctaatatttaaacgactacccccgcgctatccccccgtacgaaacgtattaacctccgtaacctcgcgaaaaaccgaaaacgacgaatccgaataccgcccgccgacctaaacaataacgaaacgcgaaactaacgacgcctccgctattatttttaaaccgcgaaacccgaaacaacaaccgttaaataaaaacgaaaaaaaaaaaacgaaaaccgaaaaacgcgaaaaaaacgataaaacccgaaaaaaacttcgaaaaaaccgaattctaacgcgcgaaccccgacgccccctccaacgatcgcaaaacgaaaacgaaaaccgaaaaaaaaatacaaaaaaaaaacgaaccgaaacgacgaaaaacgcaaaacttttaaattaataatcaaacgcaataaaacgaaacaaaaccaacccgaactcgcgtccgaactatcgacgcgtataccccgaaatccaaaaaaatcgtataaaaaaccgcaaccgccgccccatcttcgaccccgactaaaacgaaaacaacaacgcgacgcgccgcgacgcaaaaacaaaataaaaaaataatcacctcgcctccgaaaccacctaaatccttttaaaatatccgaaatacgaaccccgaacgaaaacgccgaacacgaaatattttcttaaaaaaccaattccgaactacgctaaaaaaaaaaaaaaaaaaaaaaaaaaaaaataaataaaacgaaaaccgaaaaaaccgaaaaaaaccccccaatcccgcgccgaaacgacgacgacgacgacgacgacgcgacgataaaaataataaatacattacaaaattttttt

SEQ ID NO: 26351 - DNA, 1020 bp, Artificial Sequence
  chemically treated genomic DNA (Homo sapiens) CpG-island No: 26351
tgcgtcgttggttttttcgttcgttacgtatttgggtttcgagaggttagaggggagtgtttttagtggttcgggttttcgaaggtggtttagttcgggcgttcgcgtagtcgggtatttattttgggggcgcggcggtaggagagcgcgggcggagaggtgcgggcgttttgggacgattagtcgaggacgtttggtgtttggacggttgttttcgcgttgttttttcgtgcgaggcgtgttggttttcgtggtttcgcgagggatcgagggcggcgggttcgagtgtcgttcgtcggtttgggtagtggcggagcgcggagttggcggcgttttcgttgttgtttttgagtcgcgaagttcgaagtagtagtcgttgggtgggggcgaaggggaggaggcgggggtcgggaggcgcgaggggggcggtggggttcggagggggtttcggaggagtcgggttttggcgcgcgagtttcgacgttttttttagcgatcgtagggcggggacgggggtcgaggggagaatgtaggagaaaagcgggtcggggcgacggggaacgtaaagtttttaaattagtaattaaacgtagtaaaacggagtaaaattagttcggattcgcgttcgaattatcggcgcgtgtgtttcgagatttaaggaagtcgtgtggaaaatcgtagtcgtcgttttattttcggtttcggttggggcgggagtagtagcgcgacgcgtcgcgacgtaggggtagggtggggggatagttatttcgttttcggggttatttgggtttttttaaagtgttcggggtgcgggtttcgggcgggagcgtcgaatacggaatgtttttttaaagggttagtttcgagttgcgttgaaaagggggggggggagaggggggagagataagtgagacgaagatcgagaaggtcgaggagagttttttaatttcgcgtcgaggcggcggcggcggcggcggcggcgcgacgatgaggatgatgaatatattgtaaagttttttt

SEQ ID NO: 26352 - DNA, 1020 bp, Artificial Sequence
  chemically treated genomic DNA (Homo sapiens) CpG-island No: 26352
aaaaaaactttacaatatattcatcatcctcatcgtcgcgccgccgccgccgccgccgccgcctcgacgcgaaattaaaaaactctcctcgaccttctcgatcttcgtctcacttatctctcccccctctcccccccccccttttcaacgcaactcgaaactaaccctttaaaaaaacattccgtattcgacgctcccgcccgaaacccgcaccccgaacactttaaaaaaacccaaataaccccgaaaacgaaataactatccccccaccctacccctacgtcgcgacgcgtcgcgctactactcccgccccaaccgaaaccgaaaataaaacgacgactacgattttccacacgacttccttaaatctcgaaacacacgcgccgataattcgaacgcgaatccgaactaattttactccgttttactacgtttaattactaatttaaaaactttacgttccccgtcgccccgacccgcttttctcctacattctcccctcgacccccgtccccgccctacgatcgctaaaaaaaacgtcgaaactcgcgcgccaaaacccgactcctccgaaaccccctccgaaccccaccgcccccctcgcgcctcccgacccccgcctcctccccttcgcccccacccaacgactactacttcgaacttcgcgactcaaaaacaacaacgaaaacgccgccaactccgcgctccgccactacccaaaccgacgaacgacactcgaacccgccgccctcgatccctcgcgaaaccacgaaaaccaacacgcctcgcacgaaaaaacaacgcgaaaacaaccgtccaaacaccaaacgtcctcgactaatcgtcccaaaacgcccgcacctctccgcccgcgctctcctaccgccgcgcccccaaaataaatacccgactacgcgaacgcccgaactaaaccaccttcgaaaacccgaaccactaaaaacactcccctctaacctctcgaaacccaaatacgtaacgaacgaaaaaaccaacgacgca

SEQ ID NO: 26353 - DNA, 549 bp, Artificial Sequence
  chemically treated genomic DNA (Homo sapiens) CpG-island No: 26353
tacgcgcgttcgtagtcgtggagtggcggttttttttgtcgttcgtaatttcggggtcgtcggtttgcgtatatcgggagtaatttcgttatttatagcgttcgcgttttgcggttcgcgcggaattgcgcgcgggaaggtggtagagcgacgttttagaacgttgtttgcgtagacgttgtcgttgtttttagattttaattcggtcgcgcgcgggcggggttttggtagtaacgaaaatggcgagtttcgtagtttttcgggttcggcggttatatttcgggagtcgttaggtgggagttcgtttttcgtgtttttaaacgtttagagttcgggatacgggtcggcggtcgggttattaagttagttttcggaatcggttcgcgtcggaatttagattcggtttgtaaagttcgtttttgtcgttttttcgtagcgcgttttgttttttattgtcggtttttttagttttaaaattaaattttgttttttattttgagagattaatatttcgtaggtgaaatcgtggagacggagttgcggtgggtt

SEQ ID NO: 26354 - DNA, 549 bp, Artificial Sequence
  chemically treated genomic DNA (Homo sapiens) CpG-island No: 26354
aacccaccgcaactccgtctccacgatttcacctacgaaatattaatctctcaaaataaaaaacaaaatttaattttaaaactaaaaaaaccgacaataaaaaacaaaacgcgctacgaaaaaacgacaaaaacgaactttacaaaccgaatctaaattccgacgcgaaccgattccgaaaactaacttaataacccgaccgccgacccgtatcccgaactctaaacgtttaaaaacacgaaaaacgaactcccacctaacgactcccgaaatataaccgccgaacccgaaaaactacgaaactcgccattttcgttactaccaaaaccccgcccgcgcgcgaccgaattaaaatctaaaaacaacgacaacgtctacgcaaacaacgttctaaaacgtcgctctaccaccttcccgcgcgcaattccgcgcgaaccgcaaaacgcgaacgctataaataacgaaattactcccgatatacgcaaaccgacgaccccgaaattacgaacgacaaaaaaaaccgccactccacgactacgaacgcgcgta

SEQ ID NO: 26355 - DNA, 549 bp, Artificial Sequence
  chemically treated genomic DNA (Homo sapiens) CpG-island No: 26355
aatttatcgtagtttcgtttttacggttttatttgcggggtattaattttttaggatgaaaggtaaaatttggttttgaagttaagagggtcggtagtggggggtagggcgcgttgcggagagacggtaggagcgggttttgtaagtcgagtttggatttcggcgcgagtcgatttcgggaattggtttggtgattcggtcgtcggttcgtgtttcgggttttgggcgtttggggatacggaaggcgggtttttatttggcgattttcggaatgtggtcgtcgggttcggaaggttacgaggttcgttattttcgttgttgttagggtttcgttcgcgcgcggtcgaattgggatttgaaggtagcggtagcgtttacgtaagtagcgttttggagcgtcgttttgttattttttcgcgcgtagtttcgcgcgagtcgtaggacgcgggcgttgtgggtaacgaagttgttttcggtgtgcgtagatcggcggtttcggggttgcgggcggtaggagggatcgttattttacggttgcgggcgcgcgtg

SEQ ID NO: 26356 - DNA, 549 bp, Artificial Sequence
  chemically treated genomic DNA (Homo sapiens) CpG-island No: 26356
cacgcgcgcccgcaaccgtaaaataacgatccctcctaccgcccgcaaccccgaaaccgccgatctacgcacaccgaaaacaacttcgttacccacaacgcccgcgtcctacgactcgcgcgaaactacgcgcgaaaaaataacaaaacgacgctccaaaacgctacttacgtaaacgctaccgctaccttcaaatcccaattcgaccgcgcgcgaacgaaaccctaacaacaacgaaaataacgaacctcgtaaccttccgaacccgacgaccacattccgaaaatcgccaaataaaaacccgccttccgtatccccaaacgcccaaaacccgaaacacgaaccgacgaccgaatcaccaaaccaattcccgaaatcgactcgcgccgaaatccaaactcgacttacaaaacccgctcctaccgtctctccgcaacgcgccctaccccccactaccgaccctcttaacttcaaaaccaaattttacctttcatcctaaaaaattaataccccgcaaataaaaccgtaaaaacgaaactacgataaatt

SEQ ID NO: 26357 - DNA, 2005 bp, Artificial Sequence
  chemically treated genomic DNA (Homo sapiens) CpG-island No: 26357
gcgcgcgttataggttttatttcggttacggcgaaggggcgtcgcgagttataatcgggttgtaggtggagggcgtcggtttcgcgcgtcgtcgcgtttttcgcgtcgtcggggatgaggtcggggtcgcgtcgcgttcgcgggggtgggggcggcggtttaggtgagttattaggtgagcggtcggagaggggaataggtgattgtcgcgtttcgttagttttcgttcggttcgcgcgatttcgggatatatcgcggtagggggacgggggttgcgggggacgtcggggttcgcggtgggtttgggggagggggaggggagagaaggggcggaggggggagggggaaaggagggcgggttcgcggttggcgggcggcggcgggggggaggggcggggcgcggcgtagcgggcgggggtcgcgtaggtttcgcgttcggcggtgtttatttcggtcggttggttgatttcgaataggtttagtcggttggcgttttagtggtggatgatgtcggttagttttcgtcgtttttcgttacggtcgttcgtcgatatggttttggtcgcgtttttttagtcgcgcggggtcggggtcggaggacgggtcgaggacgataggttcgcgggggttcggcgtttttcgttatttttcgtcggtcgttttcgttttcgcggttgttttcgttttcgcggtcgcgtcgcgtttttcgatttggttttcgtttggggtttagttcgcgtcgcgtcgcgtcgttttagtttcgtcggtcggtgtgcgttcggcgttcgtcgttcgtcgttcgtattcgttcgcgtttcgttcgtcgtcgtgcgcgtcgtcgttcgtcgtgcgcgtcgtcgtttcgcgcggcgtcgtcgtattttcgggtcgttttattaggtgttgttgtcgcggtcgttagggagggaggtgtcggagggcgggtttcgcgcggtgttagggtttcgtttggattggcggtggtgggttttaatcggcggtatcgggttttttttcgattagcggtgttaggttcggttcggacgcgcgttgttggatttaaatgggtagtgttgggttcgatgggtggtgttgtgttgggttcggacgcgcggtgtagagttcggacgggcggtgttggatttaaatgggcggtgttggatttggacgggcggtgatgggttcgatgggcggtgttatgttcggttcggacgggcggtgttaggtttaaatgggcgttgttgggttcgatgggcggtgttgcgttcggttcggacgggcggggacgggcggtgttgggtttaaatgggtggtgatggatttgtggacgggcggtgttggttttagacgggcggtgttgggtttagacgggcggtgggttcgatgggcggtgttaggttcggttcggatgggtggtgttaggtttaaatgggcggcgtcggattcgatgggcggtgttgggttcggttcggattggcgggttcgggtttggacgggcggtgttggatttaaatgggggtgtagtgttggatttggacgggcggtgttgggttcgaacgggcgatgggttttatgggcggtgttaggttcggttcggattggcggtgttgggtttaaatgggcggcgttgggttcgatgggtggtattgggttcggacgggcggttttgggtttggacgggcggtgtagtatttaaatgggcgttgttgggttcggacgggcggtgttaggttcggttcggacgggtggtgttgggtttaaatgggcggtgttaggtttagtaggggatcggtgggcgtggcggtataggtacggagcgtagggtcggtggagcgtttttttcgaagggttttgcgtttttcgcgttcgttgttttttttgttcgcgtattgtttcggggttgttgcgtgttttttttagggtgattttttttcgttgggttattttaaagtcgatttttttaagttgttttttttcgcggaggatacgttgttaggttttgtgt

SEQ ID NO: 26358 - DNA, 2005 bp, Artificial Sequence
  chemically treated genomic DNA (Homo sapiens) CpG-island No: 26358
acacaaaacctaacaacgtatcctccgcgaaaaaaaacaacttaaaaaaatcgactttaaaataacccaacgaaaaaaaatcaccctaaaaaaaacacgcaacaaccccgaaacaatacgcgaacaaaaaaaacaacgaacgcgaaaaacgcaaaacccttcgaaaaaaacgctccaccgaccctacgctccgtacctataccgccacgcccaccgatcccctactaaacctaacaccgcccatttaaacccaacaccacccgtccgaaccgaacctaacaccgcccgtccgaacccaacaacgcccatttaaatactacaccgcccgtccaaacccaaaaccgcccgtccgaacccaataccacccatcgaacccaacgccgcccatttaaacccaacaccgccaatccgaaccgaacctaacaccgcccataaaacccatcgcccgttcgaacccaacaccgcccgtccaaatccaacactacacccccatttaaatccaacaccgcccgtccaaacccgaacccgccaatccgaaccgaacccaacaccgcccatcgaatccgacgccgcccatttaaacctaacaccacccatccgaaccgaacctaacaccgcccatcgaacccaccgcccgtctaaacccaacaccgcccgtctaaaaccaacaccgcccgtccacaaatccatcaccacccatttaaacccaacaccgcccgtccccgcccgtccgaaccgaacgcaacaccgcccatcgaacccaacaacgcccatttaaacctaacaccgcccgtccgaaccgaacataacaccgcccatcgaacccatcaccgcccgtccaaatccaacaccgcccatttaaatccaacaccgcccgtccgaactctacaccgcgcgtccgaacccaacacaacaccacccatcgaacccaacactacccatttaaatccaacaacgcgcgtccgaaccgaacctaacaccgctaatcgaaaaaaaacccgataccgccgattaaaacccaccaccgccaatccaaacgaaaccctaacaccgcgcgaaacccgccctccgacacctccctccctaacgaccgcgacaacaacacctaataaaacgacccgaaaatacgacgacgccgcgcgaaacgacgacgcgcacgacgaacgacgacgcgcacgacgacgaacgaaacgcgaacgaatacgaacgacgaacgacgaacgccgaacgcacaccgaccgacgaaactaaaacgacgcgacgcgacgcgaactaaaccccaaacgaaaaccaaatcgaaaaacgcgacgcgaccgcgaaaacgaaaacaaccgcgaaaacgaaaacgaccgacgaaaaataacgaaaaacgccgaacccccgcgaacctatcgtcctcgacccgtcctccgaccccgaccccgcgcgactaaaaaaacgcgaccaaaaccatatcgacgaacgaccgtaacgaaaaacgacgaaaactaaccgacatcatccaccactaaaacgccaaccgactaaacctattcgaaatcaaccaaccgaccgaaataaacaccgccgaacgcgaaacctacgcgacccccgcccgctacgccgcgccccgcccctcccccccgccgccgcccgccaaccgcgaacccgccctcctttccccctcccccctccgccccttctctcccctccccctcccccaaacccaccgcgaaccccgacgtcccccgcaacccccgtccccctaccgcgatatatcccgaaatcgcgcgaaccgaacgaaaactaacgaaacgcgacaatcacctattcccctctccgaccgctcacctaataactcacctaaaccgccgcccccacccccgcgaacgcgacgcgaccccgacctcatccccgacgacgcgaaaaacgcgacgacgcgcgaaaccgacgccctccacctacaacccgattataactcgcgacgccccttcgccgtaaccgaaataaaacctataacgcgcgc

SEQ ID NO: 26359 - DNA, 2005 bp, Artificial Sequence
  chemically treated genomic DNA (Homo sapiens) CpG-island No: 26359
atataaagtttaataacgtgtttttcgcggaagaaaatagtttgaaaaggtcggttttgaagtgatttagcggaaaggaattattttggaagaaatacgtagtagtttcggggtaatgcgcgggtaggaggagtagcgagcgcggggagcgtagggtttttcggagagggcgttttatcggttttgcgtttcgtatttgtgtcgttacgtttatcggttttttgttgagtttagtatcgtttatttagatttagtattattcgttcggatcgaatttagtatcgttcgttcggatttagtagcgtttatttggatattgtatcgttcgtttagatttagaatcgttcgttcggatttagtattatttatcggatttagcgtcgtttatttagatttagtatcgttagttcgaatcgaatttagtatcgtttatgggatttatcgttcgttcggatttagtatcgttcgtttagatttagtattgtatttttatttggatttagtatcgttcgtttagattcggattcgttagttcggatcgaatttagtatcgtttatcggattcggcgtcgtttatttagatttagtattatttattcgaatcgaatttagtatcgtttatcggatttatcgttcgtttggatttagtatcgttcgtttggaattagtatcgttcgtttatagatttattattatttatttggatttagtatcgttcgttttcgttcgttcggatcgaacgtagtatcgtttatcggatttagtagcgtttatttagatttagtatcgttcgttcgaatcgaatatagtatcgtttatcggatttattatcgttcgtttagatttagtatcgtttatttggatttagtatcgttcgttcggattttgtatcgcgcgttcggatttaatatagtattatttatcggatttagtattgtttatttagatttagtagcgcgcgttcgaatcgaatttagtatcgttggtcgggaaggaattcggtatcgtcggttgggatttattatcgttagtttagacggaattttagtatcgcgcggggttcgtttttcgatatttttttttttggcggtcgcggtagtagtatttagtggagcggttcggaggtgcggcggcgtcgcgcggggcggcggcgcgtacggcgggcggcggcgcgtacggcggcgggcggggcgcgggcgggtgcgggcggcgggcggcgggcgtcgggcgtatatcggtcggcggggttgaggcggcgcggcgcggcgcggattgagttttaggcggaggttaagtcggaggacgcggcgcggtcgcggaggcggaggtagtcgcggaggcggaggcggtcggcggggggtggcgaggggcgtcgggttttcgcggatttgtcgttttcggttcgtttttcggtttcggtttcgcgcggttgaggaggcgcggttaggattatgtcggcgggcggtcgtgacgaggagcggcggaagttggtcgatattatttattattggaacgttaatcggttggatttgttcgagattagttagtcgatcgaggtgagtatcgtcgggcgcggggtttgcgcgattttcgttcgttgcgtcgcgtttcgtttttttttttcgtcgtcgttcgttagtcgcggattcgtttttttttttttttttttttttcgttttttttttttttttttttttttttaggtttatcgcgggtttcggcgtttttcgtagttttcgtttttttgtcgcggtgtatttcggggtcgcgcgggtcgagcgggggttggcggggcgcggtagttatttgttttttttttcggtcgtttatttggtggtttatttgggtcgtcgtttttattttcgcgagcgcggcgcggtttcggttttattttcggcggcgcggggggcgcggcggcgcgcggggtcggcgttttttatttgtagttcggttgtggttcgcggcgttttttcgtcgtggtcgggatggagtttgtgacgcgcgt

SEQ ID NO: 26360 - DNA, 2005 bp, Artificial Sequence
  chemically treated genomic DNA (Homo sapiens) CpG-island No: 26360
acgcgcgtcacaaactccatcccgaccacgacgaaaaaacgccgcgaaccacaaccgaactacaaataaaaaacgccgaccccgcgcgccgccgcgccccccgcgccgccgaaaataaaaccgaaaccgcgccgcgctcgcgaaaataaaaacgacgacccaaataaaccaccaaataaacgaccgaaaaaaaaaacaaataactaccgcgccccgccaacccccgctcgacccgcgcgaccccgaaatacaccgcgacaaaaaaacgaaaactacgaaaaacgccgaaacccgcgataaacctaaaaaaaaaaaaaaaaaaaaaaaaaacgaaaaaaaaaaaaaaaaaaaaaaacgaatccgcgactaacgaacgacgacgaaaaaaaaaaacgaaacgcgacgcaacgaacgaaaatcgcgcaaaccccgcgcccgacgatactcacctcgatcgactaactaatctcgaacaaatccaaccgattaacgttccaataataaataatatcgaccaacttccgccgctcctcgtcacgaccgcccgccgacataatcctaaccgcgcctcctcaaccgcgcgaaaccgaaaccgaaaaacgaaccgaaaacgacaaatccgcgaaaacccgacgcccctcgccaccccccgccgaccgcctccgcctccgcgactacctccgcctccgcgaccgcgccgcgtcctccgacttaacctccgcctaaaactcaatccgcgccgcgccgcgccgcctcaaccccgccgaccgatatacgcccgacgcccgccgcccgccgcccgcacccgcccgcgccccgcccgccgccgtacgcgccgccgcccgccgtacgcgccgccgccccgcgcgacgccgccgcacctccgaaccgctccactaaatactactaccgcgaccgccaaaaaaaaaaatatcgaaaaacgaaccccgcgcgatactaaaattccgtctaaactaacgataataaatcccaaccgacgataccgaattccttcccgaccaacgatactaaattcgattcgaacgcgcgctactaaatctaaataaacaatactaaatccgataaataatactatattaaatccgaacgcgcgatacaaaatccgaacgaacgatactaaatccaaataaacgatactaaatctaaacgaacgataataaatccgataaacgatactatattcgattcgaacgaacgatactaaatctaaataaacgctactaaatccgataaacgatactacgttcgatccgaacgaacgaaaacgaacgatactaaatccaaataaataataataaatctataaacgaacgatactaattccaaacgaacgatactaaatccaaacgaacgataaatccgataaacgatactaaattcgattcgaataaataatactaaatctaaataaacgacgccgaatccgataaacgatactaaattcgatccgaactaacgaatccgaatctaaacgaacgatactaaatccaaataaaaatacaatactaaatctaaacgaacgatactaaatccgaacgaacgataaatcccataaacgatactaaattcgattcgaactaacgatactaaatctaaataaacgacgctaaatccgataaataatactaaatccgaacgaacgattctaaatctaaacgaacgatacaatatccaaataaacgctactaaatccgaacgaacgatactaaattcgatccgaacgaataatactaaatctaaataaacgatactaaactcaacaaaaaaccgataaacgtaacgacacaaatacgaaacgcaaaaccgataaaacgccctctccgaaaaaccctacgctccccgcgctcgctactcctcctacccgcgcattaccccgaaactactacgtatttcttccaaaataattcctttccgctaaatcacttcaaaaccgaccttttcaaactattttcttccgcgaaaaacacgttattaaactttatat

SEQ ID NO: 26361 - DNA, 786 bp, Artificial Sequence
  chemically treated genomic DNA (Homo sapiens) CpG-island No: 26361
gcggttgtacgtaatatttttatcgtttgaaatttgcgatttttcgtatttggttttttttcgaggtttttgtatatcgtatcgtgattgacgtattcgaggggatcgttaaaaatatattttaagtttaattttttaatattttcgcgacgtaatttttttttttttttttagcggttttggttcgtttttcgtttttcgggtcgcgtttcggttggcgattcggcgtgtatacgaggttttttcgcgggagagttcgcgtttcggttcggggtttgtcgggggttgtagataaagaggttgtagcgtcgtcgcggtcgttaggatcgtttttacggggatagttttacgtttatcgtttcggttttcgcgtcgtcgtcgtcgtttcgttttatcggtggtttcggggtcgggtttttgcgttcgttattgttgtagttcgacgaataatggtaggaggaggcgtcggcgttcgaggttcgggttttttgcggttcgcgggttcgtcggttgttgttggttgattgattaaacgtattagcggagggagggagcgagcgagcgattttggcgcgcgttttttcgttttttttttgcgaggcgaggttagttcggttcgtagttcgttcgtcggttcgcgttttttttttttagttcgttataatattgtagtaaatttttattgggtcgcgtcggagggaaggagggggtcgggttcgcggttcgttcgtttattggttgaggttaatttttagttttttttgtttttttttttttttaggtcgg

SEQ ID NO: 26362 - DNA, 786 bp, Artificial Sequence
  chemically treated genomic DNA (Homo sapiens) CpG-island No: 26362
ccgacctaaaaaaaaaaaaaaacaaaaaaaactaaaaattaacctcaaccaataaacgaacgaaccgcgaacccgaccccctccttccctccgacgcgacccaataaaaatttactacaatattataacgaactaaaaaaaaaaaacgcgaaccgacgaacgaactacgaaccgaactaacctcgcctcgcaaaaaaaaaacgaaaaaacgcgcgccaaaatcgctcgctcgctccctccctccgctaatacgtttaatcaatcaaccaacaacaaccgacgaacccgcgaaccgcaaaaaacccgaacctcgaacgccgacgcctcctcctaccattattcgtcgaactacaacaataacgaacgcaaaaacccgaccccgaaaccaccgataaaacgaaacgacgacgacgacgcgaaaaccgaaacgataaacgtaaaactatccccgtaaaaacgatcctaacgaccgcgacgacgctacaacctctttatctacaacccccgacaaaccccgaaccgaaacgcgaactctcccgcgaaaaaacctcgtatacacgccgaatcgccaaccgaaacgcgacccgaaaaacgaaaaacgaaccaaaaccgctaaaaaaaaaaaaaaaaattacgtcgcgaaaatattaaaaaattaaacttaaaatatatttttaacgatcccctcgaatacgtcaatcacgatacgatatacaaaaacctcgaaaaaaaaccaaatacgaaaaatcgcaaatttcaaacgataaaaatattacgtacaaccgc

SEQ ID NO: 26363 - DNA, 786 bp, Artificial Sequence
  chemically treated genomic DNA (Homo sapiens) CpG-island No: 26363
tcggtttaggggaggggggaaataaggggagttagaagttggttttagttaatgggcggacgggtcgcgggttcggtttttttttttttttcggcgcggtttaatagaaatttattataatgttgtggcgaattgagggggaggggcgcgggtcggcgggcgggttgcgggtcgggttggtttcgtttcgtagagggaaggcgggagggcgcgcgttagggtcgttcgttcgtttttttttttcgttggtgcgtttagttagttagttagtagtagtcggcgggttcgcgagtcgtagagggttcgagtttcggacgtcggcgtttttttttgttattgttcgtcgggttgtagtagtggcgggcgtaggagttcggtttcggagttatcggtgaggcgaggcggcggcggcggcgcgggagtcggggcggtgggcgtggagttgttttcgtggggacggttttggcggtcgcggcggcgttgtagtttttttgtttgtaattttcgataggtttcgggtcggggcgcgggttttttcgcggaggagtttcgtgtgtacgtcgagtcgttagtcgggacgcggttcgaggagcgaggggcgggttagagtcgttgaggaaaggggaaggggttgcgtcgcgggagtgttggaaagttaggtttgagatgtatttttgacggttttttcgggtgcgttaattacggtgcggtgtgtaggagtttcgggaggaaattaaatgcggagaatcgtaggttttagacggtgaaggtgttgcgtgtagtcgt

SEQ ID NO: 26364 - DNA, 786 bp, Artificial Sequence
  chemically treated genomic DNA (Homo sapiens) CpG-island No: 26364
acgactacacgcaacaccttcaccgtctaaaacctacgattctccgcatttaatttcctcccgaaactcctacacaccgcaccgtaattaacgcacccgaaaaaaccgtcaaaaatacatctcaaacctaactttccaacactcccgcgacgcaaccccttcccctttcctcaacgactctaacccgcccctcgctcctcgaaccgcgtcccgactaacgactcgacgtacacacgaaactcctccgcgaaaaaacccgcgccccgacccgaaacctatcgaaaattacaaacaaaaaaactacaacgccgccgcgaccgccaaaaccgtccccacgaaaacaactccacgcccaccgccccgactcccgcgccgccgccgccgcctcgcctcaccgataactccgaaaccgaactcctacgcccgccactactacaacccgacgaacaataacaaaaaaaaacgccgacgtccgaaactcgaaccctctacgactcgcgaacccgccgactactactaactaactaactaaacgcaccaacgaaaaaaaaaaacgaacgaacgaccctaacgcgcgccctcccgccttccctctacgaaacgaaaccaacccgacccgcaacccgcccgccgacccgcgcccctccccctcaattcgccacaacattataataaatttctattaaaccgcgccgaaaaaaaaaaaaaaaccgaacccgcgacccgtccgcccattaactaaaaccaacttctaactccccttatttcccccctcccctaaaccga

SEQ ID NO: 26365 - DNA, 664 bp, Artificial Sequence
  chemically treated genomic DNA (Homo sapiens) CpG-island No: 26365
gcggcgtcggttcgtagcggatttatcggacgatgtcgaatatgataagtacgttgtttagtagttttacggcgtatacggtcgagtagagcgcggtgatggcgattgttagggcgagggacgaggcgtttcgcgcgtttggcggtttcgacgtattggcgttagcgttggggtaggcgttagggtaggcgttcgaggcgttggcgaagagcgggggttgtagttcggcgtcggcggagggggtcggttttatggttgtcggtcggtttcgtcgcgtttttttttatcgtgcgttttgggcgcggggattcgacgcgaggggagcggtaaggtagaggtcgcggtttcgacgtcgtcggttgtcgcgtttcggtcgtttcgttgtttttgcgtttcgttcgtttgtttcgtcgttcgtatcggtttagttttcggcgttcgttcgtttttttcgttcggagcgttgtgagttaggagtagtcgtaggtttttcggacgcgttcgtcgcgcgtattacgtggttcggaggcggtcgttagtttgcgttcgcgatcgggggcggacgttgtattatcggttcggagttgggtaggggaggtttttcgttttttttttagggatgtttcgtcggttcgagtgcgatttcgttttaatttggattttt

SEQ ID NO: 26366 - DNA, 664 bp, Artificial Sequence
  chemically treated genomic DNA (Homo sapiens) CpG-island No: 26366
aaaaatccaaattaaaacgaaatcgcactcgaaccgacgaaacatccctaaaaaaaaaacgaaaaacctcccctacccaactccgaaccgataatacaacgtccgcccccgatcgcgaacgcaaactaacgaccgcctccgaaccacgtaatacgcgcgacgaacgcgtccgaaaaacctacgactactcctaactcacaacgctccgaacgaaaaaaacgaacgaacgccgaaaactaaaccgatacgaacgacgaaacaaacgaacgaaacgcaaaaacaacgaaacgaccgaaacgcgacaaccgacgacgtcgaaaccgcgacctctaccttaccgctcccctcgcgtcgaatccccgcgcccaaaacgcacgataaaaaaaaacgcgacgaaaccgaccgacaaccataaaaccgaccccctccgccgacgccgaactacaacccccgctcttcgccaacgcctcgaacgcctaccctaacgcctaccccaacgctaacgccaatacgtcgaaaccgccaaacgcgcgaaacgcctcgtccctcgccctaacaatcgccatcaccgcgctctactcgaccgtatacgccgtaaaactactaaacaacgtacttatcatattcgacatcgtccgataaatccgctacgaaccgacgccgc

SEQ ID NO: 26367 - DNA, 664 bp, Artificial Sequence
  chemically treated genomic DNA (Homo sapiens) CpG-island No: 26367
gggagtttaggttgggacggggtcgtattcgagtcggcggagtatttttagggagggggcgggaggttttttttgtttagtttcgagtcggtggtgtagcgttcgttttcggtcgcgggcgtagattggcggtcgttttcgggttacgtggtgcgcgcggcgggcgcgttcgaggagtttgcggttgtttttggtttatagcgtttcgggcgaggagagcgggcggacgtcgggggttgggtcggtgcgggcggcgaggtaggcggacgaggcgtagagatagcggggcggtcggggcgcggtagtcggcggcgtcggggtcgcggtttttgttttgtcgtttttttcgcgtcggattttcgcgtttagggcgtacggtggagagggacgcggcggagtcggtcggtagttatggaatcggtttttttcgtcggcgtcgagttgtagttttcgtttttcgttaacgtttcggacgtttattttagcgtttgttttagcgttggcgttaatgcgtcggggtcgttaggcgcgcggagcgtttcgtttttcgttttggtaatcgttattatcgcgttttattcggtcgtgtgcgtcgtggggttgttgggtaacgtgtttgttatgttcggtatcgttcggtgagttcgttgcgggtcggcgtcgt

SEQ ID NO: 26368 - DNA, 664 bp, Artificial Sequence
  chemically treated genomic DNA (Homo sapiens) CpG-island No: 26368
acgacgccgacccgcaacgaactcaccgaacgataccgaacataacaaacacgttacccaacaaccccacgacgcacacgaccgaataaaacgcgataataacgattaccaaaacgaaaaacgaaacgctccgcgcgcctaacgaccccgacgcattaacgccaacgctaaaacaaacgctaaaataaacgtccgaaacgttaacgaaaaacgaaaactacaactcgacgccgacgaaaaaaaccgattccataactaccgaccgactccgccgcgtccctctccaccgtacgccctaaacgcgaaaatccgacgcgaaaaaaacgacaaaacaaaaaccgcgaccccgacgccgccgactaccgcgccccgaccgccccgctatctctacgcctcgtccgcctacctcgccgcccgcaccgacccaacccccgacgtccgcccgctctcctcgcccgaaacgctataaaccaaaaacaaccgcaaactcctcgaacgcgcccgccgcgcgcaccacgtaacccgaaaacgaccgccaatctacgcccgcgaccgaaaacgaacgctacaccaccgactcgaaactaaacaaaaaaaacctcccgccccctccctaaaaatactccgccgactcgaatacgaccccgtcccaacctaaactccc

SEQ ID NO: 26369 - DNA, 915 bp, Artificial Sequence
  chemically treated genomic DNA (Homo sapiens) CpG-island No: 26369
cgggcgtgtatattttttatttacgacgtagtttcgaaagtttttcgtcgattatttttttaggttattgttattcgtatagggtacggacgttttttttatttattcggtcgtgttagtcgttagtatatttattcgggagtatataattttttttgtaaagcgttttggtttattcgtttttttttttcggggtcgtttttcggataggttcgattatattttaggagttgttttcgttacgttggcgtggaaagggagcgggtatatttacgggcgatttcgcggggcggagaggaggtacgggtggggagacggatgtttttttttttcgcggtcgtatcggttttcgtagtgtttttttcgttcgggagtcggcggtcgaagtcgggcgtttttcgcgcgggttttttcgaaataagtagtttttcgcgttcgggagtcgtagtttttttttggggttttcgggcgaggtcggttaggcgggatattttaggagtttatggcggtggcggcgtttgcggacgatgcgcggtagtcggattttgcgggcggggcgggcggcgtcgtagtttcggagttttcgtcgtcgtcggcgcgtttcgggtttagtggagtgtagtcgcggcgcgtatgcgttttgggttcgtcgtcggggagggcggggcggcggacgcggttgagattattgtttgggttttaaaggggtcgcgtttcgaattttagttcgtcgtttcgaattttagttcgtcgtttcgcgggttggggcgcgattcgggtttttttgttatttataaaattagttacgatcggtttttaatcgcgagagttttttgggttgcgatttttgtttttgattttcgttggtgttttattttttttaattttaattttttttatttgagtttgttttga

SEQ ID NO: 26370 - DNA, 915 bp, Artificial Sequence
  chemically treated genomic DNA (Homo sapiens) CpG-island No: 26370
tcaaaacaaactcaaataaaaaaaattaaaattaaaaaaaataaaacaccaacgaaaatcaaaaacaaaaatcgcaacccaaaaaactctcgcgattaaaaaccgatcgtaactaattttataaataacaaaaaaacccgaatcgcgccccaacccgcgaaacgacgaactaaaattcgaaacgacgaactaaaattcgaaacgcgacccctttaaaacccaaacaataatctcaaccgcgtccgccgccccgccctccccgacgacgaacccaaaacgcatacgcgccgcgactacactccactaaacccgaaacgcgccgacgacgacgaaaactccgaaactacgacgccgcccgccccgcccgcaaaatccgactaccgcgcatcgtccgcaaacgccgccaccgccataaactcctaaaatatcccgcctaaccgacctcgcccgaaaaccccaaaaaaaaactacgactcccgaacgcgaaaaactacttatttcgaaaaaacccgcgcgaaaaacgcccgacttcgaccgccgactcccgaacgaaaaaaacactacgaaaaccgatacgaccgcgaaaaaaaaaaacatccgtctccccacccgtacctcctctccgccccgcgaaatcgcccgtaaatatacccgctccctttccacgccaacgtaacgaaaacaactcctaaaatataatcgaacctatccgaaaaacgaccccgaaaaaaaaaaacgaataaaccaaaacgctttacaaaaaaaattatatactcccgaataaatatactaacgactaacacgaccgaataaataaaaaaaacgtccgtaccctatacgaataacaataacctaaaaaaataatcgacgaaaaactttcgaaactacgtcgtaaataaaaaatatacacgcccg

SEQ ID NO: 26371 - DNA, 915 bp, Artificial Sequence
  chemically treated genomic DNA (Homo sapiens) CpG-island No: 26371
ttaaaataggtttaaatggaggaaattagggttaaaagaagtgaagtattagcgagggttaggggtagagatcgtagtttagaaagttttcgcggttgggggtcggtcgtagttggttttgtgagtggtaagagaattcgggtcgcgttttaattcgcggggcggcgggttggggttcggggcggcgggttggggttcggggcgcggtttttttaaggtttaggtagtgattttagtcgcgttcgtcgtttcgtttttttcggcggcgagtttagagcgtatgcgcgtcgcggttgtattttattgggttcgggacgcgtcggcggcggcggagatttcggggttgcggcgtcgttcgtttcgttcgtagagttcggttgtcgcgtatcgttcgtagacgtcgttatcgttatgggtttttgaggtatttcgtttggtcggtttcgttcgggagttttaagggggagttgcgattttcgagcgcggggggttgtttgtttcggagaggttcgcgcgagggacgttcggtttcggtcgtcggttttcgggcggggagggtattacggaggtcggtgcggtcgcggagggagggggtattcgtttttttattcgtgtttttttttcgtttcgcgaggtcgttcgtgggtgtgttcgttttttttttacgttaacgtggcgggggtagtttttggagtgtaatcggatttgttcggggggcggtttcgggagagggaggcggatggattaaggcgttttgtaagagggattgtgtgttttcgggtgggtgtgttggcgattggtacggtcgagtgagtgggggaggcgttcgtgttttgtgcgggtggtagtgatttgggagggtggtcggcggggggttttcggggttgcgtcgtgagtggagggtgtatacgttcg

SEQ ID NO: 26372 - DNA, 915 bp, Artificial Sequence
  chemically treated genomic DNA (Homo sapiens) CpG-island No: 26372
cgaacgtatacaccctccactcacgacgcaaccccgaaaaccccccgccgaccaccctcccaaatcactaccacccgcacaaaacacgaacgcctcccccactcactcgaccgtaccaatcgccaacacacccacccgaaaacacacaatccctcttacaaaacgccttaatccatccgcctccctctcccgaaaccgccccccgaacaaatccgattacactccaaaaactacccccgccacgttaacgtaaaaaaaaaacgaacacacccacgaacgacctcgcgaaacgaaaaaaaaacacgaataaaaaaacgaataccccctccctccgcgaccgcaccgacctccgtaataccctccccgcccgaaaaccgacgaccgaaaccgaacgtccctcgcgcgaacctctccgaaacaaacaaccccccgcgctcgaaaatcgcaactcccccttaaaactcccgaacgaaaccgaccaaacgaaatacctcaaaaacccataacgataacgacgtctacgaacgatacgcgacaaccgaactctacgaacgaaacgaacgacgccgcaaccccgaaatctccgccgccgccgacgcgtcccgaacccaataaaatacaaccgcgacgcgcatacgctctaaactcgccgccgaaaaaaacgaaacgacgaacgcgactaaaatcactacctaaaccttaaaaaaaccgcgccccgaaccccaacccgccgccccgaaccccaacccgccgccccgcgaattaaaacgcgacccgaattctcttaccactcacaaaaccaactacgaccgacccccaaccgcgaaaactttctaaactacgatctctacccctaaccctcgctaatacttcacttcttttaaccctaatttcctccatttaaacctattttaa

SEQ ID NO: 26373 - DNA, 556 bp, Artificial Sequence
  chemically treated genomic DNA (Homo sapiens) CpG-island No: 26373
gcggttttcgcgagaattcgcgcgggaataggagttgcgggtttcgtatagcgttcggtacgtagatttagtttattaacgggttggaaggtcgcgttttcgttttcgcgtttttttagaattttttttattttaagttcgggttttcggatttttttattttacggtttttttttttattttgggtcgtttagttttaatcgtttttattttcgttgattcgtttttcggaagcgatttttcgtagttgcgtatcgaggcgtattttcgcgtatttttaggaggcgggtttagttcggtggcgaggggagcgcggttttcgagtgggcgaggcgttggcggttgtaggtttcgatatcgcggagtatatttttttttatcgagatcgtgttttcgcggggtttgtgttttcgggaggagttggttgcgtttggagatttttcggtttggtattcgtcgcgtttttttgtttgttgttttttacgtttagttttattcgatttttggaagtttaggggtgtgtcgttcgatttttaaaatatgtttttatttttag

SEQ ID NO: 26374 - DNA, 556 bp, Artificial Sequence
  chemically treated genomic DNA (Homo sapiens) CpG-island No: 26374
ctaaaaataaaaacatattttaaaaatcgaacgacacacccctaaacttccaaaaatcgaataaaactaaacgtaaaaaacaacaaacaaaaaaacgcgacgaataccaaaccgaaaaatctccaaacgcaaccaactcctcccgaaaacacaaaccccgcgaaaacacgatctcgataaaaaaaaatatactccgcgatatcgaaacctacaaccgccaacgcctcgcccactcgaaaaccgcgctcccctcgccaccgaactaaacccgcctcctaaaaatacgcgaaaatacgcctcgatacgcaactacgaaaaatcgcttccgaaaaacgaatcaacgaaaataaaaacgattaaaactaaacgacccaaaataaaaaaaaaaaccgtaaaataaaaaaatccgaaaacccgaacttaaaataaaaaaaattctaaaaaaacgcgaaaacgaaaacgcgaccttccaacccgttaataaactaaatctacgtaccgaacgctatacgaaacccgcaactcctattcccgcgcgaattctcgcgaaaaccgc

SEQ ID NO: 26375 - DNA, 556 bp, Artificial Sequence
  chemically treated genomic DNA (Homo sapiens) CpG-island No: 26375
ttaggggtaggagtatattttaggggtcgagcgatatatttttgggtttttagaagtcggatggggttaaacgtggagagtaataagtagggagacgcgacgaatattaggtcgagggatttttaaacgtagttaatttttttcggggatatagatttcgcgggggtacggtttcgatggaggggagtgtgtttcgcggtatcggagtttatagtcgttagcgtttcgtttattcgggggtcgcgtttttttcgttatcgagttggattcgttttttgagggtgcgcggaggtgcgtttcggtgcgtagttgcggaggatcgttttcggggggcgggttagcggaagtgagggcggttgaggttgggcggtttaaggtggaaggaggggtcgtgaggtgagagagttcgggagttcgagtttgaggtgagaaaggttttagggaggcgcggaggcgggagcgcgattttttagttcgttagtagattgggtttacgtgtcgggcgttgtgcggagttcgtagtttttgttttcgcgcgagttttcgcgggagtcgt

SEQ ID NO: 26376 - DNA, 556 bp, Artificial Sequence
  chemically treated genomic DNA (Homo sapiens) CpG-island No: 26376
acgactcccgcgaaaactcgcgcgaaaacaaaaactacgaactccgcacaacgcccgacacgtaaacccaatctactaacgaactaaaaaatcgcgctcccgcctccgcgcctccctaaaacctttctcacctcaaactcgaactcccgaactctctcacctcacgacccctccttccaccttaaaccgcccaacctcaaccgccctcacttccgctaacccgccccccgaaaacgatcctccgcaactacgcaccgaaacgcacctccgcgcaccctcaaaaaacgaatccaactcgataacgaaaaaaacgcgacccccgaataaacgaaacgctaacgactataaactccgataccgcgaaacacactcccctccatcgaaaccgtacccccgcgaaatctatatccccgaaaaaaattaactacgtttaaaaatccctcgacctaatattcgtcgcgtctccctacttattactctccacgtttaaccccatccgacttctaaaaacccaaaaatatatcgctcgacccctaaaatatactcctacccctaa

SEQ ID NO: 26377 - DNA, 642 bp, Artificial Sequence
  chemically treated genomic DNA (Homo sapiens) CpG-island No: 26377
ttttcgtgttttttttcgtttagttttttttcgtttttcgtttttttcgattcgtttatgtttatgttttttttgttgtcgaggttgggttttttagttttcgttttcgcgttttcgttttagttagttcgggttcggatttgtcgcgcggtcgtttgggtttcggcgtggcgggcgtagattcggacggcggcggtagcggcggcggttagtagggtttcgagtagcgttagggaacgggcgcggcggcgcggtggcgcgggaggttgcgcggcggggtcggggttgggcggttcgcgttggttcggtcgggttcggtttatggttgcggttggcggcggttgtcggcggttcgggaagcgaaagagcggggcggggtcgggggcggggcggtcggggcggggaggggcggggcggtcgtaggggttgggcggggggtcgttggttttcggtttcgtagttcggttagagttcggggcggggttagttatatcggaacgttaagaggggttgatcgcgtttatgcggtcgggttcgtagtttcggttattttagtttttttaggtcgttttttgttttttcgcgttttttttcgtgttttcgtttttaaagttaagttaggtttttgcggtttatttgttt

SEQ ID NO: 26378 - DNA, 642 bp, Artificial Sequence
  chemically treated genomic DNA (Homo sapiens) CpG-island No: 26378
aaacaaataaaccgcaaaaacctaacttaactttaaaaacgaaaacacgaaaaaaaacgcgaaaaaacaaaaaacgacctaaaaaaactaaaataaccgaaactacgaacccgaccgcataaacgcgatcaacccctcttaacgttccgatataactaaccccgccccgaactctaaccgaactacgaaaccgaaaaccaacgaccccccgcccaacccctacgaccgccccgcccctccccgccccgaccgccccgcccccgaccccgccccgctctttcgcttcccgaaccgccgacaaccgccgccaaccgcaaccataaaccgaacccgaccgaaccaacgcgaaccgcccaaccccgaccccgccgcgcaacctcccgcgccaccgcgccgccgcgcccgttccctaacgctactcgaaaccctactaaccgccgccgctaccgccgccgtccgaatctacgcccgccacgccgaaacccaaacgaccgcgcgacaaatccgaacccgaactaactaaaacgaaaacgcgaaaacgaaaactaaaaaacccaacctcgacaacaaaaaaaacataaacataaacgaatcgaaaaaaacgaaaaacgaaaaaaaactaaacgaaaaaaaacacgaaaa

SEQ ID NO: 26379 - DNA, 642 bp, Artificial Sequence
  chemically treated genomic DNA (Homo sapiens) CpG-island No: 26379
aggtaagtgggtcgtagaggtttggtttagttttgggaacggaagtacgggaaggggcgcggagaggtaggaagcggtttggggaggttggggtggtcgggattacggattcgatcgtatagacgcgattagttttttttggcgtttcggtgtagttgatttcgtttcgggttttggtcgggttgcgaagtcgggaattagcgatttttcgtttagtttttgcggtcgtttcgttttttttcgtttcggtcgtttcgttttcggtttcgtttcgttttttcgtttttcgggtcgtcggtagtcgtcgttagtcgtagttatgggtcgggttcggtcgggttaacgcgggtcgtttagtttcggtttcgtcgcgtagtttttcgcgttatcgcgtcgtcgcgttcgttttttggcgttgttcggagttttgttggtcgtcgtcgttgtcgtcgtcgttcgggtttgcgttcgttacgtcgaggtttaggcggtcgcgcggtaggttcgggttcgagttggttggggcgggagcgcgggagcggggattgaaggatttagtttcggtagtaggggggatatgggtatggacgagtcgggggaggcggagggcggagggggattggacgggagggagtacgggaa

SEQ ID NO: 26380 - DNA, 642 bp, Artificial Sequence
  chemically treated genomic DNA (Homo sapiens) CpG-island No: 26380
ttcccgtactccctcccgtccaatccccctccgccctccgcctcccccgactcgtccatacccatatcccccctactaccgaaactaaatccttcaatccccgctcccgcgctcccgccccaaccaactcgaacccgaacctaccgcgcgaccgcctaaacctcgacgtaacgaacgcaaacccgaacgacgacgacaacgacgacgaccaacaaaactccgaacaacgccaaaaaacgaacgcgacgacgcgataacgcgaaaaactacgcgacgaaaccgaaactaaacgacccgcgttaacccgaccgaacccgacccataactacgactaacgacgactaccgacgacccgaaaaacgaaaaaacgaaacgaaaccgaaaacgaaacgaccgaaacgaaaaaaaacgaaacgaccgcaaaaactaaacgaaaaatcgctaattcccgacttcgcaacccgaccaaaacccgaaacgaaatcaactacaccgaaacgccaaaaaaaactaatcgcgtctatacgatcgaatccgtaatcccgaccaccccaacctccccaaaccgcttcctacctctccgcgccccttcccgtacttccgttcccaaaactaaaccaaacctctacgacccacttacct

SEQ ID NO: 26381 - DNA, 693 bp, Artificial Sequence
  chemically treated genomic DNA (Homo sapiens) CpG-island No: 26381
gaaattaaaatattataaattttcgaaggtatcgcgagaagcgtagatgcgtttgaggtcgtggagaggcggagcgagggcgggaacgttgagtaagtagggcggagtttaagttttttcgaggtttcggtcgggagtttgttttttttaggtggcgttttcgcgtgattgcgttttatataatcgcggtttggagcgttatagtggcgtattttaggttagatcgaattagagtgggcgaaagtttcgtgtttcgtttttttttatttgatcgacgttaaagtttattagtgagcgggcgtttagagtcgtcgtgttcgttttagttcgttcgggttcgtttcgattcgtttgcgttcgttcgtttgtcgtagttagtagtttgtagtcgtcgtcgggttgtgttttagattgttagataaatcggcgggtcgggtcggcgggtcggtgagcgcggttcgggtcggatatggcggcgttttacgtttgtattaagtgttattagcgtttttttttcgaggcgttgttttaggggtagtagttgtgtaaggtgcgcgggttggggcggcggtcgggaattggggacgtaggaggcgcggttcggagttttagattttgtggggacgttcggcggggttttcggagtagggtgtggtaggttcgttaggttgaggagtcgtatttatttcgttg

SEQ ID NO: 26382 - DNA, 693 bp, Artificial Sequence
  chemically treated genomic DNA (Homo sapiens) CpG-island No: 26382
caacgaaataaatacgactcctcaacctaacgaacctaccacaccctactccgaaaaccccgccgaacgtccccacaaaatctaaaactccgaaccgcgcctcctacgtccccaattcccgaccgccgccccaacccgcgcaccttacacaactactacccctaaaacaacgcctcgaaaaaaaaacgctaataacacttaatacaaacgtaaaacgccgccatatccgacccgaaccgcgctcaccgacccgccgacccgacccgccgatttatctaacaatctaaaacacaacccgacgacgactacaaactactaactacgacaaacgaacgaacgcaaacgaatcgaaacgaacccgaacgaactaaaacgaacacgacgactctaaacgcccgctcactaataaactttaacgtcgatcaaataaaaaaaaacgaaacacgaaactttcgcccactctaattcgatctaacctaaaatacgccactataacgctccaaaccgcgattatataaaacgcaatcacgcgaaaacgccacctaaaaaaaacaaactcccgaccgaaacctcgaaaaaacttaaactccgccctacttactcaacgttcccgccctcgctccgcctctccacgacctcaaacgcatctacgcttctcgcgataccttcgaaaatttataatattttaatttc

SEQ ID NO: 26383 - DNA, 693 bp, Artificial Sequence
  chemically treated genomic DNA (Homo sapiens) CpG-island No: 26383
tagcggggtgggtgcggttttttagtttggcgggtttgttatattttgtttcggggatttcgtcgggcgtttttatagaatttggagtttcgggtcgcgttttttgcgtttttagttttcggtcgtcgttttagttcgcgtattttgtatagttgttgtttttgagatagcgtttcgaaggggaagcgttggtggtatttggtgtaggcgtagagcgtcgttatgttcggttcgggtcgcgtttatcgattcgtcggttcggttcgtcgatttatttgatagtttgaggtataattcggcggcggttgtaggttgttggttgcggtaggcgggcgggcgtaggcgggtcggggcggattcgggcgggttggggcgggtacggcgattttagacgttcgtttattggtgggttttgacgtcgattaagtgggaaggggcggaatacggagttttcgtttattttgattcggtttggtttggagtacgttattgtgacgttttaggtcgcgattatgtaaagcgtagttacgcgggggcgttatttggaggggataggttttcggtcgggatttcggaagagtttaggtttcgttttatttgtttagcgttttcgttttcgtttcgtttttttacggttttaggcgtatttgcgtttttcgcgatattttcggggatttgtgatgttttggtttt

SEQ ID NO: 26384 - DNA, 693 bp, Artificial Sequence
  chemically treated genomic DNA (Homo sapiens) CpG-island No: 26384
aaaaccaaaacatcacaaatccccgaaaatatcgcgaaaaacgcaaatacgcctaaaaccgtaaaaaaacgaaacgaaaacgaaaacgctaaacaaataaaacgaaacctaaactcttccgaaatcccgaccgaaaacctatcccctccaaataacgcccccgcgtaactacgctttacataatcgcgacctaaaacgtcacaataacgtactccaaaccaaaccgaatcaaaataaacgaaaactccgtattccgccccttcccacttaatcgacgtcaaaacccaccaataaacgaacgtctaaaatcgccgtacccgccccaacccgcccgaatccgccccgacccgcctacgcccgcccgcctaccgcaaccaacaacctacaaccgccgccgaattatacctcaaactatcaaataaatcgacgaaccgaaccgacgaatcgataaacgcgacccgaaccgaacataacgacgctctacgcctacaccaaataccaccaacgcttccccttcgaaacgctatctcaaaaacaacaactatacaaaatacgcgaactaaaacgacgaccgaaaactaaaaacgcaaaaaacgcgacccgaaactccaaattctataaaaacgcccgacgaaatccccgaaacaaaatataacaaacccgccaaactaaaaaaccgcacccaccccgcta

SEQ ID NO: 26385 - DNA, 788 bp, Artificial Sequence
  chemically treated genomic DNA (Homo sapiens) CpG-island No: 26385
tgaggcggttacgcggggtatttggggtacgtttttcgatttgtggagtttgttatcgaagagatttcgaggttttttaaaacggtttttcgggttttttttcgtttcgacggtgaggacgtagttgttggagatgcgttcggtttttttagatttagggagggggtaggtttcggggcgcggtgaagggttatcgtagttcgggtgcgatacgtttgtggaggttaaggttaggttcggcgtcgattttcgatttttttcgtttcggtttttttattttttttcgcgttagcgtcgtttttcggtatcggggtattttggcggcgaaggcggcggttttagtcggggagttgaggtttttcgcggtgacggttaggaattcggcgacgttgaattgtttcggtatggcgggcgcgagcgtggagttgtcggagcggggcgcggggggtattgagttgtttcgcgttgagtcggttttatcgtcggtcgggggcgtcgtttcggtttttatacgtttcgttttttcgtacgtttcgttttcgattttttagtcgtttttcgttttttagttgggacggtttcgttttcggtttttcgtttttttttatcgttaaggtttaggtttcggtttcggtttcggtttcgtatcgcgttaggtcgttttttcggtttttcgtcggttttttaggttacgtttttagttttttatcgttttagatttcgttttttggcgcgatgttttatttttggttttagtagaaattttttcgtttttttttatttttgtt

SEQ ID NO: 26386 - DNA, 788 bp, Artificial Sequence
  chemically treated genomic DNA (Homo sapiens) CpG-island No: 26386
aacaaaaataaaaaaaaacgaaaaaatttctactaaaaccaaaaataaaacatcgcgccaaaaaacgaaatctaaaacgataaaaaactaaaaacgtaacctaaaaaaccgacgaaaaaccgaaaaaacgacctaacgcgatacgaaaccgaaaccgaaaccgaaacctaaaccttaacgataaaaaaaaacgaaaaaccgaaaacgaaaccgtcccaactaaaaaacgaaaaacgactaaaaaatcgaaaacgaaacgtacgaaaaaacgaaacgtataaaaaccgaaacgacgcccccgaccgacgataaaaccgactcaacgcgaaacaactcaataccccccgcgccccgctccgacaactccacgctcgcgcccgccataccgaaacaattcaacgtcgccgaattcctaaccgtcaccgcgaaaaacctcaactccccgactaaaaccgccgccttcgccgccaaaataccccgataccgaaaaacgacgctaacgcgaaaaaaaataaaaaaaccgaaacgaaaaaaatcgaaaatcgacgccgaacctaaccttaacctccacaaacgtatcgcacccgaactacgataacccttcaccgcgccccgaaacctaccccctccctaaatctaaaaaaaccgaacgcatctccaacaactacgtcctcaccgtcgaaacgaaaaaaaacccgaaaaaccgttttaaaaaacctcgaaatctcttcgataacaaactccacaaatcgaaaaacgtaccccaaataccccgcgtaaccgcctca

SEQ ID NO: 26387 - DNA, 788 bp, Artificial Sequence
  chemically treated genomic DNA (Homo sapiens) CpG-island No: 26387
ggtagggatgggggaaggcggaggagtttttattgaggttaggggtggggtatcgcgttagggggcggggtttgaggcggtgaggggttgggggcgtggtttagggggtcggcgaggggtcggggaagcggtttgacgcggtgcggggtcgggatcggggtcggagtttggattttggcggtggaggaaggcgaggagtcgggggcggggtcgttttagttgaggagcggagagcggttggagggtcgggggcggggcgtgcggaggggcggggcgtgtggaggtcgggacggcgttttcggtcggcggtgaggtcggtttagcgcggagtagtttagtgtttttcgcgtttcgtttcggtagttttacgttcgcgttcgttatgtcggagtagtttagcgtcgtcgagtttttggtcgttatcgcggaggattttagtttttcggttggggtcgtcgttttcgtcgttaagatgtttcggtatcgaggggcggcgttggcgcgggaggaggtgagggggtcgaggcgggaggggtcgggggtcggcgtcgggtttggttttgatttttataggcgtgtcgtattcgagttgcgatggttttttatcgcgtttcgaaatttgttttttttttaggtttgggaggatcgagcgtatttttaatagttgcgtttttatcgtcgaggcgggggaaggttcgagggatcgttttggggggtttcgaggttttttcgatgataaattttataggtcgggggacgtattttaagtgtttcgcgtgatcgtttta

SEQ ID NO: 26388 - DNA, 788 bp, Artificial Sequence
  chemically treated genomic DNA (Homo sapiens) CpG-island No: 26388
taaaacgatcacgcgaaacacttaaaatacgtcccccgacctataaaatttatcatcgaaaaaacctcgaaaccccccaaaacgatccctcgaaccttcccccgcctcgacgataaaaacgcaactattaaaaatacgctcgatcctcccaaacctaaaaaaaaaacaaatttcgaaacgcgataaaaaaccatcgcaactcgaatacgacacgcctataaaaatcaaaaccaaacccgacgccgacccccgacccctcccgcctcgaccccctcacctcctcccgcgccaacgccgcccctcgataccgaaacatcttaacgacgaaaacgacgaccccaaccgaaaaactaaaatcctccgcgataacgaccaaaaactcgacgacgctaaactactccgacataacgaacgcgaacgtaaaactaccgaaacgaaacgcgaaaaacactaaactactccgcgctaaaccgacctcaccgccgaccgaaaacgccgtcccgacctccacacgccccgcccctccgcacgccccgcccccgaccctccaaccgctctccgctcctcaactaaaacgaccccgcccccgactcctcgccttcctccaccgccaaaatccaaactccgaccccgatcccgaccccgcaccgcgtcaaaccgcttccccgacccctcgccgaccccctaaaccacgcccccaacccctcaccgcctcaaaccccgccccctaacgcgataccccacccctaacctcaataaaaactcctccgccttcccccatccctacc

SEQ ID NO: 26389 - DNA, 517 bp, Artificial Sequence
  chemically treated genomic DNA (Homo sapiens) CpG-island No: 26389
ttttcgggatttcgggtattagttttcgtaggcgggagtagtagtggtttatgtcgtttagtaagtttagcggttttttagttgtcgggtttttttttcggtttcgggcgatggttagattgcgtttcgataggtagtatatcgtttcgtagtagtcgcgtatcgggtttagcgtttttatgttggggagtgagtttagaggtgttttaaagagaaagaaaattaaaagaagtttcgttatagtgatttgtaacgcgcgtacgttcgtcgcggcggttatttatagagtttgtttggaaggtacgtttttttatttaaaatggttcgtttcggttttgttttcgtcggttttgggcgtttatagttcgtttaaattgtaaataggtttttttcggttggtttgacgtcgaagatcgcggagtcgcggatttaaagaatgaggaagcgttgatatcggggagaggcgggttttttcgttagtaaggatttaaaaattatttaaaattattaattttta

SEQ ID NO: 26390 - DNA, 517 bp, Artificial Sequence
  chemically treated genomic DNA (Homo sapiens) CpG-island No: 26390
taaaaattaataattttaaataatttttaaatccttactaacgaaaaaacccgcctctccccgatatcaacgcttcctcattctttaaatccgcgactccgcgatcttcgacgtcaaaccaaccgaaaaaaacctatttacaatttaaacgaactataaacgcccaaaaccgacgaaaacaaaaccgaaacgaaccattttaaataaaaaaacgtaccttccaaacaaactctataaataaccgccgcgacgaacgtacgcgcgttacaaatcactataacgaaacttcttttaattttctttctctttaaaacacctctaaactcactccccaacataaaaacgctaaacccgatacgcgactactacgaaacgatatactacctatcgaaacgcaatctaaccatcgcccgaaaccgaaaaaaaaacccgacaactaaaaaaccgctaaacttactaaacgacataaaccactactactcccgcctacgaaaactaatacccgaaatcccgaaaa

SEQ ID NO: 26391 - DNA, 517 bp, Artificial Sequence
  chemically treated genomic DNA (Homo sapiens) CpG-island No: 26391
tggaagttaatggttttgagtgatttttaaatttttgttggcggagaggttcgttttttttcggtattagcgtttttttattttttgaattcgcggtttcgcggttttcggcgttagattagtcggaggaagtttgtttgtaatttaagcgggttgtgaacgtttagggtcggcgggggtagggtcgaggcgggttattttgaataaagaggcgtgttttttaggtaggttttataagtgatcgtcgcggcgagcgtgcgcgcgttgtaggttattgtagcgggattttttttggttttttttttttttggggtatttttggatttattttttagtatgaaggcgttgagttcggtgcgcggttgttacgaggcggtgtgttgtttgtcggaacgtagtttggttatcgttcggggtcgagggaagggttcggtagttgaggagtcgttgagtttgttggacgatatgaattattgttattttcgtttgcgggaattggtattcggagtttcgagag

SEQ ID NO: 26392 - DNA, 517 bp, Artificial Sequence
  chemically treated genomic DNA (Homo sapiens) CpG-island No: 26392
ctctcgaaactccgaataccaattcccgcaaacgaaaataacaataattcatatcgtccaacaaactcaacgactcctcaactaccgaacccttccctcgaccccgaacgataaccaaactacgttccgacaaacaacacaccgcctcgtaacaaccgcgcaccgaactcaacgccttcatactaaaaaataaatccaaaaataccccaaaaaaaaaaaaaaccaaaaaaaatcccgctacaataacctacaacgcgcgcacgctcgccgcgacgatcacttataaaacctacctaaaaaacacgcctctttattcaaaataacccgcctcgaccctacccccgccgaccctaaacgttcacaacccgcttaaattacaaacaaacttcctccgactaatctaacgccgaaaaccgcgaaaccgcgaattcaaaaaataaaaaaacgctaataccgaaaaaaaacgaacctctccgccaacaaaaatttaaaaatcactcaaaaccattaacttcca

SEQ ID NO: 26393 - DNA, 853 bp, Artificial Sequence
  chemically treated genomic DNA (Homo sapiens) CpG-island No: 26393
tacgtcgacggaaaataagtgcgttttttattgtagttattaggaggcgttagtttcgtttgtttttcggtacgggttttcgtttgcgtacgcgttattttttttttttagcgttttcgttttttttttttcggtcgttattagtttcgtttggttagttgcgttcgtgcggcgacgtttacgtattttttgacgtagcgagcgacggcggggagtcgagcggaagtttagtattattgtcgttagaggaggggaggggtgagaagtataagtggtatcggaagtggaattaattcgtttattttttttgcgtttgcgaaatagaaaagataaggcgtttgtcgggcggggtgtggtttcgggtggcggagaacgttgcgattggttttcggttgtggcgatagcgacgattggtttttgcgtgtagagcgcggtgagagtgggtggtggtcgttggaatttaaaagtggcgggtgtggcgcggggttggtagcggtcggagtcgtgcgagttttttattttgtttcgcgagcgggcgagagaacgcgagttttaggattttcggtatttattttttttttattgtattttttcggcgcgtgtgggatcgaggtggatatggattcgtaggtgagtaggggcggcgtaggtgttttgttttggggatggggacgacggttgatcgtttcgatgttgtcgcgttttcggttttcggtcggtttttgttatgtttatcgggagagcgaaggttcgtgcgttttcgtataagtggaaaggggcggaggtaggagtggagacggtttagagtattcggggaggtcggaaggtacgtttgtttgtttttttttagttt

SEQ ID NO: 26394 - DNA, 853 bp, Artificial Sequence
  chemically treated genomic DNA (Homo sapiens) CpG-island No: 26394
aaactaaaaaaaaacaaacaaacgtaccttccgacctccccgaatactctaaaccgtctccactcctacctccgcccctttccacttatacgaaaacgcacgaaccttcgctctcccgataaacataacaaaaaccgaccgaaaaccgaaaacgcgacaacatcgaaacgatcaaccgtcgtccccatccccaaaacaaaacacctacgccgcccctactcacctacgaatccatatccacctcgatcccacacgcgccgaaaaaatacaataaaaaaaaaataaataccgaaaatcctaaaactcgcgttctctcgcccgctcgcgaaacaaaataaaaaactcgcacgactccgaccgctaccaaccccgcgccacacccgccacttttaaattccaacgaccaccacccactctcaccgcgctctacacgcaaaaaccaatcgtcgctatcgccacaaccgaaaaccaatcgcaacgttctccgccacccgaaaccacaccccgcccgacaaacgccttatcttttctatttcgcaaacgcaaaaaaaataaacgaattaattccacttccgataccacttatacttctcacccctcccctcctctaacgacaataatactaaacttccgctcgactccccgccgtcgctcgctacgtcaaaaaatacgtaaacgtcgccgcacgaacgcaactaaccaaacgaaactaataacgaccgaaaaaaaaaaaacgaaaacgctaaaaaaaaaaaataacgcgtacgcaaacgaaaacccgtaccgaaaaacaaacgaaactaacgcctcctaataactacaataaaaaacgcacttattttccgtcgacgta

SEQ ID NO: 26395 - DNA, 853 bp, Artificial Sequence
  chemically treated genomic DNA (Homo sapiens) CpG-island No: 26395
aagttaggggagggtagatagacgtgtttttcgattttttcgggtgttttaagtcgtttttatttttgttttcgtttttttttatttgtgcgggggcgtacggattttcgttttttcggtagatatgataaaggtcgatcgggagtcgggggcgcgatagtatcggagcggttagtcgtcgtttttatttttagggtaggatatttgcgtcgtttttatttatttgcggatttatgtttatttcggttttatacgcgtcgggggaatgtagtggaagagaagtgggtgtcggggattttgggattcgcgttttttcgttcgttcgcgaagtagggtagagaattcgtacggtttcggtcgttattagtttcgcgttatattcgttatttttgaattttaacggttattatttatttttatcgcgttttgtacgtagggattaatcgtcgttgtcgttatagtcgagggttaatcgtagcgtttttcgttattcgaagttatatttcgttcgataggcgttttgttttttttgtttcgtaggcgtaggagaggtaggcggattaattttattttcggtgttatttatgttttttatttttttttttttttagcggtaatagtgttggattttcgttcggtttttcgtcgtcgttcgttacgttagaaaatgcgtggacgtcgtcgtacgaacgtaattggttaagcgaaattggtggcggtcggaggagaaggggcggggacgttggaggaaagaaatgacgcgtgcgtaaacgaggattcgtgtcgggagataggcgggattagcgttttttggtgattgtagtagggagcgtatttgtttttcgtcgacgtg

SEQ ID NO: 26396 - DNA, 853 bp, Artificial Sequence
  chemically treated genomic DNA (Homo sapiens) CpG-island No: 26396
cacgtcgacgaaaaacaaatacgctccctactacaatcaccaaaaaacgctaatcccgcctatctcccgacacgaatcctcgtttacgcacgcgtcatttctttcctccaacgtccccgccccttctcctccgaccgccaccaatttcgcttaaccaattacgttcgtacgacgacgtccacgcattttctaacgtaacgaacgacgacgaaaaaccgaacgaaaatccaacactattaccgctaaaaaaaaaaaaaaataaaaaacataaataacaccgaaaataaaattaatccgcctacctctcctacgcctacgaaacaaaaaaaacaaaacgcctatcgaacgaaatataacttcgaataacgaaaaacgctacgattaaccctcgactataacgacaacgacgattaatccctacgtacaaaacgcgataaaaataaataataaccgttaaaattcaaaaataacgaatataacgcgaaactaataacgaccgaaaccgtacgaattctctaccctacttcgcgaacgaacgaaaaaacgcgaatcccaaaatccccgacacccacttctcttccactacattcccccgacgcgtataaaaccgaaataaacataaatccgcaaataaataaaaacgacgcaaatatcctaccctaaaaataaaaacgacgactaaccgctccgatactatcgcgcccccgactcccgatcgacctttatcatatctaccgaaaaaacgaaaatccgtacgcccccgcacaaataaaaaaaaacgaaaacaaaaataaaaacgacttaaaacacccgaaaaaatcgaaaaacacgtctatctaccctcccctaactt

SEQ ID NO: 26397 - DNA, 507 bp, Artificial Sequence
  chemically treated genomic DNA (Homo sapiens) CpG-island No: 26397
ttagcgcgcgtttttaaattgttggtttttttttttcgtttcgttttttttttgttttttcgttcgaacggttggggttttgttcgttcgttgtttattggttggttttcggtggcgttatcgttttgggttttcgcgtttttcgtttgcgttagttttggaagtacggggcgggacgtttacgggaagcggcgcgtacgttcgtcgattttttcgcgttaatcgtcgacggtcgtcgttcggtgaaggaggggtttagtttttttaggtgtcgcgcgtaggaggggatacgcgtgcgtaaaagggcggtgggtggggcgcgattcgttacggggagggcggggttggggttaatagcgagtggagggcggggcgcgcgagggaggagggcgtggtgggggtatcgagaagggtgaatggagggcggggttgtgaattggggtcggggggcgggatttggagtgattatggggggtggggtagttaacggatgtggtatggggcggg

SEQ ID NO: 26398 - DNA, 507 bp, Artificial Sequence
  chemically treated genomic DNA (Homo sapiens) CpG-island No: 26398
cccgccccataccacatccgttaactaccccaccccccataatcactccaaatcccgccccccgaccccaattcacaaccccgccctccattcacccttctcgatacccccaccacgccctcctccctcgcgcgccccgccctccactcgctattaaccccaaccccgccctccccgtaacgaatcgcgccccacccaccgcccttttacgcacgcgtatcccctcctacgcgcgacacctaaaaaaactaaacccctccttcaccgaacgacgaccgtcgacgattaacgcgaaaaaatcgacgaacgtacgcgccgcttcccgtaaacgtcccgccccgtacttccaaaactaacgcaaacgaaaaacgcgaaaacccaaaacgataacgccaccgaaaaccaaccaataaacaacgaacgaacaaaaccccaaccgttcgaacgaaaaaacaaaaaaaaaacgaaacgaaaaaaaaaaaccaacaatttaaaaacgcgcgctaa

SEQ ID NO: 26399 - DNA, 507 bp, Artificial Sequence
  chemically treated genomic DNA (Homo sapiens) CpG-island No: 26399
ttcgttttatgttatattcgttagttgttttattttttatggttattttaagtttcgtttttcggttttagtttatagtttcgttttttatttatttttttcgatgtttttattacgtttttttttttcgcgcgtttcgttttttattcgttgttagttttagtttcgtttttttcgtgacgagtcgcgttttatttatcgtttttttgcgtacgcgtgtttttttttgcgcgcggtatttgggaggattgagttttttttttatcgggcggcggtcgtcggcggttggcgcgagggagtcggcgggcgtgcgcgtcgtttttcgtggacgtttcgtttcgtgtttttagggttggcgtagacgaagggcgcgaggatttaaggcggtgacgttatcgagagttagttaatgggtagcgagcgggtagagttttagtcgttcgaacggaaaggtagggaaagggcgggacgggaggaaagagttaatagtttgggagcgcgcgttag

SEQ ID NO: 26400 - DNA, 507 bp, Artificial Sequence
  chemically treated genomic DNA (Homo sapiens) CpG-island No: 26400
ctaacgcgcgctcccaaactattaactctttcctcccgtcccgccctttccctacctttccgttcgaacgactaaaactctacccgctcgctacccattaactaactctcgataacgtcaccgccttaaatcctcgcgcccttcgtctacgccaaccctaaaaacacgaaacgaaacgtccacgaaaaacgacgcgcacgcccgccgactccctcgcgccaaccgccgacgaccgccgcccgataaaaaaaaaactcaatcctcccaaataccgcgcgcaaaaaaaaacacgcgtacgcaaaaaaacgataaataaaacgcgactcgtcacgaaaaaaacgaaactaaaactaacaacgaataaaaaacgaaacgcgcgaaaaaaaaaaacgtaataaaaacatcgaaaaaaataaataaaaaacgaaactataaactaaaaccgaaaaacgaaacttaaaataaccataaaaaataaaacaactaacgaatataacataaaacgaa

SEQ ID NO: 26401 - DNA, 628 bp, Artificial Sequence
  chemically treated genomic DNA (Homo sapiens) CpG-island No: 26401
gcgtttttcgtagtcggggttcggggagggagggtttcggtagggggcgtcggggagggaggattaggagattcgcggtttcgttttcgtcgcgtttttttttcgggcgggataattgaacggcgcggttttggtttagcgttggttgtcgaggttcggtcggagcgtggagttcgcgtcgttgttttaggatcgcgttcgcgtttttgttcgtcgtcgtttatcgttcgtcgttcgtcgtttatggagcgcgtcgcgtcgtcgcgtcgggtttcgttttcgttgttgttgttcggcggttttgcgttgttggcggtcggaggtaggggcgtttcgggttcgtcgttttagtttagggtttcgattttttcggtttcgcgttttttgcgagtttcggaattacggggattcggagttcgtgcgttgttttgcgcggcgttttcggattgttagcgtcgaggtttcggcgacgttttttttttttacggttagtttcggtttttatttttttttcggtttggggatttgttttaaaatcggatttttttattttttaaatatatcgttttattttagttttagtaaatttagtcggtttcgggggtcgtatttcgggttttgggggttt

SEQ ID NO: 26402 - DNA, 628 bp, Artificial Sequence
  chemically treated genomic DNA (Homo sapiens) CpG-island No: 26402
aaacccccaaaacccgaaatacgacccccgaaaccgactaaatttactaaaactaaaataaaacgatatatttaaaaaataaaaaaatccgattttaaaacaaatccccaaaccgaaaaaaaaataaaaaccgaaactaaccgtaaaaaaaaaaaacgtcgccgaaacctcgacgctaacaatccgaaaacgccgcgcaaaacaacgcacgaactccgaatccccgtaattccgaaactcgcaaaaaacgcgaaaccgaaaaaatcgaaaccctaaactaaaacgacgaacccgaaacgcccctacctccgaccgccaacaacgcaaaaccgccgaacaacaacaacgaaaacgaaacccgacgcgacgacgcgacgcgctccataaacgacgaacgacgaacgataaacgacgacgaacaaaaacgcgaacgcgatcctaaaacaacgacgcgaactccacgctccgaccgaacctcgacaaccaacgctaaaccaaaaccgcgccgttcaattatcccgcccgaaaaaaaaacgcgacgaaaacgaaaccgcgaatctcctaatcctccctccccgacgccccctaccgaaaccctccctccccgaaccccgactacgaaaaacgc

SEQ ID NO: 26403 - DNA, 628 bp, Artificial Sequence
  chemically treated genomic DNA (Homo sapiens) CpG-island No: 26403
gaatttttagggttcgggatgcggttttcggagtcggttggatttgttaggattggggtaggacggtgtgtttgaggggtgggggaattcggttttgaaataagtttttaggtcggggaggagatgaggatcggagttggtcgtgggggaggggggcgtcgtcgaggtttcggcgttgatagttcgggggcgtcgcgtagggtaacgtacggatttcgagttttcgtggtttcgaaattcgtagggagcgcgaggtcgagggggtcgggattttaagttggggcggcggattcgggacgtttttattttcggtcgttagtagcgtaaggtcgtcgagtagtagtagcggaagcgggattcggcgcgacggcgcggcgcgttttatgggcggcgggcgacgggcggtgggcggcggcggataaaggcgcgggcgcggttttggggtagcggcgcgggttttacgtttcggtcgagtttcggtagttaacgttgggttagggtcgcgtcgtttaattatttcgttcgggaggagggcgcggcggaggcggggtcgcgggttttttggtttttttttttcggcgttttttgtcgggatttttttttttcggatttcggttgcgaggggcgt

SEQ ID NO: 26404 - DNA, 628 bp, Artificial Sequence
  chemically treated genomic DNA (Homo sapiens) CpG-island No: 26404
acgcccctcgcaaccgaaatccgaaaaaaaaaaatcccgacaaaaaacgccgaaaaaaaaaaaccaaaaaacccgcgaccccgcctccgccgcgccctcctcccgaacgaaataattaaacgacgcgaccctaacccaacgttaactaccgaaactcgaccgaaacgtaaaacccgcgccgctaccccaaaaccgcgcccgcgcctttatccgccgccgcccaccgcccgtcgcccgccgcccataaaacgcgccgcgccgtcgcgccgaatcccgcttccgctactactactcgacgaccttacgctactaacgaccgaaaataaaaacgtcccgaatccgccgccccaacttaaaatcccgaccccctcgacctcgcgctccctacgaatttcgaaaccacgaaaactcgaaatccgtacgttaccctacgcgacgcccccgaactatcaacgccgaaacctcgacgacgcccccctcccccacgaccaactccgatcctcatctcctccccgacctaaaaacttatttcaaaaccgaattcccccacccctcaaacacaccgtcctaccccaatcctaacaaatccaaccgactccgaaaaccgcatcccgaaccctaaaaattc

SEQ ID NO: 26405 - DNA, 574 bp, Artificial Sequence
  chemically treated genomic DNA (Homo sapiens) CpG-island No: 26405
cgtgggaggtagttgcgtttttggggttcggttttgcgagtagtcgtgggtggggaaaggagtttgggggtacgcgggttttgggagtggataagggggtggcgttcgggggttgagggggtttaggggcgagtgtatttaaggcgtgtcggtttcgtttagtcgcgttttgggtgcggcgagtttgtatattggtgtagatgttttcgtcgtcgcgtcgggcgtaggtttgtatttgtaagttcgggattagggatttgaaagcgttcggcgcgtcgtttggatttgtttcgtcgggcgttatcgttgcgttttaggcgggaattgtaggaaaattttttttgtttggcgggagggcgggggaggaggacggtttacgatcgatttcgggtgcggtaggggaagattttgtcggggtcggggcggggggaggcgggtaaagggtttattacgttggggtcgaaagtttaagtaagtcgcgcgttttttgatttttaatattttaggttgtaggataagtagtattgttttatttatttttggacgttgcgttgggcgttttatttgtttttat

SEQ ID NO: 26406 - DNA, 574 bp, Artificial Sequence
  chemically treated genomic DNA (Homo sapiens) CpG-island No: 26406
ataaaaacaaataaaacgcccaacgcaacgtccaaaaataaataaaacaatactacttatcctacaacctaaaatattaaaaatcaaaaaacgcgcgacttacttaaactttcgaccccaacgtaataaaccctttacccgcctccccccgccccgaccccgacaaaatcttcccctaccgcacccgaaatcgatcgtaaaccgtcctcctcccccgccctcccgccaaacaaaaaaaattttcctacaattcccgcctaaaacgcaacgataacgcccgacgaaacaaatccaaacgacgcgccgaacgctttcaaatccctaatcccgaacttacaaatacaaacctacgcccgacgcgacgacgaaaacatctacaccaatatacaaactcgccgcacccaaaacgcgactaaacgaaaccgacacgccttaaatacactcgcccctaaaccccctcaacccccgaacgccacccccttatccactcccaaaacccgcgtacccccaaactcctttccccacccacgactactcgcaaaaccgaaccccaaaaacgcaactacctcccacg

SEQ ID NO: 26407 - DNA, 574 bp, Artificial Sequence
  chemically treated genomic DNA (Homo sapiens) CpG-island No: 26407
atagaagtaagtaaaacgtttaacgtaacgtttagaaatggatgagatagtattgtttattttatagtttgggatgttagggattagagagcgcgcggtttgtttaaattttcggttttagcgtggtaggttttttgttcgttttttttcgtttcgatttcggtaaggtttttttttgtcgtattcggggtcggtcgtgggtcgtttttttttttcgttttttcgttaggtagaggggatttttttatagttttcgtttaaagcgtagcggtgacgttcggcggggtaggtttaggcggcgcgtcgggcgtttttaagtttttggtttcgggtttgtaagtgtagatttgcgttcggcgcggcggcgggaatatttgtattagtgtgtagattcgtcgtatttagagcgcggttgggcgggatcggtacgttttgggtatattcgtttttgggtttttttaattttcgggcgttatttttttatttatttttagagttcgcgtatttttaaatttttttttttatttacggttgttcgtagggtcgggttttaagggcgtagttattttttacg

SEQ ID NO: 26408 - DNA, 574 bp, Artificial Sequence
  chemically treated genomic DNA (Homo sapiens) CpG-island No: 26408
cgtaaaaaataactacgcccttaaaacccgaccctacgaacaaccgtaaataaaaaaaaaaatttaaaaatacgcgaactctaaaaataaataaaaaaataacgcccgaaaattaaaaaaacccaaaaacgaatatacccaaaacgtaccgatcccgcccaaccgcgctctaaatacgacgaatctacacactaatacaaatattcccgccgccgcgccgaacgcaaatctacacttacaaacccgaaaccaaaaacttaaaaacgcccgacgcgccgcctaaacctaccccgccgaacgtcaccgctacgctttaaacgaaaactataaaaaaatcccctctacctaacgaaaaaacgaaaaaaaaaaacgacccacgaccgaccccgaatacgacaaaaaaaaaccttaccgaaatcgaaacgaaaaaaaacgaacaaaaaacctaccacgctaaaaccgaaaatttaaacaaaccgcgcgctctctaatccctaacatcccaaactataaaataaacaatactatctcatccatttctaaacgttacgttaaacgttttacttacttctat

SEQ ID NO: 26409 - DNA, 798 bp, Artificial Sequence
  chemically treated genomic DNA (Homo sapiens) CpG-island No: 26409
ggtggttgttgaggtaatcgatatttcgggtaacggtaagtggaggcgggagggggcgtggtttcgacgggtaagcggcgataagaggtggcgtttttcgcggtattgcgagtatcgttagtttgcgtcgttaggcgtaggcggggtggtttttgcgtttttcgtttttttgaaaaattcggcgggcgagcgaggttgcgggtcggtcgttgtttttttttatatttttcgtcgagaagtttcgttcggcgtttaatatggcgggtgggcgttgcggttcgtagttaacggcgtttttggtcgtttggatcgcggttgtggcggcgacggtaggtttcgaggaggtcgcgttgtcgtcggagtagagtcgggtttagtttatgatcgtttttaattggacgttggtgatggagggcgagtggatgttgaaattgtgagtgtgttcgttcgtttcggacgtcgtagtgttttcgcgggcgttatttttttaagttcgcgcggttcggtggcgatttcgtattgtcgtttgggtttaatttaaaatttcggattaggtttgttaataatttgcggcgtcggtgtcgggtcgtttgcgattttgtattgtcgttgggttcgatttggggttcgcggattcgttttattaacgatttgcggttgtggggttcggtcgttcgcgtcgcgtatgcgcgtcgagttttcgcggtgatagtcgagggtgtagcgcgtttttttgttttgggggatagtgttttcggggtggagtgggtagttttttatagggaggagaagggaagg

SEQ ID NO: 26410 - DNA, 798 bp, Artificial Sequence
  chemically treated genomic DNA (Homo sapiens) CpG-island No: 26410
ccttcccttctcctccctataaaaaactacccactccaccccgaaaacactatcccccaaaacaaaaaaacgcgctacaccctcgactatcaccgcgaaaactcgacgcgcatacgcgacgcgaacgaccgaaccccacaaccgcaaatcgttaataaaacgaatccgcgaaccccaaatcgaacccaacgacaatacaaaatcgcaaacgacccgacaccgacgccgcaaattattaacaaacctaatccgaaattttaaattaaacccaaacgacaatacgaaatcgccaccgaaccgcgcgaacttaaaaaaataacgcccgcgaaaacactacgacgtccgaaacgaacgaacacactcacaatttcaacatccactcgccctccatcaccaacgtccaattaaaaacgatcataaactaaacccgactctactccgacgacaacgcgacctcctcgaaacctaccgtcgccgccacaaccgcgatccaaacgaccaaaaacgccgttaactacgaaccgcaacgcccacccgccatattaaacgccgaacgaaacttctcgacgaaaaatataaaaaaaaacaacgaccgacccgcaacctcgctcgcccgccgaatttttcaaaaaaacgaaaaacgcaaaaaccaccccgcctacgcctaacgacgcaaactaacgatactcgcaataccgcgaaaaacgccacctcttatcgccgcttacccgtcgaaaccacgccccctcccgcctccacttaccgttacccgaaatatcgattacctcaacaaccacc

SEQ ID NO: 26411 - DNA, 798 bp, Artificial Sequence
  chemically treated genomic DNA (Homo sapiens) CpG-island No: 26411
ttttttttttttttttttatgggaagttgtttattttatttcgaaaatattgttttttaaagtaaggggacgcgttgtattttcggttgttatcgcgagggttcggcgcgtatgcgcggcgcgagcggtcgggttttatagtcgtaggtcgttggtaaggcgggttcgcggattttaggtcgagtttagcggtagtgtaggatcgtaagcggttcggtatcggcgtcgtaggttgttggtaagtttggttcggggttttaggttgagtttaagcggtaatgcgggatcgttatcgggtcgcgcgggtttgggagggtgacgttcgcgaggatattgcggcgttcggggcgggcgggtatatttataattttagtatttattcgttttttattattagcgtttagttggaggcggttatgggttggattcggttttgtttcggcggtagcgcggttttttcggggtttgtcgtcgtcgttatagtcgcgatttaggcggttaggagcgtcgttagttgcgggtcgtagcgtttattcgttatgttgggcgtcgagcgaggtttttcggcggggagtgtggggaagggtagcggtcggttcgtagtttcgttcgttcgtcgggttttttaaggaagcgggagacgtaagggttatttcgtttacgtttagcggcgtagattggcggtgttcgtaatgtcgcggaggacgttattttttatcgtcgtttgttcgtcgaggttacgttttttttcgtttttatttgtcgttgttcggggtgtcggttattttagtaattatt

SEQ ID NO: 26412 - DNA, 798 bp, Artificial Sequence
  chemically treated genomic DNA (Homo sapiens) CpG-island No: 26412
aataattactaaaataaccgacaccccgaacaacgacaaataaaaacgaaaaaaaacgtaacctcgacgaacaaacgacgataaaaaataacgtcctccgcgacattacgaacaccgccaatctacgccgctaaacgtaaacgaaataacccttacgtctcccgcttccttaaaaaacccgacgaacgaacgaaactacgaaccgaccgctacccttccccacactccccgccgaaaaacctcgctcgacgcccaacataacgaataaacgctacgacccgcaactaacgacgctcctaaccgcctaaatcgcgactataacgacgacgacaaaccccgaaaaaaccgcgctaccgccgaaacaaaaccgaatccaacccataaccgcctccaactaaacgctaataataaaaaacgaataaatactaaaattataaatatacccgcccgccccgaacgccgcaatatcctcgcgaacgtcaccctcccaaacccgcgcgacccgataacgatcccgcattaccgcttaaactcaacctaaaaccccgaaccaaacttaccaacaacctacgacgccgataccgaaccgcttacgatcctacactaccgctaaactcgacctaaaatccgcgaacccgccttaccaacgacctacgactataaaacccgaccgctcgcgccgcgcatacgcgccgaaccctcgcgataacaaccgaaaatacaacgcgtccccttactttaaaaaacaatattttcgaaataaaataaacaacttcccataaaaaaaaaaaaaaaaaa

SEQ ID NO: 26413 - DNA, 582 bp, Artificial Sequence
  chemically treated genomic DNA (Homo sapiens) CpG-island No: 26413
ttcgcgttcgttttttcgtttttttttcgttcgtttttttttttattatcgtagcgttaggaggaaggcggtcggggtttaagatggttttagtcgggttttgcgttttgttcgtttgttgttgggggtcggcggcggtgttggttacggtcgtcggcgacgtggatttatttaaggagttggagtgtaagtttaaaagtattacggtgtcggtattgttttttttgcgcgagaacgatttgagtattatgtatagtttttcggtttcggagtttaagttttttttttcggtgcgtaacgatttttcgggagaaatggtcgtggtggacgatttggagaatacggagttgttttatttcgtgttgggtgagtttcgggggaggtcgaggcggtcggaggcgttggatcggcgtttttattttttattttagttcgttttatatatttattcgtcgacgatttttttttttttatttttatttttcggattcgttttattttcggattattttttatatttatttgtatattagcgtttttgtgtatttgatttttttttaaattcgatttggatgttgagtt

SEQ ID NO: 26414 - DNA, 582 bp, Artificial Sequence
  chemically treated genomic DNA (Homo sapiens) CpG-island No: 26414
aactcaacatccaaatcgaatttaaaaaaaaatcaaatacacaaaaacgctaatatacaaataaatataaaaaataatccgaaaataaaacgaatccgaaaaataaaaataaaaaaaaaaaaatcgtcgacgaataaatatataaaacgaactaaaataaaaaataaaaacgccgatccaacgcctccgaccgcctcgacctcccccgaaactcacccaacacgaaataaaacaactccgtattctccaaatcgtccaccacgaccatttctcccgaaaaatcgttacgcaccgaaaaaaaaaacttaaactccgaaaccgaaaaactatacataatactcaaatcgttctcgcgcaaaaaaaacaataccgacaccgtaatacttttaaacttacactccaactccttaaataaatccacgtcgccgacgaccgtaaccaacaccgccgccgacccccaacaacaaacgaacaaaacgcaaaacccgactaaaaccatcttaaaccccgaccgccttcctcctaacgctacgataataaaaaaaaaaacgaacgaaaaaaaaacgaaaaaacgaacgcgaa

SEQ ID NO: 26415 - DNA, 582 bp, Artificial Sequence
  chemically treated genomic DNA (Homo sapiens) CpG-island No: 26415
ggtttagtatttaggtcggatttggggagaagttaggtgtatagaggcgttagtatgtaagtgggtgtggagaatggttcgggagtggggcggattcgggaggtaggagtgggggaggggaggtcgtcggcgagtgggtgtgtagagcgagttggagtggggggtgggggcgtcggtttagcgttttcggtcgtttcgatttttttcgggatttatttagtacgaagtagggtagtttcgtgttttttaggtcgtttattacgattatttttttcgggaagtcgttgcgtatcgagaagaggagtttgggtttcgaggtcgaggggttgtgtatgatgtttaggtcgttttcgcgtaggaagggtagtgtcgatatcgtgatgtttttgagtttgtattttagttttttggatggatttacgtcgtcggcggtcgtggttagtatcgtcgtcggtttttagtagtaggcgagtagggcgtagagttcggttaaagttattttgagtttcggtcgttttttttttagcgttgcgatggtgggggaggaagcgagcggggagggagcgagggagcgagcgcggg

SEQ ID NO: 26416 - DNA, 582 bp, Artificial Sequence
  chemically treated genomic DNA (Homo sapiens) CpG-island No: 26416
cccgcgctcgctccctcgctccctccccgctcgcttcctcccccaccatcgcaacgctaaaaaaaaaacgaccgaaactcaaaataactttaaccgaactctacgccctactcgcctactactaaaaaccgacgacgatactaaccacgaccgccgacgacgtaaatccatccaaaaaactaaaatacaaactcaaaaacatcacgatatcgacactacccttcctacgcgaaaacgacctaaacatcatacacaacccctcgacctcgaaacccaaactcctcttctcgatacgcaacgacttcccgaaaaaaataatcgtaataaacgacctaaaaaacacgaaactaccctacttcgtactaaataaatcccgaaaaaaatcgaaacgaccgaaaacgctaaaccgacgcccccaccccccactccaactcgctctacacacccactcgccgacgacctcccctcccccactcctacctcccgaatccgccccactcccgaaccattctccacacccacttacatactaacgcctctatacacctaacttctccccaaatccgacctaaatactaaacc

SEQ ID NO: 26417 - DNA, 528 bp, Artificial Sequence
  chemically treated genomic DNA (Homo sapiens) CpG-island No: 26417
gtcgcggggattcgataggcggtattacgtatatatttgcggtaggtgtgcggagtcgttttttttcgggaaagtgttgggttggggggatgatggggcgttggggggtggatttcggttgcgggttgcgttcggtttttagcgttggggattttcgttgcgcgtttttttcgcgtattttacgcgcgttaggaggagatcgcgcgttttacgttcgtggagaggaggggacgcgtttttttcggttgtcgtcgtagtgtttttcggtttttagtagggggcgcgttagagtgttaggcgtcgttgcgaggtttttcggtttcgcgggattcgtcggggtttttttttgtttttcgtttttatttggttgaggtagttttcgtcgttggttttcgtttttatttttatttttattagtatcgcgttcggtttcgttatataatatagtatggttggggttgtcgttgtcgttatagtcgttttttttttggtgtgcgcggggttgtcgttttgttattggtgggattt

SEQ ID NO: 26418 - DNA, 528 bp, Artificial Sequence
  chemically treated genomic DNA (Homo sapiens) CpG-island No: 26418
aaatcccaccaataacaaaacgacaaccccgcgcacaccaaaaaaaaaacgactataacgacaacgacaaccccaaccatactatattatataacgaaaccgaacgcgatactaataaaaataaaaataaaaacgaaaaccaacgacgaaaactacctcaaccaaataaaaacgaaaaacaaaaaaaaaccccgacgaatcccgcgaaaccgaaaaacctcgcaacgacgcctaacactctaacgcgccccctactaaaaaccgaaaaacactacgacgacaaccgaaaaaaacgcgtcccctcctctccacgaacgtaaaacgcgcgatctcctcctaacgcgcgtaaaatacgcgaaaaaaacgcgcaacgaaaatccccaacgctaaaaaccgaacgcaacccgcaaccgaaatccaccccccaacgccccatcatccccccaacccaacactttcccgaaaaaaaacgactccgcacacctaccgcaaatatatacgtaataccgcctatcgaatccccgcgac

SEQ ID NO: 26419 - DNA, 528 bp, Artificial Sequence
  chemically treated genomic DNA (Homo sapiens) CpG-island No: 26419
gggttttattagtgataaggcggtagtttcgcgtatattaaagagaaggcggttgtggcggtagcggtagttttagttatgttgtgttatgtgacgaggtcggacgcggtgttgatggaggtggaggtggaggcgaaagttaacggcgaggattgttttaattaggtgagggcgaggggtaagaaggggtttcggcgggtttcgcgaggtcgaggggtttcgtagcgacgtttggtattttggcgcgttttttattaggggtcgggaggtattgcggcggtagtcggggggagcgcgtttttttttttttacgggcgtggggcgcgcggtttttttttggcgcgcgtggggtgcgcggagaaagcgcgtagcgggggtttttagcgttgagggtcgggcgtagttcgtagtcgggatttattttttagcgttttattatttttttaatttagtattttttcggaagaaggcggtttcgtatatttgtcgtaggtatgtgcgtgatgtcgtttgtcgggttttcgcggt

SEQ ID NO: 26420 - DNA, 528 bp, Artificial Sequence
  chemically treated genomic DNA (Homo sapiens) CpG-island No: 26420
accgcgaaaacccgacaaacgacatcacgcacatacctacgacaaatatacgaaaccgccttcttccgaaaaaatactaaattaaaaaaataataaaacgctaaaaaataaatcccgactacgaactacgcccgaccctcaacgctaaaaacccccgctacgcgctttctccgcgcaccccacgcgcgccaaaaaaaaaccgcgcgccccacgcccgtaaaaaaaaaaaaacgcgctccccccgactaccgccgcaatacctcccgacccctaataaaaaacgcgccaaaataccaaacgtcgctacgaaacccctcgacctcgcgaaacccgccgaaaccccttcttacccctcgccctcacctaattaaaacaatcctcgccgttaactttcgcctccacctccacctccatcaacaccgcgtccgacctcgtcacataacacaacataactaaaactaccgctaccgccacaaccgccttctctttaatatacgcgaaactaccgccttatcactaataaaaccc

SEQ ID NO: 26421 - DNA, 1267 bp, Artificial Sequence
  chemically treated genomic DNA (Homo sapiens) CpG-island No: 26421
aacggagaaggtagcggtttttttaaataaggcggagaaggttaagatgatgatcggacggttattttaggtattcgtttcgaggtcgcggggggagggattttattatgtaaatttgagttgttgatcgatgacgcgttattattttacgtatcgtttcgttcgtttattggttgagatgagtttggttttattgataataaataggggggcgcgcggtttggaggcggggtcgtagggggcgcgggttggggcgggggaatttcgtttcgttttttttgtgcggcgttcgggcgtaacgtaaatatggcggcgggtggtattcgtcggtgaggcggtgtcgggcgggggttgtcgggtgttatgggcggtggcgacggtatcgttttcgcgtttttttgagcgggacggtagggggggtttttgcgttgagtcgggcgatggacgatagcggcgagttgggtggtttggagattatggagatttttacggagttgggcgacgagttgattttgggagatatcgacggtgagtggtgggtgggtgggagtgcgggggtcgcgcggggaggaaggggttacggcggcgcgttcgggtgcgcgtgcgtttatttttcgatagtttcggttcgcgcgggaagaatttcgtgcgtacggtgttttcggcggtttttaattttttcggcgttgcgagcgtgagttcgatttagttgcgtcgtttcgggaggtcgtgggatttggggcgtcgcggggtcgaaagcggcgcgagggtcgcgggttttagagcgcggggttagggacgtcgcgggggcgttttagggagcggtttaaggagagcgcgtggtcgtcgtttttttcgcgcgtttatacgcggttttcgtggttcgttttttcgtcgttcgcgatcgcgcgtcgtatttgttattttttttttggtcgcggggacgtttttgggattttcggggtttagtttttagttttcgcgtttcgaatttttgggttttttaggattgatcgacggttaggtcgtcgggtgtttcgcgaaattttgggtagcgattgtagaagtaagttgttgatgaagagagtagtggcggcggagtgtggatatattttttcgggatggagattcgggcgtttttgttgttacgttgtaaggggaattgagtagaagaaattttgagttgtggtttttcgggtacgggttggggagcgggtggtttttgttttagcgttttaatagcggagtggaagagttggtaggagtt

SEQ ID NO: 26422 - DNA, 1267 bp, Artificial Sequence
  chemically treated genomic DNA (Homo sapiens) CpG-island No: 26422
aactcctaccaactcttccactccgctattaaaacgctaaaacaaaaaccacccgctccccaacccgtacccgaaaaaccacaactcaaaatttcttctactcaattccccttacaacgtaacaacaaaaacgcccgaatctccatcccgaaaaaatatatccacactccgccgccactactctcttcatcaacaacttacttctacaatcgctacccaaaatttcgcgaaacacccgacgacctaaccgtcgatcaatcctaaaaaacccaaaaattcgaaacgcgaaaactaaaaactaaaccccgaaaatcccaaaaacgtccccgcgaccaaaaaaaaaataacaaatacgacgcgcgatcgcgaacgacgaaaaaacgaaccacgaaaaccgcgtataaacgcgcgaaaaaaacgacgaccacgcgctctccttaaaccgctccctaaaacgcccccgcgacgtccctaaccccgcgctctaaaacccgcgaccctcgcgccgctttcgaccccgcgacgccccaaatcccacgacctcccgaaacgacgcaactaaatcgaactcacgctcgcaacgccgaaaaaattaaaaaccgccgaaaacaccgtacgcacgaaattcttcccgcgcgaaccgaaactatcgaaaaataaacgcacgcgcacccgaacgcgccgccgtaaccccttcctccccgcgcgacccccgcactcccacccacccaccactcaccgtcgatatctcccaaaatcaactcgtcgcccaactccgtaaaaatctccataatctccaaaccacccaactcgccgctatcgtccatcgcccgactcaacgcaaaaaccccccctaccgtcccgctcaaaaaaacgcgaaaacgataccgtcgccaccgcccataacacccgacaacccccgcccgacaccgcctcaccgacgaataccacccgccgccatatttacgttacgcccgaacgccgcacaaaaaaaacgaaacgaaattcccccgccccaacccgcgccccctacgaccccgcctccaaaccgcgcgcccccctatttattatcaataaaaccaaactcatctcaaccaataaacgaacgaaacgatacgtaaaataataacgcgtcatcgatcaacaactcaaatttacataataaaatccctccccccgcgacctcgaaacgaatacctaaaataaccgtccgatcatcatcttaaccttctccgccttatttaaaaaaaccgctaccttctccgtt

SEQ ID NO: 26423 - DNA, 1267 bp, Artificial Sequence
  chemically treated genomic DNA (Homo sapiens) CpG-island No: 26423
ggtttttattagtttttttatttcgttgttaaggcgttggaataaaggttattcgttttttagttcgtattcgaggggttataatttaaaattttttttgtttaattttttttgtagcgtgatagtaggagcgttcgggtttttatttcggagagatgtgtttatatttcgtcgttattgttttttttattagtaatttgtttttgtagtcgttgtttaaagtttcgcggagtattcggcgatttggtcgtcggttaattttgagaagtttagggattcggggcgcggagattgggggttgggtttcgggaattttaaagacgttttcgcggttaggaagggagtgataggtgcgacgcgcggtcgcgggcggcgggagagcggattacggaaatcgcgtgtgggcgcgcgagggaggcggcggttacgcgttttttttaggtcgttttttgagacgttttcgcgacgtttttagtttcgcgttttggaattcgcgattttcgcgtcgttttcggtttcgcggcgttttagattttacggtttttcggagcggcgtagttgggtcgggtttacgttcgtagcgtcggaagggttgaggatcgtcgggggtatcgtgcgtacggggtttttttcgcgcgaatcggggttgtcggggggtgggcgtacgcgtattcgggcgcgtcgtcgtaattttttttttttcgcgcggttttcgtatttttatttatttattatttatcgtcgatgttttttagggttagttcgtcgtttagtttcgtgagggtttttatggtttttagattatttagttcgtcgttgtcgtttatcgttcggtttagcgtagaagttttttttgtcgtttcgtttagggagacgcgggggcggtgtcgtcgttatcgtttatgatattcgataattttcgttcggtatcgttttatcgacgggtgttattcgtcgttatgtttgcgttgcgttcgggcgtcgtatagaaagggcggggcgggattttttcgttttagttcgcgttttttgcggtttcgtttttaggtcgcgcgtttttttgtttgttgttaatgggattaggtttattttagttaatgggcgagcgaagcggtgcgtggggtgatggcgcgttatcgattagtagtttagatttgtatagtgaggttttttttttcgcggtttcggagcgaatgtttggagtagtcgttcggttattattttaatttttttcgttttgtttaaaggagtcgttgtttttttcgtt

SEQ ID NO: 26424 - DNA, 1267 bp, Artificial Sequence
  chemically treated genomic DNA (Homo sapiens) CpG-island No: 26424
aacgaaaaaaacaacgactcctttaaacaaaacgaaaaaaattaaaataataaccgaacgactactccaaacattcgctccgaaaccgcgaaaaaaaaaacctcactatacaaatctaaactactaatcgataacgcgccatcaccccacgcaccgcttcgctcgcccattaactaaaataaacctaatcccattaacaacaaacaaaaaaacgcgcgacctaaaaacgaaaccgcaaaaaacgcgaactaaaacgaaaaaatcccgccccgccctttctatacgacgcccgaacgcaacgcaaacataacgacgaataacacccgtcgataaaacgataccgaacgaaaattatcgaatatcataaacgataacgacgacaccgcccccgcgtctccctaaacgaaacgacaaaaaaaacttctacgctaaaccgaacgataaacgacaacgacgaactaaataatctaaaaaccataaaaaccctcacgaaactaaacgacgaactaaccctaaaaaacatcgacgataaataataaataaataaaaatacgaaaaccgcgcgaaaaaaaaaaaattacgacgacgcgcccgaatacgcgtacgcccaccccccgacaaccccgattcgcgcgaaaaaaaccccgtacgcacgatacccccgacgatcctcaacccttccgacgctacgaacgtaaacccgacccaactacgccgctccgaaaaaccgtaaaatctaaaacgccgcgaaaccgaaaacgacgcgaaaatcgcgaattccaaaacgcgaaactaaaaacgtcgcgaaaacgtctcaaaaaacgacctaaaaaaaacgcgtaaccgccgcctccctcgcgcgcccacacgcgatttccgtaatccgctctcccgccgcccgcgaccgcgcgtcgcacctatcactcccttcctaaccgcgaaaacgtctttaaaattcccgaaacccaacccccaatctccgcgccccgaatccctaaacttctcaaaattaaccgacgaccaaatcgccgaatactccgcgaaactttaaacaacgactacaaaaacaaattactaataaaaaaaacaataacgacgaaatataaacacatctctccgaaataaaaacccgaacgctcctactatcacgctacaaaaaaaattaaacaaaaaaaattttaaattataacccctcgaatacgaactaaaaaacgaataacctttattccaacgccttaacaacgaaataaaaaaactaataaaaacc

SEQ ID NO: 26425 - DNA, 581 bp, Artificial Sequence
  chemically treated genomic DNA (Homo sapiens) CpG-island No: 26425
agatagtcgttgtcgacgttaggggcgaggcgtagtgagttttttttcgagttttttttttcgcgttaagtattgtaattcgttgcggagatagtagaggtttgatcgtttcgttgaggttttagaatagtaaagtaagttattgggattgtcgaagtttcgcgtgtttttcgttttcgcgggtgtcgggtttggagagtgttaagtattttgagattcgcgtttttttagcgcgtgaattttaatcgttaatcgaatattgcgtttttcgattttgttcgattttgtagacgttcgaaatttcggaagttaaaatcgtgtttgaatttattgttcgcgttttatttttttttatgggtagttttttgagtaaattggaattttcgttttcgtttttagtttaggtgcgtatcgatttgttcgagaggtttacgaaacgtcggttattttagtttttttattaagtttatcgggtttagttcgtttatcgcgtttattttgttttacggtatagatttgtgaggaggcggttaaatttggattttgttaatttaattacgtggttggttaacgaggtttgg

SEQ ID NO: 26426 - DNA, 581 bp, Artificial Sequence
  chemically treated genomic DNA (Homo sapiens) CpG-island No: 26426
ccaaacctcgttaaccaaccacgtaattaaattaacaaaatccaaatttaaccgcctcctcacaaatctataccgtaaaacaaaataaacgcgataaacgaactaaacccgataaacttaataaaaaaactaaaataaccgacgtttcgtaaacctctcgaacaaatcgatacgcacctaaactaaaaacgaaaacgaaaattccaatttactcaaaaaactacccataaaaaaaaataaaacgcgaacaataaattcaaacacgattttaacttccgaaatttcgaacgtctacaaaatcgaacaaaatcgaaaaacgcaatattcgattaacgattaaaattcacgcgctaaaaaaacgcgaatctcaaaatacttaacactctccaaacccgacacccgcgaaaacgaaaaacacgcgaaacttcgacaatcccaataacttactttactattctaaaacctcaacgaaacgatcaaacctctactatctccgcaacgaattacaatacttaacgcgaaaaaaaaaactcgaaaaaaaactcactacgcctcgcccctaacgtcgacaacgactatct

SEQ ID NO: 26427 - DNA, 581 bp, Artificial Sequence
  chemically treated genomic DNA (Homo sapiens) CpG-island No: 26427
ttaggtttcgttggttagttacgtggttggattggtaggatttaggtttggtcgtttttttataggtttatatcgtggggtagggtgggcgcggtggacgaattgaattcgatgaatttggtgaaggggttgaggtggtcggcgtttcgtgggtttttcgggtaagtcggtgcgtatttgggttggggacgagggcgaaagttttagtttgtttaggaaattgtttatgaggagagatgaggcgcgggtagtgagtttaagtacggttttggttttcgaggtttcggacgtttgtagaatcggatagagtcgaagagcgtagtgttcggttgacggttgggatttacgcgttaggaaagcgcgagttttagggtgtttagtattttttaggttcggtattcgcgggaacgggggatacgcgggatttcggtagttttagtaatttgttttgttgttttgagattttagcggggcggttagatttttgttgttttcgtagcgagttgtagtatttggcgcggggagaggaattcgagaggaagtttattgcgtttcgtttttggcgtcggtagcggttgttt

SEQ ID NO: 26428 - DNA, 581 bp, Artificial Sequence
  chemically treated genomic DNA (Homo sapiens) CpG-island No: 26428
aaacaaccgctaccgacgccaaaaacgaaacgcaataaacttcctctcgaattcctctccccgcgccaaatactacaactcgctacgaaaacaacaaaaatctaaccgccccgctaaaatctcaaaacaacaaaacaaattactaaaactaccgaaatcccgcgtatcccccgttcccgcgaataccgaacctaaaaaatactaaacaccctaaaactcgcgctttcctaacgcgtaaatcccaaccgtcaaccgaacactacgctcttcgactctatccgattctacaaacgtccgaaacctcgaaaaccaaaaccgtacttaaactcactacccgcgcctcatctctcctcataaacaatttcctaaacaaactaaaactttcgccctcgtccccaacccaaatacgcaccgacttacccgaaaaacccacgaaacgccgaccacctcaaccccttcaccaaattcatcgaattcaattcgtccaccgcgcccaccctaccccacgatataaacctataaaaaaacgaccaaacctaaatcctaccaatccaaccacgtaactaaccaacgaaacctaa

SEQ ID NO: 26429 - DNA, 822 bp, Artificial Sequence
  chemically treated genomic DNA (Homo sapiens) CpG-island No: 26429
agacgttcgagggtgaattgcgaatttcgaatttcgttgtttagatgttaaatagttttgtttttttttttttttagaaggagaagttgcggtcgatgtagcggtagatgttttcgttgttgaattcgtttattttagatattagttttaaagggttttcggcgggggtttcggaattcggagagtttgagattcggggaggcgcggcggggaggcgcggcgggtcggcgggcgggcgggcggtggcggcggttgcggtataggggttagggtttcgcgttgttttttgggcgggttttttttttgaatcggagcggttttttcggttcgtttttgtttttttttttttttttttttttttttcgtttgtttttcgggggtcggtttagtttttaggtcgttttcgaagaatttgtgtttgaggttttcgaagtcgtcgttttagtcgcgtcggtcggtttttattttttttagtattacgcggtggaagaggcggatgcgtttttacgggtggttgtttagtcggtggaatatttcgtagtatagtaggtggcggaatttgcgattttcgcggtttaggtttattttcggtagttggaagtagtcgagtatgaagaggtcgagcgtgaggttttcgtagcgcgggggtgcgtcgtcgtttaggggcgataggaagtgttggggttagtatacgtcgtgcgttaggttcgggtttggcggtacgtgtcgtcgtaggtttcgttagtggtgtagtagtttgtttattgtttgtcgttgttttagtagttgtcgtagtcgttcgttggggttgtgggtttcgtt

SEQ ID NO: 26430 - DNA, 822 bp, Artificial Sequence
  chemically treated genomic DNA (Homo sapiens) CpG-island No: 26430
aacgaaacccacaaccccaacgaacgactacgacaactactaaaacaacgacaaacaataaacaaactactacaccactaacgaaacctacgacgacacgtaccgccaaacccgaacctaacgcacgacgtatactaaccccaacacttcctatcgcccctaaacgacgacgcacccccgcgctacgaaaacctcacgctcgacctcttcatactcgactacttccaactaccgaaaataaacctaaaccgcgaaaatcgcaaattccgccacctactatactacgaaatattccaccgactaaacaaccacccgtaaaaacgcatccgcctcttccaccgcgtaatactaaaaaaaataaaaaccgaccgacgcgactaaaacgacgacttcgaaaacctcaaacacaaattcttcgaaaacgacctaaaaactaaaccgacccccgaaaaacaaacgaaaaaaaaaaaaaaaaaaaaaaaaaaacaaaaacgaaccgaaaaaaccgctccgattcaaaaaaaaaacccgcccaaaaaacaacgcgaaaccctaacccctataccgcaaccgccgccaccgcccgcccgcccgccgacccgccgcgcctccccgccgcgcctccccgaatctcaaactctccgaattccgaaacccccgccgaaaaccctttaaaactaatatctaaaataaacgaattcaacaacgaaaacatctaccgctacatcgaccgcaacttctccttctaaaaaaaaaaaaaaacaaaactatttaacatctaaacaacgaaattcgaaattcgcaattcaccctcgaacgtct

SEQ ID NO: 26431 - DNA, 822 bp, Artificial Sequence
  chemically treated genomic DNA (Homo sapiens) CpG-island No: 26431
ggcgaggtttatagttttaacgaacggttgcggtagttgttgaggtagcggtaggtagtgggtaagttgttgtattattggcggagtttgcggcggtacgtgtcgttaagttcgggtttggcgtacggcgtgtattggttttagtattttttgtcgtttttagacggcggcgtattttcgcgttacgaaagttttacgttcgatttttttatgttcggttatttttagttatcggagatgggtttgagtcgcgaggatcgtaagtttcgttatttattgtgttacgagatgttttatcggttggatagttattcgtgggagcgtattcgttttttttatcgcgtggtgttggaggaggtggaggtcggtcggcgcggttggagcgacggtttcgaggattttaggtataggtttttcggaaacggtttggaggttgggtcggttttcgaagaataggcgaagaaaaaggaagagaaggggaaagaataggagcggatcgaagaggtcgtttcggtttagaagggggattcgtttaaggggtagcgcgaggttttggtttttgtgtcgtagtcgtcgttatcgttcgttcgttcgtcggttcgtcgcgttttttcgtcgcgttttttcggattttagatttttcgggtttcgaagttttcgtcgaagattttttggaattagtgtttgagatgggcgaatttagtaacgaggatatttgtcgttatatcgatcgtagtttttttttttggaaggagaaggaggtagagttgtttgatatttgagtagcggaattcggaattcgtagtttattttcgagcgttt

SEQ ID NO: 26432 - DNA, 822 bp, Artificial Sequence
  chemically treated genomic DNA (Homo sapiens) CpG-island No: 26432
aaacgctcgaaaataaactacgaattccgaattccgctactcaaatatcaaacaactctacctccttctccttccaaaaaaaaaaactacgatcgatataacgacaaatatcctcgttactaaattcgcccatctcaaacactaattccaaaaaatcttcgacgaaaacttcgaaacccgaaaaatctaaaatccgaaaaaacgcgacgaaaaaacgcgacgaaccgacgaacgaacgaacgataacgacgactacgacacaaaaaccaaaacctcgcgctaccccttaaacgaatcccccttctaaaccgaaacgacctcttcgatccgctcctattctttccccttctcttcctttttcttcgcctattcttcgaaaaccgacccaacctccaaaccgtttccgaaaaacctatacctaaaatcctcgaaaccgtcgctccaaccgcgccgaccgacctccacctcctccaacaccacgcgataaaaaaaacgaatacgctcccacgaataactatccaaccgataaaacatctcgtaacacaataaataacgaaacttacgatcctcgcgactcaaacccatctccgataactaaaaataaccgaacataaaaaaatcgaacgtaaaactttcgtaacgcgaaaatacgccgccgtctaaaaacgacaaaaaatactaaaaccaatacacgccgtacgccaaacccgaacttaacgacacgtaccgccgcaaactccgccaataatacaacaacttacccactacctaccgctacctcaacaactaccgcaaccgttcgttaaaactataaacctcgcc

SEQ ID NO: 26433 - DNA, 839 bp, Artificial Sequence
  chemically treated genomic DNA (Homo sapiens) CpG-island No: 26433
gcgttcgtggtttttagtttcggttagtacgggcggtcgttacgttagggagtagtttgtttaggcgcgtttggttcgcggaaggttcggttcgaggaaggtttagaggcgttagtgttttaggaagaggtaaacgatgcgttttttgcgtaggtcgaggtagttttggacgtcgcgtagtttcgtgtagaggggcggtcggcgcgttagttgttcgggtttaagtagcgtcgtttggtaattttgtgttttaggcgggtttagggtgtttaggggtttttagtcggttagcgggtcgtgggcggcggcggcgttgggttggttagagtcggtcgttacgtagtttttttataggatgggttcgcggatcggggcgttagcggattgcgggggtttgcggcgcggatagcgcgggggcgtcgcgtttagtgcgcgtagttcgtaggtggcgcggtgatgttgtacggagacgtcgtattcgaggatttcgcgcgttatagtttcgcggtattagttgagttagtgcgagcggtttaggtaaagcggtttcggtagttagggcgttttaggtagcggcgttagcggttggttcgtgttagcggtcggtagtttcgttaggtgcgtaggtcggtcgtttagcgcggttagtagcgtggttatgtttttgagtagcgtggagattttgttgtattaggcgggtaggttggcggcgcggttatgtattcggcgcgggtcgacggtgaagcgcggttttatagggcgacggagatgggtagtagttgtttagttttagttgttttaggcgcgtttttagtttttgcgttttgtgtagtatttgt

SEQ ID NO: 26434 - DNA, 839 bp, Artificial Sequence
  chemically treated genomic DNA (Homo sapiens) CpG-island No: 26434
acaaatactacacaaaacgcaaaaactaaaaacgcgcctaaaacaactaaaactaaacaactactacccatctccgtcgccctataaaaccgcgcttcaccgtcgacccgcgccgaatacataaccgcgccgccaacctacccgcctaatacaacaaaatctccacgctactcaaaaacataaccacgctactaaccgcgctaaacgaccgacctacgcacctaacgaaactaccgaccgctaacacgaaccaaccgctaacgccgctacctaaaacgccctaactaccgaaaccgctttacctaaaccgctcgcactaactcaactaataccgcgaaactataacgcgcgaaatcctcgaatacgacgtctccgtacaacatcaccgcgccacctacgaactacgcgcactaaacgcgacgcccccgcgctatccgcgccgcaaacccccgcaatccgctaacgccccgatccgcgaacccatcctataaaaaaactacgtaacgaccgactctaaccaacccaacgccgccgccgcccacgacccgctaaccgactaaaaacccctaaacaccctaaacccgcctaaaacacaaaattaccaaacgacgctacttaaacccgaacaactaacgcgccgaccgcccctctacacgaaactacgcgacgtccaaaactacctcgacctacgcaaaaaacgcatcgtttacctcttcctaaaacactaacgcctctaaaccttcctcgaaccgaaccttccgcgaaccaaacgcgcctaaacaaactactccctaacgtaacgaccgcccgtactaaccgaaactaaaaaccacgaacgc

SEQ ID NO: 26435 - DNA, 839 bp, Artificial Sequence
  chemically treated genomic DNA (Homo sapiens) CpG-island No: 26435
gtaggtgttgtataaggcgtagaagttggaggcgcgtttggagtaattggagttgagtagttgttgtttattttcgtcgttttgtggagtcgcgttttatcgtcgattcgcgtcgaatgtatggtcgcgtcgttagtttgttcgtttggtgtagtaagatttttacgttgtttaagagtatggttacgttgttagtcgcgttgggcggtcggtttgcgtatttggcggagttgtcgatcgttgatacgggttagtcgttggcgtcgttgtttgaggcgttttgattgtcggggtcgttttgtttgggtcgttcgtattggtttaattggtgtcgcgaggttgtggcgcgcgagattttcgagtgcggcgttttcgtgtagtattatcgcgttatttacgagttgcgcgtattggacgcggcgttttcgcgttgttcgcgtcgtaagttttcgtagttcgttggcgtttcggttcgcgagtttattttgtaggaggattacgtggcggtcggttttggttagtttagcgtcgtcgtcgtttacggttcgttggtcgattgggagtttttggatattttgggttcgtttgaggtataggattgttaggcggcgttatttgagttcgagtagttggcgcgtcggtcgtttttttgtacggaattgcgcggcgtttaggattatttcgatttgcgtaaggagcgtatcgtttatttttttttggagtattggcgtttttgggtttttttcggatcgggtttttcgcggattaggcgcgtttaggtagattgttttttggcgtgacggtcgttcgtgttggtcggagttggaggttacggacgt

SEQ ID NO: 26436 - DNA, 839 bp, Artificial Sequence
  chemically treated genomic DNA (Homo sapiens) CpG-island No: 26436
acgtccgtaacctccaactccgaccaacacgaacgaccgtcacgccaaaaaacaatctacctaaacgcgcctaatccgcgaaaaacccgatccgaaaaaaacccaaaaacgccaatactccaaaaaaaaataaacgatacgctccttacgcaaatcgaaataatcctaaacgccgcgcaattccgtacaaaaaaacgaccgacgcgccaactactcgaactcaaataacgccgcctaacaatcctatacctcaaacgaacccaaaatatccaaaaactcccaatcgaccaacgaaccgtaaacgacgacgacgctaaactaaccaaaaccgaccgccacgtaatcctcctacaaaataaactcgcgaaccgaaacgccaacgaactacgaaaacttacgacgcgaacaacgcgaaaacgccgcgtccaatacgcgcaactcgtaaataacgcgataatactacacgaaaacgccgcactcgaaaatctcgcgcgccacaacctcgcgacaccaattaaaccaatacgaacgacccaaacaaaacgaccccgacaatcaaaacgcctcaaacaacgacgccaacgactaacccgtatcaacgatcgacaactccgccaaatacgcaaaccgaccgcccaacgcgactaacaacgtaaccatactcttaaacaacgtaaaaatcttactacaccaaacgaacaaactaacgacgcgaccatacattcgacgcgaatcgacgataaaacgcgactccacaaaacgacgaaaataaacaacaactactcaactccaattactccaaacgcgcctccaacttctacgccttatacaacacctac

SEQ ID NO: 26437 - DNA, 550 bp, Artificial Sequence
  chemically treated genomic DNA (Homo sapiens) CpG-island No: 26437
atcgtcgcggaaaatttgggatgttagcgagcggtcgtatttcggcgtttgcgtattgtgttcgcgtttttaggtagcgtcgttgcgcgcggagttatcgatcggtcgatttcgagaggttcggtttttttaggtcgtttgttcgtttttagttttcggggtcggttttaggaggcgtttttaggagaggggcgggcgttttattttagagatcgagtggtagggcggttattgtggcggggtttttttttcgtttcgttttagttattttttagtttcggtagtcgttagttcggggtcgtcgtcgtttggggcgggagttgttcggtttcgtcgtcgttttcgtcgtcgttttcgggtttaggtttttcgggtcgtttgtcgtcgttatgaggttgcgggtgcggtttttgaagcggatttggtcgttggaggtgttcgagacggagtcgacgttggggtatttgcgttcgtatttgaggtagtttttgttgtgtatttgggggtataggtacgttggggtcggggttgggcggttcgcggggagtgg

SEQ ID NO: 26438 - DNA, 550 bp, Artificial Sequence
  chemically treated genomic DNA (Homo sapiens) CpG-island No: 26438
ccactccccgcgaaccgcccaaccccgaccccaacgtacctatacccccaaatacacaacaaaaactacctcaaatacgaacgcaaataccccaacgtcgactccgtctcgaacacctccaacgaccaaatccgcttcaaaaaccgcacccgcaacctcataacgacgacaaacgacccgaaaaacctaaacccgaaaacgacgacgaaaacgacgacgaaaccgaacaactcccgccccaaacgacgacgaccccgaactaacgactaccgaaactaaaaaataactaaaacgaaacgaaaaaaaaaccccgccacaataaccgccctaccactcgatctctaaaataaaacgcccgcccctctcctaaaaacgcctcctaaaaccgaccccgaaaactaaaaacgaacaaacgacctaaaaaaaccgaacctctcgaaatcgaccgatcgataactccgcgcgcaacgacgctacctaaaaacgcgaacacaatacgcaaacgccgaaatacgaccgctcgctaacatcccaaattttccgcgacgat

SEQ ID NO: 26439 - DNA, 550 bp, Artificial Sequence
  chemically treated genomic DNA (Homo sapiens) CpG-island No: 26439
ttatttttcgcgggtcgtttagtttcggttttagcgtatttgtatttttaggtgtatagtagggattgttttaggtgcgagcgtaaatgttttagcgtcggtttcgtttcgggtatttttagcggttaggttcgttttagaagtcgtattcgtagttttatgacggcggtaggcggttcgaggggtttggattcggaagcggcgacggggacggcggcggggtcgagtagttttcgttttaaacggcgacgatttcggattggcgattatcggagttgaggggtagttgaggcgaaacggggaaagagtttcgttatagtggtcgttttgttattcggtttttggaatagagcgttcgttttttttttgagggcgttttttggagtcgatttcgagagttggaggcgggtaggcggtttaaaggaatcgggtttttcggggtcggtcgatcgatgatttcgcgcgtaacggcgttgtttgagagcgcgggtatagtgcgtaggcgtcgagatgcggtcgttcgttggtattttagatttttcgcggcggt

SEQ ID NO: 26440 - DNA, 550 bp, Artificial Sequence
  chemically treated genomic DNA (Homo sapiens) CpG-island No: 26440
accgccgcgaaaaatctaaaataccaacgaacgaccgcatctcgacgcctacgcactatacccgcgctctcaaacaacgccgttacgcgcgaaatcatcgatcgaccgaccccgaaaaacccgattcctttaaaccgcctacccgcctccaactctcgaaatcgactccaaaaaacgccctcaaaaaaaaaacgaacgctctattccaaaaaccgaataacaaaacgaccactataacgaaactctttccccgtttcgcctcaactacccctcaactccgataatcgccaatccgaaatcgtcgccgtttaaaacgaaaactactcgaccccgccgccgtccccgtcgccgcttccgaatccaaacccctcgaaccgcctaccgccgtcataaaactacgaatacgacttctaaaacgaacctaaccgctaaaaatacccgaaacgaaaccgacgctaaaacatttacgctcgcacctaaaacaatccctactatacacctaaaaatacaaatacgctaaaaccgaaactaaacgacccgcgaaaaataa

SEQ ID NO: 26441 - DNA, 557 bp, Artificial Sequence
  chemically treated genomic DNA (Homo sapiens) CpG-island No: 26441
ttggtcggcgcgtggttgttattgtacggttcgcgtcgggtttttcgggaggcggggagagtgcgaatagggcggagggaaaggagtacgtcggttgtagttcgggcgagcgggagggcgcgtatttatttttatatatcgcggttaaggagagttagagtagtaggagcgtttgtacgtagagtcgtagatttatgttgttttttgggtcgtcgcggtttcggcgagtcggcgcgggggaggagaggtcgggcgttcggaggttaagaaaggcgcgagtcgcggttggcgcgtgcgggcgtagagttcgggaggtttttcggtcgttgagtgtgcgcgttgagtttcgtcgttttcgttggtcgttttcgtttttttgtagttttttttttcgtcgcggggtagcgtcgcgaagttggtttcggcggtttcgggagcggtagcggcgagtttttttttagcggttggttgttcggtcgcggttgtaattgttcgtgatttcggttgttagagagaatgtttttcgtttattttaggggttgtattttgtagtttgt

SEQ ID NO: 26442 - DNA, 557 bp, Artificial Sequence
  chemically treated genomic DNA (Homo sapiens) CpG-island No: 26442
acaaactacaaaatacaacccctaaaataaacgaaaaacattctctctaacaaccgaaatcacgaacaattacaaccgcgaccgaacaaccaaccgctaaaaaaaaactcgccgctaccgctcccgaaaccgccgaaaccaacttcgcgacgctaccccgcgacgaaaaaaaaaactacaaaaaaacgaaaacgaccaacgaaaacgacgaaactcaacgcgcacactcaacgaccgaaaaacctcccgaactctacgcccgcacgcgccaaccgcgactcgcgcctttcttaacctccgaacgcccgacctctcctcccccgcgccgactcgccgaaaccgcgacgacccaaaaaacaacataaatctacgactctacgtacaaacgctcctactactctaactctccttaaccgcgatatataaaaataaatacgcgccctcccgctcgcccgaactacaaccgacgtactcctttccctccgccctattcgcactctccccgcctcccgaaaaacccgacgcgaaccgtacaataacaaccacgcgccgaccaa

SEQ ID NO: 26443 - DNA, 557 bp, Artificial Sequence
  chemically treated genomic DNA (Homo sapiens) CpG-island No: 26443
ataagttataaaatgtagtttttggagtgagcggggagtattttttttggtagtcggggttacgggtagttgtagtcgcggtcgagtagttagtcgttaagaaagagttcgtcgttgtcgttttcggagtcgtcgaggttagtttcgcggcgttgtttcgcggcgggagaggaggttgtagaagagcggaggcggttagcgggagcggcggggtttagcgcgtatatttagcggtcggggagtttttcgagttttgcgttcgtacgcgttagtcgcggttcgcgttttttttggttttcgggcgttcgattttttttttttcgcgtcggttcgtcggggtcgcggcggtttaaggagtagtatgaatttgcggttttgcgtgtaggcgtttttgttgttttggttttttttgatcgcggtgtgtggaggtgagtgcgcgttttttcgttcgttcgggttgtagtcggcgtgttttttttttttcgttttattcgtatttttttcgtttttcggggagttcggcgcgagtcgtgtagtagtagttacgcgtcggttag
